United States Patent 12,144,834 (METHODS AND COMPOSITIONS FOR TREATING GASTROINTESTINAL AND INFLAMMATORY DISORDERS) - sequence listing, part 2

SEQ ID NO: 12 - DNA, 154723 bp, Roseburia hominis
gatcaaactctcatgttatagtttgtttccttttccagaataatctggcttattcagatgttactctgaatttactgttttaggttgttctttataagaacgttcgtctgtctttcaatctcttgatcgacagcttgaaatttaggatctttcaaggtttattcactgttcagttatcaatgtacatcgtcaatacttcgtattgactttagaagttgcttcgcaacttccgaacggatttttcaatctcattcatcgttgtcatctctcggcgacagcttatttactataccacgccgccaaccgtttgtcaacaacttttttattttcttttgcttcttttcagaagccctttgcctgtccgctgttctcgcggtcagcttgtatatactaccatctgcatctcagattgtcaacactctttttacagtttttttaaaaagttttcacggattttcccctcactgtcggcagcccttgtaattcatgccttttagcgtgcaaaacccgttcccagagacagaagaatattgttttcatacagttctttcagaaacgcactctgattaatataagaaacaatcactctccccgtctctcccgtactgcaaagggcaacaatgtaaaacgcaatccagacgatgagaagcccctccatcagccccgctaacattcccgtgaaacggttcacgccttttaatatcggaatatgcgatacaattccaagcagcgccgaaatcacatgcaccagaatccatgagagaatcagcaccgtcacaaacgcaattccctgcacgataaatcctgccaggctctgcgcgatccctgcatataccccggtctccgcaagcacagtgtccgctgcgccggaagcccccgaaacgatctgcgccatcacagattccggaagatccagccccagttccccggcttctccgtactgttccactgcgccttcttccatctttccctgcgccgcacgccgcacagattcctcacacgcagcttctattttttcgtaaatagttgtattctcctgtatccactggctgacatgcggcgttgcccacgagacaaacaccagcacaatcacccatgcgacaagtgaaaaaacaatccttaaaaatccttttgtgtagccgtagattgcacagcacaccaacaccaggaggacaagcatcaatacccagttcataatctcctccttattttaatctgatccgctgtgtcgtatctttgagcacaagcgtgtagttcaattttaattttcccggtataatctcaaaaagttcttcttcaaactcatggtggaacttataaacaccgtgcaccgtatagatgtcgcagacatttgcgttccggatacagatctcattattggtcaaaaattcgatactgctgtagtccagaccgaaatccttttccatgaccagttttccgttttcatcatacaccgccagatgatttgtcaccgcctcatcctcattgccggtcacgattccgatatagtgctcattgtaaaaaatactttttgtcttctcatccatcgggatctccgcgattgcctgcggcttctgcgcaccctcaaagatcactgctttcgtatcgccgaacgcaaccatccggtcgttggaggtaaactccatctccgggatgaccatatcatcgtaattgttcactcccacacagtgatcgatttcgttctgaccaaccgtgccataattgtaaaacgcaattgtgctcttgacgcttccttcattgatattgatcatggataccgccagctttaccgcatcattggaaagcgcaatggcgatcgggtatcccccgttctggccgtggatctccccttccgccaggctgttgccctctctgtcatacagcgcaaggtacgccgccttgtcttttttcatcagaaccgcaaccgtcccctgctctgccacgcatacctgctgaatctgcatggttgtctcaatgcttcccacaagctttgtcggtgttaaaatataaatttttgtcccgcccttgtcgtagatgctcagataatttccgcaggtatccagcttcggcgacgacatctcatacgtctggttccagatcagttcattcgcggcatccagataaaatgctccgtcattgctgtattttaaaatatttccctgaaattccgtaaaatgtgtcgcatccgtatccgaccgctccgcggttgacataatgtcatagttctcataatggcggagcgccatgtagagtcccagaccggtcagcaccagaagaatgaccgccgtcacaatcacgatgcggcgcaggacctttctgcgatgttcctttattttacggttatattcctccatatcggtatcccctaccgtatgaaatccgcttttgtttttttctgccatacttcctcgttcctatgttgtctatgctttcactgattatgaatattatagcatgtgtgtattcccgtttcactatttttttaattcggcagaatcagacgctgaccggcgtagatggcattttcatcctcaatgccgttgacctcgcagagcttgtccagcattgccgttgtctgatatattttccggcagattcccacaaggctgtctcccttctgcacatcataatatccctgcgacagatacatctgcgcctcggtctgcactgctgccgcctgcacattctccgccgatgagtttccggcagctgtcgtcgtgccctgggtctgtaccgccgccgggtccccgtccgtggatggcgtgctctgcgtctgcgcctccaccgacgtgcccgctgcgtctgcgcatgcctgtccaccggctgccgccgtatcccccgcagtttccgatcccgctgcagttcctgctgctgcatttgccgttgcattttccgctggctctgctgtcccctgtgccccctgtgcctcctgcgccgtctccgcctgctgcgccgcagaatcttcctgcgttcccgccgcttccgcagacagttcctgtttttcgacattccccatcaccgtctctaccgccacagacggcatccgctccgtctcttccgtctccgtgtccgccgtctgcgcttctgtcacataccgggttcccttcatctgcgcaagcgtctgttccatatccaccatcttttcatgattcagatatgcggtcacaccaagcacacacacaaccgcccccagcagaactgtggctgcatacgcgggtctttcctgcttttcctgccgaccggcatcctgctgtactctcctgcggtaaagaccacggtacacccctgtaccttcctcattttccggcattttcgccatgtccgccgccacttcccgctccccggcgcttactggcactgccggttttggcttctcttccccttccacatccatttcccggtaaaattccttttcctcttttttccagaggtcgttctcctctggcacctgcctgtgctggtaataaatgtaaaatccatctcttctgtacaggtgcccgttccggctgccgtagaccgcctcctcacattccaggctgtccatcagaaaaagaatctggcgctttccaccgaagttccgttgatgcagcgcctccaggtgcgccgtcatattggggagctgtcccttgatatccagcgcccatcctacaatcacgaacggatcatgctccggctttaactgcttatatatgtacgcccacgtgtgatcgtcccagaccggaatatcccggtcaaacaggatttcattcaacggaataaccgcttccacaaacgtgcactctctgcccatgcagttctcaaattttcccagcagcacatatgccgttttttcttccacgccgccatgcggatgcattctgcggtacacggtatcttccacataaatccgttcccctgcatccggcgacccgatctgtttgatttctcttggcagttccctctgtaccttctcttccgtctgttcctggtgaataatctctatcatgccacacgattcccctttccgcatccggctgcgcatccgcgcaatacacgcacatggattttacaaccttttctcggggaaatcgtaccacaagccctctgcatattttgaaatattatgggcttgtccgaaaaaatgtttcgacagccttccgtctcttctgccaaaatctttcccggcattacaaaagccgcagggaagctacaatccccgcggccttatctgcgtttttctctaattctgttttacaaacgcctttactttctcgtagatgctctgtgcatccagtccatacttttgaatcagttccagagccggaccggactctccgaacacatcgttgataccgatcttcatgactttcgtcggctgcttctcagaaaggatgtcgcatacggcacttcccagtccgccgatcacggaatgttcctcgatcgttaccacttttccggtcttcgctgcggacgcaagtaccagcttttcatccagcggcttgatcgtatggatgttgataatctccgcatcaataccgtctgctgccagaagcttctccgcctctctcgcctcgttcacacacaatcctgttgcaaataccgagacatcttttccctcttttaacacaattcccttgccgatctcaaaccggtaggtcgcctcgtcattaaataccggaaccgccagtcgtccaaaacgcaggtacaccggtcccacgtgatcatacgccgcatgcactgccgcacgcgcctccacatcgtccgccggattgagcacgaccattcccgggatcgcgcgcatcaaagccagatcctccaggcactgatgggtcgctccgtcctcacccacggagattcccgcatgggtcgctccgatcttcacattgaggtgcgggtaaccgatcgagttgcgcacctgctcgtaatttctgcccgccgcaaacatcgcaaaagaactgataaacggaacttttccgcaggttgcaagacctgccgcgattcctgtcatattcgcctctgcaataccgatgtcccagtggcgctccggaaatgccttcttaaaaatgccggtctttgtcgcacctgccagatccgcgtccagcacgatcagatcttcatgctcttttccaagttctaccagcgcgttgccgtaactctctctggttgcaatcttctttcctaattctgacataatgctgcacctgccttttccagatcttccattgcgatcttatattcatcatcattcggtgcttttccgtgccagtcaacggcattctccatgaatgaaacaccttttccctttaatgtctttgcgataatcgccgtcggcattcccttggtcgcccgcgcctccgcaaaagccgcacggatctcgtcaaaatcatttccgttgatgttgatcgtatggaaattgaacgcctcaaacttcttgtcgatcgggtacggagaacataccgcgtcaatggaaccgtcaatctgaaggttgttgttatccacgatcaccaccagattatccagtttcttaaatcctgcccacatggcagcctcccagatctgtccctcctggatctctccgtcaccgcaaagtgcatatacacgatagtctttcttgtcgaactttcctgctgcagccattcccactgccaccgagagtccctgtcccaaagaaccgctcgacatatccacgcccggaatatgcttcatatccggatgtccctgcagataggatcctgtgtggcgcagcgtcaccagatcctccttagggaaaaatccacgctctgcaagcgcagcgtaaagtccgggtgccgtgtgtcctttggacaacacaaaccggtcacgatccgccatcttcggattcttcggatcaatgttcagctcctcaaagtacagatatgtgaaaatatctgccgccgagagcgatccgcccgggtgtcccgcttttgcactgtgcaccgctgttacaatgcttttgcgaatttcatttgctgtcttttgaagttccagattcgtcatgtcgtgtcatggtcctttcttatatctgattgtcatccgcccggtccagatgccggacagttgcatccttttctcatgcggtcactacagttccgtgcgcccctcaagcgcgcgcagaagcgtcacctcatcaatatattccagatcgccgcccaccggcaccccgctcgcaatccgcgtaacttttataccggtcggtttgatcagtttgctgatatacattgccgtcgtctccccctccaggctggaattcgtcgcaatgatgacctcatccacatccttttgcaggcgctgcatcagttctttgagtttgatgtcccccggtccgattccgagcatgggtgagatcgcgccgtgcagcacatgatataccccgtcatacttctgtgtcttctcgtatgccgcgagatccctcgtgttctccaccaccataattaccttatggttcctggaactgtcgctgcagatcggacagatttcctcatctgtcagcgtaaaacattccttgcaataccgcacattctgctttgcgtccaaaatcgcagaagaaagctcctccacctgctcctttggcatattcaggatatgaaatgccagacgctgtgcagacttcgtgccgattcccggcagggcggataattcctgtattaacttgctgatctgtctgctatagtattccattctctccctcaaacttcctgtcaacactgccgggctttccctgcagccttatatatattacttgataacgccgcattttacaaggcggttttgatttttcttcctctggtatgctatactggatttattcacagattgtatgaaaagaaacggagattaccatgaaagaaacgattgcaaccatccctttgatgaatgccttccacgcagacgacgaatgccctttctgctacctggaacgcgaggccgagcagcatgccatctccttcatcctcggctctgcctatatggaggatgatatccgtgccaaaacagacgccaccggtttctgccgccaccacttcaagatgatgtacgactacggcaaccggctcggcaacgccctgatcttaagcacacacttaaaaaagctgaaccaggagctcggcgatgagctggcacattttacgcccggcaaatccagctttatcaaacgcatgaagcacacggatgtctcatccgggaatgcgcccaaaacgcctctcggcgcatggatcgccgctaagaccaccgactgctatgtctgcgaccatttccatcagatctacggccgttatctggatacttttttcgacctgtataagaaaaatgaggaattccgcgcactttttgaaaaaagcagaggattctgcctgccgcactttggtgatctgatcgagacagccgaggacaaactgaccgatgacgagaaaaaagagttttatcccaaagctttttcgttgatgcaggagaatctcgaccggctccagaaggaagtgtcctggtttgtggaaaaaaacgactaccgcaacaaggacaaggactggggtacctccgccgacagcatccagcgcggcatgcagaagtgcgccggcggctatcccgccgacgaggtattcaaggcaaagctctgattgccatgtgcccccacgcaggttgctcttgtttcatggcactgccgcatcagatagacattgccgtctgctgataagcaatgtgatgagaagatcacgacttttgctttcaggcagaatgcatatggaaattctgttcaaaaaatgtggcatttctaactagccgttttttgcatctgcgatgatccgtgtctttccaagttttgagcaatcctagagtcatgtccgcccattgtctccggtgtgtcggacatgcacccgtcggatggtcaaaacgtggcaagagacacggaatcagatgcaaaaatcggcaggaagaaatgctcccatttttctccaacgaatgttccatatgccttcctgcctgaaatctgaatttcgttcctcgtaatattgcttatcagcagacggtatttacccgctaaagctgcagtgccataaaacaaaactgcacccgtacagcgcgatcgccacacaggtgcagttataaattctattagaatggcattccgccaagtccgcccatgccgccggtaatctttgccatggaactctgggaaaattcgtctaactgacggtaggcctcgtttgtcgccgccatgatcagatcctccagcatctcgatgtcatccggatccacaacctccggggaaagctttactttcgttatctcatgcttgccggataccgtcacttccacggcaccgccgcccgctgccgcggtcacttccttctcttctaactccttctgggcctcttccatctggcgctgcatcttctgcgcctgcttcataaggttattcatattacccggcataccgcccgggaatccacctctttttgccatgtctgcttcctcctgcttttctcttaggactgttccatctatcataatataaattgtgtgattcgtccagctttaaaaatcctcttcctcgatgtccatctggatgagcgcgcccagatccggatagacctcgtcactggcatgccccgtgtcgtttaacttcaccagaatcgcaacctctttgccaatccgatccgccgctgccgcttttaatgcgtcctggcaatccgaacggttctgctcgacgtactcgtaagcgtttttgtcatcgaacaccagcatcaattccccgttcggtccgagcgaccgggtcgccatcttaagatacgtctttgtcacgccggtaagctgcgataagatgccgccccagtttgtcagcacctgcttcacatcctccggaatcgccttgggcagttctgccttgggcagcgagcctccctgtgccccctgcgcgcttccacctacgccctgcctggcactccccggtgccgccatcacaacgcctttttccagtttcttctccaggctgtcgatgcggtccaccagggacgtgtaatctttttccatttccggtttacataacttaattatcgcaatttcaatcagaatccgcttctggctggcatatttgatctggccgccaagctccgagaaaatgcggatatagcgcatcagaatatcggcgtccaccatagacgcctcttccttcaggagcgccagattttccgaagagatgtcaagcacatcctccatatcgtccgagctttgcaccagcatcagattgcgcagataccatgtgaaatccgtgacaaactgccctaactcccgtccttcgatcacgagcgtctccacggtctggattgcccccgtgatatttttatcgaggatctgtctgagcaggcggctgaaaatctctgtgtcgactgctccgagcgtatccagcactttgtcgtaagtgagctcctgtcccaggtaaaaagcgatacactgatccagaaggcttaacgcgtcacgcatcgagccgtctcccgccttggcgatatagcgcagcgccctgtcctccaccgtcacctgctccgcatccatcagttcccgcaggcgggcagtgatcgtgtcgatcgagattctgcggaaatcatagcgctggcaccgtgatagaatcgtgatcggaatcttgtgcgcctcggtggtcgccagaataaaaatgacatacgccggcggttcctctaaggtcttaagcagtgcattgaacgctcctattgaaagcatatgcacctcatcgataatgtagactttgtattttccttcggtcggacggtactccacctcctcgcggatctggcggatgttgtcgacgccgttgttggaagccgcatcgatctcaatcacgttcatggaattgcccgccgcaatcgccctgcatgtcggacattccccgcacggactcccgtccaccggatgctcacagttgaccgccttcgcaaaaatcttggcaatcgtcgtctttcccgttcctctggttccgcaaaatagataagcatgtccgattctgtctgctttaatctgattctttaacgttgttacaatatgatcctgtccttttacatcgtcaaactcctgcggacggaacttacgatataatgcctgatatgacatgcttttccctcaccttaatctccaaagctgattccaatccgctttgcttcttttatcatctggtcgttcggatcgaccgtttttaatttgcccgccacgtctccgagcggtacatatttgatcttgccattgaccatggcaaccatgttgccgtagttctcgtccatgatcgcttttgccgccgccgaaccgagtctcgtgcagagcacacggtcatacggacatgggcttccgccgcgctgtgtgtgacccggtacagtcacgcgcacctcgacgccggtctccttgaatatacggtctgcaatctcgtaggaaacagacggatatttccgctttgccactttttccttgtactctttcttggagagcgccgcatcctccttggagatggctccctcggcaaccgcaagtatggtaaatccttttcctgccttcgtgcgcttgttgatcgcggcaatcactttctcgatgtcgtacggtatttccggaagcagaataatatccgcgccccccgcaacgccagcataaagcgtcagccagccgactttatgccccatgacctcaacaataaagacgcggttgtgggacgctgccgtcgtgtggatacagtcaatgcaatctgtggcgatattgatggcactctgaaatccgaatgtgacatccgtcccgtaaatatcgttgtcgatcgtcttcggcagatggataatatttaacccctcttcccgaagcaggttcgccgtcttctgtgttccgtttcctccgaggatcaccagacagtccaggttgagcttgtggtaggtcgccttcatcgcctccaccttgtccagtccgtttgcatccggcacacgcatctgcttaaacggctgtcgcgatgatccgagaatcgtgccgcctttcgtcagaataccggagaaatccgcggatgtcagcagccggtagtccccgtaaatcagacctttatagccattcaaaaaaccatatacttccaattcatccacgttctcgctgagtcctttaacaacaccgcgcatggcagcattcaatgcctggcagtctccgccactcgtcaacataccgattctcttcatctgcttctcctcctgtttccgtcttttcgtaccatcagttcatggtctgtgggtccgcatccggaccgcagtttttctatatagaatattaccctcttcgacgccattttgcaactgtgtttcacagcaccagcgcgccgcagcgcctaatagcgcacggaaaatgcccgctcctcttcgtttaattcgagtttctgccggctcactctgtccagataaatataggaatcctccctaaggcgcgcaatgatctcgtcgatcgcctcccgtctcccctgcagttctgccgagacgcttccatcgtactcatttctgacccatcccgtcacatcgtagtgtcttgcaagctgtgacatccggtagcggaatccaacgccctgcacgcttccctcaaaccggattgcttcccgtgtcttattttccataccttaccctcctgttatgctataaaaatagtatctcccgaaaaaacttatttcaagacttttcgcgaaagcatcttgcaaaatcaaccagatatgatatactaatcgagtgtctcacagtagaatcctctgtgagccattcattcggagacgtatcgaagcggtcataacggggcgcactcgaaatgcgttagccctccggggcacgcgggttcgaatcccgccgtctccgctgtcacaaaacccggcagaatcataaattgattctgccgggtttttctatgcctttcttttttcctaaaaacaaagtgtgcgcttgccgcacacttgcgcccgagcggtatgcaaagcattatgtacctcaccgcgagctgcacatccccgcggaacgtttttgtgtaattaggaacgaagtttcctattacataaaaaagagaaaccgcaatatacggtctctctctttcttaagccaccagacggatcgctccgcctgccgtgcccctgcccaggaatcggagtaacaggatttgaacctgcgacctcacggcccccagccgtgcgcgctaccaaactacgccatactccgtttcagatgaatggattcattatatcatattttttgtaatttttgaagcccttttttaaccgcgtcaccacacgcccgcattccggtctgcccggatctgatccgcaaccatctgcgcaatcagcgcatatccttcctcggtcgggtgaattccatccacgaaatattccgggtgatcctgcgtcagcgcgtagagatccagcgttccgcagcccgattgctccgcgatgtccggcacaaggttccggatctctcctccgatcacatcattgttaatcccgtataggatctctccctcctccgcaggaaatgcttccggcggtgccatcagatacagatacggatgtcccggcagattgtgaagttcgtcaatcaatgcaagatactgttcctcatacctctctgcatcccagtatttctgcttggaatcgttggttcccagcataataatcaccacatccggggactgcgcctctatcacgttcagataccccatgttgcggtagcttttccgggaaagatcctgcagggttgctcctctcacgccgtaattgaaaatgaggtatcgcgggccaagccggattcctagctgcgccggatacgacttcgtcagccgttcctcatcctccagaccgctgccgtatgtgatactgtccccaatacagtatatgatctctgttttttcgtattccttttcccggatgttttgtgcgtctgtcaaaacaactgctgccgtcaggaaaaatgtcagcaataccgcgcgcacatgcctgatccggcagtaaattttctcattcatactcttattccattccactttttctccactatcataccacctttacggcattttttacacataaaaagctctccggatgctcatactttttctgaagtatgaaaaagtgaggtaatcttatggcatcttatgtatctcccgagatccgcgaccggtttgataccctgtctgctgatctgaaaaatctgattctggaacggaatgtctgtctcaacaacatgtatgacctgattcatgttcttgaggatattgtcgcagaaggggaagccgaataacggcttccccttctgcatgccatccgcaaacttatcctgccggatgtctcttttcttccccggtcttcctctttgtctcaagaaaacgtcttttatatttaactgctgcataatcgctgatgcgcttctgataaaccatatcagaaactccaccgaccataccgaccaccggcagtccctgcacgaatttcagatacagcagttctcccgccagtgcatccgatgtgcgccggatctgctcgtttctggaaatggaaaacgtacgctcctcacgcatccacagattcagctccatattgttctgggcaagctgctcgccgtgcgacaatgccgtctcgatcagctttaatatgaagatctgctcctcctgcgtgtcatacgtgtatccgtagctgagtgcgacctcgtagatacttttcaacaaaacaccgaggaacagcggtatatccggcagacccagaccgaaaaatcccatgccgacaccttccaccgccgataccgccagattcaggttccggctggcacccgcctctctcccgaatgcccgcagggcatgtctcgtgtcgcgcacctctgcggcgtaagcattgatcttataattctgctcctttttctccttctgacaggtcttctctatcaccggcgttcccttgtcaaagatcagttcaaacgctttgtaaaaagcggtgtgcagagtcgcctccagcttctgtggcacatagcgcgtgatcttctcctgccagcccgccgtccgcgccggcatggcatggcgcagaaagcgctcctctgccttgacaactgctgcccattctttttcgaccggattctgtttctctctcatcgcccgcgcctccccttatgcttccagtgtacggttcatgatctccattttctcctccgcctcgtaaatgagccggctgcattcctttagttcctcggagaaattctccgtctccgtctgatacagacacttatatttgatgtcatgctccaggcttgcccacagatccatcgccagcgtgcggatctgcagttccaccggcaccagctgctttttgttcataaaatataccggcacccggatgaccatgtgaagactccggtaaccgttctccttcggcatctctatgtaatccttgatctgcataatcataacatcatcctgcgccatcagacggtcgcggatcagatagacgtccttgatataagagcagacaacacggattcccgcgatgtcgtagatgttgttgcaggcagccgacagcgtcagatccagatccttcttctggagcttgcccagaatactcttcgccgacttcaggcgggtgtcaatatggtggatcggacagcgcagcttccggtacttgaactcgtcctctattatctcaagccttgccgtcgttgcacacatcgccgcattgtacatgcgcaggatcggatcgatcgtctgtgaaaactgatccttcatatctgcgatccgttccatgctgtcatccatcgccgcacgcatcggcaccagatcccgcaccgcgatcacattctcctgtgcggtcacctcttcgatttctatttcctgctgcttcccctgttcctccaatttataaaaacctccattgtctgttttccatcatcaggtattattatatcagacattcatgaacccgccgttaaatccccataaaatatttattaaatcttctgcagcgccaaaaacggacggacttcccgccgggaagcccgtccgttttatgttacaattcgatgccgcagccctgcataagctcgcgggcgctgtcgagcgaatccacgccgtgcagattcttgatcggcgcaaactcccgctttctgtcgacctcgtaaggaacgcagtccgccatcatgtgtaccatatcgaggacaagtgtctcaaacttgtatccgttcggtgcatccggcttcaccaggctgccggattcgtccatatacggaatctttttctctaccacatggatcggcatatgtgcatccgcaatctcttccaggcgcttctcggaaaagacgtagtttaagatcacaccaaatccatagagcaggtcgccgtttgccttccgtgcagtcgccatctcttccgtcatctcgtaatactccgcgatcgacggcttgccgtcctcggtacagagcacccccactttctcatccggcgctgcctttctgacaaccttcgcgccgctctcacagccgtaggcaatcgttgcaccgatgaacagcgggtctgcaattctctgcaggcagttgtccacagcaaatacattgatccactcaatcccgtgggaacggatgtcggagagcagccctgcattcaccatggagccaaaccagccgccattgccgttcggggacatggcaaccctggtgcgggattccatatatacccggccctgataatcgcaggcgggttccatctcctgcacgaaaaacttcacatactccttcgggtagccaaagtacccgtgctcctcaaaaaatgcctgcgtgtcgtcatggttgatgttgcttgtcatgatataaagcggaacatacgcgccggcttcatccgtcacgtccatcaggttacgaatgagctgctgaaacaaaaacagctcccggcgaatcccgatattgagtgttcctttcggtctgtccagtccgagacgcgttccctgtcctcccgccagaagaaccgctccgacttttccttcccggatcgccttgatgccgagttcccggaactcgtccctgcgccgctcaatttcttccgtctcaaccgcctcaagcggtgcgaatacgccccgctcgttcacggtctccttgcgctcaatctgctctaacacagaccagtcgatcgcatccagctgtgccttcagcgcctcgttctccgcctctgaattcttctccatggcagcacggatatagcactgcctttcgtcttcccaaattttcataaaaacctttctccttttactatcaattaaacccgcggaatcccttgccgatgatctcactgctgttcgtgatagcaataaatgcggtcggctggtggatgcggatgtaattacgcagttctaccgcctgggagcgcttcataatggtgataatgatcgtcttctggttgtgctcatatgccccctcggctttatagatcgttgcactgcggtgcagctcattcgtgataaaatcacagattggctccggatcattgcagatgatcgtaaaatacttgcacaggttgatactttcaatgacattgtccacaacgagcgacttcgccagaagtccgcagagcgaacaaagtcccgtctgtgcatcaaacacaaaacacgaagctatgacaatccccagatccaccagaaacagcgcgcctccgatgttcagcttcgtatactttttaaggatcatggcgataatatccgtaccgcctccggatgctccgatattgaacatgatcgccgcactgaatgccggcagcacaatcgcatacatcagttccagtaccggttgcgtcgtcagcggatgctccatcggaaaccacacttccgcaaggcttagccccacagacatcagcacgctcacatacacggtgcggatgccaaagcttttcccgaggaaaataaatcctaccaccagcagcaccatattgatgataaatgtgatatttcccggagttgccggcataacggcacttaggaccaccgcgatacccgtgactcctccaaacgaaaaattattcgggaacttgaacacataaacgcccaccaccagaatcagcgtggcaaccgtcagaatcacatattcctccagcgtacgttttacttttcccatattcttgtacatttcttcaaaatcctcatcatctgaacgtatttctctgatattctaccgtatttcccgcaaaaatgaaactgtattatcaaaaaataagaaaatattaggaatcaattcccttgcggcgtcatacaacgcgcttttccagccacctgccacgccggtagcggatcacgaaaagcagcgtgcggaacgcccagtccacatacatgccgatccagacaccgagcacgccaagtcccatcgttccggcaaaaaagtaactgcttgccacgcggaaaacccacatggaaaaaacgctgacctccatcgtatactttgcatctcctgcggcgcgcagcacattcggaagggtaaaactgagcggccagatcagcgccgcgcagattgcgaaacttaccagaagctgtgtggcaatccgtgccgcttccgccgatagcgcgaagcaggcaatgattggttttacgagtgcaaacagtgccagatccgccagcaccattcccgcataagccagaccaagcagacgcttgctgtagtatttcgcctgttctttttccccggctccgatacatctgccgatgaccgtcacgatcgcaagtccgatcgcaatacccggaatattggcaaatcccgccacgctgttcgccaccgcattcgccgcgatcgccgccgtgccaaacgtcgcggtcagactcgacaccagaagctttccaatctggaacattccgttttccacaccgctcggaatgccgatctttaaaatttttccgatcacatcccgctgcggcttcatacagcccggcgtcgcaatacacagcgggttgtccttccgcgagagcagcacaaccatgacaatcgccgatacgatccgcgccgtgagcgttgcaagcgccgctcccagcacgcccatcttaagtccgaagatcagcaccgcattgccgccgatattgatcacattcatgaccaggcttgtatacatgctgaccttactgtttccgattgcccggaacagcgccgctcccgcgttgtaaacgcccagaaacgggtaggatatggcggagatgataaaataaatctccgcattctgcatgacgtccgcgtcaatctgcccgaaaattgcccgcagcaaaaagcggtaggacagcaggatgaccaccatcaccgtccccgcggacatcagcatgatgaacatcagctgtccggcagacaattttgcccgttccggcatcttcttgccgatatactggctgcataccacagcgccgccggttgcaagcgctgacaaaatctggatcagcagtgtgctgatgctgtccaccagcgacacgcccgacaccgccgcctcgccgcacgaggagaccatcagcgtgtcaaacagtccgatgctcaatgccagcgcctgctcaataatgagcggtacaatcagttttttcaaatcttctctggtaaaaagtaatgattccatttttccctcaaaaaaatgtggcacagcgtcacgccatgccacaaatgactgtcattctattgttctgtgcagtgtccggattatgccagtgcagccgtgatgattgccatggaatatacctcggaagcgttgcatccgcgggacagatcgttgatcggcgcatttaagccaagcaggatcggaccatatgcctcgaaattaccaagacgctgtgcaatcttgtaaccgatatttccggcgttgatatccgggaaaataaaggtgtttgcatgtcctgccacttcgttgcccgggcacttggtacgtgcaacacgcggggatactgctgcatcaaactgtaactcgccctcgatcggaagagacggatattttgcctttgcctttgctgctgcattgcgcatcttgtctacatcctcacccttgccggaacctaaggtagagtagcttaagaatgcaaccttcggatctacaccgaagatcttcgcacactctgcagactcacctgcgatctcaaccagctcatcctcggtcggatggatgttgattgcacagtcacccattgcaagaacctcgttctcaccggttgcagacggacgaaccagaatgaagcaggaagatacgatggagttgcccggcttggtcttaatcagctgtaatgcaggacgtacggtatctgcggtggagtaggttgctccgccgagaagtgcatctgcaacgcccatctttacaagcatggttccgaagtagttcgcctgggacagaatgccctttgcctgctccggtgtcacacctttgctctttctgagttcacagaacagatctaccatctcgtcaaatctgtcatagtttgccggatcaatgatctcagcgccacgaatattgaatccgctctcctcagcagccttaaaaatctcatccgggttaccaaccagaatcgggtgcaggaaggtacctgccaataatctggatgctgcctctaaaatacgcgggtcatttccctctgtaaaaacaattttctttggatctttcttcaagatatcgatcaactgaccaaatccgaacatagtatactctctcctttgacattgtgtttaatgtaagcgcttacttcccgtgttcatgcgggctgcgcccccgttatgcttttattatatagcgctttttacaaaaagcaatgcttgtacgaaaataaatgcatgatgggttgtgctttttgttagtcatctctaactcccagcatacaacaccgtcatgcatctgtcaatcaatgtactatttttccccagcgcctttgctaccttctgcatttttctctgtatccacatgcgccgcctgagctgtcccgctgctctgtgacgattttatcacgccaaaaagctttggcacgttctgatccttatccggcttggtcatcagcataaaacgccggaagaagaacaggataccgatgctgaccaccgagagcagatcctcgagcggcgtggtcgtctgcacaatcatgtgacgcgcgatcaggaaaatcagcacctcaataatattcgcggaactcggcttgcagagcatctttaaaaactcaattccgatgacaacgttaaacacggcatccagatactccagaaatgcccccgccgtcgtccggtgttcccagtagcgcgccagctccggcacaagtgtgatcatcgccaccagaatccccgccacgacagctgccgccatcagaagctctaagatctctccgccccggtaaagtatctttctcgccttatcccacatggtatctctccttctcccaaaaagtcatctgccagaattcatttagaaaacatttataaaacgcaaaatccgagcgcctcgcttcgaatccaaaaccataaacgttaccaccacagttagctcagcccaggcaccctcacggcacacaagaacttctgcttagggctgctccattcctgacctgacccggttcacagattcctgttgcgtaagacccagacgtcaacgccacttatggtgggcagctttacagcttacctgatcctctgttcggcatcaccccaactatagcggattgttggtacagggtaccgctaccaccccggctgctcggagacttaagtatatcctatctgacgcccgattgtcaagcattctgcgtgttttcacgcaagctctttttcttatcgcgcagttcccggaagaagccggagagcatcgtcgaacattcctcttccagcacgcctctctcgatctcgacctgatggttgaactgtgccatctgaagcaggttcagcaccgacccggcgcaccccgccttcgggttcatgctgccgatcaccacctttttcatgcggctctgtacaatggctcccgcacacatctggcatggctctaatgtgacatacatcgtgcagtcttccagccgccagtcgccggtctttttgctcgcctttttgatcgcagtaagctccgcgtgcgccagcgtatttccctctgtatttcttctgttgtaaccccgcgcaatgatcctgtcattctggacgatcacgcagccgatcggcacctcctcgagcgcgtatgccttttttgcctcgcgtatcgccgctttcatatatttttcttcctgtgtcatggacagtttctccagaaatgctatactatagtatagacttattttagccgatttgatgcattttgtcgatggaacattttcggcagagggagtatgtatgaactgcaacaaccatattaccggcagttttcctgtccataccatgtatacaaccgatcgtctgatcttaaaaatactgacccctgatgacacgaacgaggttctggctttccagtgccgcaaccgtgagctctttgaacgctatgagccgacgcgtcccccctattttctgactccggcgcaccagcaggccattctaaaatgtgagtatgatctcgcacggaaatgtgcatcgatccgtttttatgtcttcttaaaaaccaacccgcggatcatcatcggtaccgtctgcctgcacgatattctgcgcatgccgtactgctgcagcgagatcggctacaagttcgacgccgcattccagcatcagggctacgccagggaagccgtggcaaaggttttaaacatcgcttttaccgatctttccctgcaccgcgtgtttgcccgcgtgatgccggaaaatactccctctctccggcttttggaagtcatcggcttcacttgtgagggcaccgaatacgcctgcacccagattcagggaaaatgggaagaccacatccgctatgcccttttaaatccttactcttcaatataacgcacccagcagccaaaatggttgaccggttccctgccttccctgcgctcaccccctgggccggcggcaaagaattccgggaaaccgaaaatagccgccatcacgcgctcctgtctctgatatactcccggcacgccaaggaaccaccgttcctccgccgtcctgccaagcaccagataccgataattgaaaaatccatgtagcagaaagctgttgtttcccagataccagtattttttcggcagactccgcagatcctttaattccagctggatgcactgcgtatcccactcctcaaacagagccgccggtttgtgttctctgcagagctcctcccacacggcattccagtcgtattccgggaacagattgcgcatgggaagctcggtgacatgaatcgcctccgtctcctcccctgctttctccattccggacccagacggcacatcctgcgccattccttttgccgccatccggctgttctgttccgactgtacaggggctgctcccccctgctttctctgcgccatctcttgcgccgccgtctggctgttctgttccgcctgcgccgcggctgcttcccgcacttctttttgcgccgcagtttctgctgccgcccctttctctgctgccttctccttcggctcatccggctgccactcccggaatccggacagccccaccttaaacggagcaccctcgcgccaccggctcatcagaatccgctcttctccgatgacaaaaaacaatccctccatctctgtaatgccataaggagatgctccgactctgccgccttttaagacaacggcgccatcgccgcttccgttcgcaagcttcatctcaccgaccagtactccggtcacacctgttgcttccttcccgcctgccgcttcgcgctggaacagatacactctgcatgtcgcagacgccgcatagacgccgcgcagatgaatctcaattcttgcatcttgtccccggatctcaattctcgcaaatccgacattgcttccctttttttcctcctcataggcatatatatatgtaacaaaccgcttcattcccgccatgggtactccctgatacttctatccttatcttcatatatatgcaagcattccataaatagaatcttttcaaaaaataataattattcctatttttctcttgacaaattctttctgtgcgtgtaagataatatcagtaacaattactagttttaaggaaaggatgtatcgtatccatgctgaagtacagtaaacagcgggagtctatcaagaattttcttgtaacccggtatgatcaccctaccgccgagaccgtatatctgaatatccgaagggagttcccgaatatcagccttggaaccgtctaccgcaacctgaatctgcttgcggaaatcggcgagatccagaagctttccccgggaatcggaccggatcgtttcgacggcaaccctgctccacactatcatttcatctgccgccattgcggctgtgtgatggatcttacggtgagcggcttagatcatatcaacattcttgccggtcaggactttgacggtgagattgaagggcatattacctatttctacggtgcctgcccttcctgcaaggcatctgaaaaatgctcatcctgatctgaaaattgcaaaaaagatattgacaaaagtttttttgcagtttaaaatcagtaacagttactattattgattccaattaaaatttttataagaaaaggagaatgaattatggcaaagtatgtatgcacagtatgcggttatgtttatgagggagatgcagctccggagttctgcccggtctgtaaggcaccggccgagaagttcaagcttcaggaaggcgagaaggtatgggctgccgagcatgtagtcggcgttgcacagggtgtcagcgaagatatcctttctgatctgagagcaaacttcgagggcgagtgctctgaggttggtatgtatcttgcaatggcacgggttgcacaccgcgagggatacccggagatcggaatgtactatgagaaggccgcttacgaagaggctgagcacgctgcaaagtttgcagaacttctcggcgaggtggtaacggacagcacgaagaagaacctgcagatgagagttgatgcagagaacggcgcgactgccggcaagactgatcttgcaaagagagctaaggctgccaacctcgatgcaatccacgataccgttcatgagatggctcgtgatgaggctagacacggcaaggctttcgagggtctcttaaagagatacttcggttaattccaagcttaatcttttcctaccaaaaagggtgtgcagaaaattctgcacaccctttttaagctatattcttatacctgatgattgatatatgtattaaattcctgaaatgtcatccccaccggcacccggtcaaaagcggttgtggggctttcttttccgccgcgcatatttacataataatctacaatggtacgcatggcttcttctttcgtcgggtattcatagattcccttctgccttacattcggatgctccatgtgatatgttttgccgttctggaaatacaacaggaagcagtgcatatgctcatcctcctcctgattcccatagtcatccggttcgtaaatccgacagcaatacatctgattcggcacttcaatggtgtccagcaattcatgcatgagcgccacctgttcaatgcaggttccgatcttctgctgtatcgtctgggacacagacatcgtccggtactgtcttctgaaatctttcatttcacagatatgcgcctttccgtcctgacccagccacccgtattcaatatttttatctatccattcatagacgtcttccgccgtatgaagctctggcacgttggtctccggcttcttttctgccccgtatgctgctttatccatcgtctgtctctccttttatatctacgcagatagaagttccttctaccgccgttgtccaatgtaaaatacagtcaggaagtctgatttcccaacacgatctgtatcaaattcttgtccagcatcaatgtgcggttccagggattgataatcacaccgcttatcccttctgtacggagcgcggttgtgaataacttttccatatccgaaagaaatgtggacatcacgttcccgctgcccttcaattcttcctcaaaactcgtaaatgctgcccaccactgctgaccgtctgccgtctgtaccgcctgaatctcgatcttaccgtctccctttggtggttccactgccagaatgaactgtccaccctctctcatgcgtctgcgcacgaccgtaagcgcatgtgccagcccctcctcggacggttcctgctggagcgcatagactgcctgctcaatcttttcgtttccctgcagaccctcgtctgtgtttctgctgtctctatccatattcccaatctccctatttcactctttccctatccgggcgttcttcccttattataaacaaggttccccgtggttttcaacgggtttcctgtttaacattatacggtatttcctatagaagaaggagcatttttgtgtaataggaacaaagtttcctattacacaaaaaaagcccgcccagataatatctgagcgggctttcggcttctctattaaaaaatagattatactaactcaagcagtacttccagagcgccgtcacccttacgctgaccgatcttgacgattcttgtgtaaccaccattgcggtctgcatacttcggagcgatctcgtcgaataactttgcaacaaggtctacttccttggtgttcttcttcttaccagcagcatctgtcggaacttctgttacagagtaaagaacctttaacatctctctacgagcgtgaagacgggaaggcttatctttcttgatggtcttctcaacttcatcgtatacggttactttcttaccgtctacaacttctttgactctcttgccatctttgtccttgcgggcaactttagccttaacagtaacctcttcgaagttatccttctctcttactgccatagcaatcagtccctcagcgatcttgcgaacttccttcgccttagcctcggttgtaacgatcttgccgttgtttaataatgctgttacctgacctcttaataaagcctttctctggctagaggttctgcttaatttacgatactttgccattttcttttcctccattgatgtggtacatccgatgatgccttttggtcttactcacccgatgccgcgcgaaccatttcgcgccggaacaaatcacacagattcattcctgtctggctcccgacatactccatgcctttcggtcttactgtttctgccatataacgtggtaccttctgaacggtagcagttcagaaggtagcgctacgtgaagtttgacttgtcaaacttctaatgaatcgagcatgctcgattctatttattcttctccctggttcagctgaagtccaagctcttttaactttgcaagaacctcctctaaagacttacgtcccaggttacgaactttcatcatgtcttccggtgtgcggttcgtcaattcctcaacggtattgattccggctctcttcagacagttataagaccgaacggaaagttccagttcatcgatgttcatctcaagaaccttctccttcgcattatcctctttctcgatcataacgtctgcctgctgtgccgcctcagacagatcgatgaacaggcttaaatgctcgctcaatacctttgccgcaaggctgacagcctcatccggctctaaggtaccgttcgtgtatacatccagtgtcagcttatcgtaatcggtaatctgaccaacacgtgtattctcgatagaaaggttgacacgctccaccggtgtatagatagaatcgacagcgatgacaccgatcggtgtatcctcagtcttattcttctctgcactgacatagcctctgcccttagtaatggtaagctccatgtataacttacaatctgctccgccatttaaattggcaattaccagatccggatttaaaatctgaatatcagaatccacctggatatccgctgctgtgaccacgccttcgccctcaaattcaatgtatgcaactttcggctcattcgtagaactgttattgcggattgcaagattcttgatgttcatgataatctcagttacgtcttcctttacgccaggaatcgagctgaactcatgcagcacaccatcaatcttgacctggctgacagccgcacccggtaatgaagaaagcatgattcttcttaaagaattaccaagtgttgtaccgtagcctctttccagtggctctacaacaaaccttccgtacttcttgtcttctgaaatttctgcgatctcaatttttggtttttgaaaatcgaacactacaaaatccctccttctcgggtaatttgcctattggattgtctccgcctaatcacgattacttggagtacaactcgacgatgagcatctcgtcaacaggtacgtcgatctgctctctggaaggtaattcttttacagttccctgtaatttctcagcgtcaacatctaaccaatccggaaccagtcttccgccggttacctcaacaatgtccttcattctctgaagacccttgttcttctccttgatctcgattacgtcgccggccttaacaaggtaagaaggaatatttacctgcttgccgtttactaatacgaacttgtgatctacgatctgtcttgcttcctttctggttcttgcgaatcccatacggaatacaacgttgtctaatctggactctaacatggtcattaagttggtaccagtcatgcccttcatctgatcagccttcacatagtagttgtggaacggcttctctaatacaccgtagatgaactttgctttctgcttctcgcgtaactgaagaccgtactcagacaccttcttgttcgctctctttaactctctgttggatttcttatcatatcctaagtagcttggctctaaaccaagggatctacatcttttcagaacaggaactttatttactgccattttcgtctctccctcctaattaaactcttctgcgttttggtggacgacatccgttgtgaggtaccggagttacatctttgatgcttgtaacctcaagaccgcaagcggaaagcgcacgaattgctgcttctcttcctgatcctggtcctttaaccataacgtcaactgtctttaatccgtgtactaaagctgcctttgtagcagtctcagctgccatctgtgcagcatatggagtagatttccttgaacctctaaatccaagaccaccggcacttgcccatgataaagcattaccttcagcatctgtgatcgttacgatcgtgttgttgaaagatgactgaatatgtgcctgtccgcgttcaacgtttttctttacacgcttttttgtcactttttttgtaactttagccatatctaaactaacctactttctcaaaataatctaatgattgtatgcaactgaccgccatacttcatctgtggcgatcctgcgaacgaaatcgcaaaagtaattacttcttcttgttagcaaccgtacgcttcggtccctttctggttcttgcattggtctttgtcttctgaccacgaaccggaagaccttttctgtgacggattccacgatagcatccgatctcctgaagtctcttgatgttcatggcgatttctcttcttaaatcaccttctacagtctgactctcgtcgataactgcactgattctcttaacctcatcatctgtcagatctctgacacgggtattcgggtctacttttgcttctgcaaggatgcggttagaacttgttctaccgattccgtagatataagtcagaccgatctcaacacgtttttctcttggtaaatctacacctgcgatacgagccatgtgctttttaacctccattgattcatatgatgcctgtgatacacactgcgcatcttgttattttctgattcctgcgactgtccagatgacagaccgcgtcttaaagcaagccacttgacatcatgacttttacgttcaagaatctgctgcggcagctccgttgtcctccggcctgaaatgtgtgccctcgcaattctctcgtattccggatggttctcccctgcgtcctcggtatgtaaacgcaaaaaagcagctatccctgctgtttcatatgataacagtgcgaacaactcatcctggtgttccactgcagccgcacataatgaaagcgcaaaaagacaagaacaattagccctgtctctgcttgtgtttcggattctcacagataattctgatgcttccttttctcttgatgactttgcatttctcgcaaataggcttaactgatgatcttaccttcacagcaaatcctcctttccaaacaatgaatggcacgcacccgcgtgcatctctcatgttctatcatagctcttcttggcgcactgtatgcgcaaaaaggcactatccaaaagtgtccgtttagcattatagcatgaacacttattagaagtcaattctttttttacttatctctccagataattctgccctttgtcaggtcatacggagacatctcaatggttactttatcacccggaagaatacgaatgaaattcatccgcagctttccgctgatggttgccagaatctgatgaccattctcaagctctactttaaagaatgcgttcggcaacttctctaccactgttccttctacttcaatcacatctgcctttgacataaataaatcctcctaatattatgattctgcacgctctttcaagatacgcacatacgctttgattgccctctttaccgtaagatcggtaatttcctgctccagacatcccagcacctcctccggtaatctgtgaataatctgaatatgttttctgttctttttcttcggttccgcaagcagcttcacattgccgtccgccagatacacgaaccgctcatcctttccggtaaccagataaatatggttcctgtcatgacctgccatggattttgcaaattcaatcatactatctttttctccattcgcttactgaccggtctatgcctctgtctgcctgcccagatactgattccatctgcctgtggcaatctcagactctgtaagcgtaaagatctccggctcaccgtcagtgatcagaatcgtgttctcataatgcgcggaaagcgaccagtcttctgtgacaaccgtccagtcatcatccatccataccacctcggcagatcccagatccaccatcggttcaatggcaagtgtcataccgggtcttaacttgataccgcgccgaaactgtctgaaattcgggatctccggatcttcatgcatatgcttgccgatgccgtgcccacacaggtcacgcacgactccatagccaaaacttccggcataatcaccgatcgccgcagagatctgatgcagatgattgcctgctgtcgcaaacttgataccctcgaaaaagctctgtctggttctctctatcaaaagcttcgcgtcatccgagatctcaccgacgccatgcgttctcgctgcatcggactgataccctttgtagatcacgcccgcatcaaggcttacgatgtcgccctcctcgatgatgcggtctgcacgcgggattccgtgtacgacctcctcgttgatcgatacgcagattgatgcaggatagccctgataacctttaaatgacggttcgcatccaaagcttcgaatcatttcttctcccagtctgtcaacctcaagtgttgacattcccggctttaattcttttcccagctgctcatgcacttttgcaagtattttccccgcctcgcgcataagttctatttcctggggggatttaatcgttacagacatgttactctcctaatattgccacaatatccgcaaacactttttccatcggctgtgtaccgtctacggactttaagatgttctgcttcttataataatcgatcagtggctgtgtctgctcatgatataccttaagacgcttctgtacggtctcaggcttatcatcgtctctgagtaccaccggattaccgcagcggtcacagattccctcgaccttggtcggaatggaaacaatgtgataggttgcgccacagtttaagcatgcacgtcttccactcatacggtttacgatattctcgtccggaacatccacatcgactgcgaaatccatcttctgaccgatcttaacaagtgctgcatccagagcttctgcctgcgggatcgttctcggaaatccgtcgagcacaaatccgttcttgcagtcctcttgtcctatgcgatccattaccagatcacaggtcagctcatccggtaccagaagtccctgatccatgtactttttcgctttctgtcccagttctgtgccgttcttgatgtttgcacggaaaatatcgcctgtggaaatatgcggaatgctgtacttatctgcaatctgctttgcctgtgttcccttaccggctcccggagcccctaacataataattttcataggaatacctctcctctttctttttaagcgaaaacgctgaacttataaaataagtccagcgttccttcccatatccaacagctctgctggatcaatcatttaaaaatcccttataataacgtacccgcatctgtgattcgatctgctttaaggtctcgataacgacacctacgataatgatgatggacgttccaccgaaggatacatccgctccaaacacaccgttaaagaaaatcggaacaaacgcgatgaacgcgagtgcaaccgcacctataaagacaatataattcaggattcggttcaggtaatcactggtcggcttacccggacgaatacccggaataaatccgcctgcttttttcatgttgtttgcaatctccaacggattaaacgtaatcgatgtatagaaatatgcaaacgcaatgatcaatacgatgtatacaaccagtccgatcgaataaatcggctcgcttggattacaccaatttgactgtgacatacctcttaagatcttgctcccaatacctgttccatttcctttgccaagaagactggcaatgattaccggcgtctgcaacagtgactgtgcaaagataaccgggataacaccaccggtgtttaccttgagaggaatgtatgttgactgaccgccaacctgctttcttccctggatcttcttggaatactgtaccggaattcttctctcgccgccctgtaagtatacaacaaacagtaccattccaacaatgattgcaagaatgataactgccgcaagaattgctttcggtacattcttacctgaaataaactgatcatacagcgtcttaatatcatccggcatacgggagataatgttgatagtaagtacgatggaaataccgtttccaacgcccttctccgtgattctctcaccaatccacataagaacagcagatcccgctgtcaatgtgaaaataaccatgataatatcaagaacaccctggtatccactgctgaattccagataaccgcctcttctgaagccgattgtcattgcaaccgcctcgatgagcgctaaagcaaccgtcagatatctggtgatctctgcgatctttttacgaccttcctctccgtcacgctgcatttcttccaactttggaatcgcgattgtaagaagctgcattatgatggatgacgtgatgtacggggtaatgttcaatgcaaagatagacattctgtagaaagaacctcccgtgattgcatcaaagaatcccattccatctgcggtctggcttgcaaaccagttcgcaaatacatcactgtcaacaccaggaatcggaagacagcttccgattctgatgacgattaacatcaaaaatgtaaaaataatctttttgcgaatatctttaatcttaaatgcattacggagtgtctctagcattagatcacctctgcttttccaccaagagcctcaattttttcttttgcgcttgcgctgaatgcatttgcctgaacggtgagtttcttagtaagttcgccattaccaaggatcttaacgccatctcttggattcttaacaacgcctgcctcgatcaatgtctcaacagatacaactgcgccgtcctcgaatgcctcaagagctgaaaggttaattccgatgattgtcttggagtttctgcacttgaaacctctcttaggcaatcttctgtataatggcatctgaccaccttcgaaacctggtcttggtgctccggaacgagccttctgtcccttatgtcccttaccagcagtcttaccatttcctgatccgtgtccgcgtcctcttctgaaattatcactctgagtggaacctgccgctccctgtaaatttgataagtccattactgacacctccttatcctcttattttaaacttcttctactttcacatatggtgcaaccttgcgaagcgcgcctgctgttgcagcgttgtccggaagctcaacagtcttgtaaagcttgctgagtcccagtgcttcgatggtcttcttgttcttcggaactgcaccgatcgtggatttaataagtgtaactttaagtttcttctctgccatcttaaattcctccttaacctacgatctcttctacggatttaccgcgaagcttcgctacttcttccggagactttaactggctcaaagcatttaacgttgcaagaacaacgttctgcttattgtttgaacctaaagactttgtacggatgttcttgatacctgcaagctcacatacgttacgtgcaggaccaccagcgatgataccagtaccatccggagacttctttaataatacggaagcaccggtgtgcttaccaataacatcatgtgtgatactgtcaacctcatccagctttactgtgatgagcttcttcatagcatcctctttgcccttgcggattgcctccgggatctcggctgctttacccaaacctgcaccaacatggccattgccgtcgccgacaacaactaaagctgtaaaacggaagttacgtccacctttaacaacctttgttacacgtttgattgacactactttttcttctaactctaactgactagcatcaataatttcacgtttcatgttttgcgtttcctcctattaaaattctaatccagcttctcttgctgcatcggctaaagctttcacttttccctgatatatgaaaccgccgcgatcgaatacaaccgtgttgatacccttgtctaatgctttcttagcgataacggtaccaagctttgctgctgcttcaacgttattcgtcttctctaactctgcctttacgtccttctcaagagtagaagcagaaacaagtgtatttccgactgtatcatcaataatctgagcgtacatatgattattacttctgaacacagccaggcgtggtctctctgcagtgcctacgagatgatgacgcattcttctatgcttattttcgcgaactgctgttcttgatttcttactaaccatttttcgtcactcctttaattatttcttaccagtcttaccaactttacgtctgataacttcatcagcatacttgatacccttgcccttatacggttcaggtcttctcttatctctgatttccgctgcgtactggccgaccttctctttatcgatacctgatacaatgatcttgtttccatcaactttggactcaagtccctccggatcggtcatctcaaccggatgtgagtatccaaggtttaaagtaaggacttttccagacttggaagctctgtaaccaacaccgtttacctcgagctcctttgtatatccatcagttacaccaacaaccatgttgtggatcagtgttcttgtcaatccatgtaaggatttcattttcttcaaatcgttcggtcttgtaacgattacttcgtcaccctctaatttgatgtccatctcggacggaagggttctctcaagagttcccttaggaccttttacagtcacatgattattttctgcaatatccactgttacaccagccggaactgcgattggcattcttcctatacgtgacatgcccgtacctcctaatttgtgcttatatcattgcggcttgcgccgtagttacccgattcggtaagaacctcctccaggttaagtaacccggaagaaccgaaagcaacattgcttctggacagaccagagacagatgctcccggaagatgctctcggaagaaccagcctttggttcttccgattttgtccgtccaatggcgggcaaaatctaccatacgaaagctaatacttcgccaccaacctgaagctttcttgcttccttgtcagtgatgattccctggtttgtggaaagaattgcgattcccagtccgccaagaactctcgggagctcatccttgccagcgtatacacgaagtcccggcttggagattctctttaatcctgtgataatcttctcgtttttgtctgcgccgtactttaaagtaatgcgcatggtcttgaagttaccatcttcaacaatatcatattttgcgatatatccctcatctacaagaatgtcagcgatagcaattttcatcttagatgcaggaacgtcaactgtatcatgtttagcagtgtttgcattacggattcttgtaagcatatctgcgattggatcactcgtagtcatgattgtatatttcctccttattattgattgcagcaaatatgctgcacggtcttttaccagcttgctttcttaacacctggtatctggcccttgtatgctaactcacggaaacatactctgcagattccgtattttcttaaaacagaatgtggacgaccacaaattttgcaacgtgtgtaagctctggtagagaactttggtttacgctgctgttttactttcatacttgtcttagccattaaaattccctcctacttatttggcgaatggcatattgaactgtgtcaataattcgcgagcttcctcgtctgtcttggcagtggttacgaagatgatgtccataccacgtaccttgtcaaccttatcgtactcgatctccgggaagattaactgctctttgataccaagggcatagtttccacgaccgtcaaacgcgttcgggttaacacctctaaagtcacgtacacgaggtaatgctaagttgatcaaacgatccatgaactcatacatcttctcgccacgtaaagttgtcttacatccgattgccataccttctctgatcttgaagtttgcaatagaattctttgccttggttgcaaccgctttctgtcctgtgattgcttccatatccttaatagcagcctctaataactttgcgttctctttggcttcgccaacgcccatgttgacaacgatcttgtcgagcttcggcacttccataatattcttataaccgaatttcttgatcatagcatctacgatctcattctggtactgttctttcagtctgctcacctgattggcctcctctctctaattagtcgattacttcgcctgtagattttgcgaaacgtaccttcttatctccatccatcttgaaaccaacacgggtaggctttccgttgtgaagatacattacattagaaatatcgatcggtccctcctggtgaacgatgccgccctgctgattctgcatacttggctttgtatgctttgtcaccatgttgacaccttcaaccagtacagttccgtcttttctgttaacagcaatgactttaccttcgctgttgatatctttaccagcgattactttcaccatatcgccttttttaattttcatggttgccatattccgatcctcctacaatacttccggagctaaggaaacaattttcatgaactgtttctcacgaagctctctagctactggtccaaaaatacgtgttcctctcggagttttatcatctttgatgatgactgctgcgttctcatcaaatttgatgtaagaaccatctttacgacgtgcgccctttacggaacgaacaactacagccttcacaacgtcgccctttttaacaacaccgcctggtgttgcatctttgaccgtagcaacaataacgtcaccaatattcgcatatcttctagtagatccacccataacacggataacgagcaactcttttgctcctgtgttatcggctaccttaagtctactttcctgctgtaccatgcttgtagcctccttctaactattttgctctttccatgatttctacaagtctccatctcttatccttggataaaggtcttgtttccattactctgactttgtcaccgatcttgcactcgttcttctcgtcatgagcctttaatttatatgttttcttaacgatcttgttgtaaagaggatgtcttacgttatcctggattgcaacagtaattgtcttatccatcttgtcgcttacaacaataccaacacgtgtttttctaagatttctttcttccacgactgactattctcctttctggaatcctactgcgcaactttttctttctcagtaatgatcgtctgaattcttgcaatgttctttcttacttctttgattctgcttgtattatctaactgattggttgcgttctggaatctcaaattgaaaagttcttttttagcctctactaactgtgcgctcaaatctgcgacagactgggtttttaattcttctaaatatttactagttttcatttgatacaccgccttctaaatccgcacgagaaactactttacatttgcaaggtaatttgtgtgtagcaagacgtaacgcttctttcgcaacgtcttccggaacaccggagatttcaaataatacacgacctggtttcacaacagctacccaatactccagggagccttttcctttacccatacgaacacccataggcttctgcgttacaggcttctccgggaaaatcttgatccagactttaccaccacgcttgatgtatcttgtcatagcgatacgggctgcctcgatctggtttgctttgatccaacatggttccagagcaacaataccgtactcaccgtaggtgattgtgtttcctctggttgcctttcctgtcatggaaccacggaactgctttctatgctttactctctttggcattaacattagttagctcccccttccttatttgctcttaccggaagtacctcgcccttgtagatccataccttaacgccgaccttaccataagtagtgtctgcctcagcgaatccataatcaatatctgcacgaagtgtctgaagcggaatagtaccctcagagtagaactctgtacgagccatatcagcaccgccgagacgtccggagcaggatgtcttaataccctttgcgccagccttcatggttcttcccatgcaggacttcattgctctacggaaagaaacacggttctctaactgtaatgcaatgttctcagctactaactgagcatcgcggtccggtctctttacttccttaatatctacaaccaacttcttgtctgtgaacttctgaacctcgcccttgatcttctcgatctcagcgccgcccttaccgataacaacgcccggctttgcggtatagatgataacctttacacgatcagatgctctctcgatctcgatcttggaaacacctgccgcgtataacttcttcttaagataagttctgatattgtagtcttccactaagaaatctgcgaaatctgcttccgcataccatttagagtcccaatctttgataacgccgactcttaagccatgtggattaactttctgtcccatgtttgacctccttattatttctcatccagcacgattgtaatgtggctcattctcttctcgattctgtaagctctgccctgtgctcttggtctgattctcttcattgttggtcccttgtttgcataacactctgcaacatacaggttctccaacttgtaattcttctccggataattgttctcagcatttgcgattgctgactctaacagtttcttaaccacgctggaagcgtaacgcggattgtaggatacgatagctaatgctgtctgaacgtcctttccacgaattgcgtctaatacgaagcatgctttctgaacagacactcttgcataagataactttgcggatggtctggtatcttttacttcatttctctctctcttgatcttacttctatgtcccttagccatggatgaaacctcctttcaaaaatagttcttatctaacgcctgacttcttctcgtcttttccatgtcctctgtaagttcttgtagcaacgaactcaccaagcttatgtccaaccatatcctctgtcacatataccggtacatgctttcttccgtcatgaacagcgattgtgtgacctacgaactgtgggaagatggtagaacggcgtgaccatgtcttaattacagacttgtcaccggctttgctcatagcatctacttttttcagtaagctttcatctgcaaatggtcctttttttaatgaacgagccataatttacctcctaatattatcagtccttacacacacccgtgtgtttcctcggactacgaacatcttgtttattatagcagaacatgccggaagaagcaagtacaacttctcccggtcaaattccagcttatttgtatatttttgacaaacacccgatgggcttatcaatggttgaaacttatttcaacgccttaccgtctcttcttcttacgatcatcttgttagaagacttgttcttctttctggtcttaaggccaagagcaggcttgccccaaggtgtgcatgggcccggacgtccgatcggagcacggccctcaccacctccatgtggatggtcattcgggttcataacagaaccacgtacagtcgggcgaacacccatgtgacgcttacgtcctgctttaccgatatttacaaggttgtgatctccattaccgatcacaccgatggttgcgcggcagtttaacggaaccatacgcatctcgccggacggaagtcttaacgttgcgtactttccttcctttgccatgagctgtgcgctcataccagcggaacgaaccatctgtccgcccttgccaggatgaagctctacgttgtgtacctgggtaccaaccgggatattctcgagcggtaagcagttaccaacacgaacctctgcagtcgcaccactcataacagtcatgccatctgtgagtcctgccggagcaaggatgtatgccttctcgccgtctgcgtagcagatcagagcgatgtttgctgttctgttcggatcgtactcaataccaacaacctttgccggaattccgtctttgctgtttctcttgaagtcgatgactctgtattttcttctgtttccaccgccgtgatgtctaacggtgatctttccctgattgttacgaccagcgttcttctttaaagaagtagtgagcgctttctccggtgttgtctttgtgatctcggagaaatcggagccagtcatatttcttctggaaggtgtatatgggttgtatgtcttaattcccattgttgttctcctttcgatgtttgttatcgcgcatcgctgcgcctagtttgctatcagaacgaaacgcttttcatcttacagtccagcgaagatctcgatgtccttgctgtctgctgttaatgttacgatagctttcttggtcttggcagtcttaccggttaccattccacgtctcttgttcttgccgtccatgttcatggtgttgacgcttgcaacctttgttccctcgaacattttctcaactgcttccttgatcatggacttgtttgcttccgggtgaactaagaatgtatacttcttctcagccattgctgccatgctcttctctgttactactggtttgaggattacatcataatactgtacgtttgccattatgcatacacctcctcgatcgtctttacagcgtcctttgttacaacaaccgtatcatacttcagaacgtcaaatacgttcagctcatttgtctgagcagtctttacagtcggaacgttgtctgcggatttgattacgttgacatccatatcgttcaatacaacaagtgccttctcaacctttaagttcttcataacctctacgaacttcttggtcttgatctcgtcaagctttaactcgtcgagaacgatgaacttgttctcagcaactcttgaagtaagtgcagactttaatgctgctctcttctctttcttgttgagcttgaaagaataatctcttggtaccggagcgaatactacgccaccatgtgtccactgcggagctctggttgaaccctgtcttgcatgtccggttcccttctgtctccatggttttctaccaccaccgcgtacttcggaacgggtcttagccttctgtgttccctggcggttgtttgcaagctgctgaaggactgccatgtgtactaaatgctcattcacttctactccgaagatagcatcgttcaactcaaggctgtcaacttccttgccttccatattataaacagctactttagccatcgtttagttcctcctttcctattcgagcactatttaccagcttttactgtttctttaactgttactaaacacttcttagcacctggtacggcaccttttactaaaagcaggttgttctctgcgtcaactcttacgatttcaaggttctgtgtagtaacctgtacgcttcccatatgtcccggcattccttttcccttgaacacacggctcggtgaggagcacgcaccgttggaaccctgatgacgatggaacttggaaccgtgagccataggacctctgtgctgtcccaatctcttgatagcgccctggaatccttttcctttggaaattgcagtagcgtcgatcttgtcgccctctgcaaaaatatcagccttgatcacatcgccaagattgtaatctgctgcgttctcaaacttgaactctttcacaaaacgcttgccggatacgccagcctttgcaaaatgtcccatctgagccttgtttacaccatgtctgtgagctacctgcttcttgccgtttgcatccttgttgacaaccttttctttcttgtcagcaaatgcaacctgcactgcactgtatccatcgttctctactgtcttgatctgtgttacagaacatggacctgcttccaatacagtaactggtactaaaacaccgtctgcattgaagatctgagtcattccgacttttgttgctaaaatcgctttcttcatacttttacctcctgttttctctacagcggaacgcttcatgcccaaccatgtggggtagcggaaccgttcatcctagaaagtccatataagtggaatgggaagttttcaccgcctgcattacttctatataaaacccttcaggatattaactaaatcattgatttgtctgggatgaagaaattatttattcttcatcttgatatcgatgtaaacacctgccggcatctcaaggcgggataatgcatcaaccgtcttctgggtcggtgtaacgatatcgatcagtctcttatgagttctctgctcgaactgctcacgggaatctttgtacttgtgagtagctcttaagattgtaactacttccttctttgtaggaagaggtaccggtccgctcacctgtgatccgttcttctttacagtttcgatgattttctgtgctgatgaatcaactaacttgtgatcataagccttcagagtgattctcattacttgacttgccataaaaaaagtcgcctccttttcgcacttttacaagcgatgtaatcgctttttgtacgacaagcggtgactgcacacatacccgcgtgtatcatggactcacgcccacaaagaagcccgcgcttcctacacgccatccctctgtccttcggacaaattctattcgtgatacagtgacttgtcgccagtttcctaacttgacattcgctccacggaaaacctgcaatgctctgcagcaacctcacgcttcaacgctatcaatgtcacagcaatgcatagtatacacgatgaaaccgcgaattgcaaggatttttttcagttttttgcattttcgcgccgccccatccacttgtcgaccagattgtatacaagactgataccaaagcaaaggatgcctccgacaaaaaatcccgccgcccggagcagcacattgtcgtagcggatgtccacgagcaccagttttacaacgcacagcagcaccagaaccagtccgcagacccgcagcgccttatattttctcttcatccgcatttccgccagaaatcccgccacgatacagcagaacgcaatcacaatgcccgtcacatcgttcacgaacacgggcaccccataggagtgcagtgcgaccgatgcaaacagcagcagctttaacgccacgtaaattccccaccagtctccgtccttccttatcagcaggctgtaggtattggtgcacacgagcaccagtcccaaaagcatatagataaggtgaagcaccggcgcgtccggttttcccatcagaaccagaaccgctgcaataaggagcgcctgcacggccatcgttaccgccgcgaatgctttttcttcctctcccgtctttggatttctgcgaaacagcggaactttcgccgccagaatattgcagagcacaatcggcataaaacagatcagatcgctcaggtaaacatctgcgaccgctgccagatccgttccccacaccgccgtttctgacaggaatgccaaaaacatcagataaccacagatcttcatccaggtttcatactgttccctgcagaaccggatcagcagcaccgcgctgcagaaaaataccagtccccagaccgttctcatgcccccgttcatcgggatcagcaacagcaggatgccatagccgagtgccgccgcccggtatgcttttcttttgcgcaggaaaccgtacagaaggcacgcctccgccagaagtcccgtcgatatatactccccgaaatacggcgcggcagctcccgcaaagaacatctgcgcaaaaacagccacctccagcagaaccgtacccgcggacagatccccggggcgccggaattccagcagcgccagaactgcaatgccaaataccagtaagagcagcgccgctccggtaaaccggttcaaaaacagtccgcaaaaaatgatgatacacagtgcccccacaataccaccaagcagttttccattctcgtccatttccgccgcggctacgccaagcagtaccggaaccgctgcaagcgcaagaagcaataccactgacacgtttcccgcagcggagccttctgtataggaagcagctgctccaagcaccagaatgagcagcccgatgctccacgacacaagattcaccgcattacggtaatattcccgccgtaggtgggacacgaaaaagatggtctgcgttaccgcataatatatagaaagaatcagaaacctttccgcattctccgtccagttacacatgagcacgccgagaatcaatgagatgcccacaccaatctgccctatgataaggaagagattcgaccgcagacgtgacagcacacacagaaccaccgcccacaccagcagtcccagataaagtatgccgtcgtttattgcatggaaataaaaatcacttaaaaacagcgagagataccacgctcccatgccgcagcccagcagcccaagaaatgctttattcctgcggtcatgtgccacaagaattcctcctgccagcgtgatcgcggcactgacggtatacatcagaaccatctttactccctggctaagatacggcagcaccagcatcgcaaaaaacaccagactcaggaagatcagtcctgcagcgcagaccggcagaatcgccctgccgatcgttttttccagatcctgcttcccggatgcctgctggtatcccgcctgtgctgccaccggccgcggcggtgtctgctgatacgcctgctgcgggtttcccggctcccgcgcggactgtgacattacgcccggcgccggcggtatcggatttcccgtctccgctgtctgcactgccggctgcggcggtgtctgctgatacgcctgttgcggttttcccggctccgctgtctgcgctgccgcccgcggcattgtctgatcccacggctgtgccgctgcccccggctgtccatacgccggccatccatacgccgccttcggcatcgccccctgacggtatcccgcccgttcacggtctgcctgtgccgcgatcactgtgcgcagcgccgtcagctgtcgtcccagcgcatccacttccctctgcatctgatcaatcttcatccgtgtaagatcgtcccccagatccccggaccgccaggcaagcagtaactcattgaaccgtctctgttcctctaaaagccggttctcacactccactaattgttccagcataaactcctctttcctctcctgtcatttagttctctgtcactcattgtagcgtaccctcatttaaaacacaagaactgtccgcgcgggcgttttctttaaaaaattgtttttatcattaagattttgccaatttctacgctttttttcccaaaaacaatttgtatatgctataatgatttagattattctttaaggagatttctatggacattattatcgtaggctgtggaaaagttggttttacgcttgtcgaacagctcagcaacgaagatcacaatattgttgtcattgatgaaaagccggaaaaggttcaatatattaccgaccgtctggatgtgatgggcatcgtggggaacggcatcaaccataagacactgctggaagcgggtatcgccactgccgatcttttgatcgcagttaccggagatgatgagaaaaaccttctgtgctgcgtgattgccaagaagaccggccactgccagaccatcgcgcgcgtgcgcaatccgatctacaacggcgagatcgccttcctgaaaaaggaattcgggctcgccatgattatcaatcctgagttgacggcagccaacgagatttcaagagtatttcagtttccttccgccatccgtgtggattcttttgcaaaggggcatgtagagctgcttcactttaaagtcagcgagaattccccgctgattcatttaaagctgttcaatctgcaccagaccctgcacagcaacgtgctggtgtgtaccgtcatccgcggcagcgaggtcatcatcccgaacggtgattttgaattccgcgccggagataccgtcgcaatcgcttccgagcgccgcaacgccattgactttttccgtaagatcggcatcgtcaagaaccgcgtcggcaatgccattctcgctggcggcggtaaggtttccttttacctcgcaaagattctcatccagtcgggcatccgtgtgacgatcatcgagatcaatccgtcccgctgcgacgttttaagcgagctgcttccggaggcgacaatcatctgcggtgatgccaccgatcaggatctgctgtccgaggagggcttagagcaggcgcagggttttgcagctctcaccggtcttgacgaggaaaacatcctgctgtcgctgtacgccaacgatgtctccaatgcaaaaacggtgaccaagatcaaccggagcagttttaactccgtcatcaacgagatgaatctgggaagtattatttatccgcgtgtcattaccgctgattacattttaaaatatgtgcgctccacagtgaattccatcaacagcaacgtggagacactttacaagcttgccggcggaaaagccgaggctctggaattcatcatcaaggagaattctgccgtcgcaggcattccgctgcaggatctgaatttccgcaagaatactttaatctgctgcatctaccgcaacggtaaggtcattctgccgggtggacaggatatgatgctcgccggagactccgttctggtcgtcatttccggataccgcatctccgacatcaaagagattctggaggattaacctgcaatgaattattccatggttttatatattctgggctatattttaaaatttgagagcgcgtttctgatgctcccggcactggtatcgttgatctatcaggaaagggcaggcattccgtttgtcattaccgctgcaatctgtctggttttagggattgttttcacacataaaaaaccgtcttcctcgaccgtgtatacaagggaggggtttgttactgtcgccttgagctggatcgttatgagtattttcggcgctatccccttcgtgtggaacggcgacattccatattatgtagacgccctgtttgaaacggtctccggttttaccacgaccggttcaagtattctctccgatgtcgagtccctgtcgcatgccagccttttctggcgcagtttcagccactggatcggcggcatgggtgtgttcgtctttattatgtcgatcctgcctctgatgggcggctctacgatcaacctcatgaaggcggagagcccgggaccttccgtcagccgtctggttccgcacatcaaggataccgcgaaaatattatacggcatttaccttgccatcacgctccttgagattgtcattctgtgtgcgctcggcatgccgctgtttgagtctcttctgacgagtttcggcacgaccggcaccggtggtttcggtttccgtaacgacagctttgcaagcttttcgcctgctatccagaatacggtcacaacttttatgatcttaagcggtatcaattacacattttatttttgtattttatcgcgcagaatcaaggatgcattccgcatcgaggaagtgcgctggtatctctttttgatctttgcttctgtcggaatgattacctataatatacgcccgctttacgcaaataccagggacgcgctgcggaatgcctttttccaggtcggtgcgatcatcaccaccaccggatattccactgccgacttcgacatgtggcctgcgctctcccagacgattcttgtgacgctgatgttcgtcggcgcatgtgcgggaagcacaggcggcggtatgaaagtatcccggctggtgattttattcaaaaccatccgcaaagagctttccctgattatccacccccgcgagatccgcaagatccgcatggacggacatgtcgtagaacacagcaccctgcgctctaccaatgtttttctggtcatttactttattttgctcatgctgtcaacgcttatcatcagcctggacgagttcgattttaccacgaactttacagcagtcgtctcgtgtctgaacaacatcggtcctggcttaaaccgtgtcggaccggcgcagaatttttcgatcttctcgccgctctccaaggttgtgctgatttttgacatgctcgccggcagactggagcttttcccgctcatgattctgttcatgccgtccacctggcgtaaaaaataacgtgcagccggcaatttgggctgcgcagttttgaaccggtagatatttttctaccggttttttattggctttttatcgcctcttttctgctccggatgttgtatccgcatccgttaaagcttgcaccgcgccgtagcgagggctttttctctgcccgcaggcagacgtttttactttttccttgccctctgctggcttgtggtatatatttgttatagttttaaattagaagtacacaggaatggagattgctatgtggattgcagataactggaaagattacgaagtcattgactgctcaaaaggagaaaagctcgagcgctggggagattatcttctcgtccgtcccgacccgcaggtcatctgggacacgccgaagaccgagcgcggctggcgcaaaatgaacggccattaccaccgcagcgccaagggcggcggggagtgggaattttttgatcttccccagcagtggaccatccattacggcaagctgactttcaacttaaagccgttcagttttaagcacaccggactgtttccggagcaggctgccaactgggactggttttccgaaaagatccgcagcgccggacgtccgatcaaggtgttaaatctgttcgcctacactggcggtgccacgattgccgccgctgctgccggtgccagcgtcacgcatgtggatgcctccaagggaatggtgacctgggcgaaggaaaacgccgtctcttccggtcttggtgatgccccgatccgctggattgtggacgactgcgtaaagtttgttgagcgcgagatccgccgcggcaaccactatgatgcgatcattatggacccgccttcctacggaagaggacccaagggtgagatctggaaaatcgaggacgccatctatccgctggtgcagctctgtgagcagttgctgtcggacgatcctctgtttttcctgatcaactcctacaccactggtcttcagccggcagtgctcagctatatgatgaataccgtcttaaaaaaacacggtggtcatatcgccgcagatgaaatcggtctgccggtttccagcaacggtctggtgcttccgtgcggggcaagcggcagatttgagcgctaagggcgggaacgattttgtcctgtttttgcacaatttttgtaaatagttgttttcctgcatacacaatacaatttttgtggtacgctgtttttatgcaaaggtgatacggggatccggatcaccggcaaataaaaacgaacaggagaatgatttctatggcacagtttgtaaaattagttcccgagaatttaaaggcgctgcgcgaagtaaatccgcgcctgatgtcttataatgtagaattcgccgaggtaaccggcggcaccttctggaaagcgtacacaccggagcaggttgcaggaaccgaggaattccatgtcgctccgagcgcagacggcattgctgcaatgtacaaggatctgatgcaggtatacgcaccgatcgatctgtacaacgagaagctccgctccctcgcaaaggagctcggaaccgcatgggtgcgtgtgtccggcacctgggcaaccaagacttactatgattttgacaatgcaacaggcggtattgctccggagggctacttaaatgtcctgacaaaggagcagtggattggtgtgctcgacttcgtaaaagcgatcgatgcgaaactgatgatttccgttgcgaactgcccgggtctgcattccgcagaggaaccgtggaatccgagtgaggcggagaagatttttcgtctgagcaaagaacacggcgtaccgatcgacggcgccgagttcgcaaacgaaccgaacatgatggaggataccggcttcccggctggttatacaccggctgattaccaccgcgatcaggatctgtttttcgcgtgggtacgcgccaactatccggaatgtatctgtatcggaccgagcagtgttggcgagggtcttaccatcaatggcggtgatgacaacagcaagagtggtggtatcgagcagcttgtaagagagaactgctccacaaccgacctgttagaggacaccaaagagccgttggacgtattcagctaccattattacaacggtgtatccgagcgtcttgcttccgtgatgccaagcggacactggctggcagataccgcccataccgaggcgtatctggacgttgcattaaactgtgcgcgcacctatgctccactccgcgacaaatactgcccgggcggcgagatgtgggtaacggagtccggcgacgcaggcggtggcggtgatacatgggcttccacgtatctggatgttttccgtaccttaaacgagctcgctggattcgcagcgatcacagacggcgttattttccacaatacactggcttcttccgactacggcttcctggcccgcgaagtatttgatccgcgcccgaactattttgccgtattgttgtggaaccgcctgatgggtacgaccgtttacgataccgcagagccaatccgcgagggcgcacatgtcttcgcacattcccgcaaagatggaaaagagggcgttgtatatcttgtgatcaacaactcgctgacagaggcaaccaccgtagagcttccgaagagcgcagagcgctacacactcgccggcgagggcggcaacgtgcgtgccgctgtcatgactttaaatggcaagccacttgttctgggtgccggcaattcgcttccggaactcactccggcagcacaggaagccggaacagtgactcttgcaccggcaacctgtacattcttcgtactgtaagcagcgcggggaagcaatctgcaccgatgagtaagccgtataagctggctagtaagttgcattactggctacagtggggcttaagtaagttgcaacggcatgtgcgttaatacttgtatcggctggctggcaatataccggtatgtaatctgtaatgactggctgcatggataggtacgttgcatacactggctgggctgcaacgttgtgtgacctgcaacgactgggtaaatttgtaagttacatcgactggcaagctgcagggctgagccttacatgcacccacaggagctttcttggtcaatcattgtttgctgatgttgtgcataagatcaaaacgggtctacagaggactttttctctctgtagacccgtttttgcgtacaatcttctatttttttgacttacatggctgcattttggcttccgccgggtctggcgacactctttttctctcccagacccgaaatcagtttcttttcgggtctcacgggctggtttttcattcccagacccgcgaacagcccttttttcttcccacgcgcataataacaaggtcccggcgggtctggagagacgttttttctctctcagacccgccggaaccttgcacaagaccatttttcttcttaatatccggtcggacggtcttttttcccgaccttgaggcgtgacatcgcgcgcgccagcgatgctttggaacgataatactcctgaatgctctgtttctggcggagctgctcctgtgcacgctcttttgcctcctcggcacgccgcacatcgatctcctccggggactcacaggtgtcaacaatcaccattgcacggttattgatgatctgtgcaaatccggtgcctgtcacacccacgatctcctcgcctgtttcgtccgtgatgcggatctcgccgatctcaacggcaaacaccatattttcgtgatgcgcctggattgctttctctccgtcatgcagcggcagaacgacctgctcacatcttccgtcaaaaaagacacggtcacaggcaatcactttcagactaaatgtattcatgcccccatctccttcgcacgctcgatcacatcatcgatcgtacctacattgaagaacgctgcttccggatactcatccatctcaccgtcaataattgccttgaatcctcttaccgtctccttaagcggcacatacttgcccggcacgccggtaaagttctctgccacgtggaacggctgggataagaacttctggatctttcttgcacggtataccacgagcttatcctcctcggacagctcctccataccgagaattgcaatgatatcctgcagttctgtgtacttctgtaaaatctcctgtactcttctggcggtctcataatgctcttttccaacgacgtcctcctcaaggatacgggagttggactcaagcggatccaccgccggataaataccctgctctacgatctttctggaaagtaccgtggtggcatccagatgtgcaaatgtcgtcgccggagccgggtctgtcaggtcatctgccggcacgtaaacagcctgtaccgaagtaacagatccgttctttgtggaagcaatccgctcctgcagttcgcccatctccgtcgccagggtcggctgataacctactgcggacggcatacgtccaagcagcgcggatacctcagatcctgcctgtgtaaaacggaaaatattatcgatgaacagaagtacattctgatgctcctcatcgcggaaatattctgccatcgtaagtcccgtctcagcaactctcatacgtgctcccggcggctcgttcatctgtccgaacactaacgccgtcttatccagtacgccggattccttcatctcagaccacaggtcatttccctctctggaacgctctccgacgccggtaaaaatggaatatccgccatgctctgtcgcaatgttgcggatcagctcctgaatcaataccgtcttaccgactccggcacctccgaagagaccgatcttaccgccctttgcatacggtgccaaaagatcgatgaccttaataccggtctcaagcacctcaacgaccgggctctggtcttcaaaagatggcggatctctgtgaatcacccagtgttcctcaccgtcaaggctttcgcctccgtcgagtgtatctccgagcacgttaaacagtctgcccagggtcttatttccaaccggaaccttgataccgccgccctcggcaataacctccatatccttgcataagccctcgcttgccgcgagcatgatgcagcggacagtattattgccgatgtgctgtgcaacctccatcacgcagcgctttccgttgttgtccacttcaagcgcatctttaatatatggaaggtcattatcttcaaattctacgtcaacgacaggtcccatgacctgtacaattttccctttcttcatacaagctcccttccgctttatttctttttcttgttcttctgcgctttcgcaccgccgctcacctctgtgatctgctgtgtgatcgccgcctgccgtacccggttgtattcgatcgacagcgtctgtatcatgtccttcgcgctgtccgttgccgcctgcattgccatcattctggaattatgctcgctggcaaacgactctaccagcgcacagtagatatatccggtgacatagttcggtactacatgctccagaatcgcctccatggatgactccacccggatctcctcctggtagatatccgccggggcaggatgcaggaagtcttcctttacaagcggaagaagtttcatcttctccgcattcatagaaaaagagttttccatctttgtgtagatgatatatacctcatcaagctcattttccgcgtacagatccatgacgtgatccgcaatgacacgcgcgcggtgaagcgacgggttctgcacggtatacttgaactccgcatccaccgcgagaccctctttcgcaaaatactggcgtccgagctcgccgacgacaaacagcttattgttctcgccctgcgtgaaaagctcatgcgccatcttgatgacgttgtggttgtatgctcctgccagacccttatccgcagtgatcacgatatatccacgccgcttttcttcctccgggatctccttcttctggtcaaaatagcggttctgcacctccggaatgtggcgcaggaatctggaaatggaaccctgaagtgcatagaaataaggttccgtctgctcaagcttctgcttggcactgcgcagtttggcagaggatatcatatacatggcgcttgtaatcttcatggtatcccggatacttttcattcgcttttgaatttccttggtatttgccatgctctatcacctgctcttatattctttaaccgcctctacaatctgctccgtaatcgcatcatccagcactttttcctcgttgatcttcgtcacaagctccgcgtgctgtacatggatgtaatctaacatacccagctggaattctttcgtctttgccgtgtctacgtccagcatcagacgcttgttggcagcgaccagcgtgatgacctgatccgccaggctcatcggatggcagagcggctgctttaacagctccatcaggcattttccgtgctgtaactgctcttttgtcatgtcgtccagatcggatgcaaactgtgtgaacacttccatctcacgatactgcgccagatcaatacggatcgtaccggacgctttcttcatcgccttggtctgcgccgcaccgccgacacgggatacggagagaccgacgttgactgccggacgcatacctgagaaaaacagatcactctccaaaaagatctgaccgtctgtgatggagatcacgttggtcggaatgtatgcggatacatcgcccgcctgcgtctcaatgatcggcagcgccgtgatggaacctccgcccagctcatcggaaagcttgctggaacgctccagcagtctggaatgcagataaaatacgtctcccggataagcctcacgtcccggagaacgctccagcaaaagggacagtgcacgatatgccactgcgtgcttggagaggtcatcatatacgatgaggacatccttgccctgatgcatgaaatactctgccatagcggttcccgcatacggtgcaatgtactgtaacgatgccgactcgctggctgtcgatgataaaatgatggagtagtccatcgcatcattcttcgtcaatgtattcacaagctttgctacggtcgatgccttctgaccgatcgccacataaatacagatcacatcttttcccttctggttcaagatggtatctactgcgatcgacgtcttaccggtctgtctgtcgccgataatcagctcccgctgcccgcgtccgatcgggaacatggcgtcaatcgccagaataccggtctcgagcggctgcttgaccgactgacggtcaacaatgcccggcgcttcctgctcgatcgggcggtaatcgtccgccggaatctctcccttgccgtcgatcggcgctcccagtgcatttacaattcttccaagataggcatttccgactggaacacccgccttcttcttcgtgcgtgtgacctttgtgccctctttgatgccagtgtcttttccgagaatgatacagccgatctgatcgcgcttgatatcctgcaccatacctctgacgccattctcgaagatcacgatctcaccatacatggcatgctcaatgccatagatggtcgcaattccgtctcctacccagatgacagagccgacttcctgctcaccggtcaccatatcataattttctatctctgttttcagtatggagataatctcctctgaatttatggaacccacgtcatcacctccatgtcaatttttgttctaaattcttgatccgcccccggacgctgtaatcttccaccagatctcccgtctccagcacaaatccgccgatcagttccggctgtgtgcagatggtaagctccaccgtctctctgtggtgctttgcggcgagatatgctttgatctgtgcaagctgctcctcatccggtgtacccgcgcagtacataacggtctttaaaattccatttgcctcatcgtagcagcgcgtatacgctttaaagacatcctccatctccgatacgtttccgtggtcgcacatttcttttaagaaattccagacctctttcggaaacagctgctcaatcagcctgtgtttttccctgccggataccaccggacagtccagcacgcgcggcaattcgccagtcagtgagaaaatccgcttcatctcttccacagtctctttctccacgcccagctcaaaaagaaccgttccgtaattatttgctgtttgtgtcatttaaaccacccgttttcgccaaaaactgttcatacataagcttgttctgcgctgcctgatccgtgtcgcccaataccttagcggttgccgccatggcaagtcccgcaatctgcgactgcagctcctgcacggttttctcacgctcaaggtcaatcgacttgtgtgcgttggcgataattttctgcgcctctgcatccgctgcatccatacggctctcatactccgcctgtgcgctctttctcgctttttcaacgatctgcgccgattcctcatgcgcctgctttaaggcgtcctcatactgcgctttcagctcatttgcctgctcatttacatggcgtgcgtccgccatctgcccttcgatcagctgcttgcgctgatccatcactttcgtgaccggtccgatcaaaaatttgcggagccccagatataatacgatcagattgacgatggtaaagatgacattccagtcgattctaagtaactgcatactctaccataacctttccttagcctaagaataagatgattaagattgctactaccataccgaaaattgcagtaccctctgccagtgcacatccaagtaacagtgcctttgtgatctttccgtcagcctccggctgtcttgcgatagcgtctgttgccttggaagttgcaagtccgataccgatacctgctccaatacctgtaagtgctgcgattcctgctccgattgcgattaaagatgtcataataatgttctccttttctttttcgatttgattactcgatggtttccttaataaaaagtgatgttaaaaatacaaatacatatgcctgaatgaatccgtcaaacaggtcaaagtagagactgagcggtaccggcacaagtaacggtgccacgatcttgatcagctccatgataacgaatgcgcctaagatattaccgaaaagtcgcatacacagtgataacggccggataaatatttccagaatattcatcggcagcataagcgggatcggttccgcaaagctctttaaaaagcccttgacgccttttttatgtacgcccgaaaattcaatcagaacgatactcatcagtgcgagagcacctgtgacgcccacatccttggttggagacttgagaccgaacagaccgatcatattggctacgccgatatacagccctacggtcatcagatatgggatatacccctttccatcctcccccaggagatcataaaagaagttgtataagcctcccactaccgtttccagtacaacctgtttcttgccgacattctctactttcaggttgcgcacaagaatgatcgagccgagcaacagcactgccatgatgatccacgtgaccacgaccgactccgccacagggattccgccaaaaacggggatcgtgaacgcagtctcacagttcagctcttccatcagctgctttgatagttcctccgtattaccacttcctttctctttttttgtgttcctattttatgaagtttcccattaaatgtcaatttcgtcaaaagttctaattttacgttctgtttttgtgcaacatgcacggagagattgtgatttttttcacattttccgcctttttacaaattgaaaattgcaaaaatatacatttagtcaaaaatgtcttccattgtttgtaaaaaatatcggtttccatagatagaactttctatctatttgaacggacttcctacctattttgacctttccttaacaaatacacccaaaaagaggcagccgtcccttttcgtgaagctggattttgataagtagcattataagaaactcgcactttgcggtttccgttggaaatgcagatggaaattcggtcaaaaaatatggcatttctaaccagccagatgtttgcatcttcgatgatccgtgtctttccaagtttggaacaatccgcgggtcaggtccgcccattgtctccggtgtgccggacatgcacccgtcggatagtcaaaacgtggaagagacacggaatctgatgcaaacatccaactggtagaaatgctcacatttttctccaacgaatattccatctgcatttccaacggaaatctgcatatgtgcttcttataatgctgcttatcacatcaactgcacgaaaaaggggctgcacgcttaatgtgcagccccttaacaagcctatattattttcttctggactcaagttcttttacgtttgcctctaccttcgccttggaaagcggatatataagtaacagtgccagtccgcataatgcatagatgattgccgggaagaaggtggacagattgtagattccatttgcaacttcctgcgtctggcttgttgccagctcatcataaccgatccagccaagtgcccatccggaaagtccgcccgcaattgcctgaccgatctttcttgcgaaagagtacataccgtatacggtaccatcatctctggtgtgattcttcacttccatgtcatcgataacgtccgttaccagtgcccagcactgcatctggaagaaatacataccgatcatggcaaggaatgccagtccgacgaacagccatacattctttacatgcagtacgccaataataaaatataatcctgcggagataaacattccgataagactgcactctttctttccgtacttcacggcaagctttgtggacactgcggaaagtacaagcacgcacggaagcatcagcagcgaatatacggataatgctgcagtgttcttaaagtaatctgcaaacagatactggttgatgccctgggacattaaagatgccaacaacaacagcactgccgagagaatcaggcccatcagcgatctgctggaaaacagtgcggaaaccgtctgtccgaacgtcttcttctggacatccggcttcggtacatacgcgacacgttctgttgtcagcgtatagcataacagatagcagataacggcaagtacggaaaagattcctgcgatcatggaaattttggacgcggatacgaccttgtttcctgcctcatcggtgtaatataccaccatcggtgcaagcataccgatcaggatacctgccagcgtaccgcccagagaacggaacacagataaggagcttcggtccttcggctcgctggaaataacagatgccatggatccatatggaatatttacggatgtatagaaaatggatccccataaaatgtaagtgatgaacatgtaagcaacttttgctgcatacggtgcatctaccagaaatgactggtacatcatgaacgatgccagtgcaacaaatgcgcacatacgcagaatccacggacggatgcgtccgttcttggtcggcttgctgttatcaacaatgcgtcccattccgatgtcggtaaatgcatccagacatcttgcaagcaggaacatggtacctaccataccagcagagactcccatgacctttgtgtaaaataccattacatagctgctggcgaaaatgaatgtaaaatcattcgcaatatcaccgcacatgtaaccgattttgtcctttacgccaaacggcttggtgtttgtgtttcccataatgcgcctcctgtagcagaccgccccatgcggtctctttgatggttttattatagcaacttccctttccctgtactttgcctttttttgtttgacacggattatttttgtgttatatttattttgtactaaaattttttcacgttgttatttgcagctaacagtttccggatcaagcaaggaggattcttatggcattgccctatatttccgtggaggactgttttccggtcatccgccagaccatcttagacacctacaaagtcgactcttttctgatgcattatccctactccgatctggagcggctggacatggggcttcgcaaaatggtctggggaacctactccacaaattctgccatcttctccctgtctcccgagcaggatgcctggcagattatcgtgttaaaaagtgttctgggcttttacaatctgattatcacagttacaaacgaggagcatcccgatatgtttggcttcatgccgttccgtaccgaacctgcaactccggctgtcatcaaccgcatcatgaaggagaacggcattccgccacagtatacatccagcatgcagcaggtctactacaatcttcccgtcgtggaaatgcagagtctgatcaccacactgcagcatctgatcactgcatttatccccgggtttgcagccaatcacgtcgagtatatcaattatacctccgaacagcacgaagttgactttaacgaggaacggattcacaaatttacttccgattatatggcaaacctcgccgaacacataaaatcctgtggcgatgctgtcatcaccggtgatcagacagcctcctccgaaagcatgaaatccctgttgaattttgcggtttctttttccgagacaccactctcccagttaaaggaatatctctcctacatcaacacttttctgtctgccaaaatgatggacacacaggtgcatcccgcctatatctttaagcagatgcatacctttcagcttaaaattaacgagaccgtgcaggcgcaggaactgcagcatcttccttatgaaatggtacgcaaatactgcctgctcgtgaaaaactttacctatgacaattattcctatctgatacgaagcgtggtcaattatatcaaccaacacctgtcctcggaattatcgctcgccacgcttgcttcggaatttggcaaaaatgcttcttacctctccagcgaatttaaaaaggaagtcggcgacacactcacaacttatatcaacaagcaccgcattctcgcctcgctgcgttactttaacaccacggacatgagcgttgcggaagtatccaacgccgtcggctacaccgatatgggctatttttcacgcctcttccggaaatatgtaggacagagtcctcgcgaatataaaaagatgctggataaatgacattttatgccccactatctgcgctcttccagataccactccgcctcccgcaccgtatccaccagaacctccatcgcctccagcggatattctcctgcagcggtctcgcccgtcagcatcacagatgccgcgccctgctgcaccgcgcggaatatatcggacacttccgcccgcgtcggcaccgcccgatgctccatggaggcgagcatctgcgtgacaaccataaacgcgcgcccgtgctttctacactgagccgcaatctcctcctgcgcgcacggaagctttgccagaggcatcgcattccccagatctcctctggcgatcacgatctcatcgcagtgtggcaacagctcccccagatgctccattccctgcagattctcaatctttgcgaaaatgcggatgtctccggcatcctcatttattaaagcttcttttaagttctttaagtcttcttgatttctcacgaatggaagcatgacccctgtgatcctgcactgctttactctggcaagattcctgtaatcacgctccgtcagcgtcggtgtctgtatctccacaccgggcgccgcgatacttttcccgctttttaagacgccgccccgcacaacggtacattccaccgcgacagacgatccgcagcggaattgttcttctacttttaatgcaatcctgccgtcgtccagcaaaatctcctgtccgggcgcaagcgccacaagcagcgttcccggcaccggaatctccgtcggatcaaacagattgttttgtccgtccgccacaaggctcagaccgtctccctcttttaaaagacgctctgccccaagcgtaccgatgcggagctccggtccccgcaagtcaatcagaatctctggcgttccgtcatgcagccggctccatgcgctgtggatgccggagatccacgcatccgcttcttccagatccgcatgggacagattgattctgattcctgtcattcctttttcaaacaaatgaaccagcatctctgtatcacagcatgctggtccgatggttccgtaaatttttgtcttcattatactcttctctccgcgcagctgctctgctgcgccgcccgtgattcgatcgtgcggcagattctcccgccgcttgttctatagcatctttttcttacgcagtatcagcatcgtgataatgcagatcaacagagtcagcacacagatcagcaaaaatccgtgcggcgtattagcaaacggcatccaccgctcatccacgttcattccatagataccggaaatgaccgtcggaatcgccatgacaatcgtgattgaggtcagatacttcatgacgttgttcaggcggttgtcaatcacggaggacatcagttctctggtaccgttgatgatgtcacggtagatggaagtcatctcgatcgcctgctggttctcgactatgacatcccccagaagctccgtatcctccgggtactgctccagtctcttatagcgcgtcagccggtctaacaccacgccgtttgcacgcagggatgtggcgaaatagaccagcgtggactccagttcgtgcagatcaatcagatccacgtcctcggtgtgttgtccgatccgctcctcaatctccgtgcggcgcttgtcaatgatgcgcaggttggtctgatagattgtcgcggtgcggtacagaatctggtacacaaagcgcagacgctttttcgtgctgaactccttcacgcggttgatcacaaaattcttgagcaccggcgtatcctccgtgcacaccgtcacgatcacatcctgcgttaagataatgccgagcggaattgtcgtgtaggactgcttatcgtgccggatctccgtcgtcggaacgtccaccagaatcagcgtatatccgtcctgcagctcgatacgggagctttcctcctcatcgagtgctgccttgatatcgtcgatatccacattcagcacatcggcaatctcctcacattcctcctgcgtgggactgatcatccgcacccacacgccgtcctgcagcttctcctcctcatgtatcacctgattatcggtcataaaatatttcatcatagcttttgccctatatcctctctacctgtcatatagaatctgatatgcattcagactgagttttcttgcaaactttgtccctgcatttttaatctgaccgcaatactcaaatccatacgcctcatgcagatgaatgctcgccgcattctcactggtgattaaagagatgaccgtgtcaatctcctcacactccgccgcataggcaagcacgttctccatcaggctgcggccgatgccacgccctcgataatccttgtgtacataaatcgatatctccaccgccgggtcaaatgccttacggtccctgtaacgggaaagcgacgcatatcccgccaccttgccgtcctccacatcaacataaatgacatagcgcccgttatgctccgcaaaccatgccttccggttctccatgtctttgacttccgtatcaaacgttgccgtcgtgtgaagaatcgcttcattatatatatccatcaatgcaggaatatcctgcagtaccgctctgcgtatcattctcttaccagctttcgtgtcctaaaatgtctctgtaacagaaaacgccttcggaatccgaaggcgttttcccttttttatcatatcacagtttttctggcacttctacgctaaatttgcaaaatcacaggaaatcacgcgccacgtttccgctccggaagctgcgccagaatgattgcagcaaacatcagcacacagccggaaagctcacgtaccgagagcgcctgccctaatattacccagcctgcaatcaatgaaattaccgactccaggctgaggattaaggacgccaccgttgggttcatgccacgctgtccgacaatctggagtgtgtacgccacgccacaggaaaaaacacctgcgtacagcacaggaacccacgcctgcagaaccgctcccatatccggtttctcaaacagccacatgcagaccgccgacagcagtgcacacacaaaaaactggatgcacgacatttttacaccgtccgccagcggcgcaaaataatcaataacaagaatgtgcgccgaaaatgcaaatgccgacagcagaacgaacagatctcccttctgcagggaaaagctgccatctgtcatacataaaatgtataaccccgcgacagccagcgccacagcggcccagattttgattcccgccttttttcctaaaaaaatacttaatatcggcaccagcacaatgtacatcgctgtgataaatcccgccttgcctactgttgtatactgtattccgatctgttgcagattgcctgccacaaaaagcatgaccccgcagcagattccgccaagcagcagatttttccggcttcccggtgtctttccggcatcctcttcctttgcacctgttctatgaaacactgcaatacatgggatcagcactaacccgccaatcacattccgcactacgttaaaggtaaacggtccgatataatccattccaacactctgcgccacaaacgcaacgccccagatcgttgccgtcaaaagcagcagcaaagattgtctcatcacaaatttattcatcactctactacagaacgctccgcaggaactgtcttgcctctggcgtcttcggattggaaaaaatctcctccggctttccttcctcaagaattcttccatccgccataaagacaaccttgtccgcaagtccgacttttccgatccgttcttttgcaagagcctctgcccttcctttctccatcttttttacatgaacaggcgccagcattacattctcaagtacagtcttgtgtgggaacagattgaatctcccgcacataacagtccgccaggccggcaatcgcctcctgatcatttctgctcgtctcatcgtaaaaccccaccgtataaaacccggctgcctttgccgtcttaatcgcatagagcgcatcctcgaacacccaggtgtccgccgggtgcgtaccaagtgcctttgccgctgccagatagatgtccggcctttcttttcccgcgccgatctccgtgcaggtaaaaatctgtttaaaatagccggcaagtcctgtccgcgcgagcgccgcctccaccatcggccggttcgtcgcggtggcgaccgccatcggtattccctgctttttgagcgattccagatatgccgcaacgcccggcttcggcagaacctcatcccggtatgccgcaaacacaatcgcgtccatgtccgtcacaatcgtatcggggggatccggcaaattgtacttttccttcacatacacagctccgtcccgcatgctcatgggaaaaagcacatctccgagcccttcttccggttcgattccccggttccgcaaatactgctcgccgacgtgaacccacacctgcatggagtctagcagcgtgccgtccatatcaaaaatggcacccttcattcctgatcccccgccatttcctctgccagagcgtgcagacgcctcgtcgccgcctcgatatccttctgtgcaaaaatggcgctgatcacggcaacgccgcacagaccgtttccgcgcagctgcagaagattctcctccttgatgccgccgatcgcaatgaccggaatctttaccgtctcgcagatggcacgtatcgtctccgcatcaatgtgtcccgcctccggtttggaactggtcgtaaacgcagcgccaacgcccaaataatccgcgccatggcgttctgcgcggagcgcttcttccacattatgcgcagatacgccgatgattttgtcagcgcccagaatggcacgcacatcgccggcttccatatcatcctgcccgacatgcaccccgtccgcgtcaatctctttcgcaagcgccacgtcgtcgttgatcacaaacggcacgccgtaccgccggcacactgcctggatctccaacgcctccgcacggagtgcttccccggtcagctttttttcccgcagctggacaaatgtcgcgcctccccggagcgcttcttccacctgcgcccccagcgttgttccctcgctccagcttcgatcagtcactgcataaagcagcagatctcttttatcgcacttcataacgaatccttccctccagcattttctggtccatccggtacacagcatcaatgataccggtcccgtaggaggcatttccgccgcataaaccgcgctgctcccatgcaatctctcctgctgcattcatcacgcagactgccgccgcgaccgcctccataccgcgcgccgcgcatgctgctcctcccgcagtattcccgccggtgcttccagctggcgcttccatattccgtgccaccgcgaggaacgccgccgcaagtccggaaagctggcacccggttccggtcacccggctcatctcctctctccctccgcggatcaccacacactgctgtccgtccgagacaagatcgatcgcaccggtcaccgccaccaccgcgccaaggcgcttagagaccgcctttacaaatgtgaccgcctccgcgagcgtctcctccgtgaccacatccaccggacgcacatccacaccgcccgcggcgccggccgccttcttttccgccagttcagaaagtgtccggatctccgacatattgccgcgtatggcggtaaacgtcaccgcctgcagcagctcttctgccattttccggcgaaatgtacttgcaccaacaccgaccggatcaagcagtaccggaatcccgttcgcgtttgccgcctttcccgccgcaagcattgcctgctctctgcgttccccaggagttcccatattaagagcgagcgctcccgcatgcgccgtgatctctcccatctcctgcggctcgtccgccatgaccggattcgctccgcacgccagaatcatgttcgccacgtcatgcgccgtcacatagttggtgatgcagtgtacccgcggcgccgccgctcttattttttccagatattcatatgcttccaagtaatgcttcccctttttcaacgccattttataaatatattccattttttagaaatttcttacactatattaagacattcttcattttgccgtcaagcttccgacacattttcccgataagatagaatcatcaaaaggagctgttgagtttcgacgcgggggttggggttctgtcagttccgcctaaaaactctctcaccggcactgccggcgggttttatatatattccatataccatattacactatttcaaaaagcctttcggaagtccctcctacacttccgaaaggctttttgtcatttatccacaagactgctcttctgcgggctcgaccgccgcagcgccgcctgactgcgcgttccagcggctctcgggaatctcccgctcccgcagtctttttttcacaaacatggcaaacagtgcgtacagcacggagcaaagcggaatgaacaccagaatacccaggatgccgaacatgttgccgccgacggtcactgccaccagcacccagatggagggcagtccgatggagtttcccaccacgtgcggatagatcaggtttccctcaatctgctgcaacaccaaaaacagcaccagaaaccacaccgcctgcaccggatctaccatcacgatcagaagcattccgatgacacagccgataaatgcgccgaaaatcggaatcagcgccgttatcgcaatcacgattccggtcagcattgcatacggcatccccagaatcgacatggtaatgacaaacaaggtgccgagaatcaccgcctccacgcactgcccggacaggaaactggaaaacacctgattggacagggctgccaccgagagaatcttctccgtgatcttctccggaaagacagcgtacagaatctgttttgcctgtctcgccagacgctccttctggaacagcacatagatggaaaacgtaaacgcaatcacaaacgtcaccacaccgctcacgatcccggaaaaaataccaacgccggagctcacaacccccgccgcaaaattctgcacaaacgtcacaatcgagtcggcaagcgatgaccagtcaatattaagctccgccaccgcaggggcaagtgccggatagctgtccggaagatctgtcagccacttctgtacggcttttaccgcaaccggaacctgctgtacaatcatggaaatcgtatttccaagctccggtatcacgaccacaagtgccagcgtgataataccgatcacaagcgcaagcgtcagcagataggcaacgggtcttctccattttgcaagcttcccgttcttcgcaaacagatgccgctcgatactcttcatcggaacattgatcacgaatgcgatcgcgcctccaaccagaaacggcatcacaatccccagcacaaaatccaccgctccgatcaccacgtcaaaatgctccatcccgcaatagagcagaatcccaaatgcaatgatctgcatcagccgtttccgcgtctcttttgatatctccatacttactctcttcctctctttctctcctacaccaccgcaatctgcgcggttcccatccctacacagatcagataaagaaccaatagatgcaccgggtagaacgcatagaacaggtactttatgttccatccgcgcttcccattatagaacgcaatcgggataaacgccacgatcgccggaagttcccagcagaacgccaggcagcctgccacgatctgtagtccccgcatctgtctcgtcatataaaataccagaattgcgagcacgccttttgcatcataatctgtgtgtagcagataggccgcacccattcccccgaatgtgatgatgacaagcagcgcactgcgcaaaaccggatgccactcctgctttttcaccaccgcatcaaacagcatgatcgtaagcagcccgatcagcagcgtgaaaaatacattctgatagccgaattccagtattttcccggaaaatgccagatcgaacggtatctccgacagcagggcaaatccaaacagccgaagtgcatattttttccggctgcccgtgtaaaaaaatccctccacaagcagaaaacagaaaatagggaatgccactctgccgacggcgcgcatcgcataatagatcttatagagcatctcactcccctgcccggcaatcagcagtctggcaatgaccgccgctccgatatggtcgatcagcatcgtgatgatcgcgatcaacttcaatgtgcttccgctcaatcctttttgaggcatcttccccaccgtccttttcttcctatgaaaaaaagaggagaccaggctgtttcgtccatctcctcttcgtgtatgtcgtcctaacctacaaattcttccacacatctgcggtatgccgctaccggatccgccgcctgtgtgatcggtcttccgactacgatgtaatccgatccgagttcctttgcctttgcaggtgtcgtcacacgcttctgatctcccacatcgccgtccgcgaaacgcacgcccggtgtgatcgtcaaaaacttttctccgcagactgcatgtaccttgcctgcctcaagcggcgagcatacgactccgtccagtcctgcttccatggtatttttcgcatagtgcatgaccgtctcatcgatcggcttgtcaatccacagttcctgctgcatcacttcctcgctcgtggaggtaagctgcgtcaccgcgatcagcagcggtctgctgccgtccgctctcgtcagtccctccagtgccgcctgcatcatgcccttcgttcccgctgcatgtacattgcacatatcgacatccagtcccgagagaaccgccatcgcctttttcaccgtgttcggaatgtcatgaagcttcagatcaaggaagatcttgtgtcccatccccttgatggtacgcacgatgtccggtccttccgcataaaaaagctccattccaatcttgacgaacggcttctcgtccttgaacttctcaagaaacgcaatgacttctgccttactgttaaaatcacatgcaataataacgtcttttcccatgtcttcctcccgtgttcttcactcgcaaatcatcagtgcaattatacactgcaccgggggctttgacaaggcaattcgcgttctgttgacagaatctttatccttgatcctttttcctttcatcgcaataaaactccttctttcatccaaaaattccggttgtggcaagtgatattcctgcatcgttctgcgtattgtcgggattccccatcgtcctgattggaaaaactggacagcgaatcatataaatgtctgggacatccctggtttgcactctttatctgttggagtttcacatttaagtttctgaattaactctaatttttcaagtaattctttcgttgtcattttagttctccccatatttttatatcgtatcactattttttgtgtaagaaactcaaattttatttcacgaactcaaaaaggaactcaaataatttgagttcctttttgagttccttcctatggatatcacccggcattaaatgcccatacagactaaagcccatacataaaaaggagccacagagtgactcctccagtgcagtccgaaaacatacacctctttcattacatataatatatcttatatccttgaaaaatgcaagtttttattattttttcaaacattcaaatacgcctctaaccccacaacctttgccggaacattattctgtataatatgatcgtaaatctccgaagcaacactattctgcagtcgctgattctcttccttgtacttatttagcaaagtcaatgctctcgtaccactaaaatccactcgtttaagaagacagcacacaattataatataatcaatcagagaatacaacgtaatattctgaatacccgtttctttttctacccattttttaagcacggggctgattttccgatctttaaatctagtatcgaaaataatattattatgtgcaacagaattccgcagtgctttcaaagtgtaaatcatgatagaaagtaaatttttattagcatctatcgaaatatcaaacatattcatctgctttaagatattctcacgtaccgcctcatttaggcactcaaaaaaacctgccagatcactaagatatagtatttcaaaaacgacccagataggtgcatcttctcctctattataaaagtgccgcaccatttgattttctttttcttcttcatcatgatagcgcgcagctaatttggcgtacaccgaattacgcaatttaaggcgttttgactgcaatttcgtatttgtcgtattatcactcatacgttctttataaagatgctcaaaagtgccaagcttaagacctttcactgattcattgcacacaatatttttaagtgctgtctcaataaacataagttccggatacagcgctgccttcaaattattatcatactcaataaccgctaccacctcgctgaaatcagaatatggaatctgcctgtaactatttccggcaaaacggtatcccttatacccatgataatagccatagcttgttaattgctgtttttgataacttccgctaatttgtattttgcaatcatttctcaaatgccgcattaacccattgattgtctgcggagagttcattcaggttcctcctctcgtcattgtttgtattgcttttgtaattattttaacaaaatccatcctatctgacaagcagtgaacctattatcaggcaagaaagtgtactatcttctctcttaacattcatgatccttttcttctgatattctatacacaaaaaaccgccaacccttgatctctctaaggttgacggcttcttaccagtcagtcgatgcgacaggattcgaacctgcgacctctgcgtcccgaacgcagcgctctaccaagctgagccacgcatcgatatttgtgaagcactttgttgtctctcaaatcgtgcttaattatattatcacaagtttttctgtttgtccagaaaaattttgtatttttttaatttttttgaaatttcaaacaaagccgcctaaattttgtgatatactgtgcgtgaacactgcatactaacacattcacaatatagaagaaaggtctttcatcatgtataaaaccgtactcattaccggcgcctcacgcggcatcgggcgggcgatcgcctgcgcctttgccagggagggctgccgtctggtcatcaactgttcccactccgaaaaggagctgctggcgctggcagacgaattaagggaaacctgccatgtggacgtactcaccagcatcggcgacgtatcggactatacctatatggaacagcttttctcccaaagcgaagcccgcttcggcggcgttgacattctcgtaaacaatgccggcatctcacatatcggtctgctggaagatatgaccatcgatgagtggaaccgcatcatcggcgtcaatctgacctccgtcttttccgcgagcaagcttgccctgccacacatgatccaccagaaatccgggaaaatcttaaacatctcctcgatctggggaaatgtcggcgcctcctgcgaggtcgcatactccgcctgcaaaggcggcatcaattcctttacccgcgccctcgccaaggagctcgcaccgagcagcatccaggtcaacgcgattgcctgcggcgtgatcgacaccgagatgaatgcctgcttttccgcagaagagcgcgcccagctcgccgaggagatccccgccgggcgcttcggcgcgccggaggaagtggcatcgcttgccgtgcagattaccaccggaaacgactacctgaccgggcagatcatcaccctcgacggcggctacctctaggagccgcagcgcaggcaacgggcattccccaaggatttctgcccgcttcacccgcttactctgccaccagtacgatcgccgtgcgcggcggaaccttcaatgtcttcttataataaaactctgtgtaggactccatatccctgccatcctcgtacttcacggacgtgttgacacacactttccactgaagcccgttcggcagttccggaagctgcatcactaacgtctcccagtaagcattcatacaatagaacacaatatcgtcccgcgtgtcgtgctcatctcttcccgcatacatgatgccgatgagccggctgttagaatccgtaccgccgttccacggataaccgttgtgaatgctgatctccggcagattgcatgccaccggcttcgtcttcttgcgcagaatggcatagcgcttccggaaaccgatcatataccgcacaaaatcatgaatctcccggtatttttccagtctcgtccagtccagccaggatatgatattgtcctgacagtaggcattgttgttgccaaactgcgtgttgcagaactcgtcgccgccgtagaacatcgccggtccgcggctgcagagcagcgtcgcaaacgcatttttcaccatgcgccggcgcagtccctcgatctgcggatcgtccgtctctccctcggcgccgcagttccagctgtttccgttgttgtcgccgtccgtattgttccagccgtttttctcattgtgcttcgtattgtacgagtacagatcatagagcgtaaaaccgtcatggcaggtcaggaaattcaccgatgcgctctcacctctgtgcaccggatcgtacagatctgtcgaaccgatgatgcggttgatcgcggttcccgccatgcccccgtcgccctttaaaaagcggcgcatatcatctctgtatctgccgttccactctgaccacctgcgaaacgccgggaaggttcccacctggtaaagtcctgccgcatcccacgcctcggcgatcagcttcacatgccccaggatcgggtcgcaggcgatcccctgtaaaatcggcgggtccggcatcggcgccccgttctggtcacgcgtcagaatcgaagccagatcgaaccggaaaccgtccacgcggtactccatcacccagtagcgcaggcagtcaatgataaacttgcgcatgatcgggtggttgcagttcatggcattgccacatccgctgaaattgtagtaatgtccatccggcgtcagcatataataaatattattatcaatgcccttaaacgaaaaacacggtccattctcatttccctcggcagtatggttaaacacgacatccagaatgacttccatgccgtttgccttgagttcactgatcagcagctttaactcgtctccctcgtgattgtgctctaccacggacgagtagctggtgttcggcgcaaaaaagctcaccgtattgtacccccagtaattgtacaactgcacgccgtccaccacgcgggcgctctccatctcatcgaactcaaaaatcgggagaagctcgatcgcgttgacaccaagatccttcagatacggaatcttctggcgcagtccctcaaacgtgccgcctgccgtcaccccggaagaagcgtccctggtaaatcctcttacatgtgtctcgtatatgatcagatcctccgccggaatctccgggaacgtcatttttccccagtcaaaattattctccaccacacgggcgtgatacacaaaaccctcgtcactctccggacgctcaccccagtttcgctgccctgtcaccgccttcgcaaacggatccagcagcacattgttcttgtcaaacaacagccccctggacacatcatacggtccgtccagctgaaacgcatattcaaattcatcaatcttcaagccgaataccagcattgcgaacgtgttgccaatgtgatatgcctccggatacttcagtctggcatatggctctttttcctgcggtctaaacagcagaagcgtacatcccgtcgcaccgaccgaatgaatcgtaaagctcactccccttgccgtcggcactgcaccttccgaattgtaaaatcccgggcgcaccataaaaccgtcaatctcatccagtggcgggagcatgactccccgatcctgtctgtggcctaatcctgccatcgccgctcctccttcttccttttgcgtactatattactattatacgcgctccggctattttttcaactgctccggcgctcatctgcgccccttccagcgtgaaaagtatcccgttttgccgtcggctttcttgtcattttcccgccaaaatggtatcatatttacagaaatgatcctgacagaaaggaagtaatcttatgcacacattccaaccgttaccatttgatcttgtagaatttaatccatttaccaaaatcggcaaagagtgggcgctcgtcacagccggcagcagggaaaaagccaacaccatgaccgtaagctggggcggtgtcggtgtcctctggggtaaaaatgttgctttcatttttgttcgcgattcgcgctacaccaaagaattcatcgacgcgaacgaatttttctccattaccttcctgtccgggcagtaccgtgacgcgttaaattactgcggttcccattccggaagagacgaagacaagttcgccgcggcaggtcttaccctcgccacgcgccacaacatcccttacgtggatgagggcaactttgtccttctctgcgagaaaatgtctgccacccgcatcacggaagactcttttcttctccctgagatcaaggaaaaatggtacaaggacggcgatatgcacaccatgtatgtcgcggagatcatcgatattctcgcccgttaattctatttttccaaaaaggaagccacttatgtatacaatgaccgttgcgccaggggcagatgtctctggcggcttttattcactgaaagcggcgttcgccgccatgccagaagaccccacggttcccgtgaccatccgcgtcatgcctggaatctaccacgaaaaattatccctcacacgcccgaacgtcacgatcgagggcgcaggagcatccccgtccgacaccgtgatctccttcggcgattacggctacgagatcatgccggacggcatcaagcgcggaaccttccgctcctacacctttttcgtgcatgccgcagacgtcacgctgcgcaacttaaccatcgagaatactgccggcgactccaaaacgcacgggcaggcaatcgcactctacgccgaatgcgaccgttttatcgcggaatcctgccgcattctcggacatcaggatacgctttttaccggtccgcttcccccggaggaatacgagcccggcggcttccgcgggccgaccgagtccgcaccgcgcatcaacggcagacaatattatcacaactgctatatctgcggcgatatcgactttattttcggcagtgcgaccgcttactttgaaggctgtacgatcgcatccttaggacccggatatgtcaccgccgcttccacccccgaagggcaggaatacggctatgttttccacgactgccgctttgccgcggagggttgtcctcagcacgcggcctatatcggccgtccctggcgggattacgcacgggttgtcctcatggactgcgcgataggcgcccacattcatcctgccggatttcatgactggggcaaggagcacgcacacggcaccgttctttttgccgagtatcacagttatccacaggacgctgactgtggctgtgcagacagctgccgcccgtttgcacagcgtgcagactttgtggataccttagacggcgcacaggctgcccatttttccagagagcttgtgctggcgggggacgacggctggctgccgtgaccgttttcttgtatattccgccaaatgatggtaaaatactaaccataaatggattgttttgtattaaggaggttgtttttatggaagaaaagatttacaagacaatgggatcgactggcgctgcaagccttgccgtcggcatctgcgtactgacaggcggcattgcagccggaattcttctcattgtgaatggcgcgcgcttattgaagaaccgcgcgaagataatattctgatttttctttttatttgcaggcatcacagccgcatgatgcggtcacagacctgctccatcagcttttcgtcgtggcttacgaccagaagccctatttttcgttctttcacttccgccagcaggaagttccagatctggctctgggtgatgggatccagcatggtgctgatctcgtctgcaatcaggaaccgtgttctctcccccagagccctcgctatgcagaatcgctgcagttctcctccggatagttcgcccggataccggttacaccagtcccgctcaatcccgagcccctctatcacacgttcgctgatcgaatctccctcctgcagaaccgcctgcatccgcacgcgcggattgaccgcctgctccggatgctgccagatcatctgcaccgggcagtaaccgctccccggaagcggcatatcatccacacagacacgtccagtcaccggcgtgcggcagcccgccagaatctgacagagcgtcgtcttaccaaagccgctcggcgcggcgatccccagccggtcggtactccccagttccagactcacatccgacagcacctctctgctgccccccggatatttatagctgatatgttccgctttcagtctcaccggacgtttcctcctctccctctgatagttctttatgaattctctgtatacaatatgcagcgtaccctgccgccgcgtacacaagcgaccggaatctccccgtcacacgcctcccgacggtcggcgcagcgcggtgcaaacggacatcccgccggcagatctttcacgtaaggctgtgttccgggcagtgccgcaaacccgcgccccggcagcgcctcatacagcgctctcgtatatgggtgccgcaacagcgtctcgtccgcaaaatctgtcaccttcgcttcctccacggtcgtcccggcataaaacacaacgatccggtccgccacttcaagcgccagttccagatcatgtgtaatcagaagcacaccgtttccatcgtccgcaaatgtccggaaatcctgcatcgcctgttttgccagcgcaagatccatgcccggcgtcggctcgtccgcaatgatcaggcgcggctgccacatcagtgccgtcagtaaaagcacacggcgcgccatgccaccggatagttcaaacggatagagatccgcaacttcgtccgcaagcccataccttgcaaggagttcccgcatccgcgcttcctcctgccgcttttcccggtctgctccgcaaaaaagcttctgccgctttccctggtctgctccgcaaaaaagcttctgccgcttcttcgtttccccaatgatctgtctgccgaccttcatcagaggatcaagataattgacactctgcggcaccagcgcgatctccctgccgcgcagcgcctttaattccgcctcgccgcaggcgcttccccggtaaaaaatactgccgcttgcagccgcattggcggggagaattcccattatggcatgcgccagaaggctttttcccgatccgctgctcccgacgaccgcgacgatctcaccctcacgcaccgtcacattcagatcacggatcaccggaagttccccttgctttgcgctgcgcttctcatactgcgcgaaagataccgtcagatgctcgatgcgcagtaattcttttttctcttccatcgtttttctccactcaaaatcttctacagctgcgcgctcgacgggtcaagcagcgcctttaagccgctcccgatccggtcgaaaagaaccaccacgccgaccagcgccagtcccgggaagagcgccaaccaccattttccggtgctcagatacgacatgctctccgagaggatcacgccaatcgccggcttctccggcggcagtccaaagcccagaaacgtgatgctcgcctcatgcaggatcgcgtgcgggaacaataacaccagtcccacaaggaactgcggaagaatctgcggaaaaatgtgccatctggcaatgtaccacggacttttcccgagctgttttgcaatgccaacgtacgccgcctcccgcacctgcaggatctccccgcggatcacgcgcgcgaggttcggccagtgtgtcagcgccacaccgacaaccacacccttttcaccctttccaagcgcgtaggaaatcaatagcaacagcacaatatgcggaactcccatcatcagatcaatgcaccagctgatgatgccgtccgcccattttccgccgaccgccgcggcagttccaaggaaaagcgcaagcactgcgctgaccgccgacgccagcacaccgatgcggatgctcgtggagagccccgccagcgtgcgcgacagcatatcacgccccatccagtccgtcccaaacagatacttaaggcacggcggcagatttttgcgcgaaaaatccgtgaccaccgcccgctcctccagacagattccagccactgcaacggctgctaaaagcagcactgccgccagaagaaagcgccgcatccactggcgcccgttgcgtctgcccgccgtgtgggcagcaatcgtcatatgaccggttttatccatgacttctgcccctccttatctgcggatcaatcacaccgtaaagtacatttgccgcaagatttccgaggaatacgaacagtgtgctgatgaccgtgatcgccaaaagcagcgacacatcgctccccagcccggcatcaatcgctgcctgtccgagtcccggataagaaaatacctgctccacgagcaccgagccgccaaagatctcactgatggaaccaaactgcagggtgatggcaggcagcaccagattgcgcagggcatgtctttttacgatatagccgctgctctccccccgcgcacgcgaaaacagcacataatcactctccatgatcgcaaccattttctcccgggtgtgcagcgtgatgtttgccacgcccgtcagaccgagcgtcagcgccgggagaagcaggtgccggatgcgcacgccgatgcccgcctccgccgctgtcatgcctgccggcagattcatgccaaacggcagccagccgagccacacggcaaagaccatcaagagcagcagaccgatccagaatgccggcgtgcttgccagaagcagcgcatacccgcggatcagccggtccggcagacggttcttaaaataccccgccacaatgccgagcacaagccccaggattccggacaatacccacgccacgcacatcagcgcaaacgaattgccgaacttctccgcaaccacatccgcaaccgggcggttatatttcagtgaagtgcccatatctccccgcacaaaatccttcgcccagttcagatagcgctctgcgggcgggacatccttcccccagtaggactccatctgcgcccgcttctccggcgtcatgcgcatgtaagctgtcgctccgacgttcgcctgtaccggatcaatcggtgacaacgacaccagcataaacgcggcaatgctgacaccgataagcagtgtcagcatttttattacattttttataaaaaagcttatgtaatgcctgatattcattcttccctcatctatttccaggtccactggtcgacattgttgactaacgaccagccgtgaccgtgcggatgcagcttctgctccgccactgccaggccatcccgcgcaaagtagagatgatccacgttggcaaaccatacccagagtgcctcggcatccggtccgacatcttcctgtgcctgttgccagagactgtaggactcattcatatctgtcgcagcaagtgccgcatccagaagttcgtccgtcttctcattggaatatcccgtaaaattgcaggaaccgccggtataatacagctgataatcctccaccggcgagttggaaccccagccccagatgatcggatcggagtacatctttgtatacagttcgtcccagcttcccagaccttcgtacaatacattaattccaaccgctttcatctggttggagaactctgccgtgagtgcctgccgcacggaatcggacgcggaatagtacacggtaaattccgctttctgcccgtctttttccacaatgccgtcgctgtccgtatcactccatccaccgtccgcaagaatctgctctgccttttccacatcatacggaataatcatggactcgctcgaccacggcatgttatccgatacgctgtaagcgacctcgccgtagccgtttaacacatgatcgatcatggtctgacggtcaagcgcgtagttcatcgcccggcggagtgccacatcgcatgtcacatcgtttcccgccgcatacacggtatccccgtcgacaacctcgctgcccgccggaatcgacggaagcgagattcccctggaatccaccgacttacagaccagaagctgatagccgtccacctgctcgtcgctgtacaccgcagacgtgtaggcgatatccacctgtcccgcttttaccgccgcaagcgccgcgtcttcctccatgaacagaacaatgacttttttcatccgcacttcatccccgtagtagtccggattcgcctccaaaatggcctgctgtcccttgtcccactgtgtcaggatatatctgccggaaccgaccgggttctccccgtaggtcgcctcatcgtagcagtgctccggcacgataccgaacaccgccagtgtatacaaaaatgcattgtacggcttgctcatatggaaaatcaccgtggtgtcatccggcgcctccacagaatcgagcatacttaagtccgcctccgaattcggcgtggcaagcgccgtgttaaacgtaaatgccacatccgacgccgtcagcggttccccgtccgtgaacttcacatcgtcccggatgtgaaacgtccaggtcagtccgtcctcactcacgctgtaatccgtcgccagatcgttctcgaactccatatccacgttcgtccggatcagcgtcgactggatcaacggctcatggcagtgttccccgcagccccagttgatgcacgggttaaatcccgccgccggctccgacgaaggactcatcgccacgatgaccgtatccgcggttcctgccacgctctgcgccgtattcccgcctccggcgctgtcttttccctgtactgcctctgtcgccgtaccatctgcgttattgcctgtctgctccgcacctgtgctgccgcatccggcaaacagatttatcgtcactactgctgccccaagcagcgccatccatctctttttcattatttattctcccttgttaaaatcgccggcatttctgcccagtgcacaaaggatagcatgaaaaagaggggccgcacaagcccctcggggggataaaaatgacgcaaaatcaaagattatgctttgtcatattcatccagaaagtgatggcggacaccatcttttttataaccgatcacagtgtttaagttgacgttctccacactgcggaagatattcttctcaatgtaaggattcttcttgcgaagctcccggatcagatccttgatctccgcgcgcttggaacccttctccgtaccgccgcaggaagcacagctttccgtgaaacggcaggcacactgaataaagtgcaggtcattgtaattcatccagtggatgatgtcctcctcgcgcaccagatacagcggacggatcagctccatccccgggaagttcgtactgtgcagcttcggcatcatcgtctgtacctgcgccccgtaaagcattcccataaggatggtctcgatcacatcatcaaaatgatgccccagcgcaatcttgttgcagccgagctcctttgccttgctgtagagatgccctctgcgcatgcgcgcgcacaggtagcacggagattcctcctcacccgccacaatgtcaaagatctcggaagtaaataccgtgatcgggacgtttaagattctggcgttgtttacgatcgtctcgtagttgatctcattgtaccccggattcatgacgaggaataccacctcgaaattcttcttgccgtggcgctccagctcctgaaacagcttcgccatcaacatggaatcttttcctccggaaatacagacggcgatcttgtccccgtcctggatcagctcgtattcgttgatcgcctttgtgaacttccgccagatctctttgcggaactttttgacaatgctgcgctcgatctcgctgcagcggtccgcattcttctccccggcgtccggggcttttgtctgttccatggattccagcagcttcatgcgcaggtacgcacggtatccgccctgcacactgtatacctcataaccctcttctaaaagttcgcgcgccagctcgtcgctgcgctctcccgtatagcagatcaggtaaaccgggcggtctttgggcacctcgtctctgtgcgcctcgaactcctcccagtagatatgcttcgctcccggatatgtttctctcaaaaaatcagcttctctgcggatgtctatgataactttttcccgctcatccttctgcagttcttctatggttctctgatacatgcctgtccctcattctctattctgccgcaaggtccttgatgacctccgatgcaatgatcaaccctgccaccgatggtacaaatgcattggaacccggaatcgcacggcgctccgtacatttatgctttgctcccggcgggcagatgcagtgcgcacggcagctgatcgacatatcctcgatcggcgtaaccggctgttccttggaatataccaccttcagtttcttcaccccgcgctttttgagctcgcggcgcatgaccttcgccaacgggcagaccgacgtcttatagatgtccgccacctcaaacattgccggattcagcttgttgccggcgcccatgctgctgatgatcggcgttcctgtctctttcgcctgcatgaccagcgcaatctttgccgtcacagtatcgactgcgtccacgacatacgaatagctcgaaaaatcgaactcgtctctcgtctccggcagatagaagcacttgtgtacctccaccttgcagtccgggttgatgtcgagaatgcggtcacgcatgacctccgccttatattttcccacggtgctgcgcgttgcgatgatctgacggttcaggttggtgaggcagaccttgtcatcgtcgatcagatcgatggctcccacaccgctgcgcaccagcgcctccacggtgtagcctcccacaccgccaatgccaaaaacagcgaccctcgcacgcgagagccgctccatagcctcttttcctaataataattctgttctggaaaattgatttaacatagatactcctgtatattgtaacgtttacgcctgtccgcttctatcatatagcgtccgccgctattttgcaagttccaacatgcgctgcagcggctttgcggcacgggtcaggatctcgtcggagagcgtgatctcctcgagttctccgctgccgagcttctcaagcacctgctcgactttatcgatcgtcactttcttcatgttcgggcagaactgtctgtgtcccaccgagtagaacttcttgtccggattcttctgctgcagttcaaagaatacgcccatctccgtacaaatgatgaactttttgcagtcgctctgcgtcgcaaaatcaataatctccgacgtgcttcccacgaaatcggacatcgcaaccacgtccgcggtacactccgggtgcgtcagcaccagtgcgtccggacaggcatccttcgccgcctgcagctctgccgcatgaatgctcttgtgcacatggcaaaagccgtcgtggaagatgaaatgcttctccggcagcttctccgccacatatctgccgaggttgttgtccggcacgaagaaaatattcttctgcggaatgttggacacgactttcaccgcgttggaggaagtcacgcacacatccgataccgccttgatctccgcggtggagttcacatagcagaccactgccagatcttcgtattcctctctcacttccgcgatccggtccgccgtaatcatatgcgccatcgggcagtccgcacactcgtccgccatcacaaccgtcttatccgggtttaagatcttcgcgctctcgcccataaacgtcactccggcaaacagaatcgtcttctgcggcaccttcgtcgcaactttgctcagataaaaggaatcgcccacataatcggcgatctcctgcacggcaccgtccacataataatgcgcaagaatgacaacatccttctctttctgcaattccttgatccgcttcgctctctctgcttccatttttatctccgttctctatacatccgcttttcaggtgacaagacacctgtcacgatagattgtcattgtgatactttgatatcatatcatgttttcggcaaatgtccagagttttcctgtctctgcgcctgtttttccggggcgccccgcacttttcccatgcaataacaggccttccgcactttccacggtcaaaaacagaccctccgcactttccacggtcaaaaacagaccctccgcactttccacaggcaaaaacagaccctccggcggcacaggcaaaaccgtgctgccaaaggatccggcatttgctcttcgagcggtctcctagttctttgcaaacagggaggtggacagatatctgtctccggagtccggaagcaaagccacaatcgtcttacccttgttctccggtcttgcagccagaatggctgccgcctttaatgctgcgccggaagagatacctacgaggataccttcgctgcgtgcaaatgctcttccctctgtaaatgcgtcgtcgttctcgatcgtgataacttcatcgtacaccttggtgttgagtacgtctggaacgaatcctgcgccgataccctgaatcttgtgcgcacccggtgtacccttggataataccgggctggttgccggctctaccgcaacgatcttgacgttcggattcttctcctttaagtactcgccgacaccggttaccgttcctccggtacctacgcctgctacaaagatatctaccttaccgtctgtctgctcccagatctccggtcctgtggttgccttgtgtgctgccgggtttgccgggttcacgaactgtcctaagatcacagcgcccggtgtggactcctttaattcctctgctttggcgatagcgcccttcatgcccttcgcgccctcggtcagtaccagctctgcgccgtatgctgccagaaggtttctgcgctccacgctcatcgtatccggcagtgtcaggatggcatggtagccctttgccgctgcaactgctgcaagtccgatacctgtgttgccggaggtcggctcgataatggttgcgcccggctttaagatacccttcttctccgcatcctcgatcatcgccagtgcgatacgatcctttaccgatcctgccggatttaaatactccagctttcccaggatcgttgcatcctttacgcctgcttccgcagagtagcggttcagctttaataaaggtgtgtttccaatcaggtccagtgcgctctcagcaattttactcataataaaatcctcctgttctcaattcatttccgtttctatggtgtttttttgttttcctataaaactactatgttttgtatgaattgattataggacgctatttcttatttgtcaagcgctattttcttatttatacgatttatttttgcgcgccatccaagatactgggcaatccagattccggcgaagatcgcacaaaagattgcgacgtagccaagcacacccgcgacgctgcgctccatccagtatgccgcatacgccaccggaagcaccgagccgagtgtaatcagaaaatacgccgccgtctgaccggcaagactccatcgatccacttcccacacgaccgatcccgccgcatacaccatgccgaccagaccacacagcaccgtctgcaccacaactgcccgtatctcactccccatagcgtccacaaacgcgggcacacacggatagtagctgccgtcgccccagaatgccgacatcatgactgtgatcacatagccgatcgcaatcccggttggaattccgaacaatcctctcagtaacacattctttttcatatctctcaccgttccctttctcatattcccaacagccgcttgatctttgccacatatctgcgcgagacgtaagccgtctgccctcccgcgaggttcacgcagatcgtacccgaaaaactcaggtcaaaccgttttgccattttcagattgatgatctccgaatttgagatccgtacgaaacgcgtctgatccagctgttcctccgcctcgtaaagccgcatccgaagcagatattcgccctttgccgtcaccgcatagacttttccttttgccgcgtatacgcggataatatccgcctgctccagtatctccagtgtgtctcccgcaaaaccggagatcatctgcaccgacggctcctccagtttttttaagattccgttgacttcctcggtcattttcgctgcccggatcagtacctcggtctcctccagtgcattgtccagttcaatattgattttcacatgctcctcctctccaaaatgtcttcctctgccggcatgttttcgtgtcctcaagaactgtatttaacataacaaaaatgaggtgcctttgcaccccatttttcataagtggttcctatttgcacacgatcggttctttttcccgcactgcacacgcgagccgctccagcgcctccgtcagcacgctgcgcggacatgccacattgatccgctcgaaacctcttcccgccgcgccgaagatgtctccggaatccagccacagtccggctttttttacaatcagatcctccagctccttccctgagagccccaggctgcggaaatccacccacagcaggtacgttccctccggcttcactgcctttacctgcggaatctgttcttccagaaaatgctgcgcataggcaagattttcacggatatatgccttcaccgcgtcgtaccactcctctccataccggtacgccgcctcgcatgccacaagccccatggtgttaagctggctgtagccggatgccgcgaccgcctgctcgaacttccgccgcagcgcatcatccgggataaaaatattggagacctgaagtcccgcaaggttaaatgtcttgctcggcgccgtacaggtcaccacaaatttccggtagctttctttgagacccgccagtacctgatgcgatccctcaaagacgaaatccgcgtggatttcatcgctgaccacaatcactccgtatttttcacagatgtcgcccagccgcaggagctcctcccttgtccacacgcgtcccaccggattgtgcgggttgcagagaaaaaagagctttaccttacagctgcgcattttttcttcaaaatccgcaaaatcgatccggtatcttccgtcctctccctgcacgagcgtattatccacaaccttcctgccgttatcgcggatcacctgcgaaaacggatagtagaccggctgctgcagcagcaccgcgtcgcccggctccgtgaacgcccgcaccgcctgcgccagcgcaaaaacaatccccggcgtcttgaccagccagggttcctccacgttccatccgtaatgccgtcccatccagcccgcaaccgcctcaaagtagctgccgtccgcctcgctgtagccgaaaatgccgtgcgccacgctgtctgagagcgcctcctgtatataggaagagacctgaaaatccatgtctgcaacccaaagcggcagcacgtccttcggctttccccgctgtactgcaaaatcatatttgagtgaattggtatgtgtccggtcaatgaccgtgtcaaaatccagatttttctctgtcatgtctcttcctccgcgccgcagcgtcttctgctgttatcttatgccgtctgctcccaggcggttcagcagccatcatcgtcccgcaggatccacctaggccgggatctgtgcgttctctttctctccggcgagcatttcctttaactttgcatacactgcctccgccagcgcggcatgcccttcctcattcatgtgctctctgtcttcctcacttggctttgcatatgcggatgccgccagaaacgaaatgccccgctcatgcgcgatccgccggtaaacctccggcagccgctttgacaccgcaacggagctctcatcaaattcgggatcgtaccctgcctcgccaacgccctcgccgagtgcgatcggcgacatcaaaagaatcttactgtccggggtgctgcttctgatctggtcgagcagccgctccacgcctctcccgattacctccgccgatgtatcgtacatcgtcttgcagtcgttcgtcccgagcatcagcacaaccacatcaaccggcttatgcgtctctaagatcacagataaaagctccgttccccgtcttccatcccgcaacggatcatcaaaaaccgtcgtccgtccgcacagtccttcctcgacaatgcggcagccatcctcccacagccgctgcccgatccgtccgctccagcgggtgtcccagtcatagcgatccttcgttcccggtatcaatccgtatgtatttgaatctccaaagcataatatctgtttcatagaagccgcgctcctttctcatactgttctgataggaatactatatattatgtttttttatttgtcaaccgtctttaccagattcttacattaaaaatttgtacttgacttttacacatcacagtgctatcttcataatcaaacaaagagcaaatgcaaggaacagaacacggtttactgattccccgcatcacagagagccgtcggtcggtgcgagacggtatgcggtttcaggaactatcctctgcgagcagtgcactgaaccaagtaggtatcaccgggattcccccgttacagggaagcttattgctgcaggcttacgcccgcaaagatgagattgagaggtcgttttttacgacaagcaaagtggtaacgcggaagcttacgccttcgtctttggctgcacattcgtgcagcgggacgggggcgtttttgttttacagaaaatgccatccttctctttgcccaatgttgatctatcagaaaggagccgccttcgggcgggaaaaaaaatgaatggtttagtgattatcttaatcggaatcgtagcactgggtgccggctacctcttttacgggcgctggctggcaaagaaatggggcattgatccaaacgccaagactcctgcttacacccatgaggacggggaggattacgtgccgtcttccagatttactgtgttttctcatcagttttcttccatcgcaggagcggggcctgtcaccggtccgatcttagcctccgtattcggctgggtgccggtactcttgtggctgatcatcggcggtctgtttttcggcgcggtacaggatttcggtgcgctgtatgcctcggtcaaaaatgagggcaagtcgatgggtatgattattgaaaaatatatcggcaagaccggacggaagctcttcatgctgttctgctggctgtttaccctgcttgtcattgcagcgttcacggacatggttgccggtacgttcgtcggaaaaggcgtggacggcatgactgccgagacctcctacgcaaactccgccgctgcttccatctccatgctctttatcgtcgtcgccgttgtcttcggtctgatccagaagcatgtcggcaagatgaatgaagtggtaaaagcggttgttgcaatcgcgctgctcgttgccatgtttgcagtgggtatggcacttccgatctgcaccaccaaatccgcctggatctacattgtcatggcgtatctgtttctggcgtccgtcatgccgatgtggcttctcatgcagccgcgtgattatatgacaacgttcatgctgctcggcatgatcatcggcgcggtggtcggcgttctcgtcgcacatcctgccatgcagttaaacgcttttaacggctttaccgtaaacggcagcagccttttcccgacactgttcgtcacgatcgcctgcggtgccgtctccggtttccacagcctggtctcctccggaacttcctccaagacgatcagcaacgaaaaagatatgccgatggtcggctacggcgccatggtcgtagaatctctgctcggcattgtctcccttgtcgttgtcggcgctgtcgccgtaaacggaaccaaaccggacggaactccgttcgccatcttctcctccggcgttgccggtttcctcgagaagcttggtcttccggtacaggttgctacggtcttcatgaccatgtgcgtctccgcgcttgcgctgacatccctggattccgtcgcacgtatcggccgtatgtccttccaggaactgttctacggcgataccaccgatccggcaaaaatgtctccgctgcagcgcgtgctgacaaataaatattttgccacggtcatcaccctgttcttcggctatctgctgacactcggcggatataacaatgtatggccgctgttcggttccgcgaaccagcttctcgccgcacttgtcctgatcgcactggcagtcttcttaaagacgaccggacgcaccggctggacgctctacataccgatgtttgccatgctcgccgtgacgttcaccgcgctgatccagaagacgatcgctctggtgaaaaacatcgctggtggtcaggcgacattcctcgtcgacggactgcagttcatcgttgccgtacttttaatggtgctcggcgttctggttgccttcagctgcttaaagaagctgtttggaaagagcagtgccggtcaggcggcataatattggcgtaaaaaggaattgccacaataagcatagacctctttggggcgataagtaatattataagaagatcacaccatgggatttcagatggaaatacagatggacattcggatcaaaaaatgtggcatttctaaccgactgaatgtctgcatcttcgatgatccgtgtctttccaagtttggaacactccacggactgtgtccgcaagtcagcagacaattttaggacttttgtgcgtgtcccttattggcacctctgaacataacataaccgcgcgaagccgatgtttgaattgccatctgccatatttttaatagcagatggcaacgagtttcggttcgcgcggttttatattgtctgtgaagaggtgccattagggacaccagaaagtccgctcattgtctgcggcttgtcggacacactccgggagtgtccaaacgtggccaagacacggaatctgatgcaaacattcagctggaagaaatgctcacatttttctccaacgaatttccatctgcatttccatctgaaatctcacgaagtgatcttctgataatattacttatcaacgcaaaacacggtatgcttattgcggcagttcctttttatccatttatcaccggcgaaacgaccggctttccgtcgcgatccagaagcggcgtcattcctcccgcatatccgcttgcgtgaaacacataattcacgccggtttccttgtccacccagatttccatggtcgtcatcgttccctgtgaataaaccttttcaaatctctgatcctttgccatttttcttcctccttaaattggttgtgtatgactctctgatttctatcatacacatctgttatatttttacaactttttccttgcgggtgatgcggaatgtcgtctccaccatcgtaatcatcaggacaacaaaccccagcagatagaccggcaggatggaaaaagataccgcattgccgaggagtccgaacagcggcggaataaacgtcgaaccgacataagcgcttgccatctggattccaataatcgctcccgaattttccgccccgaaattatatggtgtggaatggataatgcacgggtaaataggcgcacaccccagacctatcacaagaaaagctgcaaacgcgaccgtataagactccaccggaaggcacagaataaaaatcccgcagacaagaatccctgttcccagcaaaatcatttttcggtcgccaagccgatcggtaatgattccgctgatgaatcttccggcagtaatccctatatagaacagcgcggcaaaaccggccgcacggtctgcagcaatcccttttacctcaacaaaataggtacttgcccactgcatagtcgtagcttctgcagcacagtaagcgaaaaatccaagcaaaagaaacggaacccctttgatcttaagcgcaccggttaggcctacactttttccgtcctcccgggatgtactctggttcacattccataccggcagagtaacaagcagaagcagtgcaatgccaagctgtatcagcccaaccatgcgataaccgctgttccatgtcctgtttgccaatgcatagctcataatgaacggactgacgatggtaccgacgccccagaagcaatgcagccagctcatatgcttcgctttataatgaagcgcgatatagttgttaagtgctacgtcaatggctcccgctcccagcccgtaaggaacagcaaaaacaatcagcatccagaaccggccggaaaaagaaaagccgaacagcgcaatgaccgtaagaaaaacactggcaacggttacgattctcgtgccgaattttctggtcagcttatcagaaagaagactcgagataattgttccgccagagataaccatagatacgatgcccatataggacaccggcacgccgagttcggtatgcatcaccggccagccggatcccagaagtgaatccggtaagccaaggctgataaaagcgatataaattaagattagcaaaaatatgtacatcttctaattaccctctcataatattgacaaaatatgatccggctgggaagcaatatactctttcacaattgtgttacaatgtgttttcacaatctcactatcgtaatcatgtgcgagttcatttcttactttgagcatgtccatccatgcatcatccgaaatcaagtttgccttaaatgcttcacgcagaacatcccttggagaacctgtaacgaatcctgttattgcataatactgtaccaatatgtccttcattaccttccacgataaatcaaaagtaatactaaattttgcactggttccgcttaatacaaaggaatccgtaagatctctttccctggcctccgccaaagcatccagcgaattgcaaaatgattgaaaccgtctgtcaaatttcgcgtccatattgttttatatcctccatcaataaatcattcctacaggtatccatatttaataaatcaacactgtacaaggtcggcagttcttcgactttttcaagcagctcatcaaaatcagccccgccggacaccgcaatatctatgtcactgcgttccccggctgtcccttttgcccgcgatccatataaaatcacttttttcgcaccatgctctctgcaaagatccgcaacccggcttataacttcatctgctttcatatatctcccctctctttcagctgcgtctcttactctatccgcgcctgttgccattttcgtcaaacgtgcgcttcaacgctttttccacaagaataacagaaccaatcagaaccaaaacctgaaccgcttcgatgacaagcgttactgtccctactacatcttcacccgattttgcaaacgggatttgagcgagaaccgtcggcaccagcaatatgatgcctgatttgatccataactttccgcaacagtcatgcgcaaatgcccaggtatccttattcttttcggacatggcagttctatagccgatcagcccgtttatctcttttggaggatttttgtacatgcagtaacccgctatcaccataatagaaggcatcaatagattacataaaaacatcgctataaaaaatcccatattttcctcctgtctcccggattacagtatcttttccatgccgatcttctgcggcatcagcccacacttttcataaaacttccgcgcgttttcattgcatgcccacacattgagcgtgacattgtaacagccggaggtctttgcataggctcttgatgtccgtcaaaatattgtcgttgatgtgctgctgaaaaacgcagaatgcataacctaagatattgccctctccgtcatccgcaacaaaaaccgggcgtgtgcgatcctctaagatttcctttaattcgtcttcattatattttctggcgtttgccttgaataaatccgtcgtccattatgatgaacggtcaaaacctgtgataaaagattatctattcccggaatgtcctgtgtccctgcatacctgatctgtatatgtgctcctttcacgcttcgtgtaacattatatcgtatgtgcattacgctccggcaaaagcacggtaagcctttggcttcccgtgctcgcgggcgcgttcacatggcgcgtatccgtctgccgcatgcaagcatgcgcaaccgtctctgtgccatgctcacttttgccttcgcgaacattatatcatatttttttcatatccactctttacatttctgttatccttccgcaactatcccatttatatcttcacgcaaagatgttgacttatcaacatctttgcgctataatccgagatattgatttatcaacatctcacaaaggagcacccatggatcatcgttttgaaaccttttcactctccattctggagttgaaccggtacttacagaaaatcaaagagctggagatgaaacagttcgggctgaaggccaatcacaccatgtgtctatattatctgggacagcacccggaggggctgaccgcaacgcagctcacagaactctgcaaggaggacaaagccgccgtctcccgctgtctctcacagcttagcgaccggcagcttgtcgtctgcgaacagccggaagatcacaagcgatcttaccggtcgcactacatgcttaccggtcaggggcgctccgttgtaagcggcatccagacacgcatcaaagaagcgctctcctacggtggacgcgggctgacggaggaaaggcgccgcgatttctatggcactcttgcaatcatcagtgaaaacctgtctgactatctgaccgaacacagtcagcaaaaataaaaatatatggagaatcttatggaaaaaatcagaattatcacagactcagcatccgatctctctgcttctaccagagaagacctcaccattctgccgcttgcgatccgcttcggcgatacggaatacctcgacggcgtcacaatcagccatcacgaattctacgaaaagctgattgagagcgacactctgcccacaaccagtctggtatcccccgccgcttttgaagaggtatatgccagggcggtggcggacggggagaccgttattgcaatcacgatctctggccgtctctccggcacttaccagagtgccacgatcgcggcagaagattttgcaggaaaagtatttgtcatcgacagctataacgccaccatcggcgagggcattctggtcagatatgcacttttattaaaagatcagggattatccgccaaagaaattgtcggaatcttagaagcctccaaggagcagatccacacactcggcgtcttggatacactggaatatctgaaaaaaggcggccgcatttccgccgccaccgcatttctcggcagcgccatggcgatcaaaccggtcgtcgccgtatcggaaggcgaaatcgtcatgctcggcaaggcgcgtggctccaaaaacggaaataattttctcatgaaggaaatagaaaaggcagacggaatcgattttacccgccccttctgcctcggttacaccggactcagcgatgagatgctgcaaaaatatatcaaagacagcgaagctctctggagcgaacacacagaccagcttccggtctgctccctcggtgcgacgatcggaacccatgtcggtcccggcgccatcgccgtcgcatttttctcaccgcagtcttaattctgtccgttctgccagctcacctgaccttcctcgatcatcggatagcaggtgagcgttgttccgtcgagatcttccgcgtgcatgtccacgcccatgatccggtgattgtcataggtcgtgtaatagtagattcctctggtcgcattacagcaggacgtataaatcgtaatctcgtattttccttccgccacttcgcagcatcctctctgctgatccaccgatcctaaaatatggaaaaactgactgacactctccgtctccgaatcgccggaaaccgcattcatcctcgtgaacgccacgcgcgcaaaacgggacgcggaagagagatctcccggaagtcccagcgcacccattccgcggctgtaggtgctaagcggaacatcttttgcgaaagaattctccggctgcttcggggacagtccgatatagttgttgagcataaacatctgctgtgcaaacggtggattgttcgtaagaacgcccaccggattctcgtagacgtgcagaccatccgccaccgactccaccgtgattgcctcattttcgtctgcgatgatccagtgcagctgtgacgccgggaactgctcggcgaacggggttccgaccagatttatttttgcaaggagcgcccgcacctcatccatcgtcgcgcattggcggagcacccacgggatgaactcaaatgaagccacattctcttttccctcagtcacctctgcgtagacggcatttccaacgaagttcagtcctgccatgccaattcccttctcgttgatagcatcataatacagcggatagtcccccgccacatgcgccatgccgatgatggcataatgctcttttgcctgtcccatatgccggaagttaaattcataattccgcggtgtgatgacgatctcctcaccgtaggaaaattcataatccagtgttcttccaaaatagaaatccttcgtccgataggttgctgctgtacacataatcgcttctccctctctaaaatagaaattgtgatataccgcctttttgtcataagagacagcatatcacaaaacagatgtaacatcaatgcatagtgtgcaccgaaacatttcttttcaaacataccgccgaccgttttcgcatgtcagcggatatgatatttttcaccggatatcttttactgaattcccgtcgttgatgctgaccggaaaacggtaggaataattcttgttctgccagtccggatcatccatcatgcgcagcagatttttcccggtaatcctgcctagattgtacttcgggtgaaccaccgacagcaccttgaccctcgcatcctgctgcagctcctcatcgtcaaaggacaccagcgatacatcttccggcacgtgcagtccacgttcctcaagaaactccatgtaatagccggcgacctcatcgttgtatacaatcatcgccgtgcagtctttcgtgcggcgatacatccggagaagtccctttttgctgagtttctcctccatatccttcgtggagtaccagcggatccagtcgtcgtcaaactttaccccgtaatccgacagacattccacaaaccctttatagcgctcgattccctgcatatcatcatacttgaaaattcccgcgatcctgcggtgtccgttctgaatcagaatttcggtcagcttgtaggcggcgcgggcgtccgacatctccacactgtcaaaacgctgattggaataatgattgtgaataaacagcgtcggaatgttcctcttccggatctcctcgtagagacggatattcggattcgggaaaaaggagcgtgttccttcaataataaatcctgccacattgccgttgagcagaccttccagataaatcgcctcatcgttcagccggttctttgtgacggctacatcgatgtcatatccggcttccttcataacagaatcgattccatcataaacgcgggggaacagatagtcagaaaaatagcttaaaatcaagccgatgcgcggtctctctccgtttctcaagttgccttcatacgatacatatgtgccgctccccttgactctcttgatcagaccctctgcttcaagctgatttagcgcagtgcgcaccgtctgtctggaatacccgaactttttctgcagaatgttctccgacggaaatttgtcctcattctgaatcactccgctcgtgattaaagttctgccccagttgtacaatttctcatattttaacagactctgctcaccgattttttttgacatttctgttcccccgcttcctgctgcaactctgctgtccgattgtctctccaagcccctgcggtgttacttgattacctgcaatgactggcgatccgcgaatactgccacgaatatcaggaatacgacaccctgaatcaactgcatcatctgtgtcgtgaatcccatcatggtcagtccgctgctgagcacgatgtagagcagtgaccctacgatgatattctcaaaccggacttttgctccgccggagatcggcataccgccgagtaccagtgcaatgaggatctgtgtctccaactggttaccgccggaagatgttaccgatccgactttgatgacgttgataaatgccgcaaatccggtgatcgctcctgccagaacgtagatcaaaaacttcatgcggtcggtgcggatacccgaaaacattgccgctttttctcctgctccgattgcctttaaataggttccgaacttcgtgaagcggaatgcgatgaatccgattaccaccacaataatcgtgagcgtcattttaagcgctgtgctgtcgtagttaatgagctttgcggaacctgccacgggtgcattggtggtcagatatttgataaatccacggaataagaacatggtacagatcgtaacgataaacgacttgatcttgcggtatacataaaagtaaccgttcaatgctccgatcgccgcgcctgccgcgattcctcccacgattgctaacggaatgctgatcttggaaagcatacacacaacgatggatgcaattcccaaaatcgatccctgtgaaaaatcgagaccgcccattgtcataataaagaaaacgcctgttgccgctatcatcgtcacatatacctgggaaagtaccagtgacagatttccaaccattctgaaattcgtcagtacattgaacagaaggaagatcacgaccagtcccaccaccggcagaagtgaacgaatcaacgacatcttggataattttttgagctgctgctctttttgttctgtgttcgtctttgcttgattctccatgactgcctccttataccatcatcgtaatcagactgttctcattaagatcctgattacgctccagttcgccgttgatcttgccatctttcataataatgatacggtcgcacataccgatcagctccatcagctcctccgagatcatgatgatggatttgccctcttttctcatctggttcatgagctggtagatgtcctgctttaccttgatatcaatgcctcgcgtcgggctgtctaagacgatgatgtccgaatccttaccgatccagcgcgccagtaccaccttctgcttgttaccgccggagagatccgacacgaactgatccgtattgaccatctttaccgacatctgcttggcatatttgtttgcaaatttcttttttttcttatcgctgatgaaatgtgccttgttcgacagttcatccagggacggcaggcagatattgtcgccgatgctctggttcatgaccacggactcgttgtcacgatccttggacgtgtaagcaatgctgtgcttgattgctgtcggaatatcgttgatctgtgttccgtccgccagcgtcaccgtgccctctctgtcgtaggatgcgccgaaaatcgcttttccgacctcgtgcattccggattcggacaatccgccgaaaccaagcatctcacctttgtgaagatcaaagctgatatcgctgatgatgcccggcaccgtcacgtttttcacggaaagcacaacctcatccgagactttctctccgtaatcggcacgatagtaatcaccggtcacctcacgtccaaccatcagacgcttgagatcatcctcggtcacatccgcactctttacggtatcaatgtagatgccgtcgcgcaggatcgtgatggtatcggatttctccagaacctccggcaggtcatgtgaaatgaaaattacggagtttccgctgttgcggatacggtccatgtgcttgtagagttcatcgcgtccctcctgggacaatgcggtcgtcgtctcgtccacgacaacgatcttcggatcgaagtatgtcgcttttacgatctctaccagcttgcggtcctcgaaattataattatcgatgatgtcggatgccttgatccggtcaaatccgtatttcttaagtaattccgttgccttgcggttcatggctttggtatttttgattccgaaatgtacgaactgttcctcgtgtcccaggaaaatattttccgcgaccgtaagtccggacaaggttcccagctcctgtacgataatggaaacgccctcattgttcgcttccacctgattctttggatgaatctcttttccgtcgaggataaaggttccgcttccgatgctgtaaataccggtcagcatgtttgtcagcgttgattttccggaaccgttctccccgatcagcgcgtgaacctctcccttgttgacattaaaggaaacattctgtactgccttcgtaataccgaaggacttgcaaagattttttacctgtaatctgacttcactcattgcattctcctcctcgattacttgacaatttcaccttttgtgactttggtggtcacggtgatgatgataagcagtgccagacctgtgatgacgtcctgaatcgcggtcggggcgccaagtgcgatgaatccgaagaaaatgatgttgatgacgaactcaccgatcacaatcgcctgcagcggcataccgtatttcttgaacgccagtccgaagaagcatcccatcgtcggtacgaagttacgactcatggacgccataccggttaccgccaccatggaggaaccgtagctgatggttaagatcgccataactcccaagaacgcgccgcttaacacaaatgcaagcaccttgtatttattgacattgatacccatgttcttggcaacgaactcgttgcttccgattgcataggtgtaagttccgattttcgtataattcaaaaagatatatgctacaatgcacgcaacaatcgccaggataatatcccacggcatctgaccgaatgcgcgcagatttgacggaagcgtctgctccacgccgcctgcgatatagttcgcaagtgactcataaatcaatgcgagacccgttgtaacaatcatcgacggaattctcaattttacataaaacagaccgtttaacagaccgacgatcgtgccggtgagcacacagcccaagatcagtccgaggtaccccatgttaaaccgggtggcaaacacgcatcccacgattgcagaaagcatgatgttggcaccaatggagaagtcgaacattcccataaccatgacgaaatagaatccgaccgcacccacagttgcaatcaggctggcctgaaagtagttgagcatattggccggcgagccaaaattatgcggtgtcagtattttaaagattacccaggaaaccacaaccagcgacagaagaatcagatagccctttgcgcttcccgacagcttttttgaacccatattatctacctctttttcttactcgaatcaacggatgtcacgctgtgtgagccatcctttcatacaaaaggccggtatcgccacgcgacaccgaccttttgaagtaacgctcagtctttggaactaattccctgcacgtgatgctgcatcttcaatagaaatattctttgctgcttctttcagagcgcttaagtcaagattggacatctcaacaagctcatcggatgtgtacggaagctggtctacgaaatacttctcatatgcctgatagtcttctgcagaggatacatacaggtacgggaaggaaacgtcctcgaagttgcctgcaaatcctgtgtagttgccctttattgcgttgtaaaccatcatgaatgcaattaacggatcacagtaatgtccgccagactcaccagccatggagccgttctccagtctgtctccaagatccggaaggaaatctgtagatacgatatcgatatcctgggtcttgcctgcacgctctactgctgcgattgcaccctgaagagggtcaccgccgccgcctgccgggatgagtgcatccaggttcggatctgctgccataagagcctctgctgccttggaaccaccttcggaagttgtacctgcgtactgcggctcagaaagctgtgccggatcatccggatgtgcctcgttccacttgtcaacgcctgctttgtagccttcccatcttccaagccaggttgcatctccctgctcccagccgatcagaccgatgtcacggtcacccttatcaagaaggatgtttacaagagcttcaccgtttgccggctcatcctcatgtacagctccgatgtaataagcagaatcttttgctgcctgataaatgtctgcgctgttcgtctcgctgataatacggaagaactgtgccagatatacgccgttgtcgttacatgtcttaattgcggatgtcatctctgtatcggatgagttacagatgataataccctggcatcctgctgctaccagctgctccacagatgctgtaaccttctcggatacgtgaccctgatccacgtactgaacctccaccccaagagcatcagccgctgcatcaagaatcaacttacactgggaaccgagaacatcggtggatgaccagatggaaactccgatcttaatcttggagttgtctgtcactgccggtgttgccgctgcctccgtaccggatgaagacgctgccgagtcagaactgctcgccgtctcggaacccgatccacaggccgccatacccacaaccatggtcgctgccagcgcggcagctgtcaccttcttgaaaattgttttcaatttcatgctttttcctccctatacattttatttgggttgtgtaaaaaccttttgtgattttattatagatactccctgctttttcctcaagaaaatacaaccaagttttttctaaaagttgtatggttttgtgtgtgttttgtcatacttttttgcaattattttgtatctattgtgcgttttaccatatatcgcgccatatttccactgttttatccggcggttttgtaccttatttccactttcgccacaatgtttgtctactttctattacagttacaatacaactttcgtctgtatggcacttgtactttttgagtaccaaaaaaggacaacaccggattttttgctccgatgatgtcctttttcttatgccttgactgcccagcgcattttggtggaacgcgcccttccgtttgcagcgcactcctgcgccgacggacggatgacgtccttcgcatagtcgctgtaaatcccactcttatatccctctttgagcgcctgcttcacaagcttgtcctctcccgagtggaaggtaagaattgccacgcgcccgcccggtcttaatgctcccggaagcttttccatgaattcatacagcacctcaaactcctggttcacatcgatgcgcagtgcctggaatgtgcgttggcaggtctttttgattgtgtcctttttctccttctccggcagaaaatccagcgtatcctcgatcaccctgcgcagctttgtcgtcgtgtcgatgtggctgcccctgcggatctcgtccgtgatcgcttttgccagctcctcacagtacggctcgtcggagttctcatagagcatcccggcaagttcctcccgcgtgatcgtatccagccgctccgccgcgctgatccccgtctcctgattgagcctgagatccagcggtccatccaccttaaacgagaagccgcgcttcggattgtcgatctgcatggacgacacgccaagatccgccagaataaagtcgaagccgccgacctcttttgcgatctcatcgatcgtgcagaaattctgaaggcgcaccgtcaaaagatcctccccgaatcccagatcctccagacgctttttcgtcttggcggactcctccgggtccacatcggtcgcccagatatgtccctgtcctttcagacattccagcatggcacgcgtgtgcccgccgtagccgagcgtcgcatcaaatccctgctctccgggctcaatctgcaaaaagtccagaatttcttttaccataatcgagatatgcattcccgccggcgtatttcccttccggatcacatgctcgatcgtatcctgatatttctccggctgcagttccttatatttttcctcaaacttcttcgggtattttcccttgtaacgcacccgccgcttgtgcggtgtctgtgtctcctgttccatccttctctcctactcccagtcttttaccagttctgtattgtactccgactgaatattttcgacggcttctcccgccgccctccggtaaaaatagatcctgtcgtcatcgctgtcatttttccagaattgatatccatagatgtagctttcaaaaatctcctcaaagcttccatattccttctgcagtctctgcgcaatcggcagacactggtcgaggcactcctcgaggctgatgtagccgcactgatagcacagtcccgtgatgcgcataatacggacataatcccaagcatccacaccgcgcgtgtccagatgtccatacgcatcatagcatacccatgtccggcactgctcatcctccgggatctcactgatgcttataatatcgacatagccatcctcatccatcgacagatacccttttttcaggtaagtttcaaacgcatgacggtaagacgctctggttccttttttcagcatctggctgatcgtgcgggtcgccgttgcccggctcgtaatgccccaccagtcagacagatattccttcacctgctcctgatcccagtcttctctagaatgaccgcccagttcgccatattctccgttctcaaacggtacatagatcgcgtaagcatctatgatccagcgcacagtcgggtcgtccttcacgtcctcaaacgtcagatccgactccgccttttgggaatcataagagatcagcagactgtcggcatcctggttgtaagccacatagtggtttcctgcatacacaaacatgagcgcgatcacaaccactgccgccacagtacccgcaatcagattccgaagcttcatctggatatccggcgctccgtctttttctgaaaatgcatatggaagatgcgcaccatcaaaccagatatctgcttttccgccaaccatatcctgcacatttcccacatttgcctgccgtaccggatacatggcacgcgcctcgcactttcgccccagttcatccatgaactcatacagataatatttggtcgcgccatttttcccggttgttatgacgcgggcaattctggcgtgataacgctttgcctgcgcttttgctttcttcagatagcggtactgcatcaccttgctcaaaagggcgagcaatgtcatataaagccccgcctctcccatcagaagcatcgtgcgtgcagtgtcatgggacgtgttaaaccggtacgcaatcgcgtacaaaaatatgattccccccagtgcaagtgccgcaagtgggattgcctgcaggcggctgtaacgccggtacgcctccgacaagtgccactccgccacccagacccgctcttccggttcttccatctccaccgaaccggcaatgtcttctcctgcgtatgctgcgtccccggcatatgccgcgtcttctgcatatgccgtccgtccccaggtctggtctgcggtgcgctgcgcggcacccgcatatgccccgttcctatttcccggcgcattgatgatccgcgtcatgagaaaatagcggagcgttttatccgccttccgctgtatcagccagattctaagcccaagtatcgcggcaatcacggtaagtatcagcaccagctgcagatcgtcctgcggatttaacgaggttaagctgtagcggagtcccgcaaaaataatccccaacagcggaagcaacagtagcagaagcacaatctgtgtcacattgggcgcactctttgcatccactgtatcttccttcacttccacgcggtacgtcttgcgcgctcttccttcctccctgcttttgagccggatcagataacggtccgccgtttccgtctgtaccgtctgcacccatttccatccggggctgtccggcatatttacattctcactgtactgcagatttctgcagaccgcctttttgtcgctgtgacataatccaaccgccatgtttctctccttatcaagtcattccccgcttttccggaaatgccctgtttctttcgtgtatgtcatcctaagatgacccagataaaattgtaattgattgccacacattttgcaacgtgttggttttacttgttgtcctattgccttgttccatcctgattaaaattgcattttaatgccttttccgttgataaaatagacccaatcaaaaaaagcagttgtattacagtgataataatacttagtattcccattgtattgtcacttgctccatagaaaggaatatgtatcagcaatgtaggacccaacaggccaactccagctttccaccagagttttcctgcatattcatgtgcaaatttccaagtatccatatttatcattgacatcctggttctatatcccactactccattgattttctttgggcaatgtttccacatcattctgcctgcaattatcataaccgctggaataatacaatcacatatcaaaataaaccaccagaaccacatattaccacctcctataactggaaattttcaatgtatcttccaccctcatgccaacaattcctataaaggaatcatttctttctaagtccccaatcacgaaacgtttcgtttctattctcattgattttcttctccaccagttccaatttatcactgccattctaccattccataaatgcttattcaataacctatctgtattcaaaaataaatcccactgacaaccgttggtatttgcaaaatatgcctcccgacgttataatacagctgttgtatccagaaacatttacagaacagggcacacatcagccctggaacggagaatcccatgataaaactgattgccaccgatgtcgacgggacactggtaaaagacggaacgatgcagatcgatcccgaatacatgactgtcattaaggaacttgtccagaaaggaatcatttttgctgtctgctccggcagacagttcatcagcgaacggaagctgtttgcaccgatcaaagatcagctgctctacatcacggacggcggcacggtcgtgcgcaccccgcaggagattctgatggttcacacgatgccgcgcgacgtctggagcggcatgtgccgcatggtgcaggaacagatgccgcactgcgactgttttgtcgccacaccggactactgtctcgccgaagacgccggaagccgcatgttccactggctgcgcgattcctacggctacgatatccgggaggcagagcgtctatctgacatcccggagcaggatatcatcaagttcaccgtctaccacaaatctgcctgtgaggaaatgtgtgcgccgctcttcaccccggcatggaaggacaaggcacagcttgccgccgccggcaaagagtggatggactgcaatccgctcggtgcgaacaagggaaccgcgatcgagttcgtgcagaagcatttcggcatttcaccggaagagacctgcacgttcggggataacctgaacgacatcgagatgctgcagaacgccggcaggagttacgccgtcgccaacgccagggcggaagtcatcgccgcggcaaaagatacctgtgcgccctactgggagaatggagtcctccagatcttaaaaacatttttataacgaaaaagaatcgtgtccatccagcggcagtgccccggcgtacacggttcttttttatttctgcagaagtccgccgccatattggatgcggttcctgtcaatgaattctttggaacaaaatttctatttttcttcatgcatgccccggtcatccattttcctgtctcttttggcgttcgactgcgcgccgcgggtgtccgtgaacatccgtggtgcactgtcgaacctcaaaaagacaggaatcatcgccgatggtcggggcatgcgtgttagaaaaatgaaattttgcgacagaatacgttggcaggaactgcacccaatatgccaaaccttcccaacgcacaaaaaaagaactgtgtacgccgcgcatctgccgcaggacgtgacacagttctttttcgttatattaaatgtttaacagatcgctgaataccttcagggcgccgtcggtctcatgtgcaagcacgcgctttgccagaacctttccaagctgtacgccttcctggtcgaagctgttcacattccacaggaagccctggaacatgatcttgttctcaaagtgtgccagaagtgctccgagagactgtgggtttacctgctcaccgatgatgatgctggatggacgtccgccctcgaaattcttgttgcggttctcatcggatttgccgcatgcgaatgcgacgatctgagctgcgacatttgcgcagagcttctgctggcttgtgctgtcctggatcacaacatctgtgccgatctggctgttcttaaagccgacaaactgaagcggtacgatgtctgtgccctgatgcagcagctggtagaacgaatgctgtccgttcgtgccaggctcgccgaagatcaccggtcctgtcgggtagtctaccggctcaccgaaacggttcaccgacttaccgttggactccatgtcaagctgctgtaaatgtgccgggaagcggctgagtgcctgggagtacggaagcactgccgtagccggataacccagtacgttgcgctcgtaaacgccgatcagtgcatcgagcatctccggattcttcaatacgtccttgtttgcggaaagctgatcctctgcagcagctccctcgaggaactgtgcgaacacatccggtccgaatgccagggataatacggcgccgccaactgcggaagtggaggagaaacgtcctccgatatagtcatccataaagaatgccgcaaggtaatcatcactcttcgctaacggggatgtctcgctcgttacagcgatcatatgcttggacggatccagtcccgctttctttaacgcatcttttacgaaggactcgttcgtcagagtctccagtgttgtaccggacttggataccagtacgaaaatggaatgtgccacatcggtggaattgagcactgctgcagcatcatccgggtctacgttgctgatgaactttgcttccatcttgaacttgccgtttttcttcgcccagttctcaagtgccagatacatcgcacgcggaccgaggtcactaccaccgataccgatctgaacaactgttgtgaacttctctcctgccgcattggtgatctcgccggaatgtaccttattggcaaaatctgcgattctctcctgctgctctacatagaagctgcgcttatccacaccgtctgccgtcacagcatcaccgagctgtcctcgtgtcatgtgatgaagcaccagacgcttctcaccggtgttgatcacctcaccattgtaaagtgcctcaaacttctccgcaagctgtgcttcctcagccagctttacaagtgctgcgagcaccttgtcatcgacctgcttggctgcgtagttgtaagaaaatccgccagccatcggcacactgtaattcttcacacggtcagcaccgttctctccggacattgcctcaacaagattcacgcgttccactttggaaagctcctgaaaagaagcaagggtatccaagttgttccaggtaaccataatagattcctcctatctattcttgcacatattcttattttattgatcgtagtgattatactattaaatgatctcaagttcaagtaaaacggcggagagacaaccgctctccgccgtacaatgatttattttgctgcagccggattcagtttcttcgtccggatatcctcctgtaacatggcaaggaaatcttccatagataccgttgtcgactgctgctctccgtgaagtctgtagcttaccgtgcggtctgccacttcgttcttaccgagaaccagaagatacggaactttttccatctgtgcctctctgatccggtagcccagcttctcgtttctctcatcgatctccacacggattccgttatcctcaaggtatttgtatacctcgtgagagtatgcatttaactcctcatcctcattcttgaccggaaggatctttgcctgtaccggtgcaagccagagcggcaggtttcctttcgtctcctccagaatgtaagccatgaaacgatccagggaaccaaggattgctctgtgaagaacgaccggtgtcttcttcgttccgtcactgtcaatgtaggtcaggttgaacttcgccggcaggcagaaatccagctggcaggtggaaagcgtgtattcgttgccgattgccggttttacgttgacatccagcttcgggccgtagaatgccgcctcgccgatctcctctgtatactcgatgccgatatcgtttaatacctttcggagtgcattctccgccatatcccacatagcgtcatcgtcgtgatatttcaccttgtccgccggatctcttaaggacaatacacagcggtaatcggtgatattgaagtctttgtaggtgtcaaaaatcagagccaccacgctggcgaactcagactcgatctgctccggtgttacgaacaggtgcgcgtcgttctggcagaaatgtcttcctctctcaataccctttaacgtaccgctcgcctcgaaacggaagtcgtgcgcgatctcaccgatacggatcggcagatctttgtaggagtgcattctgtttgcatagatcatcatgtggtgcgggcagttcatcggacgcagaacgaaggactctccctccacttccattgccgggaacatgttctccttataatgatcccagtgaccggaagtcttgtacagaccaaccgtgccgacacacggtgtcataacgtgcagataaccgagctttctctcttttgccttgatataattctcaagctcctgccatacggtatagcccttcggaaggaacatcggcagtccgcgtcctaccagatcgtcggacataaacagctgcatctccttgccgatctttctatggtcgcgctcctttgcctcctccaaaagcttcagatgtgcctccagttcctcggctgtcgggaaacatacaccgtaaatacgctgcattacgtgattgttcgcatcgcccttccagtatacgccggaatattttaccagtttaaaattcttgcagagctttgtattgtctacgtgcggtccgcggcagagatctgtaaaatcgccctggtcgtagacggagatcgttccatcctccagatcgctgatcagatccagcttgtactcatcgttcttaaaaagctctaatgcctctgcctttgagatctcacgtctgtagatctttttgccctctttgcagatcttcttcatctctttttcgatcgctgcgatcacgtcgtcgttgactgcgttctcgccaagatcgatatcataataaaatccttcctttacgaccgggcctacccagaactttgcttccgggtataagtgcttcactgcctgtgccattacatgcgcgcaggaatgattgagtgtgttcagtctctcatctgctttaaaatctaccattttcttcctccttgttctgcgtccgggtgctttttccggacgaaaaaaatcccccatacagacctgtgcctgtatgagggacgaatatactgtatccgcggttccaccctgcttattcccgtaaaaccatgccggactgccggatcctctcggatcacgcatcccactgtcgggaaatcactcgtttgatgataacggaatcaccggaccggattagggccgctcagaggtggtcttcccagggctttcttccaagatgcttccaccgtatgcatctctctctgtagggtgccgcactggtactcttctcttcttcgcgctgctttagattctatttcaaaaaatcagaactgtcaaggtgtttgcagcgaatttccgaaaacaatctgcttcccccccctgcaaagtggcttaccgtccgctcattgcagcgccgccgcccagatcagcccggtcagctcgtgcaccggttccaccgtcagcacatgctgaatgtgaaatggctcctgattgtatttttctccttttcgccgtgcccctctagccttccacaatctcgtactgcataagctcgtatttcaatctgcttccctccatgatctccgctggaagcagtgcccgcgccacaagcttcagatcttctgacgggatatccgttcttcttaagttcgcatagtctccatcgatcgagaccacttcataataccatgtctccattgttctctcctttgtaacctctttctattccgtatcccggtgccgctatcaaaaccgcagaccgcatttcggacagaattcataatcctccgtggtcgtaaacccacaatttctgcactgttttgtggtattccagccgtttccacgattccccggatgcaccggacgcaaatgttgtggcagaatctcgacatccccgccgcacgcaatccgttttccaatctccgcgtccagctcatagagcgcattgcagcagctcgcctgcacatagtagtgtctgttccattttatgcaggggataaagaaaagcgaaagtacggtgtatgtcatgaacacctgatatctgccgtaagctccgcaggcaccgcaggtcatcatctggtgaaaatcaaaatcttttctcccgtccgtaattcccataataaaaaacatgtgtcctcacgctccgttctcttgccgtttgttatctgttattatagacatatccatcgattgttacaacgataatcttgcaaaaacgtctgtatgatatactgcttggattccgtttgaatttcgacaaatagtgacatttttattgacatcttttttacaccgctctaaaataaccttaataaaagggagtagttttcatcttcggatgcgccagacgctgcgcgcagaagctgaaataataatcgtcatcacgccgcaaggccggttattattgtaagtaacgagacttttatcactcatttttgatgcgataaaggtctttttttatacccatttctttgtcgcaggaaaggaacacgtatggaatatgtattgttactcatcggttttgtactcttagtcaagggcgcggatttctttgtggagggaagttcctcgcttgccaaaatcttaaaggtgcccagcgtcatcatcggtcttacgatcgttgccatgggaaccagcgctccggaggcatccgtcagcatcaacgctgcgcttggcggcagcaacgatattgccatcagcaatgtcgtcggatcgaatatattcaacggtctggttgtggtcggaatctgcgcctttttgtccggctttcagacgaacgcggagatcttaaagcgggacatgcccgtcaatattctggtcacgctgattctgtgcctcatgtttctcgatggaacgcttggccgcgtcgaaggttttcttcttctggcaggaatggttctctacatcacatgcatgatccgttccgccctgcgcaaccgtgaagaaggcgaggtctgtaaggtattgccgcttccgaaaagtatcctctttatgggtggcggacttgccgctgtcatcttcggcggcgatctggtcgtcgacaacgcctgcatcatcgccgcaaacttcggtgtcagccagaattttatcggattgaccatcatcgccattggcacttccctgccggaactcgtcacctcgatcgtggcaaccagaaaaggggacagcggtctggcgctcggcaatgcggtcggatcaaatctcttcaatatcctgtttatccttggcatgtccgctgccatctcgccgcttcatgtgctcggcgaatcagtgatcgactgcgtcctgctgctctgcagcggtatcctgctgtttgttttcgcgagaaccaaacgatccatgagccgtgcggagggcgccgtctgcgtgttattgtatgtcgcctacacggcatatctctttgtaagataacctcttacacaaaggaactgccgcaataagcatatcgctctttgctttgatacgtaatattatgagaaacgcacttggggatttcatgtggaaatgcagatggaatattcgttggagaaaaatgtgaacatttcttccagctgaatgtttgcatcggattccgtgtctcttccacgtttgaacactcccggagtgtgtccgacaaatcagagacaatgggcgaactttctagtggcggctaatgccgctgcttcatagacattataaaatcgcgcgaaccgaaactcattgccatctgctattgaaaataaggcagatggcaactcagacatcggcttcgcgcgattatgttttattcagcagcggcaaaagcgccacacgaaagttcttaaattgtctcatgatttgcggacacagtccgtggagtgctccaaacttggaaagacacggatcatcgaggatgcaaacattcggctggttagaaatgccacattttttgaaccgaatatccatccgcatttccatctgaaatcccacggtgtggtcttttgataatattacttatcaaagcaaagaagttctatgcttattgcggcaattccacagatcgatccttagactaatcccatgaggctcggaactccgagggagagtcccggtacaaaggttaccagaaggagcatcacaatcagtaccaggaaatatggaataagcttcggagttacttcctcaatcgatacatgtccgataccgcatccgacaaaaagtacggagcctaccggcggtgtgatatttccaaggcacatattgaaaattaacattacgccaaactggatgtcgctcatgccaaagctctgtgcaatcggcaggaagatcggtgtaaaaatcaagattgccggtgtgatgtccatgaacataccgatgatcagcagaataacgttcatcagaatgaagatgacatatttgtttgtggataccgaaagcagcgcactgctgattgctgccgggattccggaataagccatcacgaatgacatcgcagaagaagcagaaatcaaaaacaggatgattccggaagtcttggcagaattcaggagaatctccataaatcccttgaaatcgatactcttgtaaatgatggacaggataaggcagtaaagaactgcaatacctgcaccttccgttgccgtaaagataccggatacgataccgccgataacgataatgatcagcagcagggacggaatggcatcccagatcgtctttgcaacactgatggatttgtcacggccggtcgccttgatgcccatttttttcgcatagatgaacgcaaccaccatacagccgagtcccataaggatacccggaacatatccagccataaacagcgtggaaatggatacgccgccggctacggtagagtaaacgatgaatgcagaggtcggaggaatcagaagtccggtcggtgcggaagcaatgttggctgccgccgagtaagccggatcatactcctgctctttttcaatcggactgatacatccacccattgcagatgcagccgctacagaagaaccggagagcgctccaaagagcatgtttccaagaatattggcctgtgccaggttgcccggaagttttcccacgaaaagctgtgcaaaattgacaagcctctttgcgataccgccattgttcatgatgttaccggcgaggatgaacagcggaaccgccagcagggaaaaactttcgataccggaattcatcttctgcatggtaataaacgtaatctgatcccaggaaagggtagacattgcagttacgatggaagatataataatacttacagaaatcggaacacccatgaacagcagtacgccgaaaacgacaaacaaaatgatagttgttagtacgatattcattttttccctccttattcttctactttgtttccggtaatgtcttcgtagagattaataatctgtgcgatgatgataaagatgccggaaatcggtgcgatggaatataccagcgttctcggaactcccagaagtgcggagaattccgcccttgcagacactgccagcttataaccgccaatcgtgattacaaagattgcaaggagtagaatcagcgcatcaatgaagataaccagaatctgatgcggtcttccggtcagtttatctcttaccagggtcagcgccatatgctctctggtggaaaatgcataggctgcgccgataaatccggtccagatcagcgagtactttaccagttcctcggtaaatgccgccgggctgttgaggacgtatctggtaaatacctgccacaataccaggaaggtcatgaacgtcagaaggactgcgcagcaagccgcgagaactttgttcatatatttcttaatcgtgcctaaggtcttagccattttttactcctcctcttctctgattccatcaattctatccagcaaatccgcaactcccggatattcttcgcggtattcatcgatcattcccgccgtcgcttcacggaaagcttccttatctacatcgtagacaaattccacacccatatcttccgcttccgtaattgcttcatccacagcctgatcccatgcttccttgtgccattcggtcgcatcatgcgcacattgcaggatgatttcctgatcctccggagcaatattgttccatacttttgctgacatgaccatcacgtcaggaatcatcgcgtgctggtcaacagagtacaccttgcagacctcgccgtgcttacctgtggtcaatgccgtctcattgttctcggtaccatcgataatgccggtggaaagagccgtataaacatcaccataggacattgccaccggagttccgccaagcgccgtcaacatatccgtctgcgacttcatatcctgtacacggatttttaatccctttaaatcttccggtacacggattgccttgtccttggtatagaaggaacgagcgccggatgtgaagtaggtgatcgtcacaaatccgtcttcctcggaagaaaggaagaaatcctgcatgtcctccgaatccataatgtcgtagaagtcttcggtatcattgaaaatgtacggaaggccgaacgtattgtaggcttcattgtaggtggcaagacccggtgcggaaaccttggtcattgcgattacgcctgcctgcagctgctctaagttctctgtctcagaaccaagctgtccgttcgggaaaatgttgataatgatgcgtccgtcggtcttctcttttacctcatccgcaaactgcgtcatggcaatatgtacggtgtgcgtctcggaaagaccgtgtgccagggtcaataccatcggattctctgccgttgcctctgcactgctggaaactccggagtttgcgccacagccgcctgccgcaattacggtcggcagaacgagcgctgccgccaaaatgagggcgatgttctttttcattgcttttgttctccttttccttttttattctaatttaaattacattccaatcatatcgaatacctcaaaggaaatcatcacatgatgatcctttttcggattcgggtacttcacctgtaccgactttaagctctggctgtaataccagccggtctgcgcctcttcaaatttgcgtctgtgaagaaaatgcggaacttccacaccgtcaatctgaacatagaacggcgctttttccctgtgtaccacatccagatacatcgtgtccacggtattctcataatttccttcataagtgaagtccacacaggttctgactcctgccgtcactttaatattggtcttaagatatgccccgttctggtactcattggtctttccgtcatcgtcatatacggtaaattcagaatctacgtccggcgccataagaatatgaagtccggttaccgtctcatgcatcaggttgtagatctgattctccgccatcggaataatcgcaccgctcttgatgtaaagcgggatggaactgatatcgaccggcacctcgatcgtctgtcccggcgcatactcttctctggtataaaaatcatagaagcggacgttctcatcccccgtctgcggcaggtaaatgcttctggtctccgcccctttttccacaacattagctaccagaagggaatcgccccacataaaatccacgccttcattgtaggtcttcgggtcattctgaaatgccataaacatcggctccataatcggaagaccggtctcatgcgctctgctctccagagaatacagatacgggatcatgcgatagcggaacttgattgcgtcccggatatactgcttcttgtccgtgtacatccacggttccgttaccgtattgtccgtgttggtcgagtgaatggaaaatctcggcataaagataccgttctgcacccagcggacaaaaagttccggttccggagaaacaccgtagaaacctccgacatcgcagccgtggtttgcgactccggagagtcccattcccagaatggttgcgatattgtattttaacgtatcccagcaggtcaggttatcgcctgcccacacctgtgcataacgctggattccggcatgtccggaccggcacacggaaaacggacgaaccgatggattgtactccgtcaccgcttcattggacagctggcacatgaggttgctcataaccggcttcatcgtaccgatcgtgctgccttttccctcaaaatatactctggcgtccttgtctaccatggaatcgtattcgcagttatcgttccatacagactcgcagccatactggatcagcccctgcttcagatactccttccagttcttgcggttttcttctttggtaaagtcgacgaaaattccggttccgccccaccaggtaccaattcccggctcatccgttgtgctgtcgaggacgaacatcttcttttccttcatctcctccaggagcggatgaacaagaagcattcccggctttacattcggggagacaacgatgcccgcctgcttcatctttgcgaaccagtccgccggatccttgaatcttttataattccaggtaaagctgcatctcttgatgccctgctctgtctcgacggcacagtatccggaagaaagctggaaaccatccaccggaatgccctcttccctggtggtgtcaatgaattccagaattgcatcgtcacagttttccggcagttccggatagtacatcgatgatcccaggtatccgaatgcagacttcggaagaagtacggactttcctgtcagatcggtgtagcgctcaatgacctccccgatcgacggtcccgcgatcaggaataaatccacatcgcctgcatccgcacggaaggaagaataacggtgccagtaattccgcttctcgcgtcccatattgaagtcacattctgccgtgctgtgataaaaatatccgacggcttttttcgtgccgcgctgcagcttgatgtagaacggaatatgcttgtacagggaatctgtctccttcgcattgtatcccatcgcatctccgggagccatgttcatatatttttctgctttattgatctcgccgcctttttcaccaaatccgtaaaaataatcgtcatcctcgatctggctggtatgaatgcggcgcctgttagaatcctcacggtacgcaagctccggaatatccgcatgaagcatggttccttctgcatcatagacacagatgcggaacggatctttttccacttccacacggagcttctttccggtaatcactgccctggtctcaccatccaccagtgtagattccgccacggtaatccgcttccggtaatccttcatcagttcatctgtgcgggattcccacgcggttgttaccagactgtaggacgcttcatcccagtccccgtcaaaacccgcccggatacggatgatatcatccgtaaggaaccatacacgaatctccactgcgtctgcagcaatcgaataataatgattctgtgctgtgacagcacctgctttgtaacatactttcacgagttttcctcctttggttttgtaactctttttcttattgtctatatccggttcattcagatctgttttccttctatcatcatcttacaaaacctcaggttcaataactatacagactttgttcaaaattgcacttttttttacatatcttgcacttgttgcgttttcgctttataatttctatagaaacagagttttttattttctatgaggtgccttatgattgatgttgcacagacaagtatggcagccggtgcagcctgcgccatcgcccaggtaaccggcgtcaatgacaatatgtcgcagtctcactatcacgattattttgagctgtattttctcgacagcggggagcgctatcatctgatggatgacaaactcttcaagcttcaggccggggactgtattctcttccctccacagacgatgcaccgttcctacggtgaccaggatatggcattttcgcgggtggtgctgtatttccgcccgaagacgatcacctcggcggatcttcttcataagcttctccactcgcaggtggtttaccgtcctgacagtcaggagatccaccagctgcggcgtatcatctatgccatggaagaggagcagcattcgcatctggactgccacgacgaatgtatgcagtctcttttgaacctgattatggtgcagcttctgcgcatgaatcaggagagcaccggcatcctccgcgagacccgggttaccaaagtgattcagtatatccataaccattacgcagaagatatcacactcaaagacctctccgagcgtttttatgtcagcgaatattacctctgccgggaattcaagaaaagtaccaagcgcacgatcgtggagtatatcaagcagacccgcatcatgaacgccaagcggctcttcatggaaacggaccggaatgtcaccgaagtcgccagagaaaccgggttttccaacctgacacattttaaccgggtcttccggcaagtcgcggatgttacaccgtccgagtaccggaaacgctgtcaggagctgcaccgctaaagcgtcggcaagcagggggcttgttttccctcttatttttcataaatatacgaaaacggggcggcagagaaacgcttccctgccgccccgtttttataatgtgatatctttgtttgccaaccttctgctctcggaatattggcttatcagttcataatatagtgcactctgctctcctcataccggtcttcctgcgctctctcctctgccgggtaaccgcatggaaccagcgcgaacgcatgaaggttctcgggaatatccagcacttcccgcacagctttcattctgccttcatccggcgatattcccatccagaccgcgccaagcccaagttcgtccgcttccagcagaaggttctccaccgctgcgctcatatcgatattaaaatattccggcgcaattcccttagaccggaagcacggcacaaacacaaccggcgcgtccttcgcacattttgcatagggcgaagcctctgacagccgcccgatcaccgccttgtccttcaccacataaaattcccacggctgctgattgcacgcggacggagccgccatcgccgcttttagcatcaactcgattttctcctgctccacgtccctgttctgatattttctaacgctgattctgtgaaaaatactgttcatcccgtatccctgtcctctctgcatgttccgccggcgttcttcccttctcttaccttctgccatgcgcagctgtctctgccgcgctctgtcttatgtccggtactccatgttccggctgtccatactttttatctgtaatcttccgacacttccatgtactcccggctgcgatactcctcgtttagttcccgcaattccttttcgccatatcaatactcctttccgatctcgtcctcaatgccgtacattttcttaaaccgttccaaatccgccggccccttaatcagcatcacttcctcgatctttcccgtatgaagatccttgaaaccggcaatctgctcgccgttgcagatgctcgccttaatcaccggcttttggctgactttatcataagtctgtgcgggaatttttttcttaaacagtttcgttgtggtcaccttctttcacgtggaatgattatgtctatttcttttcccttaagtacgattacaaaaacattcataactcatccttcgtatcccgcataaaagtcattgcgcattttgtaaatcatactcgcaaatatatcccattttcccagtgtattgcggtgatgtttccaaaagattatctggtgcctcgaatacataaatttgatttgtttctttattatactttaccagaccacaatccgtttcatctcgttctggtttccattcctgttcactatatgcataatctggccagtgataatcccaaaaatcataccttgacggcataacattctcgtagcttccgtcagaattaatccaacgagatacataaaatgtatctccaacccattcactgcttctaaagccaacaaatagcgcatagctttccatcccttgttcccgcatctgagcagctatcgtgtttgcttcttcattacaagtaatggttgcaagatatccacctttttgcttacaggcttcctgcgcttcatcccatgtagtatctgctgcaatgaattcataccggtgatcataagaagtccatttacctgtcttaatctggtacacaaattcgttatatgttttgaaattatcaggatatctgctctgctccaaatcataaaactccgcaaccttcgaatcaaatgtttcttcgcttacctgttcaccttcccactcataggtaagtgtatccggagaattctcatccgtaaaacatgctataccagatccgataactgtaaattccccgttttcgtattttgtaatatctagcggataaaaacccatatgacccgtgttagtataaaccaatccacttttttcaatgtactgtgatccaattctcgagaaatatccctcgactatttcaccatcatagtacccaataatagcttgtcccgaagcctcaatacctgtatcaatgaacatttctgggatatcatcatcatctaaataaataaacgtaaaagaaacttctcgcgcgcaaggcgctacttccgtattaagataatccaaatacgcttttctccaggcatcttctgggtcggactgcgctaacccttccagcgtttctgtcccttcagatgactcgtttggtattgaagatttctgttgttcagacgttgtatctcccgttgacattgagccgcatcctaccaatgatgaaaaaacaaatataaaaacaatccatctcattttttccatgttattcatccccttagatgatgatttatatttttacgcatcaaatgcattttttgataattattatactaaagttccaactaaaaagcaccccataatgatgcctttcgttttgattgaaaatttcatccaccgctttctgaatatctccttttccacgagccgtttctataatattcaaaactctactctgactctcgctgatgaagggtgataaggtgatcaagattggagaaataggctccaacctcactttgttcgtccagtgatggtaatcctgcacacaactccaccatcaaccacaaacacgactttcccttttgctttatcgctgatcttatcataaagtctgccggcactcatagactcaccttttacagtgaatgggctgttcgctacatatccgaccttcccaagtcctttcacttttacttgtattgcctctttgtcatactcattatccggctcttttacaagtttcactttcataccctttttcataaaatcactgccaaaataatgcctgcaaccagctattgtaaaatacatctcatccataataacacctccgcttaaattaaaggatcatcgtttctttctgatctcatcgtactatatcagctgtcccataatcatcccttacacatcgaatctctgttctttatccggcttatttatcatactcttcgagctcctgctcaattttttcattcctgtaatcaacaatatcaccgatcagaagaaccatttctgatgctgctatcagaatcagtcctgcccttgcaagagacttcccgactgtgtcgttcgttttcttagcctcctccgcactctttccaagcaacctgatcagctcaatatttgccaaacgctgcaaatttctattgatggctttattatccttatgaatatctcttaatgtcactttgtttgtcatgatgatgaccctccttttgtcttatccaaccatatctttgatattttctactacatgcagtttctcttcctgttcgctgtctgcaagctgcagattcgccacttcattctgccctgaaacgcccatgagcccttcaacttctgcaaggttcgcttcacaggtatctgcaagtgcgtcacagtctatatagtccgtcaatgcatacaggcaatccagttccattgattttgattttctttcaagtctgagttcttttaatcgcttaaacactttatacccctgtgtcacattgcaattcgtatcttccgcttccaaaagggtctcttcgatttcctcatctatctctctaatatccatctggagatttgttatatactgaccggcattccgataaaactctgcctgctgccttgcaaatgagagccagtcgttttcttttccatcaaacggagtaatgtttctctcctcaagcattgtctcttcaccaccttcatctttttgtacaggttcaaccacaaatctttgtttttgaatctcatggccatgctccatctgccgtatatccgctctttgcaaccgcttatctttgagtgtgcaattttcaaacagttcatcatactttcttggtctatattttcgtgtctccagccctttgatgcatttaagtgcctgttttgccttggcgacattcatattcgttccgaaattattctggaagtattcaattctctggagctcgtctttgatatctctcctgttttcccgacacactcttaacagttccactaaatctattgcctcttcttcgttcgtctcacatagttcaatataatgcagaatatcgcaaattttctgttctatatcggaatgctttttcgccagttgttcccggtagtccttcaagccttccacaagataggtgaaatgtgtcagatattccgcccagtcgatttctgacaggtcatatgacgacacgtttttttcaactggttctgatacctcatcatacgcgagttccttaatcggagaaacaaacgcatcttcatacgcttcgccactctctactgcttccgcatccccgtcttctgccttttcttcaagcggaaccatacaataaaacgcggctttttttcctacacatatgcggctattcgcctgcgcaaatgtaaatacagtcgcatcctgttcacctgccactgccaccagctgatccgcctggtttgttctataataatttccgctgtaatccattatgtagtataaagcatctgctcccataggcacctccaatactgcgtcctcgcccttgccacatcatgtatcctcaaaaaaataagaaccagcaagagtttatctcttatctgattctcattataaagatcggggtgtcccataaacacaccttgcagatcgaatttttgttcttatttcttatattgccggatcaaccggtcaatttcagcattcatcatttccactacattctcaggtcccgtgagtgtaactccgtcaccgagaccgataatccatgccaggaactgtctgctgacggcaacttctacattcacgacaaacctttcatcatccagccggatcatcgaaacatctttgccaaaacggtcgatcatcactcccgcaaaagaattgtcacactcaattcgtactaattcctctttgccgccgtacattccaaacatttttctggcatatgctgccatatcaaatgccttaaatgcctgtctgccttcccttcctctgccatttgactggatatcgagcattttgtccactcgaaaatgcttgatcattctctccgaactgtcgtatgcaatcaaatagtaattctcatcatcccaggataaagcccacggactcacctcgtatagtgcaccatcatgccgtagttctatcttcttatcaacattccactggaaatattgaaacgttatccttgaattctccgctattgccgtatgaatcctgtcaacattataataaatgctctcattcatcgtcttgacacggccagccacaaatacctgccgatgcaactgagaggcttcatatttgctcgcaagaccctcgatcttttttatcagctcgttggacttcttaactgtgataaattttgccgactgcacagaatcaaccaataactttaattctgcaagctcaaactggcggtttccaatatggtaggaatatgttctgtcctcctggattccaataatatctaatccgtataccctaagattttcaatatcattatacaagcttttacgttccgcacttatgccatatgccgcaagggcgtcaatcatttccggcatcgtaatgctgtgtgtttcgtccgttcgctcaagcaaaattttcataagatatatcagtttcaatttttgatttgacgacttaggcatggcacacctccaaaacacacaaacttcccttatatgatagcataaataatcctagtatgttgcagtgacatacccattccatgggattctgactcttcatttcctcagtaactctctctgtgcctctgcatctgtccagctattttctttctactctttccagatcaatcccgcagacaggtttctgaactaaccagctactgattttttacattttctccatccgataaaatgcgccttttttctctatcaattcttcgtaagagccacattccagaacatttcctttttcaatcacagcaatccggtcagcattgcgaatggtagacagacggtgggctacgatcagtgtggtacgtcctttcacaagtttctggattgaatcctgaatcttcttttcagagatgctgtcaagcgcagaagttgcctcatccagaatcaggatcttcggattccgtaaaaatgcgcgggcaatggagatgcgctgccgttgtccgccggaaagattttccccatgttctgtgatcatcgtgtccagaccatcaggcagtttctggacaacttcttccaggttggctgcacggatgacattccataactgttcctcggagatggattcagatccataggtgatattctcgcggagagttccggtgaagagaatggactgttgtggaacgacggcaatctgctttcggtagctgtgcagatccagttccatcaggtcatttccatcaaccaatacctgtccgctgtcagctttcaggaagccgatggcaagattgaggattgttgtttttccagagccggaaccaccggcaaaggcaactgtttcccccggctgaatcttgaagttcagatgacttaataccggtttttcatcgcctttataagtaaaagatacatcctgaaatgtaatctcacctttcagatcaactacttttttcttcctacggttgtcctcaatatcatttgcacaaagcacatcaccaatcgattcaacggattccaggcccttcgcaatgattggcagcaaagtcacaatacttgcaatctgagcgacgatactggaaaaataagtctggtataaggtgatatctccgacaccgatgattcctttccatgcaatgtaggctgtaaatgcaagacagaatacctgaaagatctgaaatgcaacccagctgattgaagaaaagtatgtctgaatcatatcaagctgaagccctttttcagcaactttgcgaagctgttcactcattttacgggcttcctgatcttccagagcgtgagctttagttacaggaatcatttcaaccatttccattacttttgcagaagtttcttccatttctttacggaaagcacggttatgggttttgatttttcctttaaaaccaacaatgatcaaaacagaaaccggtatcgtgcagaggaagaaaagaaatacgatccgacttttgaagatgaccactccgaaggatacaccaatgttcagaatgatagtcaaaagagagataaagatctgagatgcaagattttgtatctgttctacatctcgcataatcttcgactgaagccttccagactgcatttccttgtgataggtgatcgacaattgctgaagcttgcagactagggcttcgcgcagttctttctctactgttcgtaccgttttggcatagagccaggtatggatgtagttggttggtatgttctgtaccagaaatacaatcataaggatggtattcagaatcagaattttggtaatattcccgttgtggtctgtcactgcattgataatattagctgtgacgattggaagaacccaggttggggaatgcttgataatgaaaaagaaaatggaaccagccagcgcgccatagtgtcccttgaaaagagaaagaagcgtgcgcaggttattttttctgttccggctgaagatgtgcatcatggcagcttcttcctgccagagatcctgttctgaagtttgttgtatgttattttcttttgtctctcccatagtagtctttaataacctcctgtaccggtttgttgcagatttcgtagctggtatctcttgccgcagtacttctggaaggaagaaccggtgcccattcccacatggcaaaaccattgacccatgagcgttttgcgcaggcctcgaacatagctcgataccagtctggttgttcctccagacgtaaagctccctgatttgcccagttgttaggcaccattgaggaaccttttctggacatgcatcctgcttcagcgaagaaaaatggtttcttgaacttctgaacgaccctttcaatacggtcaagttcctgttcccactgatcaatcggataatatccgctggaggagatcatgtcgacacaatcccaccaggttacattttcttcctgatatttatcggtattataggaaacaggtccgtggtaatagtttcggatcgcagcgattacgtttctccattcttcactgcggtgttccgtcattaccatctcacatcctgcaataaaaagatcacattgttcggcttctgcaattttggcatagtgtgtctggaattctgtgtaagaggcaaaccagttttcccatttcggttcacatggaacatctttttcaaagaaactgatgtaagcgcgccagacaccgtttttacaattgacggtaggtttcagggcaacacggatgcccttgctttttgcataacgtatcatattgattaattcttcatctgagaatgtggcactggaagtgtaacaaatctcttctgagtgtgcgtgctcctgtagccctgcaggagcaaggattacgaaatcagcagccgtgtgttctatcatataatcaaaactatcacgtgcagtctgtgtagaaagagaaccacgtttgtgaaatggcgcaaatgtaattcctttaatatatccaagctgattttgaattttcattttggtaaaaacctcctgtctttcgaattatatagtttctggatgttttctgctgaaagtatatcatgtagaaaaaagatatgatataatgaatctattacaaaattgtaaaaatctatgatggagataatctgtgaaaccttattttgaatgttcagacaaattaaacaaaccatatgaagcctttttatttgatgcacagacatctgagatgtttccaattcttccacattggcattattttgtggagattctttacatggtggagggaaaggcgtatgtagaggcaggagaagagaattatgtattggaaccgggagatctgatcgtattttatccgcagatggctcatgcaatttattcagcaggacaacttccaatccgctactatgtcctgaaatttgatccggtacatctgaatatatccggttcggcgcttccaccgatttcgagtctgatcaccatggcagcagtggagcagaagctatcggtttatttttcgaaagagaaatttaatcagggaaaaatgaagcagctgattcagggatcagtgaagacgttagaagaaaaacaatttggttatgacattattatgcattcgaattattgtcttcttatggcagaaattcttcgtgtctggaagcaggaaggctttcagataaaaaaaaggaaaaaggaaactgtattaagcgaaaaatttacagaggtatctgagtacatttcacagcactaccaggaagatctctcggtggcggagctggcagaaaaatttcatatgagttattcgtattttgccgcaatattcaaggagtactatgggcagacctgcaaggagatgattctcacggtaagactgcaaaaagcggaggacttattgcaattcacagattttgacctaacttatatcagccaggagacaggattttgtgactgcagccattttatcaaggcgtttaaacagaagtatggagtgacacctaggaagtataggatgtgtcatattttatattcaaaataaaaaaggctgctactctaaaaaataacagcctttcttactatatcagccttttggaatttgaccatcgacatacagaatgtgattaaccaaccactctgtgagatattttaaaattcccataatctgttcatcttgatcttctacctcatcattgtgatgttccataaattcatcaagtttatgtataaattcctgatgttgaaccttctgtgtaaatatcttcttataattaatagattccatatactgctcttcatcacaaaagtgttttactgtataatttcggagattttctaatattatatcaatcctatcatatttatccggtgtaaactcatcacgaagcagttcatatgcctcatctgcatatttaaataactgcttgtgttcttcgtctatcatatctataccgatataatattctggtttcatttcatacataaattaatcctaccttccgtttatttgttttatgaacctgttccatactattcataaccggcaaatgcatttctcatgaatttcctatattttctcgttttaatgttagattccaccaaaacattccctaattttcttggaaatatccgaatcaacaaaacctttctgcgccatgtcatcgagtatctcacacgttttttcgtgcgataaacctttcttatatggtctgtcctcggttaatgcctgataaatatcaatacatgccataatacgttccggctcatttaattcagctgcggtttttccaaaaggatacccttttccatttaatttttcatgatggaaagctgcccagtctcgtatttcttcaaaatcattaacctctgataatataaggtatgtatagccagcatgattcttcatttttgaaaattcatcatccgtaagcttatccggtttttccaaaatttcattgcctactgccatcttcccaatatcatgcagtgcaccagccagataaattttttgcacattaatagaatcatatccgatatattgagcaaaaaaagctgctttttcagccactcctatagaatgcctgcttgtaaaagaagatttatagtctacaatctttgcaaaaaaatctgcgacatttttacacgttttccaatcaaaaacctgtttttgtcttgggataatctcccatagcttcatttcaaaagaattatcacttaaacatataaatgattcagaatgtgtgaatgcatgaaaaaaggcattcacacattctgaatcgaataatccatccctattttttaaaaggtactggcatataaaattccaactgttatttccagatcccgtattatttcctataatatcaatggtatctgcaagatgaataatccttgcaaacaatggaatttcattccactttttttgaaaaggaccggttccatcggcatgttcatgatgatacaaaatcacatttgacacatctgttttaaatggaattttagtaatatttttttcaccataaatacaatgaagatttgtttttttctcggataaaccttttttacaattaatgacggaatcctttttcagttcttccgaaatatattgtgtcaaagcattatcatgcagtaaagcacacatggctaaatcttgtaattcatcaccttgaattttccaatattcagccatgcatatacttatataagccactctttttccatgtttgtttttgatatttaccaactctgcttctatacagtccaaagcataagaataggctcctacaagtccgatgatatctatacttagttcttctttcattggtataatcctatcataatacatttatgcttctgagaactggtcttttcctacagagcatccgttatctttttctgcttctttggcggtcaatataaacagtccataactcaacttatacattgcttttctatccatgctgttccttctttaccttctccctgcatttcgggcaaatgcctttaaatgaaatatcataatccacaaattcaattccatgagtgttatgaattctttccagcaaatccggcatttgatccatatccacatcaaaaacttcaccgcactttatacatcttacatggtaatgatttttcaatgtaaaatcaaatcggttcggtccatccggaacttcaacctttcttaatgcaccttcctctaccaatatatcaagatttctatatacagttccctttccaattgttggatatgcttcttttataaattcatacacttcatttgccgtaacgtgtcttctcatttcgtatacggtatttcttacaagatctttttgaatggtatttctcctacttgtcattcgtcctccttattaggactagttctcaataaggattatatgccactatcatcctgttgtcaataaaaatagtaataattctcattattataaaagctgccaaactgagcatcttttacctgaataactaatttattttgcgttcaaatacatattctgaatctgaagataaatcagacctaaacgaatatccgagtctgtcaaatttctgaatctccaccggattttcaatattattttccgctatgaatctgaccatttcaccacgagccatcttggcataggtaccttttgttaccaatttatctccggataactcacaaaatacaatcgtaatatatctgtcctgtggtgtcagatacttttctatacattttgagtattcttttgatgcaagattaatgataatcctactgtcatcgattactgagcggtataacaattctccccagtactcatacagattttttgcatctccaattccaacctttgcctgcatttcaagacgataaggagtcacaccatccattggttttaaaatgccataaaacgcagacaagattcttaaatgattttgcaaatactcaaactgctggatttcaaacacagatggtgccatatattgaaatgcaatcccttcatatgctaaaacagccggagtaagcctgttataaagatccatattttccaatctgttaaagttctgctctgcaatcttgtcattacatttccagatagctttcagttcttcttttgatttgcttttcatccagtttaatacttctgctgtcttatcaatatagacaggcagtttaaccggtgctaagttatcggtatctacaatcatcttttttgcaggtgataaaataatcttcattatgccaattccttaagcatattttcaggatcatctgccgccttgactttatcatttgcctttataatgattccctgctcatcaataagatatgtagttctcactacgcccatagatacttttccataatttttcttttctttccagacatcatatgcttcaataactttacgatccggatctgctaatagcgtaaatgccagtccgtatttttcttcaaatctcttgtgagacgctacagagtccttgcttactccgagaataacagctcccttctcagtaaactgtggataacgctcagaaaagccacatgcctgcttcgtacatcctggtgtattatcctttggataaaaatataagatcactttttttcctgcataatcgcttaatttatgcatttctccattctgatccggcaattcaaagtccggtgcttttattcctaactctaacatttactattcctccgcttttgtattttccacctgttttcttgttcttttattacctgaaatcattttatgaccagaatagactgccataatcatgcatatcagagagccaaatgcaaagtatttgtgtgctgcttttaaccctttatatcctgtataaaaagttccaaccattgtaactattgctccgattgaccaatatttatgtgctttcatgatacacctccatattttattatcaacatcataatacaacaatttattatttttcaacaccagcatttttcatagttttcttttaagtcagcaaccaccagttcaactggtggtttgctataagccctccaaagggctatgttactactcgccccaaagggcggtgtcacaagcatttttactggtccgctataaagcgatacttcttgaatcttcttttctcgattcttctgcttgttcttttatatacttctgtactgcctcgtctgtgatattaccgattgtttccacataatatcctcttgcccaaaatgctgctttatcccacttactctgtaactctgggtgacgatcgtatagcattagggtgcttttaccctttaaatatcccataaaatctgagacacttaatttcggtggtattgcgacacttaaatgcacatgatctacacaaactgctccagcaattatttctacatttttatatttgcatagtgtatttaagatttcacgtacatcctctcttaccttcccatacaatacctttttccgatatttgggaatgaaaacgatgtgatattggcatttccatctagtgtgtgatatgcttttattgtccacttggaccatctcctgtgttgagtttggcttgcgacaccattctcaatataccacaggaggtttttcttttttatcctcaccgtttccaactattccattctccccagcatagctgggggattagacttttcattcaagaaaaaggcgtgttcatgggagtaagcaacaatgtagtcattctttcttttattagtactattttaaaatattctatttcgctatcaccctcattgactcccttggtttcctcataaaagtctcaatagaaatttgctcaatctttgttccatccttaagaacaacaatgtccccattctccataattattgtcttatcatcatacttgaaaccaggctcagcatccgtctcgttgaccgatgcgtcatttgccaatcttcgtacttcaatgtacaggcgatattcttcctctgaactgatatgaagatctggcacatctggacagtgctgcaacaagaacatatttgtaaagaatgggaaatccctgacttcttttgcaaccaatgggatgtttaattctttccattccttaatctcaaatcgataatatgcctcatcagaattctttggaatctctcgtatgtctctacgctttacagcacttgtctttgtaacctcaccatagtacctgattcccgcttctctcccaaagatattgatagattgataaattgccacataatgaattggtaaatccgcatccctaatctttgacgccgggatatgataaaacttatactttaagcaagtatccaactgtgctctgtttctcaacgctccaaccagcacatcgcgttgattccaatcaatcttggcaagcttgtcctcaatacctcttggcaatgttgctctttcaaatgccgaatctggagaatcagctatcagagcatcaagcatatcctgtaccatagaagtctctgaaggaagaaatggcaaaccgcctatgttcactttctcaatactttcgaagaatttgtgatttctatattcttccttatttgcataagggaataacacatatgccccaaacattgttctctcgtatggatctgcaccattatgataaacaatcgcatctctgtaacgatgcattgtatttatatcatccgtttcaggaccaggtgtatgtgaaatagtattgtaataatcactgccttccaacgcaggatttacgcgatactttgcatcaaatacatattcatatttaaccttttttccaacctgatttaccgtctttttctcaagtgaaagaacattatcgggcttttgcgccacggtcggaacttgtcctgacttagggttgtacgatagtgtaatcacttctccattctctgaattacgatacttaacctttgacgaggagccctttaccaaagatacaaacaaaccatttccctgaaccttaactatatcttgagaaatcaattcatatcgatccttcatcatgctattgagcttgataaagcaccaatactcatataataaagccaaatcttttacagaaatattgaagacatctcctgtaatagataatcctcttaaaagcatcaaatagtatttatacaaatccctatatcctggagccattgagaaaactaatgacataccggaggatgcttcttttgcctcaacatcagcccaaaaagtagtattacaacgtcggtttagttctctcaccattccgtcaatcttggctattacggcctggtcttcttttcgctgcaatttaagataattctttttgaatgattccaacttcctcgcagttgaaagcagtatgtattttgtaagctgattctcttttgtatcatatgaaacttgttttcttacagccaatgctctttcaatgcgaatctctccattcactctcttcgcttgatctggatgctttttaatccatcttatcgttctgccatcagtcttcttaactttgtgacttggtaaaacttgatgtgttgtctctagcacatgatgaggctgtgacataatggtatctgccgctttaataaaatctttgtatatcttgtttataaccgcaaagaattcaactggactactattcaccttttcgctctgctgatatcctaaatatgttttcttaaggaaatcaaaaacaacattgtaaacttccttagttacatcttcgacaatctgcttataatcgttttgataatcgattttagtaggaaaaacctctataacaaggcgcaagtaattaacaccatcaatttggatcactaaatcagaaaaaccaatttcatttccaaaattgatgacgccagataaaatctcatgatttctactcgctcgtgtcaccttgttacgcacattaaggttatcatgccaaaacgcaaccttatgtccatctacagcttcaattacaatttcatactgctgttgctcataaaacatcggatagattgaatatatacccgttgaaatttccccatttcttgaggaaaaccgtggtacatcgccatcccttaaagtcatttgaaaatcatctacacaatgaaccttaattgatgaatcgccgtttttatgctcaattccttggaagttaggatgtgttgcctttccttttatggtgacacttactttttcagtttgcacatatagcaactcattagagccagtaagctgtgaatccatcctcttcaaatctccttaccatgaaagcaatcttctttgcactttccttgtatttgcaagtttctttatttgcagccgccatcatcttcgcacttacatcatcactctccgtctgatagctctcataatctcctgcgcaatacttaaataattcgcataacattatttttactgaagcgctacttccttgtattctaggcagaatcttctgcattatttcatgatcaaatgcctgatttcttgtcaaaagattacctgcattcttattgttaagcatatagaatacaatctcatctcttacacgatatccaacatgagcatttgctttttccaaaatcttattaatatcctgaagttctatacaaacatcttcgacaaaatccttgtctgaagcacactgattaaaaaaaacataatcagctttcataaatgtgttatctgcgaaaatagcttttacttcaccctgcgtagaatcaaaatttgctagtaattctacggtggaaaattcaatggtatttgccctatcaagaacctttctactgaatgggaatgtcgtttcatccatatttacagtaccaattatatataagttctctggtattcttacaacaccatattttccttttgcagtaatatctgctccataataattttctgtaataagcggatctgttgtaacttttccatccacatattctcttgtttctatgattgataaaatatcacttaaataatattccacacgcgccaaattcatttcatctaagcataagaaatatggatttctactatccagttctgcctgcttaacaaaatcaatgattgctcctggaataaacttatcatttaagttcacatggccgaacaaatctgatgagtctgaccaatcaggtcttacagaaacaagtttataacggccattctggcttgttgcaccaattgcttcagcaaacagtcttacaagacgagtttttcctgtaccactagttcctgcaagaattacaaatggctttgatttaaggctgaggtaataattctcaacaagaccttcattaaaagtaaagccttttgccgctatgtacttctttatctgatctaatgtatcctttgttgacaattgttcctcacctacttccacatctataatctctatattctcagctttaccattaacatattctttgtaaatatccatcatgagtcttaagtcattctgtaactctgattcaccaggaacgttcccttttttatattccttatagaaaatcattccttcctgatataattcacccaactcagtcaaaccatccccaagttttgcgttgttatcagcattaaatcctcgagaatcaattcgttttcttatgtcttcggctttctcacgcatgattcgaatagtatctttcttcgaattatttttccttatatctgtacatccctgattaaatgaaagatataaagaatttccatccttagaaagtagatatacaatgtaaatgccctttgtggctgtggtcgtaatcttccggtcgaatatacaaacccatggaatcatggcccaatttccctggcctacacttcctgttatcaaatacggagctgattctacaattccggtttcatatattgctaatggtatatccgacctgaaaaacgatcccatctgatgtcccgcaaatgtttctttttttgaagggacataatcattcagaatttttgttaccactgtatttagattcataacacctggtgttgttgaaacagcactatcttcatttattgtgttcacggttacagcgggcaaacatttaaatgttagttcgccaacttttccagagtatacttctagctttccgcctactgcatcataattgtctgagttaggtgagaaaatctttcgtaattctgaaaccaaatcccctgaatatctaacttgaaatacagttcttcctgcattctccccagtcaaattaacatttgtatatgaggctgaacactttaactgaccaacccatacaactatttccttacgttcgcctttttgcaaatttgcccctaaacattttgcaaaaatatcccatttatctacaggaatagtgaatcccgatgtcaaaatggatttattgatattatttgaatatatacattctgccatctaccttttctcctccacatactctaaaaatatcttctccttaaatccaccgcgcttttcagccttattagctctcatagcctctaattcagccaatatctcaccttctctctatcactgttacattgctatatgttcttttttgcttttctaggatcctctggtttttttgcttccttaggaatcatccacattcttcccatcatgatagcgccttctatacgtccttctttgcaataaatcgccactcttctctgtgaaacattccatttttttgcacaatctgctgaagttaaatattccattctatgtcctccatataaaacgacaacatgtcgtattaattatattcgaatacgcgaatactttcaagataaatattctatgttgcgaatacttttctatatgttgacagcatggacccgcagccgcacttgaaggcaatagaaaaggccctgaccatagaattttccccacaatcagagccttcggcagaacagcctagcacagctgtcttcgttccacttcggtcgtcgctaaacaagtgccaccggcacttagcgacctgctgtaaacatatttagttagctaacacattttatatcgactattttactctcttcagtttgaattgtcgcaaattttgcgatggttcaattatccagttcatccagcatccgctcaaatggcttcacatattctttcccttgccgtctaattccattattttcaaatgctgcctgttccgcctgaacactttcattttcctgccatctgtcacaagtgtattccatatcaagaaacattctggtaagattacctgtcatttgcctatctgctttctctgcaaatattattttccccagcccggacatatacttatcaatttcaaggttattaaaaccaccgacttccatggtataagggatagcttctttgattagttctgcaaacttatcaacattccttggcaatctgtttctgaaaactagtgaatacatcgttctgtcattcattaggataatcgtgttctttccattaagctttgttatatgaccatgccaggcatataattcattaatttgagcatctaccggcattttctgtaattcattttcttgatatttaaggcatcggctaatgccttggaacaaaatatatacatagccaatctactccttacatttccatagtgccattggatgattcttcactctttcaactatctccgcgtcttcaaaaagcaactccggcatgtattttttctcttcgaatctatcaatatattccttctctttagtattcaacaccatgagatccgatatgtaattcttcgcaatcttctttctctcatccaactggaaattatctttcttattaagcactggaaataaatctcttctgattttgttgaaatcaagtgtgtcaatagctgaggtgtcaaatgatttattaagcgtatctgctgaaatcgtcatataaaataaaaagcattttctaaacaaatcacgctgttcttcaaagagaccctcagacaacatattgcaccaatcatacaaatccctggccgcagctcttgtaataagagcattgcctttagctgcaaatatttccaaaggatttaccattcgtattttcaatccatcatcaaatgctgatggaagaatgcttctgtacaccggttcaaagatatgcgccctcaaggaataattgagttctatcttaatcatatccctattaccaccggcgttctgataattatagtgaaatgcatccaagctatggctaaatcttgatgcttccgataactgatacccttctgattccatatattccttaattatgtccgttatctttgcacggcattcaagcataccctctctcgtatcattaggagtataatccatatcgatatctactgataatcgaggaaggttaaatacagttaaattaattgctgttccgcccttcaagagtaaatgctctcttaaggacttgtcctcattcagaaattttaatatttccttcaatcgaagcaccttttcaaaagtatccctcacaaaaccactttctgtggccattcgtccaagttctgctctattatattgtggcatcttctatcaccccatttttcatattgtaaatattctctggtatcacaagcttccattcatcaacatatcgtccactcgacatgtccttcgtcaggtaacgcttactctttccaatctgactcttacatgtatcaaagaattcatctgaaagccccatcttctccttatactcagaaagaagaaatcccatcttttggtataggaactgattcgataataggtctaaatatttcaagactcttttctcctgcattcgcttcatacttccaatatcctgtatcacttcttctattccagctattttatccatatcctttacgcagtctaccaaagttcgttcccgatttgtgatacgtattccaccacttagtgcaggcgtttccacgccttccatatcctttgacgccacatatcgatacgtatatccatcaaattcaaactctcgaaagctggtttctgatgcaacatagacatcgtaatatacctgatcggttatcccgtaatattccatagcggtatggtgagacacataagaggttggcgtaatcttgcttgctatctgaaatctattagcaaccggcgcccctgtctctccactgatgcaggtatacatattgttacggattttcgccactattccctccttcatcaatcgcttgattgcagagcgagcgctgtccatattgtcataatatttatttacatcttccacagtaaatactggagttttcaatagttcaaaatacagattcaaaatcaacgcctccatgttttataaatcaacttgggttatatgtaaactaatttgtcacttttataaacctaatataataccagtttccaacaaagtcaagtttaattttatttcaaaatggtttgtacagttgttgatttgtcgcatttttaaacttttacaatggatgatgcagaatttgcaccaaccacacatagtattctcgttgcgcgattacccagcatattgtggcatatcatgatttatctcagccctataataactgcttatggtacttcctgcattgaacaagctggcaagtaaataactttttatattccgcatcttagtagtattctttccaaggcaattaattacatactccacatgagaataattaagcttcaggaatttgcttttcacaagattctttggatacacatctcctgcgatggtaatctctccatttttagacaaaactgtctccagaatcaggtcaaaaattccctccaccatctcctggtcatatggatgagccagaagaaggctgtcatactcaatattctccttgatgatttcgctatagccttccatctcgtcaatcgctttctcgattcttctgcttgttcttttatatacttctgtactgcctcgtctgtgatattaccgattgtttccacataatatcctcttgcccaaaatgctttatcccacttactctgtaactctgagtgacgatcgtatagcattagggtgcttttaccctttaaatatcccataaaatctgagacacttaatttcggcggtattgcaacacttaaatgcacatgatctacacaaactgctcctgcaattatttctacatttttatatttgcatagtgtatttaagatttcacgtacatcctctcttaccttcccatacaatacctttttccgatattggggaatgaaaacgatgtgatattggcatttccatctagtgtgtgatatgcttttattgtccacttggaccagctcctgtgttgagtttggcttgcgacaccattctcaatataccacaggaggtttttcttttttatcctcaccgtttccaactattccattctccccagcatagctgggggattagacttttcatttatcaaatttgtgctcagccaaccattgcatttcgctttttaggttaagtaacaaatcaattacaaaaatactctttagcgatttttcctccgttccgaaatccaattgatcgccatgacagattttatttctcagcgggttatgatcacgatattcttccccatgactcgttagcactacattgtatatgtaatcagtcattgcttcccaataaaagacagcattttctgtcattgcagccaacctcaaaatcatatgcttttcgcttgtcttcgcaaatttcttatgattctgaaaatcaatctggtagagttcacaaatctccttctcatcatcttccgagcatattaagccattttcatctgtataatttgaaatgtcacaaatcagaccatccacttgacacatcatgatagaagtcgcaccataatagcatccagagttgtgaagattaactgcctcctccaatagcagcaatctctctgaatcatccttcaatagtttcctccatccgtctactatattatctaatttctcagaattatagtaattgcagatagatgcagccaattcatccaatggatagttttcttttttatccccacatagacccgtaatgatttcttttaattcctcatcatcttcaagaaatagtggccatgtaatgctttttaacgtatatagatatcttaggttacctagagtcttaaaaaatgactccggaatctcaattttaggaattgtagcagtgatagccgcaattgttttacctaacgattctagtgctggccgaacggattccattatctgttgctgatattcaaaaatggggcggatagtctcactaattctacgagcgttttccataaaggtttgcgagataccttgatactgcttcatacaatcagcaatttgttttaccgcagaaacaactcccggatatgcttctatggagcgggatgcaatctttgcagcatctgataaggcctccatattttgaatataaacagatggaatagtatcctcttcctcttcgcccatcgcccacagtataaaatcaatctttttggtatcgctgattgatgaataatccggaaaacgactatcaaaggatgttatatattcgttatagcttgccttgtttgccttaagatcactataccattgtacaatgacatcatataactcaattgtttcctcgagtttttgctgtcctcgtttatttgaagatttaattccaattctatcaagaaccttcgaatcccaaattggcatattctcatctatagatgccagcatcttactcgcaaaggatgcctcaacttgtccggttccttcgtacagttccgttataatttctttgtaggaacaattcttctttttcttcctttcgaaaatctcaaagaatactttccgccattctgcatttcgtctaaccttgtaaaaaaagtcaaattcccgctgaaaatcttgatcatcggcaacgttaaccgtctttactttgctcataatattcatatagtgttgaatatcctgtgcccttttttcaagattatccaatgctttctcaatgtcatgattcatttattatccctctggtcaatcctcattccacattcttcgttcttcccggcgacgctcttcttcctcttcttcctcgcggcgatactcactgtcatcccagttataaacgcattcaccacgatctatactgaagccgtctctttctatatattcatattcaccggaatcataattgaatgcatattttgccatggcttatttctcctccaaaacaaatgtcagcatatcatatgctgcctgtttcttcgcatctttcttagacgaagatcttccattggttacagtatctttttcttttatagagcatttacaattccaaaccggattaccatcttcgtcatgcgtttctttgaagtcatattgagggatggagaaatagcctcttctggcaaggatctccaactgcccgatggaatcattataattcggatcatcaatctcatctctaatagaaaagagcatatcctcatctttcagatattcatacgccaatctcgatgcgtccatcctggccagattctttgatctaccgtatccgacgaaatgataatcaattcccggtatttgaacttcacacgcaaagtgcgtatcctgctccgcttttccatatatacacatatgataccttggcatataccatgtaccctgcatggaagtaggatagaaacagtgaagtggaatgtttcctgaattagccgatgaccaagcttgtatctcagccacatagtttacgtcttcatcaaacatgagctcgcctggattcagcataacattcatgctatcctgtaatgcttccatatcccaatttgaatccaaggctatcgcaccaagaatcgcttcaaacagatcctctttaaccgatagtgaatcctgaatgtttttctcgacatctccttttcccattatcagatagtaggctatccctaagttgtcgattgcatctgcaagagtgttcttttgaaccaattgcttcttaatctcagttaattctccctcatccaaatcagaaataaaggttcccgtttcctcggtcttacccctcttttcccagttctgatacttctttgaataatggccgaattcctcggagagctgcttcacgacaacaaaatccaatgccttgtctccgataaattcaaggacctcattatcctgtcctccattttccattgaataggagcgacgagtaaatgcttgaacaagcagctcctggtttttgaacgtgtatccaatttgatcttggataaatttgatttctttctcgtccataaaaaaagacctcctagtatttatactaaaaggcataaagatagtctggcagaaaatccacgtatcccgggtacgctgaataagccagacatgatagattaaatttgattccttgttcttgagagtttaccgatgctcactttcataagcaaagataaacatgcataaacaatgtctcatatttaacttattatgcctttttcaagtaaagattaacacacgtcaaatagaaacacaagatattataaaagcatttaagggttcgagacatgctcaaacccttaatgtatacggatttcagagtgcgccaattttttcaatcagcatatcacaccaatcctgcactgctatgacagccagcaaaagagccttgatagctacaaagatcagagacataagaaagacatctgaccatctcttgcagacaagataatatataataccgcctcctgcaatcatagtaagaagccccacgatagattcagtgagctttaaccgcttctgcatcagcctgtgtataggtaaccttgtatcctgcttccggtccgtccagtactgctcctccacggtcttcatagctattgctcggaagtgccttgacataatcttcatctgctattgctccaagatagtcagatgctgcctgaaactggggataactcataccatcaccaataaacagaaaacatatttcggtgcttttgctgtttcttcttgcgtctgcgtttctgcagatacttctgttacaattgtttcctgctctgttgctgctgtactttctgtctgtgccggtgacggtgactcagaagaagtctggtctgctgcaggtgctccggagcatgctgccatagacattgccattacaacagcaagcatacccttcatcatactcttaattctcataatcgtttctcctctctgaaacatgttttgtctttcctctgcttcactatacaataccgttgtaaaaaccaatgtccaaagtaggaaaaatttgagtaaattccgacacttattttatgcagttctatctttatgagatttcatcaacatcataatacttaaaatcccggaagcaggcacttcctcctgtttcctctgccgcatagcagaacagaccaaacctgcaaccagtaaaatgatccagtttgaagtacagcttatgcacggttccgatgggtagccagtctcccttatttacccggtaatagcagcgtgcttcatccttcatgttacagaaatctgcttcaagacgaaaatccatctggtgtgattcaacaacagttccttccgtcatatccaatataccatcttcttttttatccagcataaggacttcatattttccatgatgttttgtaatgccaactgcagcataacagctctgcaacgcacacaaacctgcgacatcgccctctttcaatgcagaagcatcaacagtaacctcagctgcgcaggacggataactcatcctttgcgtaagcgtatttactgcctgtgtaagctctgtacaaacttcccgtgttgtaattgtataggttccctgcaatgcatccagatgatagtaccgtggatctggatcatgattaaactgccagcgcggaagcagcccattacagaaatcatcacttcccactaatggctgataaatatatcctggtctggtactgtgaacctctatttcttccggcacatgtccgttctgtccaaaaagcggaaaatgatccttccaggtaaccggaagcagaataggaatccgtccaactgctccgaaatcctgaaacagcattgcataccactttccatccggcgtatccactattcctccctgtgccacgccctgtccacaatatccacgatcatcacaaagtacatctccacccgtgaattctccttccagagaatcactgtaaaagcatgcttccgtccgcatccagcggtctctcagggaatgaatcagaaaaatataataatagccgtttattttttgaatatgagaaccctcatagcctagctccgggttcttatgatcactgactaaaagacgatgtaatccgtccttctttggtgcagtcaaatcttcattcaattctgtaatccagatttcatcatttccatatacaatatagtttctgccatcctcatcaaataataaagagccgtcatgataaaagccttctatcagctgctttttccatggaccatctattttttccgaagtatacaaataagtcttacgggtatcatttgccacaaagcagatacaaaatcggccttcatgatagcgcagggacgctgcccacatgccctgtccgtaaatattctgaccgcttttcagttgctgcgcatccgtatgatccaacgtctcatagacataagtcacatgctcccagtgcaccagatcaaaagactgcagaatctcacagcccggcataaagtgcatggttgtggataccatataataggtgtcttctacgcggatcacgtccagatctggataatccaatcttgttataggatttacattcattgtctattcctttctgttttatctccatattctttctttgttctattctatttttactattttatctttgtttcttatccgtctgccttttcaactcttctctgccccatttcactattgctaatatcacaatctcacagtaaaatataataatcgaaaacgatcctgcaccatgttattcatcagaaatttccggtttgcacagatttaccgggaataaacagaaggagaccagcatgaaggaaaaccgttttgtcactttcattatacaagctttataaatcttttccaatatcctcaagctctttcatagcatcctgatttttagaaagctcatcctttgctgttgcataatatgacttctggaaaagcaaatcccatgaaagatattttgccatacagtcaaactgcttatcaatcaactcatactggatactgtcaactggagaaccgcctacaacaatcgtgccaacttttttattttttaactgcattccacggcaataacacttatcaatgataagtttcaattgtgctgacattccccaccaataaaccggtgttgcaaaaaggatcatatctgcggcagcaattttatcaattgtaggatttgtatcatccttatctacacatcccttagaacattgacaggcaccacagcccttgcatggtgcaatattaagtttgtcaggttcaatgatttcaatttcgtttttttcagatgctccttttacaaaagcctcaatcgctgtaagagtgtttccttttcttgcacttccatttataatgattactttcatctcgcaaagcctccattctgcttatcatataagcaaataagttctaaataataatttttctcacataggcacattataccatagtaaacatgcctatgcgataacatttactgcttcttccgatatgaactcatcttctccacagttacctctggatagaagtaagtaagaatcgttgctttgggaacgcctgcagcaagagctttcttcacttcctctttctgctccggcgtatatgaccaatgcaacattcggtttgtgatagtatcctcccacttaggcttttccctctcaggattccttacaggcttagcaccagcacttccattagaagcgttggcactttctgcagcatcagacttctgcgattcatcgacatactcaagctcattcgcctgctccctgtcaatctttgctttctgttctgcttcatcctgcatggagaatcttctgcagagcatccactgacaatccaatatactcagcaagctgctgtctggtcatttttcgtgctgtccgcagtccatttattctttcaccactcttaacaatatcgtaatacacctttcactcttttccggcaccttatatatttgctcaagctgtatgtattgtaccgaaagagaaacctttatcagagtgactgaccccgctatttcaggtggaacattgtacaccgattttttctcactttactttcctgctgaaatataataaaaaggcagaacaaccacctgctactcactcagatagttgtcctgccctcttaataactgttccaccatatgtaaagcaaattctatttccctttcgtcacgccgattcatcataaatgcaaaacgctcaatatgcttttgcggatgtttccggctcatcaataccatcggtgatgactccagtgcatgtacgatatttagatatgtgtcaaggctcattgcccgtctgccattttccacactttttatcgtatccagcgatatgtctgccctctctgcaagttccgcctgtgtcattccaagccttcttcgttcttttctgatattcccggcaataatttcatatatatgctctctgttccccataatcccatcatcctttctgactttaccgcattatatcagaaattattatggagtctggcaatctgtaaccatttgccattttcgtataatactttgcagattcctttcaataccattttgacaacggattaaacactttttctatttctgaaatatcgttattgtcttgtacatattttgcagcctttatttcatacttactccactcttttttcaatgtttcatgaccaaaaacatctatcatcctcatcctcacggagtccgtccattgcaagctcatcaatccgtggtgtctccggctggtattctccggtaaggataagcgcacccagctccttttcaatattcttccatgaaacatatcttcttcattgatgatgttcgccataacggttgcaagagatacatccagtttatccggctcctggaaacctaaacttgctgtcaggctcccctatgcatccgcatcaatcaaaagcactcgttttccctgttttgccagccctattcctaaattactcgttgtggtggtctttccgacaccacctttctggtttcctactactataactttacacatgatgaaattcctccaaattctactatttttcttttacattgctcttttttacttctacatacgatctgtaatatttgtctgttcccttgttcgagtataggtctgacatctccagaacctctacctttgggtttctctgcatgatttttttgaaccatgtaatatcattctttgttcccatcaatcgaatctttaacatcaatcatttcctccaaacatcgcatacaagtttttattgtatgtggcatactccggataccgaatctgtattgcctgccagaaatatggtgcatagcaacagcagaacaaatcccctactgaatatctccggcactcatccacctgttcctctgtgtcctgctcatcatctacgctcggtgttccgttgcaatatagattaaaagcaattctaacaacctttgcactgccactggtctgccagccttcatgcaaacactccggttttacacagccagtcttgaaattgtaaattctatccgcatttcttcgtgtatcctcgtttattccaaggcaatagcaaagtgccttgtgatatacatctgcttccctaactttctggattttttcatagtagaatttctcatgtgcttcactaataaaactaatttttttctttttttgctcctaacgctgtactgttcatgtttgaacctccttataataattctgtttttttcaaccataacaacagaaaaaggacactttccttactttggaaaatgtcctttaatagcatttaactatttagttttgaaaggttcaattcgccagaacgtagcattaagcatagccatgtagactatatcacttccaaattcaaataaacgcgtgcttttatagctcgcctctcaaacgtgcttctatatcagatgccgtgtataacacatccgttacaattaccctttcgtcacggattgtgtaaaacactgaataattatcgacgagcattcta

SEQ ID NO: 13 - DNA, 152523 bp, Roseburia hominis
ttttccagttccttccgctgtgctatgagcttttttgtagcttcaatgctttcctgttcctttttctctaatgcacgtattctttcttcataagtctttgttgatttcgccatatcgtcttcatcctctctttttccgataaacaacagttcccggttgcatatcaggagaagcacatggtataatcctcttgcgtgtaggtatatcatggcttcggtctgatagaacctttggcggtttcgtaggaagccgcctttttaagttgccacatttcttgtgacagcttttacatttcctttatccctcagatctcgcccctcgttggcttccatgaacttttccagaatgtcagttttaataaggacttttcttccgacttttaataccggaagcttcttccattcaaccagctttctcaaagtatttctgccaattcctgtatagtcggctgcttcctcgatggataatgcaatctttctttccgtcatcttgtcacctcctattaaattgcattatgcaatttttgttgtgctgttagtatagcggttttatattgcgttgtcaagcgttatgaaattttaaaattaatcattagattgcatattgcaattacgtgaggtacatgctataattcatacataccgaaaaaggaggcaatcagcatgaaagataaagaattacgcaagctgataggcagcagggcaaaacagcgtcgtctggaattaaatctgacacagccttatgttgcagagaagatgggagttacagcttccacaatcctgcgttatgagaatggttcgattgacaataccaaaaagatggtgctggaaggtctttcggaagcacttcatgtatctattgaatggctcagaggtgaaaccgatgaatacgaaaccgatattacggataagaaagaattacagattcgtgatgcaatgggcgatattctcaaacagttacctctcgaccttagtaaaaaggaagatgctttttccaaagatttactgctgttgatgttaaagcaatataacctgtttctggaatcattccagtttgcctgcaagaattacaagggcaacacgaatgaagctgatattgcaaaagtaatggggtttgaatcgaatgatgaatataacgagattatgtttctccgggagatcacccacactgttaatgcctttaacgacatggcagatatcgtaaggctttattccaagaaaccggaaatggcagaacaaaggcttgaaaatcttttatcagaagttttgtatgaggattccgattcggtatagaacgacaaccggagttatgatatacttacacgcaagaagcatttcatcagttccgattgtctgatatcgaaaggagacacacgattatggcaaaaggatctgtaagaaaaaaaggaaagaaatggtactaccgcttctatgtagaagatgcaagcggcaatctggttcagaaagaatacgctggaacagaaagtaaaagtgaaacggaaaaactgctccgtcaggcaatggatgattacgaaagcaagaaatttgtcgcaaagacagataatcttactgtaggagaacttcttgatatgtgggcggaagaagaactgaaagtcggaacactcagcaatggtacagtggaaaattatcttggtgcaatccgttgtatcaagaaacatccgattgcagaacgcaaattaaaaaccgttactgctgaacatttacaggcatttctcgatctgcttacattcggtggggaatttccagatggaaaagtgagaaaaggatacagtaaagattacatccattccttttcagcagtattacaacaggctttccggtttgcagtatttccaaaacagttgattacttttaatcctatgcagtatattaagctgaaaaaacaggcagaggatgtggatttattctcagatgatgaggtagaagaaggcatacagcctatttcccatgaagattatgagagactgatagaatacctcaaagtaaagaatccacctgcaatcctgccaatccagatcgcatactatgcgggacttcgtatcggtgaagtttgcggattgacatggcaggacatcaatcttgaagaacaatgcctgaccattaaaagaagtatccgctatgatggcacaaaacataaaaacatcatcggaccgaccaagcgaaagaaagtaaggattgttgattttggcgatactctgactgaaatactgaaaaccgccagaaaaaaacagcttaaaagccggatgcagtatggtgaactttaccaccgcaatttctacaaggaagcacaggacaaaaacagagtgtattatgaatattatcatctggacggaaccgaagaaatcccggtagattacaaggaaatctcctttgtctgcctgagaccggacggatgtctggaactgccaagcacactcagcattgcctgccgatcagttgcaaaaaggctggacggatttgagaatttccatttccaccagttgcgacacacctacacaagcaacctcctctcaaacggagctgccccaaaagatgtgcaggaactgttagggcactctgatgtcagtaccacaatgaatgtctacgcccactctacaagaaaggcaaagcggaactccgccagacttcttgataaagtggcaggcaacgactaaataaaaaattcccttatttcccttgctgattccgcataaggtcaaaaataagggaaaatacatatcatttcactatttaaggggctggaaagcccgtaaaataaggaaagttcaagaaatctctccacaaatttcgatttctcgatttcaaaaactagaagttatctttttcttcctaaatatcggcatacttttgatttgtattgcaggtactcatttccaaatgcttctatcaaaaaatcttcctctacattgactatctgtaaatgaaaaaataccactgcaaaacctgtggcaaagcaaaggaaccaattaaagaacgaaaacaatattcctatatacattaaatcaaaacccaaaaatgcaggatttctgctaatagaatagatgcccgttgttaccaaattggtcttttcttctttttgcacacctgctctccaattctccttcatctgtgtaacagaaacaataaaagcaagtacaccgaacattgttattacaactcctgtaaattgcaacacaatatgtgctgtttccgaataaaagacaatactgataatctgtattacaggaagcaaatatgtgattattttaagagctacttctataaatttgacaaatccctcttttccttttcctaattggtctgtctttatgccttgctttttctgactaatcagctttgcaaaatagcagatgtagaacactgccatcagtgaaattgtaacaatttttattatcatcgtgtacctccaaattccgatttctcaatttcaaaaacaggaattgttctgcttagtttggcaactcgctttcttcaacgggaactgcctctaagtcagtgttgctccaataagagctaatatctgcacttgtaaagtattcaaaattatctgtggaagatttcagattgcctgtctttactccatcgcagccataaatcagttcataacttgttccatcagaaaggttaaatctgaaactggttatctctgctccagcggtttcctctacttctttgagttccagggatagcccctcaaacatatcatacaagttctttatggtttcttcggcaacaatgaccttcttttctgctgacacaggtgctccaacaaagtgatacatttctatattttcaacatcacctacctcaaaaggtaaatcaatattgactgtcttgttgttgcacccaaccaagccaagcacacaaaccactgctaaaactaatgctatcaactttttcatacaatcaacctccttcgtcaaattccgatttgtataactaaaatctcaactttccttattttatgcgacttggcggtatgccttgccactctatatgtatccttttcccttgtttttgcccttatgaggtatctacaagggaaagtttttcttattcgattttattctccaaccaccttatcaagtagtcgggctgagtttcgcttaccttctcggttagcgtgtgcatagacattcatagtggtacttacatccgagtgtccaagtaattcctgtacatcctttggtgctgctccatttgagagcaggtttgtggtataagtgtgtcgcagggtgtggaagtggaaattatcatcaagctccgacaatcgtttccttgctgtccttaaagctgtctcaaccgttgcaggggcttcgtatgctccgtccggtctgatacatacaaggtcaatctcgttgtaatcaagcggaatgtcctctgtgccatccaaatgataaagctcatagtagatacgattcttttccttaacttccctgtagtagttcctctgatagagttctccgtaactgaatacctgctttctctgttcctttttcgctttctttaagatgtcagcgagcgtatcacagaaatccacgatacggactttctttcgctttgtcggaccaatctcggtcttgtgccttgctccgttgtaacggacacttcttcgtactgtcagatactgttcctcaaagttaatgtcactccaagacagtccgcatacctctccaagtctaagacctgtgtagtacgctatctgtaccggcaggacagcaggcttgtttctttcttccagatactccataagcgtttgatactgctctggtgtaatcgggttgataacctctgcatcctcatcattatcagaaaacaaatccacatcttcctcggctttcctacgcattaccacatactgcattggattgaatgtgatgtactgctttggaaagactgcaaatcggaaggactgttgcaggactgcgtggaaagaacggatatagtcgatggtgtaaccctttgacttaaaatttccttcctcaccgccaaatgcaagtaaatccataaacttctgcaaatgctccgaagtgactgtctttagttttctgtttccgattgggtgttgtttaatcctgtttactgcctgtaaatagttaccgactgtaccgttgctaagtgaacccgttttcaaatcttcctctgcccatacatctagcatctgtccgagtgtgaggttgtccgctttggctagaaatttctttgcgtcataatcctccatagccttgcgtaacattttctctgtctctgatttgctctccgtacctgcaaattctttctgaaccaagttaccacttgcatcctccacataaaagcggtagtaccatttcttgcctttcttccttacagaaccttttgccataatcgtttctcctttcgatatcggcaatcggaactggtgaaatgcttcttgcgtgtaagtatatcatagctccgtctgcctatctataccgaatcgggatctttttctgataaaagattggctagtcgatttttcgctgtctcaggattcttagaatacagtcttacaatatcgcccatatcgttcaatgcgttgacggtgtgggtgatttctctaaggaacataatctcattgtattccttattggattcaaaccccattgtctgggcgagcattttgttatctgtatttcctttgaaattcttacaagcgaactggaacgaatccacgaacagctcgtattcccgtaacatcagtagtagcaggtctttggaaaaatcactttcggactgttccatatcataagggagcttattcagaatggaagtcatcacatcacgaatctgtaattctcttttatccgtaatgtctgtttcgtattcgtccgtctcacctttcagccattccacagatacatgaagtgcatctgccagaccttctaaggtcattttcttggtgttatcaatcgttcctgcttcgtatctctgaatggttgaggctgtcacgcccattttttcagcgacataaggctggttcaatcctaactcctgtctacggctttttgctctgctaccgattgtctttcgcaattctttatcttttaacatacttgcgaacctcctttttcggtatgtcattactataccacataacacgatatattgcaatacgcaattctataaaagatgatagaatttcgtaaggcttgacatagcgttataaaagatatatactttaatcagaattgcgtaacgcaagttttaaaaaaggctaatcctttcttcaaaaaggaacatcctctgatatacaagacttgtaatcctacgcaggaatgaggtgatcgaatgacagaattaaagtttgctctctccattgaagaagctgccgactatacaggtatcggaagaaacactcttagaaatcttgtggaatgggaaaagctgcctatccttagagtgggaagaaaaatcttaatccgcagggaacgattagacgagtttctgattctcaatgaggggaaggatttacgagacagacacgcagtaaaagcggtcaagggaacaatgaaaaatgaataagggacagtcctaagaccatccctctggtatgtatctgactaaaagccatgatatacctacacgcaaatagattatatcacggacaagtcctcagatacaaccagaacttttggaaaatgaggacaagatggatgtgaatgggtgcaatcgtccacccagttatagcttgttggtaggacaagtccacccaagatgcaaaaggtgttatgaatagtccacccaagccagaaaatgaagtgggtgcaaccatccacccaagtgaagccgactggtaggacaagtccacccaacttacaaaaagtgctgtgagaagtcataccaagtgtagctatgaaaaaagctgtccgacctatgacaaaaagtgtacgctactatgattttgagtgtccaatctatggggtacattttcaaagagttaatagtaaaaagctctattaaaatcaaaatgtaataaaacaatgcactattaaaaatgaaatttaataggaacttttactaccacttccttgccagacacagtttaaaagtaagcgaagtaacacaatgctattgtcagggcaaaaatgctaacgaatcgtgctattgttttttcgattttaatagcagacttctactgtttctacggtttttgctaaaaagtctgaataatagaacaatgctattgttaaggcaaaagtgctaacggattcgtctattgtttcgctgattttcatagcaatcttctagcatttctgttaagaaaagggagtgccggatacggcacataaaaagtgtgccattaaaggcacaaaattaggtgctgagggaacagttacagctaaaagtgaacttcataagcaagccctcggcgtttgagagcgaaatacacccatcgcacaaaacttcgttttgtactctgtgtatttcgctctgcgaggcttagccgccacaaggcggatgtgttcgcaagacgagtgcctatgcactcgctcacagggaaagtttactactcacatctcatctatcttatctgtcctcttttccaaaatcaaaactgggaaaggaggaaatcgctatgccaagaaattcatttgtgcagatgtcaaagctccataatgttcgtggaagaatctattatatctccagtgacaaaaaacaggaaaatctctatgcggtatatgaaaccacagaccgaaaattttggacagaacttgccaagtgcaatcaggcagaatttaagaaaagcggtacagagggaaaatgtatcgaagcaagagaatttatcattgccctgccggaatcctttgtggattatccgccagacggactattaaaatatatgacggataaattcaaaagtcggtatggtgttgattgtattgcagcactccatcataacaaacgaaagacgaattatcatatccatcttatctttgcagaacgaaattatcttgacgaaccgatagaaaagattgccaccagaaatatgttctatgatgagaaaggtaatcatgttcgtaccaagaaagaaatcctagacgagaatggaactatccgtaaaaggtgtaaggtgatcaagaaaggtgaggtctacgaaagacagatgtttaccatcaaggacgctcgctttaagcaggaacatttcttagatgaggtcaaggtattttataccgatgtcatcaacggacttgtcaaagatgagaaagaaaagctgtctgcattcaagcgtggggatgtctatcttgccactaagaaaatcggtaagaacaatccaaaggcagataagattacactcaataataaggtcatacaggactggaatcgtactgtggatcacgctttggtatcggggatggagcgaaaggaaatcttaaaggtaaagcaggaacagatttcaactccgattaaggaatccattcacaagtatggcaatcatccggagcttttgtttatgattatctttcgggcaatcgagctgttaaaagaactcataaagttgctgatacagaaacaggaacaacagaaagccagaatctccgaccttatggagcgaagaaatgaaaaacaagagaaacaaccagctccatccgttacacagacagacaatcagacaattcctgctgtgacccaaccattcaaagcacctgctactactaccgcagaaaagaccgttattccgccaagaccaagaatgtctgagctggcacacgattatgagatgcgacttgaagagattatggagaaacttaaacgacaaaacagagccattcatacgcaggaagtgaaaaaagaccttattgacgaggatttgaagaactgtacaggattattccaaggaaagaaacgaaaggaattgcaggcacagtctaacaaatacgcagaaacgattaagattatgaagcagggattatcccatatcgtgcaggattacaaatatccaacggtagatgcgttcctgcaagtctataaacaaggcaagtccgagtatgaatcctatgtcaaagcaaacaaggaatggaactccaagtatggagaaaactcaatccatcgaaagctggcagaaaaacaggcagaagttcagaaacgggaacaggacagagattttaactatcgttcgccatcagacagaggagctagataatctaattaaattcaaaaaagataaagaccatcaaattctttatcttttttgaatatttatgaaaagtcatcctgctatttaaagtgtctcattagatttttaattgtttcgactatcataagaatgattacgcagaaaaaggaataaaacaatgtggtattcatcttcgtgtttccaattttataaaacagcagaaatccaatgctaacaattatcacagaaataagtttatgtatccatttttgtttggtggttaaacatattttatggttacttataggtgcaaataatatacacataaggacaagtatcaaatatcctagtacagttggctttaaatagattatagcccacttatcaagacaaccgagaaaaaagctgcctaagatacatgttaactgcgttggagcatgggcacctccggtataatgtcgtaacaatgaaaaggtaattacccaaattagggtatagccgagtgtatgtgataaaactccccatacgaacaataacactatggttataaaagtattcaaaaaacattctaagccatatatgtatatttctaattgatccgcagaaacatcctccccggatagttctgctaacttattagcaatagatgtagcccacttcgtaatcattcaaaatccccgcttgtatcaaatcttgttgtatatttggcaaaagcacttatcacgtctttggaataagaacgtgcgatttgtgtagttagatgatttgacaattcaatcgttcctgatgtaatacgatagatatgtgccatatttacaatataagaacgatgggttcggataaattcacttggcaaatggacaataatcttatttagggtagacatttgttcatagcatttgccgtctacggtcaatatatccacataatgtaatctgctcgaaaatgtcaatatatctgcatagggaatacttacaatttcctgcttgtttcggtatatgtaggtattattagataactccttcgcaatttcatccaaacacagaaaaagagtattttccttgacgggttttagcaagtagtttaaagctctgacttcatatcctcggaatacatattctctaaaagctgttaaaaatataataataccttgataaccagattcacgaaggcgtttagcaacctcaattccattcatttgccccatttgtatgtcaaggaaaaatgctgaagcctgtatagttgtgccttcagaattttttgaaaaatattcttcgcccgattcgtattcgtcaatttcaatatcccaatcatattgctgcccgtattttcttattccatttttcagccgttctgattcgatcacagaatcttcaagtatggttattttcattttcatagtagtttgttattctccttatccggtatcataatatgtacggaaaaaattttgttatcagatgtaatctgcaatacgccatctgccttttctacaagctcttttactagtcttatcccaagtccatgttcttttccttgtttaacactcaaaatgtctccatcaatgctaccttttatcacaccatcataattattttcaatgtgaatcagtatcatattctggtaaggtttaatataaaaataaatgtatggatgctcggttggatcagagattataagtctttctcctgcttcaatggaattattccatatatttccaagtatggatgaaagctcaacagaatcaagcggaaaattttcaggagccataatagaatattctgtcttaattccgtgtttttcagcataatcaagttttgcggtaagtatgcagtcaatagcaatatttcccgttgctatggcactttgcgtagttgcaagagtgttatggtattgctctgtatatgctataagttcatcccatttcttgtcttttgctaatacgttgattgcatccacataaatctgcatatcatgtttcatttttcgtaatcgttcagttgtctcagataagctattgaactcagtcctttccagctcataaatcttttgttcttccagtaatcgtatgttttcttcttttgaataacctagctggtatatgtatagcatcaatactaaaaataaaataataaaaaacaagtcaaccaatgatagcctagctgaaaaggatgaatcaccaaatttatcaacagattccaaagtcagccttaatatgtagtgcccgattgcaagtccagaaattgcgatgaaaatatatgcaactttttggaacggtgaaagagatatgtctttgtttccaatagaatgaaataacaagacaaaaacagctatcattgccaaatataacatggtatatggcttccgtaatgttccacctaataatagctccagagacgctcctttataaagagtaacgggaataaagaacgaaatctgttctgcaactaagcaaatgatggaatacgaaaagccccaaaagatacggcgaattatactatcacgatagaacaatactgcatatccaatgtccaaaacacaagatgacatcaaagtgctgtaggatgatattcccattttattcagcgtgcataacacagcaaactgaaatgatacgaaaagaaacatcaaaactgcttgatgtttataatttgctcgaatacgcaattttttatggataaatattataaacaatgccagttctaagaaattaacaatatattcccatattgagtcaatatatagcatagctaccacttcctttaatcattctccgtcatattttatcatcaataaagtaggtacacaacataatatgctaccgtttgtgcatagtgagctaccattcatgcatagaggtattgaaaagtataaagattttgttatattcaaggtatactactacatcttaagtattctgagaatctataatatggagtggagatgataagatgtcgtactttaggaatattaacaggatatataatgtgtactagtatgtgttgcgtttcaattttcataaagataacctttaagaataattgaagataaccgttgttacatgattgaaaaggagtgaaggagtatgcattttaaaaaatctgttttaaaaaatcatttattgtatagcattataactttaatggctatagcaatgctatttcctattacggcatttgcacaagcttatgtacaaacatgggatcttgttgattctggcaaacatctagactatgacggaaacagcacttacatgagttatattaacactggggctgccacatggaatgcatataaatctggagtaatcagaaaagacagtgcttttgttgtagaagatgtatacgtaagcgatgtcaatgcttcgaatggatgggcaggcatgacatattctagtggtaaaattgaactcaatacctattatatgagcggttatagtaatagtaaaaaacagaatgtagcgacacatgaattgggacatgcattagggttggatcacagtacttcaacagatgttatggatgcagcaattacgggacatactagtacgcaggcattatctcaaaatgataaagattcatatgatgccgcatataataattattaggggagggagaacgctatgaaaaaatcaagtatctatggtattttgtctattgttcttatcgtaggaatgttttttacaggatgtgcatccaaaaataatgcaagtcaactgaatacaaatgtatctaacttgccaatccaccagatgcacgcatcttttgtatatgatactgataacattcgcgaagctgttggtatctgtgattacgtatttgtagcaaaggttgtcagttgcgatggaaccgagtatcgaaatgttataacgactgaagatgaaaaaggaaatcctaaggaggtcggttcgccttacactaattatactattcaggttctcgaaaatataaaaggtgaacttattacagataaacctattcctattgttaaacaaggcggaatttcagaaaaacaagatgctatttatctgtttgagaatgattcactgccttccgaaaattccatttatatctttttggcatatgcacaagaggatggttcgttactaatttctggtccaaattcaaatgtaatgtgtaacgattcgaatatgtattctattaattctgtctcagaggaaaaatcagttacagaatacgatgagtttattacatataaagatgctaatgataatgagattattccagttgatcgagagcgttataaatctatatatgagactgacaataattaatcattatttctgaaatatatagattaaagatggcaggtaggtgcttaacctatctgccatcttttcggttttatacctatatgtagaacagttcgtgcatgttgggctaccattcgtgcatagagggattgaaaaaattaaatactctgttatattaagcacataccatggtaaacaaataaagttgtctgtaattgtcagacaattaaggagggggggggtgaaaacgatggacaataagcaagtaaacaaggcaccccagaaaagtgcccgtctcgtacttcaggcagtgactgctattgctcgaagtaatgcaaattcattgtgccgtggtttgttgtatgaaccaaaagtaccaacgcagttaaaaaaataagattgggaggaattgactatgatgttaaaaagtttaaaacagaagattgcaaaagtaggtattggtttgttttgtgcaggatgtgtatttctttcttcagcagcatattctcaggcggcatcttacaccgcttatgcacttaaactgaataagactaataactttacctctatgcatgcaaaaacaacatccgatgattacatcacaaatgaggtaacagcaattaccaatacctcttacgcaaatttctgggctgtcaataacagcaagagtaaaatatctaataagtataagcagggtgttggaacaggatcttgtaatttaatctttaccaagagcggttataattctactaacacacaggtcggtatgggaatggaaaattatcaatctcaattatcaactgcatttgtaagtggaaatgtagattttagataacagaagggatgggcataaacctcttcgtgggtttatgcccttttggtaaagattatgaaaaaaatggttcttatagaaatcaaacattgtattgatcgtgcagaatataaagttgtttttattgctctaatgattttaaatattgcttcgtatattttatgtgtaaaaaatgatataggaaaaagttatcaatttattcgttcagcaaatgaaaatttcgtattacagggcactgaagcggcatatattccatatataatgtatctgttattgcctgtttatgcaacaattattgcatcactttccttaataagagaagaaaaaagcaatagttcaatcctacttattcaaagaatcgggaaaaagaaatatttagcaggaaaattatttggcattctgattgtaacctttttgacaataacaataccaatgctcataaatttattattatgccacttgacatatccaatacatggatatgacagtgcttggggagaacctgattacgctataggtttggtatcatataacgctgacaattttcttgatatggtgagattgcaacatccaactttatataatctaatatacatttttaattacggaatttttggctcgggattagctatcttagcttatgctctttcatattataacaaaatgaaagttctatatttcgcaaagatacctggtgctttgtttatattctatattgtttttaatttgattgtttctgtctttgggctaaatgaattctctatacaaggttatattatgcctaatgttcatggaaatataataggagaaattgttctgatattgcttatttttggattaagtattggcattatacagagaaaaataaaaaattatgaagttatataagaaaaaaattttgaatgttaatgttggaaaatgcttactagtatcacttataacatttgtaattagatatttttatgctaatgtgtacttggggtttcataatagtctggttacaataacagaaggagtacgttcacaaatatattttgggggaatactaatagatcattcgtttgaccttatatctttatcattttttgcgattttgtttatccttgagatttgttatcttacaatggacttatttaatgatgcaaatgataacatggtaattctacttcctcgttatgggaaaaaacacataatttataaggatatattaataaaaatgatattacgtgactgtattgtagttgtttccgattatttgttttttctttttgtagagcatacctctaatggcttagaagatttcaaagttatttttatgctattgatagagatttttcatttgcaaatgattagttatttgttttcattttggaaagattcaattataggatacatcgttgcatttattgtattttttattccagtaatggtgtgtggattttatttttcaatgggaaatgttatatggaaaatttggcattattccttgctacatattcctttatttaattggcataacaagcttattatatattatgtcgaagaaaattacgaatggactacaagcaatatagatttattgaattttaagtcaagctgtctcatttcagttatatcatccgctgttttggtgtggataggtaaatttctttgcgaaaaaaaacaaatattgtgaggtgaatgatatccatgaatttatatgtaaaatctatttcaaagtcaattaaaggtgaaaaagtgcttgatgatatcagttatacatttgaatctggtaaaatatatggaatatatggtaaaaatggttcaggtaaaacaatgctactcagagccattgcaggttttataaatacagacaaaggatacataaaatataatcacaaggcattacataaagatatggatgttttaccagatttaggagctgttattgaaaatatttctttttggagtatgtattcaggatttgaaaatttgaaaatgctttccaatataaaaggaattgtatcagatgaagaaatatatgaaataatgatatactttggtcttgatcccaaatcaaagaaaaaagtaaataaatattcattaggaatgcgtcaaaaactagctctttgtcaagcactgatggaacatccaaaaattttgcttttggatgagccaactaacgcattggatcagcatagcattgatttatttcgtgaacgtatattggaagaaaaaaagaatgataccattactatactgacaagccataataaagaagatattgaaatattagcggatgagaagatatgcatggaatttggtaaaattaaggagttgatgtaatgaagaaatttgtattaactatctgtgttgtaatcatttgtatggtgacagccttattctatggaaagactgggataaaaacaactacaggggttcatgatcctgatattgctttatcagaaaatacagctatggaaattttctatacaggagggcagaaaacttcttactttaacaatgaaagtaattactcattggatgatatggaaaaagattcttctttaatagctcgtataactgtaacaaattctcgtgaaatgagtttacgatcaacaaaaacaatggtaaaaatagaggaaatctataaggataattctgctaatctttcagtaggtgactgtatttacattatagaacctgtatcatttgttagaggtgaagaattttacactaacggatggcaatatctgaagaccgaagatacttatttaatatttttaaaaaatctaggatgtattgatgggtataaatacaccaaagaggaagaaaattcatttatgcctgtatcggaaatatattcaaagagaaatctaactcatgatgaaagttgtgtggtttttgattcggcggaaactctctattcaagtatatctatgtttgcatttttgacctcagaaaaaactatagtagataattatgagaaaatatggaaaaacattacaaattcaggtaagtatgaatgatttaattatttatgaatgaatctctcctattctatttcctgtgagaagcgtatcaatgttagaaattcatggagatactgaattaagcaatatggaatcattcaatcttaaagaaactaaaaatggagataatagaaattgaataaaaagaaattggcaaagagtgttgtaggcattgctttaattgtaagtgtagctatacttatcgttgtatgtgttggaaaaataaagcacattcagaataaaaaaaatattattggtacatggaagaatgcaaatgcagaggaagtgtttacctttcaagaaaatggaggacttgttgtaaacaaagatatgcccgaattgggtattacctgtggcaatgcattatatagcatatcttcctcaaatatgatttttgtggaacagagagataatagcgtgaattttgagatagaagtagatcaaaacgaattaacaatcttctttatgggtcataaatattgggaattaacaaaatagcaattgcatataaagcgatactcatgatatccataaccataaaatatagagccgatgaatcactcgttatttcgattgtgagttatcggctctatttcattatttatggaagggctaaagaaatatcgtattttatagaaatacttttgacagatttcttctcatttttatgttcttttatcaagtgctataccattccatattcatcgcattcacccaatcttgcatttctgaatcaagatacaaacgggcatattctagtggattgtcaatcgccagtgcatccaacattcgttgagagttaggagtagtaatcaatccatcttctgccttgccacagtcaatccgaagtatgtagccattgtaataattgatgtctatgatgttgtgatatttattatattctgcatgaacgatattcatattgcaaagtcctttctcttatctgtttcagttgtagaagcatcttgaccagttccagccgattatgtgatttatataatgttattagctgttaccggattttgcttcccttgtttttgcccttatgaggtgtcgtaacacaagggaaaaggatataacataagggaaagtctaagggaaagctcacttgccaaaactgtagtaaaatcaaggcattgcggattttatcgtaacactttataataccagttaggtgttaaagaattgtaggtatcaaaattagtatttatccctctgccccatgcttacattgctcttcttccccctcaagttcctgcaacgcatgataataattttccatccacgctgcctgttcccgcgcttttaacgcttctgaatcctcctcctcgatgtcctcaggccactcttctccttcttgtaatccctgcataagcaaccagttgtgaggcatttgaaattgaagtatttctcccagatcactttccaacgtaaccgctgtcatcatcggctcgcccggcaagcgttcctcatctccatcatccatttcgtccattcgttgtattgtccacatttcaaagttcctctatcccagtgataagcccctcaaaaatatcacgttcatattacgctccggcaaaagtccgtgaaacctccggttccccggactcgcgggcgcgttcacatggcacatatccgtctgccgcatgcaagcatgcgcaaccgtctctgttcatacccgcagtgctcgtccgaaaaatcatagattttccggactgacgggcattcgccctatcatccgcaacatctgcgatatatagcctgcaagcagacatatatcgcagccgtcacgtctggcactgctcattgcatatgcacattatatcacatcttttttcaattgcaaacaaatgttcgcttttgttataaaaagagttctctccacagaatgcattttcttataaagcagaaaaagacacccatccacttcgtacatattactttgtacaagcaaacaggtgccttttcccaaccagcgatcctgaaacgatcgcgttatttcttcttttgttatccgttatttatatgagaaagtctttgcttcccacaaaacgcaatgataaagtcagcaacacaattactgattgtccatgctcgctacgatcgcatccgcaagtgcctcaagctgtccttcctgctccggcgccatcgccgattttatggtgatctgcgtatccagaatcgtcacatttttcagttccgccagtttttctctcatctgctttgccgtcatcggtgcccaggtgccgttctccatcagtgctacggtcttgttctgaaccgcaagtgccttcatgtcggcgagcaggttctccatcaccggatagatgcctccgttgtaagtcggcgccgcaaacaccacatggcttgcgcggaagatctcactgatgagctccgacacatgggtgttcgagacatcataaacggcaatcttcttcacgccctttgccgcaagtcttcctgcaagcgcatccgccgccgatgccgtgttaccgtacatggttgcatacagaatcacaaccgcctgatcctccgcctcataggtgctccacttctgatatttttccagaatatagcccagattctccctccagatcggtccgtggagcgggcagatcactgcgatctccagcccggaggctttctttaacaatgcctgcaccgatgcaccgtactttccgacaatgttcgtgtaatatcttctggcatcatccagccagtcgcggtcaaaatcgacttcatccgcaaaaatattgccgttcaatgcgccaaacgttccgaatccgtccgcagcaaaaagcaccttgtccttctcatcataggttaccattacctccggccagtgtaccatcggcgccatcacaaagtgcaatgtatgcgcaccggttgcaagcgtatctccctcttttaccgtcacggctctctccgcgaaatccgttccgaagaactgttttatcattccaaatgtcttggtgtttccgaccacctgcacttccggataacggcgcaccagatccccgatcatcgcacagtgatccggttccatgtgattgacaatcagataatccagtttccgtccgtcgagcacatgctccagattttcaaaaaactgtcccgccacggacgcatcgactgtatccaaaagtaccgtcttctcatccaataatacataagagttgtaggataccccgcgcggaattggaaatatattttcaaacagcgccagtcttctgtcactggctccaacccaaacaatatcctcagtcacttttcttacgttgtacatagtgttcctccttctgtccggcagtctgccgtctcatattctacctgtttggtatgaattataaatcagatttctggaaattgccacccaaaaatgcactctgtatgtatttttctgcatacagatgaaaatatgcaaaaagagcattcccggcaaaaattatctacctgaaatgctctctcttccttatgctgttctgtcgacttttctgccggataaacagcgttctgccgtccgcccgtcattgcagtctgccgtttgcagcactcctactgcgctgcgtttctgccgcagcactgcttatacttcttgccgcttccacacggacacggatcgttcggatatacctttgccgcagcacgcttcttcggcgtgttcgtcgcagactcatccttgttcgttccggtcactttcgctacctgctcacgctcaaccttctgctcaatcttcacatgatacagcagccggatcgtatcctcctgaatgctcgccgtcatctcgtcgaacatgtcaaatcctgccatcttgtactcgacaagcggatctctctgtccgtaggactgcagtccgataccctgacgaagctgatccatatcatcaatgtgatccatccacttgcggtcgatcaccttcaggagaacgacacgttcaagttcacggaactgctccggctcagggaactccgtctccttcgcctcatacagcttcactgcacgctcctttaacagatgcttcagttccttattattcttaacgctgtccacgtcctccggcgtcactgcctgcatcggaatcatggagaggatcagctggttcagttcattcagatcccactcttccttcggaatatcagaagaaatacaggtatctacacaattttccacacgatccgtgatcatcttgaaaatcgcatcgcgcatgttctctccgtccagtacgcggcggcgctccttgtagataatctctctctgatcgttcataacctgatcatactcaagaagattctttctgataccgaagttgttgccctcgatcttcttctgcgctttctcaatcgcagatgtcagcatcttatgctggatctgctcaccttccggaacaccgagtgcattgaaaatgtccatcagcttctcagaaccgaacagacgcatcagatcgtcttcaagagaaatgaagaactgggactcacccggatctccctgacgtccggaacgaccgcgcagctggttatcaatacgtctggattcatgacgctctgtaccgatgatcttcaaaccgcctgcagccttcgactcatcatccagcttaatatcggtaccacgtcctgccatgttggtcgcgatcgtcaccgctccatgctgtccggcaccggctacaatctcagcctctttttcatggaactttgcgttcaataccgtatgcggaattccctcgcgcttcagcatgccgctgatcagctcggaagtatcgatattgatggtaccgacaagtaccggctgtcccttttcatgggattttaccacttcctccacaaccgccttgtatttttcattctttgtcttgtatacaacatcatgatgatcgatacgggcgatcgggcggttggtcgggatctcgacgacgtccatgccgtagatgtcgcggaactccttctcctccgtcaatgcggtaccggtcatacctgctttcttctcaaacttgttaaagaagttctggaatgtgatcgttgccagagtcttgctctctctcttgaccttcacatgctccttcgcctcaatcgcctgatgaagtccgtctgaataacggcgtcccggcataatacgtccggtaaactcatcgacgatcataacctggtcgtccttcaccacgtaatcctggtcgcggaacatcaggttgtgtgcgcgcagcgccagaataatgttatgctgaatctccagattctccggatcagccaggttctctatcttgaagaactgctcaaccttcttcacaccatcctgtgtcaggctgaccaccttatccttctcgtttacgatgaagtctccggtctcctcctgctccacgcccatgatagcatccatcttggagtactccggcatatcctcaccgcgcttcatctggcacgccagaatatcgcatgcctcatacagtctggtggatttgccgctctgtccggaaatgatgagcggtgtacgcgcctcatcaatcaataccgagtcgacctcatcgatgatggcaaaatgcagtccgcgctgcaccagctgttccttatagattaccatgttatcacgcagataatcaaagccaagctcattgtttgtcacgtaggtaatgtcacagttataagcatcccggcgctcatcattcgtcatctcgttcaaaaccacgccgactttcagtcccaggaattcatggacctgtcccatccactcagagtcacgctttgccagatagtcgttgactgtgacgatgcacacgcccttgccctcaagtgcatttaagtatgccggcagtgtcgataccagagtcttaccttcaccggtcttcatctcagcgatacgtccctggtggagaatgataccaccaataatctgcacacgataatgctccatgccgagcacacgcttcgccgcctcacgcaccgtcgcatatgcctccggaagaagatcgtccagcgtctcgccgttctccagtctctccttatattccttcgtcttgttctttaattcttcatcggaaagtgctcccatcgcctcgcggtaagattccaccttgtcgacaagcgggtaaatccgctttaactcacgctcgctgtgggttccgaagatcttcgttattgcactcataaaaagctcctactcctgtttttacacaaaactgtgtcaaaatccattctcctgcgggacacctgcaaaagggtatgaccccgcacaatattgttattgtaacacttttccagcaccaccacaataaaaacaggcgtaaaagaattgtaaattttttattaactgccgctttgatacaaatttttcttgcacacttccggttccatgttatactcaaaagtgatctgaacgatctattttttcaataaaggaggatttcaaaatgacatacacatataagaccagaggcacctgttccacacagattgatcttgaattggagggcaacatcgtgcataacgtaaagttcaccggcggctgcaacggcaatcttcaagcgattccgaagctcgtcgagggtcttaccgtcgagcaggttgaggagaaaatcggcggcatctcctgcaacggacgcccgacttcctgcggcgatcagctggctaaggcctgtcgcgaagcctacgaggcatccaagcaggcgtaaggaaacatcttttatcttatcaaatgaatcacaaatcgccatctgttttcgcctgccgcagccacagccgctctgcagcccgccggaagcagactccctgagccgggcggagacagcgacggaaaactgccaaaaagtcttctatatagtagatcatagatcattttagagttccggatgctcctggcaagggggggattctaatcgaaaaacccggcatttctaatccgcaccgcattcggcatcttcgatgatccgtgtctttccaagctttgagcaatccgcgggtgtgttcgcaagccggcagacaatttaaggacttttgtgcgttccttgcatcaccaatgaacaaaacataaccgcgcgaagccgatgtctgagttggcatctgccatgttttcaatagcagatgccagcgagtttcggttcgcgcggttttatattgtctgtgaagcggtgatgctagaaacgctaaaaagtccgctcattgtctgcggcttgccggacacatcccgcggattgtcaaagcgtggcaaagacacagaacctgatgtcaaatgcggtgcggaagaaatgctctgatttttctccaaagaatccgcccctgccagaagcagccggaacaataagatgctctgattttctgcataataaaacgtcgccggcatttttcgtcgctgccgccacccggctccgtcagatctgcgttacgtcggggtctgcagaatcggctggatctgtttgccggcgagcgccgcctcgattgtgtccggcaggagctccatttttgcaatcatggagttcggcttgctcttgcagttgtcctgcccgaacggaacgaaataaatatttttcatattcatgagcattccaatattcttaaagctggcgccgagcgcatcgttcgtcgagatggcaatcacaagcggcttaccgttgcgcatatgcgctttggtcgccatcagcaccggcgtatccgtgattccgttgcagagttttgccgccgtatttccggtgcagggcgcaatgaccatgatgtccagaaaattattcggcccgatcggctccgccgcacagatggtacggatgccctcatttccggtaatctcgcagattccgtccacataatctttcgcacttccgaaccgcgtgtcacacgtctgcgcattaaatgaaaaaaccggcaccacattggcgcccatatcgcacagccgctgtatttcttttcttgctttcgcaaacgtacaaaacgaaccggtaattccaagcccgatattataattggaaaaatccatcacatttcatgctcctttcgcacgaatctctccaccgcccggtccagaatataggcgctctctttcggcgcatattttcccggaagtccaagtgccagatccgcacggatgccgcactctctggcgcaggcaaaatccgtaccgcccggtttggacgcgatgtctaaaatatatgcatcccgcggcagttcgcggatgatcgcacctgtaaccacaggcgcaggaaccgtgttgaccagcattgccgcccccatcgcttcctccggtccaaacgcaaaatccgcggcataaaatccatccttcttggcaagtttgcgcacttcccgtcttcttgccagcaccgtcacgcgcgcgccgagcgctttcagcctcgcagccaccgctctgccgcagcagccgtaaccggtgacgataatttttgcctcctcaatgttataagggctgtggttcacaagctccgcgatcacgccctccgccgtcgccactgcattttcttccgtcacaatctcatctctcataaaatccagatagtgaatgtcccggcgctccaaaagctcctgctgttctgtggagaagcagcctccaagcaccagcgtatcgttcgtcaggtttttattcaatatatcgttcagcattttctgttccggtatctttgtcaccggaatcgggaggatcagcatatccgcctccgccagaaaacttttcaacttctcgagctgttcttttaccgtcccgctgtttctgatatccaggcagcgtacgttgagtcctcttttggtcataatctccgccagatagacctgacgcatgtcactgatgagaagtatggtctgtctattcatagaattacgctcccttctctttattatatgaaacgcgcgctcttctgccacagcgaagcatttacatgtattttacgaaaaatatatattatatctattgcatctatattttcagaatattttcatattcattctttgtttattgtttttaaatattttttattataattttctcattttatgcttgactttttctcatatatcagatagaataaagacaacaaaaagaaaggaaaacgaaatcgaaggaaaggaaggtacaagccaccagaaaagtaacgatttacccaaaacgatattaaggaaagagaggtacagaccaccgaaaacgtaattgcattcgtttttttctaactccgaagaacacacgtgacaatccaaatcatggaaagaggaatcagtatcagatgagttaatcagatatgatgcgatatccaccgtcataagaagagtgatacaaggtacgaaagaagcgaagaagtccgaaagaaaaagaaaagagaggtacagtcccatggacgagatagtttagaaggcgacatcgattcaaatgaataggatgtcgccttcgtcgttctattttttctattttatctgtttttcctgctcgctctccgtcacggacgtctccgtctgctgccagggattttcctcatccggatcagtcggatcccagtggcagtccggatctgatttatccagtttttgtgcctccggtttcccgagcggccccgggtcttccccgtcgtatatttcaaccgtagtgccttccgggcagttctccgcaatccattttgcatcctccaccgtcagtcttacgcaacccatcgacgcctgctgtcccagcttgttatacttgtccgtacagagtgtatcctttgcgcgcttgtaatagggcacagaatggaacaggattcccccgtgaatccgcgtcgcgtactgcccatacacaccgccatagagttcccgccacagatacttggtggaaatctggtaagttccgcgcggcgttgcgttgtaaagtccggtcgagcacaccattgccttatagggtaccgtatactccccctcctcatcctgggtgtagatcgtgacgcagttctgcttgcggttgatgcggatataatacgaaaattccggtgtctgcgtctccttaacatccgcttccgcttttccggttccacttacatccggcgtctcagtctcatcctgccgcaccgcttctgtcccttccacctgcaagtcttccccgttccctgcattctcaccggtctgcaccatcccgccgctgccattttcctccgcatccgttttgtcattctcaccgcttcctgtgagcgatgtctctccatcgtctgcgagcagaatgttttccgtgctgccgtccatcaccagttcttcccgctggtactccctggtccacagtccgttgtcgccgcttagcaccgccagtgcaggcacattccactccatcttgagcgcaacaaattcaaacaatgtcagtacgcacaaaaagacagtgactgcagccgcaatcatgcgggcagccctgccttccatcatacgctgtaattcattttgctcgtgcttgtcgttcttcatatcttaatcttagagctgggtctccacgaaaatgtcatagatcgcacggattgccggttcaaaatccgcattgctcacaccgataataatgttaagctcagaagatccctgatcgatcatcttgacgttgatgtttgcatgtgccagtgccgagaagatacggcctgccgttcctctggtcgacttcatgccgcgtcccacaaccgcgatcagcgccagatcactctccagctcgatactgtccggctttgccagacggtgaattgctgagatcactgcctgctccttgccctcgaattccggctggtgaacgaagattgtcatcgtgtcgatgccggacggcatatgctcgaatgagatattattctcctcaaacgcggacaatacttttctcccgaatccaacctcggaattcatcatatccttatcaatattgacggaaacaaaaccttttttgccggcaataccggtaatggtgtattttgactgatggcaggtgctctccacgatccaggttccctcgtcatccggcgcgttggtattgcggatgttgatcggaattcctgcttttctcaccgggaacactgcgtcctcatgaagcacgctggcgcccatataggaaagctcgcgcagctcacggtatgtgatcgtcttgatcggctgcggatccttaatgatgcgcggatctgcaatgagaaagcccgacacatccgtccagttctcatagcaggtggcatgtaccgcacgcgccacgatggatcccgtgatgtcggaaccgcctctggaaaaggtcttgatcgttccgtccggcagtgccccgtagaatcccggaattaccgcacgctcgcatttctccagacgctctgccagcaccttgttggtcttctccgcgtcaaaagttccgtcctcctcgaaggaaatcacctctgccgcatccacaaactcgtagccaaggtaattcgccataataataccgttcagatattcgccgcgggacgccgcatagtcaacccccgctttatttttaaagttctcactgatctttttgaattcttcctccagtgacagcttcagattcagtccattgataattgtgtcatagcggtccttgatcttcatcagcggcacgcggaaatcctcctctgcctccaccagcgcataacaggcatataacatatctgtgaccttggtgtccttggcattgcgttttcccggggcactcggcactacataacgtctttccttgtccgcctgaatgatcttccccacttttgcaaactgttccgcacttgccagagagctgccgccaaacttcacaactttaatcatttttctgctcctccaattaccagctatcgtcagggacgcttccgtcctcgctttaacgatttaatataacgatatatatattatcataaatggcggttccgtcaaatgatttttttgaaaaatcgcgtttttcctacaaaatggcagccggtccggcaagcttctcacgtaccacatacatggtcatgtccgggcgcgtcgccaccttccatttcacaagcgtcatctgcatctgttccagttcgatggcagtgatgcacccgggatgcacacagcttcccgcattcagatacagctccccgttttccggcagtctcggtctgtgtgaatggccggcaatcagataacggtcgtgaagtctggtccagcccgccaggcactgttcataccggaccgcctttttataattgcgcgccgcactcgtgggatcattcacgccggagcgctccaacggtttccacacgtagcgcaccagagctctggagagcctccagcacacagaattaaaaaaatccgcctgatgcccgtgaatcatgcagacatcccttccgccctcgcaattatctaatataatcgcctccggcaggatttttctcagctccatattgtggtttccatagatgcggcacagcgcattccggctttgcagacaagcaaacatctcatacacggtctcgtgatagtgcacaatccgatccatgcagcggttttcccagagttcctccccgtcccccagttccagatagaagaatcctctctttatataatgttccatcgccgcctcgtacaggtacgcgtttttcaggaaattgtcatttgttgtcccttcccctctgtggcagtcactgatcaccacatagcggctgcccgtgccaagcggaaggtgcagggcatgttccaatgccctgtcaatccttcgataacatcccatgttttcacctgccccgacatgatctgtgcggtttcctggttctacagcgcggtttgcatcgcccgcccgaaagcaccagaatcttccgaaaccatcctggaagcagataatatagaaataccattctgtccgccgtccgtttccacgggtatgtcacgatcctaaatcctctgcacagcagcctgttccagagaagcaccacgcttctgcagattcccggaatcaatccgtgttcctccgaaaaattcatccgcacactgacttctcttccgcagatgcgaaaaaggctgcgcggttttccggttttgtggagaccttcccagaacgccagcgccatctcctgctctgggaaaatcagcgtcgtggcaagtctgaggcgcgacggttttgtatacacgcccatccgaaagccggtgagccaccagtgtctggcacagatttcataaaacgttttctctgccgtgtccagacagctgcagattctcgggagttctgcatccgataccgcttcaaaatgcaccgtgtgataggcgtgcggcggaatcacgcccttcgcatggtaaattccgacctctccgccggtgttgatcccgtactgtcccttccagaattccaccagccaggttcttccctcataattaaagtacacgggaaatgcgtcaatcaccatcccggcacccaccgccatggtatcatatttcgcctcatatcccttgtcacgctgccaggcatccagccttgaggtaaaaatatcttccgacggcagataagcaaatccaaagggttccgccagttcattgagcagccgcacccgttccccgggagtcaatgcaagaacttttttcttcgcccgcactctgtgcactactgccaggatcagtagcgccgcaaatagtaccagaaaggcgatgcacaagaggcaccgcccgtttgcaaagcacatcagcgcgccagaagtcctcttgcgagataatcagcgagttccagcaccagatcacttaaatcccggaaggtatcaatgctctggtcatactcaccgttcatctgatgttctataatctcgcgcgtcatatccagataattcaacagaagattcctcgtctcttttcctgcaaagtagggattctggtcagcgagaagtgttgcgatctgattcgcattagcataccactcccggatctgctgttcataattctccttatccccggattttaacgtgcggatgatctgccccgtcatctccacatgttccacgagcagattgcgcagctgtcttgtgacagctaccggcagccgctctgcaaaaacatccgtgattgcatctgcagtttccaacaggcgtccctccactgcatactgctcttttgcatctgccccggaatccacactcatcatatacatccgtgtccagtagatcagttccagccacgccagacgcattgtctcaaacagctgattcactgaattctgcctctctcccgctgtctgatttccgcccgggcgctgtccacccggaatcaccactccgataccgatgtttccgcccacgccggcattactggtatttccaccatttccagcattaccggtgttcccggtgcttccgctgtttcccgtgtccccggtgtttgcgctgcctccctggggcggtacgtagctttcccccgggcagacatagagcttcattcctacctgcaggttgtaggggtttacccccggatttccgagtatcagttccgtgacggttgtgtggtactgtctcgcaaggcgatacagtgaatccccctcctgcacggtgtgtaccattctattctgacaatacataaagattccacttctttgttttctctctttatcttatgtcagatataagatcctggtgcataatgatctgcatatagggcaggcagaccgcgtgctacataattcctgcaaataccggtgccagcacaactgtcagaagtcccgcaaccgcaatggcaagactgctcatcgcaccttcgatctctcctatctccatcgccttgactgtaccaaccgcatgggatgacgctccgattgcaattccctttgccaccggctcctcaatcttaaatatacggcagaccgtctccgccagcatattgccaatcactccggtaataataatcacagcaaccgtgatggtcacataaccgccaagctcctccgatattcccatgccgatcgcggtcgtgatggatttcggcagaagcgtcacatactgcgcatgatcaaaatgaaacaacagtgccagtacaagcacacacacaagactcgtaatcacaccggagatcaatccaagcacgattgccttagaatgttttttcaaaagctccacctgctcgtagagcgggatcgccagacagaccgttgccggcgtcagaagatagctcagatattttgctcccgcgttataactctcgtaaggaatatcaaacgcgaccagaaaaatgatcaccgcgacgatcgaaattaaaagtggattacatatcggccacttcagcttctttttcaaaaatactcccagttcataggtcaatacgctgattgccacaccgaaaaatacagactgatttaaaaattccctcatttccttatgcctttctgtttctgcgaattacaaactgtgtcactcttcccgaaatcaccataaccacaatcgtggatacaaacatgatcacaaccacctgcacacagatcggctttaaagcgctccaggactcgaccagccccgcccccgccggaataaacatcaccggcatgatctctatcaaaaatttccctgcatcttccactgcagagagttttattattccaagctccagtgccgcaaacaacaataccagtccatagatgcttgccggtaccggaagtggaagcaatgcctttaatccttctccaagaaatgaaaaaagtaaaataatcaaaaattgtttcaaatgcttcatcctgccgtctcctctcatcggaacttattatagcaacagtatcacaacttttacatcgacattccgacgaaatgcatgcctttctttttctatttacagtgcaactttctagttcttactgcctatataccccgcaagtgtatccagaatcacctgcggttcgatcggctttgcaagatgagcgttcatcccggccgccaacgactggctgacatcttcctcataggcattggccgtcatggcaattatgggcacagtctgtgcatccgtccggctcattgcccggatctgtctggctgcctccagtccgctcatcaccggcatccggatatccatcatgattgcgtcaaaatatccctccggattctgctccaccatttccaccgctctttttccattttccgcatgttccacaataattccctttgattccagaatacgtctggccacaaaagtattgatctcattgtcctctgccagaagcacccgtctgccttccaggttctgttttgccatgactgcctgtggcattttttccggagcatcgacgcccgagatcgtaagcggcagatcgaggattaccccggtaccctctcctaatttactgtgaatttcaatcgtgccgtgcatcatgaccaccagtttctttacgatcgcaagtccaagaccggttccctgccattgcagggcaagcgtgcggttaccctcctgtgaaaacggttcaaacgcatgctccaggaattcctcactcataccgattccactatcccgcaccgtaaaacgcacccattcaacgtttccttccgtgcgtagcctttcggtcagaagccacacatttccgccctctggcgtgtattttgctgcattggacagcagattgaagaaaatctgcttgaaccgcaccgcatcagtgtatatcatttcttccatatgctgcagatcacactggaacgtaatgtttttctgctccatcagcgggccgatcgtggtattgattgccgttccaaacgtctttctgctcatctgctccgacttcaggttcagattgccgctctctatgcgtgaaatatccagcatatcattgatcagtccgagcagaaactcacttgaggatttaatcttatccagatatccgcagatcgtctcatcctgacattcctgccttgcaacggatgtcatgccgataatcgcattcatcggcgtccggatatcatgactcatatgggccaggaattcactcttggcgcaattcgcccgctccgtttcctcaatcgcccgctccagacgttcctgctttttcttctcctccgttacgatgtcttcgatgtccacacagcttttgaataccgtccccatctgcttatccatataggtataacggatcattttacgccgcactgaaccgtcaaactctctcacatcaatttcctgtatgtaaagcggctccacctcaagattacgccggatttcctctgtctgcattgccctgatgtgtgcttccagctgatccgtcactgcgactctggtaagataatcacgtatatccgcgtcgtagtctgttcccctggcgctcggacacatggagcttttttcctgcgccataatctcgaaatggccattctgcagacagatgtattccacataatcatagtcaaactcaatgatcagctgcatcatacggtcacggtttttctcatgcgtgacatcccagttattgtaaaaggcaaacaaatctcccgtatccagctgcggtacaatcctcacatccacacgcacccagataatgtcgtccgtgtcccgcctctttgcccagtagtaacgcgatatcatttcctctccctgccagtaggcttccatcaatgcctctggctgtagatccgcatacgtctccccagtcatatgaatttccgagaaaatcttttcaatgcgcttccggtagtctgcttcctcacgcaattcttcggtaaaatcgcccagaccattgtatttgacggattccacataccgctgcgtgagattgacgcggctggttccaatattctcatctgtccctttctgattcaatcctctgtcgattatcatacttccatctcctgccatacattatccgcagtttattttaaccctgcctgaccggccatcgctcttctctcctcatactgctcatagaagtcctgctccggttcatatggttttataaaaaacagatttaacaaaaacatgttgatcgtctttgcctcctgttcaccaattccgtctttcatccgcttctccagctgcttccgcagaccatgccagtccagcagaaaccgttcgtattgttccatctgcggagtatcgagccattttccaaccttcactttgctgcgcccgggcttctgacaggcatccatctgcagaaagtagcggattctgccttcctcatagattctgccaagcggaaatacacgacacaacccgggacgcattgcatggatcctgcatcttccctgttcattcaagaacacacactgctctttttctccgtccatcctcaggttcggaagaatcacgccgtccactacctgcagctctatcgtatcggcaagcagctgttcaaaatttttcccggtcacggtcgtcagacgccatatatcacagggatcaagcacaatggatgtccccattttctcacagcaggcatggcatcccgcgcagtctccgcacgccgcccgaaccatatcattgcagccatatatttttccatctgatatttcctgcagatcctgtaacattgcaatctcctcatttcttttttctgtgtctattctaactgttttttgcaaaagaagcaataaactcacatagcctatagagtgaaaaaagaaaccgccacaaaagtgacggcttcttaaatcctgattttataatatctgttctatgcccttatgcagcagctttctcagaatcattgtctttcatgacaagctttaagagaatcggggtgatcagcgtcgttacaataacaacgagaacgatcggagcaaacaggacatcgtctaacataccacttgcatatcctttctgcgccacaatcagtgcaacctcacctcgggaaatcataccgataccgacctggaatgcttcctttccggtacatccgcatatctttgcacccagtccgcatccgacaaccttgcttaagattgcgatgacaagcagaatgattgcgaagatccagatgctggtatccattccgccgagtgttaccttaagacctacactggcaaagaataccggtgagaaaatcaggtaagacggaatctcgcatcttcttgcaacatacggtccaaccttcatcgtgcagagcatcaatcctgcgaagtaagcaccggtaatatctgcaataccgaagtattcctctgagatataggaaagaatgaagcagagcgctacacagatgatagcggttcttctcttctcatcctgctcttccacaaatacctttaactttgtaagcacgaagatcaatactgcaataaatacgaaatacagtacaatctttaacacaactgtgatcgggcttacgctggtatcctttaagctggttacgattgtgagtacgataataccgatgatatcatcgataacagctgcgccaaggattgtcgttccgacttttcctttcagcttgcccatctcacgcagcgtctcaactgtgatacttacagatgttgctgtcagtacaacaccgacgaacactgcctttaacacctcatcgtaatcgctgaagtctgtgtggaagaaaaatgcataccccaggaatccaccaatcaacggaacaatcacaccgatcaatgctgttacgaaagatgccacaccatttttcttaagttcggacagatccgtctccagtcctgcgttaaacatcaggaggataacaccaatctctgccatctgctcaagaaagacgccggtatctccggtcaatgtaatcaaattcagacaggacggtcctaagatcacacctgcaactaatgcaccgacaaccgccggcatatgaatcttacgggtaaataaacccagaatcttggttgagatcataatgatcgccaagaacagtaaaaatgaatacgattccatatctatactccctttctgttaataaattattaaatatgtataaagtattcttatagcatagctattctaacgctttatcttacaaaatgtaagtggcgtttttcaagaaaaaacatcaaaataataacattttttaggaattttcaacagattttcgggggattttacagaagatttcgttcgcatggaatatatatttcattattgtgtgtccacaacttcaactactttacctttgcttcttcgacatatctgtctcatgcacaaaactcttgatgttgataaatgcaccagcaaaaccaagtcacatcaaagctattatttcgtccccccctattacgtagtgaagagggatagttttttagtatttttcgctatctcgaagatgtaatagttgcgactttggccagaagtggtagatacaaacgtgttttcttcgcagagtacgaaacacagccatgctatcccttctatattattagcgatatttcaacccacactcccctcacagggagcgacattatatcacaaatatagtaagttcaacatataaaaactgcattttacattctttgtatgttccccccaatgaaaaacccccgggacatctctgtcccgggggtttttcgaggagtttagttatgaaaatgttaatctatataaaggaatcttcaccgaaaggttctgcagaaatatgacctttattccacatctctgagctgctgggaacgaagctctgggaaaccgtcctcagctcctttcgatgatgttagtatacggaaaaaatgtgtccgaagtatgtcgattttcataaagctttctaaaaaaacattctatgttatttagatttctttaatattttatttctatttttttataattgcctgcaccgtgcccgactggagcagccggatctccagctgtttcatctgctccgacgcaaggctgttgcacaattccacggttccttgctgcgctctgccactgcacagaccgcaatccttaagcctgcgttctgtctcccgcgcggtccccgctccgccgtcaaagatctgcactccggctccgagaagcttctggattgtctcccgcacaaacgggtaatgcgtgcagcccagcacaacacaatctaccggatggcttcggtacggttcaaacagatttgcaaggaatgcttcgagttttgcaccctccagcacaccctgctccacatactccaccaatcccgggcacggcagccttaagatctcggcatccgactcaaaccgctgcatcagggcatgaaacttctcctcgcgcagggtcatcggcgttgccatgacaagaacgcgcgggtgaccgcccgcgtgcaccgccggctttagtgccggctcaattccgatcaccggcatatccgcatatttttcccgaaggatccggatggccgcgcttgtcgccgtgttacatgccaccacaagtgcttttacaccgcgcgacagcagatattcggcatccgcacaggtcagctgctgcacttcctccagcgtctttgtgccgtagggcgcattcttagaatccccaaaaaagatataattctcgttcggcatctgtgccaccagttcccgcagcacactgattcctccgactcccgaatcaaacacaccgatcggacattcctgtctgttttcatacttttccactgctattcctcccagactgcctcgcttccgttctccgtgcgcgtgacataaagtctgtgttctatctgttcttttaattctgtcacatgggagataattcccaccaggcgctcgcttcccgcgagctgtgacaatacttcaatcgcctgttttctggactgcgcatccagtgtaccaaagccctcatcgataaacatcatgtccagatgcacggcacccgccttgcggatggcaatatccgaaagcccaagcgccatggcaagcgctgccagaaacgactcgccgccggataaggtacgaatatcgcgctcactgtccgtgaccagactgtacaccgacagatccagaccttcgttggatttgcgcccgctgttttccgtctctttcagcttaagcataaactgatgtccgctcatcgtcaatagccgtctgttcgcctcgtagatcacctgccggaaataccggcgctgcacataggtctcaaaatcaatcttcgccgatcccgccagacgcccgtccgccgtgaagtacagtcttttcagcacctgattttccgcatcgagccgctcgtgtgcggcgaaatattccctgcaccgctccaccactttcgcatccgtctcgtatgcggtgtgcattgcaagaatctcctcatgaagctcctgctggcgctgtttttgcacctccagttccgtctcccatgccaggatcccgatctcctgctttccctcggtcagcttctgcatagtcagaagcctgccctcactttccacgcgattccggacgtatgcctcggactgctgcacgagcgtctcccgcccgctctctgtaaggaatgcttcgtggtatgcctcctccgaagaaaatccggcatcacgcagcgcctgccggtattctttctccaattccagacactcctgcacaagcccggcattcttcgtctgctcctgcgtcagcattccttcttgtctggaaatgtcttcctttttcttttgcagtgcttcctctgcatccgccagacacttcgtccgccggtctgccttatccgtcagctgctgcagcgcttcctcagcccgttccttcgtctcatatgataactccgcgcggatccgtgccgtttcccgctgtccttcttcccagtcgcgcttgagcgcctcaagcttcaggcggttcaccgcatctcccgtctccccggaatgttttttcccctcccgtgaaaatcgttccgcctgccgtccacgctctgtcagagacctcttttttgctgcaggttcttttgccgcctgctgtgcggcaaacgtataaagttctttctctccgtcgccgcacgcatctcccgcaagcgccagaaactgctgcttcgcctgctccagacgcagctcctgctctgccgccgcgcttttctgcccgtcaaattcctgatacgcagcatcgcgcgccgtctccgcctgctcccgctgttccttcgccgcctttactgctgcttcactgaccgcattctcggcaagggacgccggatgcggatgtgtcagggagccgcagaccggacaaggttctgcctcccgcagattctgtgccagaattcccgcctgttcctttaaaaacagctggtacacgtgctcatattccgcagacgcctccgtggaccgggcggctgcccgctcccacgcttttgcggcgctgacatacttttcctccagcaaaagctgcctgtttttttccgcgagcagccggctggcgccttccctcaccgcacgctcataatactgcttcgccgactcgtacgcctgttttgcctgctgttcccgctctgccgcctctcccaggcgctcatacaccggaagctgttcccggatgcggagcattttctccgcgtcggcttccgccgcatcggcgctctgcgtcttaagcttcttaaaatcctgctcctgcctgtcacacgcatccttttcctccgcgacaaggcgcttcagccgctccaccgcctcgtcagactgccgccgctcgtccaggcgctccttgcagtgcaattccttcatgtgcaccttctccgcacgctctgccgcctccagctgttctttccggcgcgcttccacgggctcttcttcctttaacttctgtacctgctgttcgcagtctcttaacccttcaaacagttcattgacttccttcgccttagagattgccgcagtcagcctccggatctcctcccgcacggtctcctgtgaagccgtcagctccctctcccggataccaatctgctccactgcttccggaagcggaagttctttcagttcttcgcgcggcagaatcacgcgcgctctctcctgctcggcagctctctcgttttccgcaagcagccggtccatctcgagcgaacgccgctttaagttctcctggattctccaatatgcgtctgtgtgaaacaatttggagaaaatctttttccggtcgtccgactttgcatacaaaagttttaaaaaatcgccctgcgcgatcatggcggtctgtgtgaactgttccttcgtcagcccgatcagctcttcgatcttcgcatcggtctggctccttttttccggatacaccgttccgtccggcagcgtcagttccacgcctgccggaaccttctgctcccgcagctttccgtttttcaattcttttacgatcttatattccggatttctccgcacgcggtatgactcgcccgcatacaaaaaagagaattccacataggtctccgtcacacttttggcatactggctccgcatcatggctccgcttctgcctccgccgctcgcctccccgtatagcgcataggtgatggcatcaaaaatcgtggtcttcccggcgccggtatcccccgtgatcagaaacagtccgcccgtctgcaccgtaaaatcaatctccgtgcgtcccgcatatgatccgaacgctgacaggatgagtttttcaggcttcattcgtccccctccatttcctgcgcaatcacctgacgcatcagttcccgctcctcaggcgtcatctctctcccgttcatctccgagaaaaacatggcaaacgcctcctccggccgcacttcggcaagctgctcttccgtgtccgacaacagcttcctcgtccgcgcgttgtcgatccgtatctccaggatgtggtcgtatttttcctccagacgctccttcggctggaacgcctccacatcatccgtaagtgtgatgctcacaaatgcgtggcagacctcctgccccgcctgctccaaaatctcatgcagcgtcccggtcagcttttttacctcccgcaccggcggaagcggaatctgccggatcacaggcggctgtcccttttctcccagttccacgaccgtcacgctcttctcctcccccgcctcgctgacagaatacggaaaaggcgtcccgcaatagcggtatttttccgctcctatatgctgtgcacggtggatatgtcccaatgctgcatagtcgaacggcgcaagcacaccggcatcaacattttcaacaccaccgacatagtggatttcagagtcgcaggtcgcaggctcctttccgcccgccgtataaaactggtgtgacaggatcacgtttctccgcgccggatctatctcctcgcgctcaatcaggcgccttaccgccatgtcatagccttttatttcctcgtcaaacagctttctcacataacccggcttcacaaacggaagcagataaaaatccacctcaccgtatccgtccgcaagcgtcacgcggcggatcgtctccccctcctgcatcggcggaagtcccgcgatatacacctcatgctttgcaagaatactgctggcaaaatcaattcttctggcactgtcatgattccccgcaatgatcatgactgcaatctgcggctctatctcgcataatgctgacagaaacgcatcaaagacagacactgcctccgccgaaggcaccggcgtgtcgtaaatatctcccgcaatcaggatggcgtccgggtgctcgctttttgcaagcgccacaatctgtgccagcgtcttgcgctgctctgccgcgagattgtagtggtgcagctgttttcctatatgaagatccgacaaatgaaacagtttcaaatcgtttcctccccgttaagcttctgttaagtttcttttcttttctacgtgataaaaagttttcattcaccgtcgttcatggtataatgaatctataaacagtgaacctagagtaaagacgaacgcccatgcctgcatgcggcggacggatgtggcagcatactaccggaggtgacagacgatggaacaaccacaggatttatttgggaactataaatattgtgaagaatgcaaacgaccgcttccattgacatataaagagaatctctgcccgtcgtgtatcgagcagaagctcttccgcgaagtcaaagagtacatccgtgagaacgatgtaaatgaatacgatgttgcacagcacttccacatcccgcatatgcaggtcaaaaagtggatccgcgaggggcgcattgagtacaaggacgaccatctgaacacgattaccatgcactgcaccagatgcggcgcaccgatctctttcggaactttatgcgccaaatgcatgcgccagaaggatgtctccgttcactcctctgcgcgcgaggatgtctcagacagccggatgcgtttcattgaagactgattcatgaatccatccggattcatgatatatgatataaaaaggtgtcccgatcgctttaccgatccgggccacctttttgttccctactttatgaccgcacgcggatacttcaccatgactgcgtcgagcatctcctcatccggttcaaattcatagcggttgattcccttctcgcctttgaaaacgagttcgtaaatcttcgtgccgctctcgccggaagtcaaatccttacaggcaagtgaattgtcattctcgtacttgtatacactccggtcccccttcggtgccagtgcaaggacatcttccatctgaactcttccaagtccctttctcttgcgcttcgccttgattcttgcgaaacggaactctccgtcataataggtgtactcatactcaatatcagagcggaatgcctgaaaataccagatgatggcaaaaataattgccggcaccgcaaataaaatcggcacccacatcgcaaataaaaagcacaggcatgccagcacaaaccataccacgtttaaaatcttcttcaccgtagatttctttctcggaacaatcactaatttctcgtgcatgtaaaacctctttccgcgcagtatcccgcctgcgcctcttccttccaaaaactgctcactgtgctatattttagcatgtatcccttttcccgaaaagaccttttgtgtttatttttcaaaaatttaagattcttacaaaacttttttcttgacatcctaatggctttcctgtaaaataaatttctgtgagacgcccagttagctcagttggtagagcagaggactgaaaatcctcgtgtctctggttcgattccggaactgggcacttcatgcgggtgtagttcaatggtagaacaccagccttccaagctggatacgtgggttcgattcccatcacccgcttttcttaattggagagcgaaaaagaacagagcagatggagagattctctcactgctctgtttttttataattttttcattcttttttcctttttaaccttccatttctatgttattcttgtactagttcattttagaaacggagtaccattatggaaaaaaagactgattttcattcactttcccgcaaggcgaaagtgcagtatgtctgggattattacaagtggccgatcgccgctgcgatcgctgcgctctgctttgtcatttacctcatctatcattacgcgacctaccgcgacccgctgttaaacgtcatcatgatgaactgcaatgattccataaccgccgacagcaagggcttcgatgaatttctcgaagcctgcggctacgacccgaaggaagattccgtctccctcacatcctccttacagttctcggacggcgagtattccacgtcctacaacgacacgcaggtgctgacgctgatgctggcagccggcggacaggatctcttcttcggaaccggcggcgaatatctcgattacgccgaccagggagctcttatggatctgtccaccgtattatccgacgaactgctggaccgctaccgggatcatctcatctacacgaccgaggacggtgccgtcgcttcctatccctgtgcgatcgagctcaccgacaatgcctggcttcacaaatacaactattatgattcctgctatttcggcattctctatcagaatcagaacttagacgccgccttacagtttgcggactttcttctgaattataacgactgatcgttttctctcctgatgctgccggcagcagagcggctgatttgttttttcagatctctacttcaggatggcaacaccgtacgccggaagcgtcagcgttccatcctgccaggaagccgcacaggttccggtcagcagttctcctgccagcttcaaatccccgctttcactgtctgcggatatctgtgacagatccacggtgcgctcgtccttcgtgcagttaaacacgacgatcaccgaggaatcctgccagttcttgcgcagcacgcacactgcgtcatccgacagattttcaagaaactctgccgttccatgcgagatctccggataggcattccgcagacgcagcgcctccttcacataccagtagatggaattgccgtcgtcctgctgctccgcaagactgtcatagatcatcgtgatcgcatccatatcctgcggtccgaggcacatcccctctgcaccggcatccttgctccagtacatcggcgcgcgcttgttctcatcttttccggcgcctttcattcccagttcttctccataatataagaagctgcttccggacatcagaagattcatcgcctgcgccagtttggtctgcgcctccatagtatcgccggagtaataccctgcgccccttcccatatcatggttggtgtaaaacggcgcatcgatatagctgtcactgtaagttcccagcgcgtcctgcagccgcacgatcgcttttccgtaggaagaggcaccgctcgttcccttgaccgccttcgcaatcacaccgtccttgtctgcaaacgcaaagtcaaagctgctgtcaattccgctctggtaatactgtgcgtatgtctccagatccgaccacacctctgtcacaatatacgcatcactcttcttttcttttaccacattattaaaccaggatagaatttctatgttcgagttgatgcttccggtctcatactcttttgccgcatccagccggaaaccatctacacccttttccagccagaaatctgtaatctcatcaaactcctgccgcaccgcttcactctccagattcagatctggcatctcgctccagaactgtgcctcataataccagtccgtccctgccagctggcagtatccgctgcctttctccctggaaaaatgataataatccacatacgggcatgcctctgtatccggctccattccctccggcagatccttcagatactctgccgccgtctgaaaccacggatgctgagacgaagtatgattcatcacaaaatcaatcatgacacggattccccgttcatggcatgcgttcacgaatgtctcgaaatcctccattgtgccatactgctcatcgatcgcacagtagtccgtcacatcatatttgtggtaagtcgtcgccggcatcaccggcatcagccagatcccatcacatcccagatctgtatccgttgccggattaccgtcattgatatagtccagcttctccgtcagtcccggaagatctccgatgccatccccatcgccgtcatagaagctgtaaacgaacacctcgtaccagctccggtagagatcatccgttcctgcagcttctgccgggtttacctcccgcatcagagacagcgccgtctcttccatgttctcctgtgctcccgcctgcgcatccgtgccctgcccggctgccgtctccgtgtcctgcccggctgccgcttccgccgcacctgttgccgcgtctttctccccggcatccgctccgcacgccgcacttccagcaagcaacgccactgccagcagtgccgccagttctctctttcctcttcgtctcatccaaacgcccctctttctgtcagattttctgtatcctttttccttatcatacaggactggtaacgttttcacaagctgtttcttcctacttttctctgtcaaacacttcacccaccaccttgaagttctggatcacgaacgtcggcagcaccgccatcacaccgacacagcccagctgcatgccattcatcgtctccacctcaaaaagggttttgagtgccggcacaaacagaacgagtgccaaaagcagcacgccgagcgcaaaggctcccagactgtaccggtttctccggaatccgatttttacaatggagtgacggcttctgcagttaaacccgtggaacaagcgtgcaagtgtcagtgtcgcaaacgccatggtgctcgccagcgccgcactctctttcaatcccacctcaaaggaaatcatggtacagacggcaatcagcgccccctgccccagaagcagcgccataaagcgcctttccagaattccgccttttggattgcgcggtttttcgctgaggacatctctctccgccggttccataccgatggcaagcgctggaagggaatcggtcagcagattgataaacaaaagatgcaccggctggaacgggaccggaagtgctgcaagcgaggtgtaaagcaccgccaatattcctgccatatttccggaaagtaaaaacaggattgcatttttaatattcttgtagacatttcttccgttcgcgaccgccttgataatcgtggcaaaattgtcgtcggtcaggatcatggctgccgcgtctttggacacctcggttccggtgattcccatcgccacgccaatgtccgccgccttcagtgccggtgcatcattgacgccgtctcccgtcatggcgaccacactccccctgcgctgccacgcttccacaatgcggatcttattttccggggagacgcgggcaaacacggcgatgtgtccgatcagatggtccagctccttatccggcatggcgtccagctcgggcccgaccagtgcgatatccccctccccgaaaatgccaatctgctttgcaatcgccgtcgccgtcactttatggtcccccgtaatcatgaccggtcggattcccgctctcttcgcatctgccacagccgccgcagactccgcgcgcggcgggtcgatcatcgccacaagtccaagaaaaatgtaatcacactccccggaaagcgtcagctcctcgctctctttcagttcccggtaagcaaacgccagcacacgaagcccctccccggaaaatctttgattctgctctaaaatctccgtacggtcttcctccgtcatccgccggatgccctgcttctccctaagatagaccgcgcgcttcaaaaggacgtccggcgcccctttggtcagcagtgtcggtacaccgtgcagcgcatagaccgtgctcatcagcttgcggtccgaatcaaacggcagttcctgctgtcgttccattgctccccgtaagaaatcatcatccacgccacatttacgcaccatctcgagcagtgctgactccgtcgggtcgccaatcactttcccgtcatccatgcgcgcatcgttatttaaaatcgcatcatacatcagataacgatgaagctgatcgttgatctgcagcgcctccggcatgatcgccgtatgatccagataaatcttctgcacggtcattttgttctgtgtaagcgtgcccgtcttatccgaacagatcaccgacacacagcccagactctccaccgccttcagatctttgatgatcgcatgctccctcgccattttctgggttcccatcgcctgcacgattgtcacgatcgagccgagggcttccggaatcgccgcaactgcaagcgcgaccgcaaacatcatcgcgtccagaagcggcatatcccggtacattgacagaccgaacaccagcgcacagacagccagaatcagatatgacagcttttttccaaaatcatccaatgcaatctgcagcggcgtctttttttccttcgcattgcttaaaagtcctgcaatcttaccgatctccgtgttcatcgcagtctccgtcacaaaaacctctgcccttccgtaagtcaccagacttcccgaatacaccatgttcacgcggtcgccaagcgccgcctcctgttcgatcacaccttctcttttctcaacattcgtcgattctcccgtcagcgagctctcattcacctgcagtgaatagctgcgccggattctgccgtccgccgccaccaggtctcccgcctccagcagcagaaggtctcccggcacgacttccttcgccggtatctccaccttcacgccggagcgcagcactttcgcgttcggcgacgtcaaatccttcagactctccagcgacttctccgcctttacatactggatcgttccaagcagcgcattgagcacgatcacaaccagaatgacaaaggtgctctccggattccccgaacaagcggaaattgcggctgccacaatcaggattcccacgagaagatccgcaaactgcccgaaaaaaaccgcaaaaacactctttttctttccctccgccagcacattctccccgtattgcgccagccgctttgccgcctcctccgttgtgagtccatgttctgaggtctccatcttctttttcacttcttccgctgaaatctgataccactctttcatttctgcctcctgttttcttaaaattaaaaaagagacttccagcacgaaatgtatctctgcgatactttccgcgctaaaagtctcataaccacgggtaatcttcatggtacacagcgccaggtccaagaccgcgtatgttgacgctgcaatttaaaactactcccctttagcagttctgttatttaagattgtatggagtataacagtccgacgccgcctttgtcaatcctctccctgcaaccttaacgcatcctttacctctcccgcgcaggaaaacagcaccaacagttcatgtgccagcagcggcattgccgcaagtccaagcagcttcgtccactccagggcggtaagtctgcaggttccaaacagctgtacaaaatacggcacttccgtgaccatcatctgaagactgattcccaccgcgaacgccgccagcatcagacggttttccagatggttcatgcaaaacaccgatgtctccacatcccgcatgccgatcgcatggaataactgcgccatgccgagcacggtaaatgcgtaggtctgcgaccgcgctaacacctgtgcatctttaagcaccgcctgcaggtgcggaatcgtcagcgtcatcccggcgcttttgatcgtgccgaccggtccctgcaaaaaggcaagcatactgattcctgcgattaaaagaccgtaaaaacaggtgcatccccagccgccgcccgcaaacaggctctcatcccggcgtctcggcgggcggttcatgtagtccttctgttcttccacatctactccgagtgccagcgccggcagggaatccgtaatcagattgatccagagaatatggctcgactttaagggcgatgccagccccatggcaactgccgccagcattgtgataatttctccgaaattagatgaaagtaaaaacagcaccgacttgcggatattttcatagatgctgcgcccctgcgcaatcgctcctgcaatcgttgcaaaattgtcatccgccagcaccatatccgccgcatttctggcgacatccgttcccgccattcccatggcaattcccacgtccgcagattttaacgacggagcgtcgttgactccgtcccctgtcatggcgacaatctccccgttctttttgcatgcggacacgattctgaccttgtgctccggggatacatgggcaaacacccgggttttactgatccgtgccgccagcgtctgttcgtccatccgctccatctcctcgcccgtcacacattcatccctccgctctgcaatgccgagctggcgtgcaatcgcaagcgccgtgtccgccctgtccccggtaatcatgatcgtccggactccggcacgtgcaaactgttccaccgcctccgccgcctcggggcgtaccgggtcttccattcctgccatccccagaaacgtaagcccgctctcctccatctgtgccgctttaggatgcatgccaatcgccagcacgcgaagtcccgcttccgtcatctcggcaagtccccgttttgcctgttctctcgccgccgcagaaaacgccgccgtcttgccgttgctccacacataccggcaccgctccaggatttcatccggcgatcccttcgtgaaagagattctgccgtccaacgtctcatgcaacgtcgtcatccgtttccgctccgaatcgaaggcaatctcgtcgatccgcggcatggtatcctccaatgtctcgcgctgtatgccgaacgctgccgccatatccaagagcgctaattctgtcggatcgccgcggcgttcccctccgtggagggatgcgtcgttgcagagagaaaatccctgcaaaaaataccggtcgtcggccggatgcagttcttttaccgcatgcactctgccgttcacgtaacatttttttacagtcatgcggttctgcgtcagtgttcccgtcttatccgagcacacaacgctgacacatcccaatgtctccacgctcggcaggcgctttacaatggcattagccttcaccatccgcgagacggaaagtgccagcaccatcgtcacaatggcgggaagtccctccggcaccgccgccaccgcaagagagatcgccgtaatcagcatctctcccacatcccgtttttgcaggattgccatgccaaaaaggagcacacataagaatacggacaccgtgcccaaaattttgccgaggtctgccaaccgcttctgcaacggtgtcagctcgaccttcgccgccttcagcatcccggcaattttcccgatctccgtatccataccgatggcagatactctccccacgccgcgcccgtaggtcacatttgtcgacatatatgccatgcggttctgcgccgtatccttgttgaccggaacagactcgccggtcagtgcggcttcttctattttcaggttcaccgcttctgtcagcacaagatccgccggaacctgacagccggcttccagcaccacaagatcgcccgggatcagatcggcagccggaatctgccgcacttcatccccttccagaagcagtgcatgcgggctggtcatctgttttaacacctccagcgattttttcgcttttccctcctgtatcactcccaccgtcgcatttaacagcaccacagccagaataattgccatatcgccgtattcccgcagcagcagggaaatcgccgccgccacaaacagaataaagatcagaggatcgtttaactgttccagaaaactttccgcccaggattttttctcctcatcctcgagcacgtttttccctcgttcttccgtttttccgcgataatattcctgcatatgcgctgcccccatccattgagtttcccgcaaagcagcacgtccaccgctttgccgttaactcatcctatgaaaatgtggacgggtttatgcctgcctgcccaaaaaagggtatgccgacgtgattccgatgtactgcatcgctccaacatctgcatacccttttccctgcaaatcatattttatttactgtaatacaaactggctcacaatctcacgcagcttctccacataggtataacactcttccaccatgtcgtgcgtggttcctgtcttctccaccatgtcgctggtcttctccgcaatatcgctgacgccgatcgacgactcgcccactgtggagttgattccgctaagtgcctgtgcaatcgcgtcgatagaattggcaagacccgccatcgcatcgctcacgtcgttcatactggtcttgaaggtatccgcatcctcctggtactgttcgctgacctgctcaaattccttatactccgtcagcacggtattctccagaaatccggtggtctcttctaagcattctgccatattggaaactgctgcgttgacagcatccacaatcgtgccgatatccttgatcgccttggaagtctgatccgcaaggcttccgatctccgttgcaaccaccgcaaatccacgtcctgcctccccggctcttgccgcttcgatggaagcattgagtgcaagcagtccggtctgggatgaaatctccatgatcgtgccggtcagttcgttgatcttatcgaccgccttcgatccctcgatggcttcctgtgcctttgtcttgacgttgttgtacatcgtcattgtcttggtgcttgcctcaactgtcttggtgcgtagatcatttgcccgcatcatgatcgcttccgaggtccgtgcgccctccgtcgccatactgttaatatcatccgctccgttcttgataacctcgatattttcgttgattgttactgtggttgccgccgtctcctccatgcctgccgcaagctgctggcttgtcgcggagttgtcggaacacatgtgatccaccgtggtggtaatctcctgcagaccatccacattctgtgtgatctggttacttgcggtatcaatatcgccaatcatggaacgcaggttcctgcgcatcacatgtaccgcatttgccatctctcccgtctcatcccggcggctgcgcagctttgcgccgttcggatttgatctgaaatccaactgtgcggtatcgacaataatcgttgtaatctgctgaatcggtctgcagataaactggcttactacgtatgccagaacaatcgctgcagccagtatccccaatgacagcagcataatcttacttactatctgattcagcggcttcatgatctcgtcttcatccgccgtcaccacaacaatctgacggttcgccgtgatcgcgtaagccgcatatttggtaacgcccttaaaatcatacgtcactgtctcattcaccggtacctgtcccttggcaagctctgcaacgacgccaagcacgacagcattctccaccggctgtccgatcttttccgcggtcgggtgatataacatggtgccgtccgtgtcaacaagataggcgtaggaagaatcaattccctccatactgatatccgctaaggcattctcatatgctcctgcatccgcctcctgtggaagattgttcacaatctccactcccatctccgccatgcttaaaatataatctgcactgacgtctccgacaaccttctttgctcccgcttccgcccggaatgcgacgatcaacaccgacataaccactgcaagcacggtcagcagcatgatctttgctgaaattgagtgaataaatgatactttctgctcctctttcatggtacttctctccattccccttcgtaattgccgggaaattttactcccagcttatatctgttattttaccacaacatacagccgaaagaaactcttcttctacaaaatattgcaaaagaaattgttgcaatcagcatagaccgctttgggatgataagtaatattattagaagaccagagaacaaaaaagttccagaataaacagacggcgggaaattctttgaagcaaaattcacgtatttcttccatgccgtggctggcatcccattccgtgtctcttccacgtttggacactcacggagtgtgtccgacaagccgcagacaatgagcggactttctggtgtccctaatggcacctcttcacagacaatataaaaaccgcgcgaaccgaaactcgttgccatctgctattaaaaatatggcagatggcaattcaaacatcagcttcgcgcggttatgttttgttcgacataaagatggcatttatgccatctgttgtctggtgccgcaagggacacacacaaaagttctaaaattgtctgctggcttgcggacacagtccgtggagtgctccaaacttggaaagacacggatcatcgaggatgccagctgcggcatggttagaaataccggattttgcggtcagaatttgccgccgcatgtttatctggaacttttaagtatctattgttcgtaatattacttatcgacacaaaacacaatatgctgatttcgacaattctttcctctatttgcttagtcctcaaacgggataacagctccgtcataggtgtcgttgatgtactgcttgatctcatcagactttaatacttttacaagtgcctggatgccagggtcattctcatgtccctcttttactgcaatgatgttcacgtaggtcttcgctgcctcggaatcggatgcctcgtaagccaatgcatcttttgcaacggagaagcctgcctgtaatgcatagttaccgtttaatacgacgaatgcaacctccggagccactcttgcaacctgctctgctgccagctcctcgatcttgacgttgtgcgggttctctgcgatatcattaacagttgcctctaatccggcgccttcctttaaggtaatgatgccgttatcctgtaacagaagaagtgctctcgcctcgtttgtggtatcgttcggcactgcgatggtgtcgccgtcagccagctcggagagatcggactttgttcccggataaatgccgaacggctcatagtggatgccgcctgcattgaccagatgggttcccttctcttcgttaaagctctcaaggtacggaatgtgctggaagtagtttgcgtcaaactcgccgctttctaccacttcgttcggcattacatagtcgtcgaaaatcttgatctccagattccatccctcatcggcaagaatcttctttgcttcctcaagaatctctgcgtgcggtgttgcggatgcagccactttgatggtgccgccttctgctgcggtatcggtgctctctgtgttctcagcactcacagcctcctccgttgcagctacgggcgtctcttcctttgttgctgcactggtgtctgtgctctcctccgtgctgcttccgcatcctgcgaatgcggataatgcgagcacgcctgccagaatcgttgacaatactttctttttcataatagtgtcctccttaaaacttaaaaatatatgcaaatttgttattgctactttctgcgatccagccgattcgcaatcttcattccgatcgtctggaaaatctggaataaaattaccagaagcaccactgtgacaaccatgatatcggtctgccatctggtgtaaccatagcggatggcaatatctcccagtccgcctccgccgacggttcctgccatcgcggaatatcctaaaatcgtgccaagggaaatcgttgctccgacaatcagagacgttctcgcctccaccagcatgaccttggtcacaatctgaaaatcggatgctcccatggagcgcgctgcctcgatgacgcctgcatccacctcttttaatgaggattctaccattctggcaatgtaaggtgccgccgcaatcgtcagcgggacgatcgtcgccgtcgatccgtagcttcttcccaccacaaatctggtgaacggaatcagcacaatcagcaaaataataaacggaatactgcgcagcaggttggaaatcacatccagcaccttgtagactgccgcattcggacggatgccgtccttgtccgtgacagtcagcacaattcccatcggaagtccgatgatatatccaaacaatgtggacgctaaggtcatatacagggtgtcccggattccctccaaaagcatgatgattacctgactattccacatctccggtcacctcctcaatctcaagtcccttttccaccagataagcctccatctgctcctgcagcccggcgtctgacggaagtcccagaatcatctcaccctttgccactccgccgacattcttggtatctgcacggaggatgttcaccggcgtaccgaactttaacaccatattggcaatgacgggctcaaatgcggaattctctgagaatacaatacgaagcttcttatcgtcgccgatgcggtcccgctgtctgctctcaccgctccatccggtcagctccgctccatccgcagtatcaccttccgccccggaatatgacgcggcatccgcagcacggtcgctcaagatcaggcttctcgccacacgggatttcggatggttgaaaatctcctcgaccaggccgacttccacgatgcttcctttttccacaatcgccacatggctgcagatttcccggatcacggacatctgatgcgtgataatcacaatcgtgatgccgaatttccggttgatctcctttaagagtgccagaatggactgcgttgtctgcggatctaaggcactggttgcctcgtcgcagagcagaatcttcggatccgtcgcaagagctctggcgatcgccactctctgcttctgtccgccggaaagctgtgccggataagcgtccgccttgtcggcaagtccgacagtctcgagcagctcaagcgctcttttcttcgcctcatccttctttttcttcgcaatctgcatcgggaaacatacattgtccagcacactcttttgcatgagaaggttgaaatgctggaaaatcattgcgatgtcgctccgctgctcccgcagttctttctcggtcagcgttcccagatctcttccgccgatgataacctcaccgctcgtcggcctctccagataattcagacaccgcaccagggtacttttcccggcaccggacattccaatgattccgtagatgtctccctcctcaatgtcgagcgagatatcccgcagcgcttccacgctgtttcccttctgctcgaaggtctttgataaatgacgtatcgcaattgctggcatgcactgccacctcctaaaatgttatttctaaaacatagaataaaaaaagcagccctgcggctgccccaacccacgctccatagcgccggtatctatctgttcttccaaagatctgaagaatccgggaaaagccgcacaacatctgcatccatgccatcacacatggacatctggcgcatcctgtcacacatcatcgctgatctcatctgccgcgctgtgtctctcatacccgtttcctccttcctgcttctccactccatgctgtctgttatctgcatgtgttttttgattacattgcctattataacaggcagtttgggaaagtgttaatacaggaagccgatagttggctataggtgaaacctatagccaaccactacataattttctctttatattttttcaattcttcgatatagatctgtccgatgtgactgattgatgcccctttgcgcttcacatagccaatccgcatcttttccgtctccttgagtggaattgccatgtaatcgctgccgtttagctcctcgcagataattcccgagcacagcgtgtacgcgttcagcccaatcataaagtttagcagtgttgcccggtcgttcgccttaatcagccgcttataatcgtaggtgctcttcatctcttccgcgaggtagagcgagctgttccgtccctggtcaaaggacaggcacggatactcgtccagttcttccatggagatcacgctctgccctgcaagcggatgtcccgaccacagatagacataggtatcgcaggcaaacagttcctcgaactccaaccccttctcccggatgatcttcatcagcacctgctcattaaaatcgttcagatacagaacgccgatctcgctcttaaagttgcgtacattctccataacgtcgtatgtggtcgtctcgttcgccgcgaattcatagctgtccatccctgctttctttacagtctccacaaacgctttgaccgcaaacgtatagtgctgcatggacacactgaacttttccttgcgctgcttctccacatagcgcgccttaaggattccgtactggtcgatcacctgtctggcgtaccccagaaactcctcaccctccggtgtgatgatgattccccggttcgagcgcataaaaatctgcagcccgatctcctgctccagttcctttaccgtctcggacagactgggctgcgataaaaacagacgctttgccgcctcattcatcgatccgcagccggctatcgtcagtgcatatctcagttgctgtaatgtcatgaattctccttttccagataacgctttttacttgaaaaaccgcggccggaaacctcactgacacgattgatcacaacaaatgcatcctcatccaccgaatggatcagcttctccgtcttcgccagttcctgtattgacaccaccgtaagcagcatctctgtctcccgctccatgtatccggtctcactttttaacattgtaacaccgcgatcgatatctgttaagactgcttttctgatctcatcgattttctcactgactactttgatctgcatctttgcagttccaagcatcaggcacttatccagcaccacgctgtagacaatcaccagcagaataccatagagaagctgttctcctgtactgtcaaacgcctggagcagcaaaatcagcatatcgaatacataaatggactttgacaccggtatcttaaaataacggttcaacacaagcggcggtatatccatgccgccagtcgatgcgcccgcacggatcacaacgccgatggctcctccgatacagattcctccaaagatcatgcagagaattatatcgtccgtgatcgcatagccgtgcagaagccgtgtaaacagatccagcgctaccggatagctgaaggtgctgaccagtgtgtttgctgcaaattttttcccgaataccgcaaatccgatcagaaacataaccgtattgaacagcagtacaaacacggagacggaacaacccattatgtggtgcacaaacagcgcaattcccgtcgttccgccggtaatcagtcctcccggcacaatgaacatcgccacgccgaatgcatacaggcagttccccagaatcaccacgcacgtctcgagcactcttttccaaaattcattcatctttcctgtctcctctgatcagatttcttatcagcttataaataccccgcacaaccgagaacacaaggaacattacaatgaatccgaatacacccatcacaatgtctgcaaattccatattgccggtgcctgttactttctgcccgatctctatggcaaacgtgatcacgataatcagtgtcagcacataaatccacgcaattaccatgacatgatcatgctttgccagccatttaaaaacaggatacacgacaaaaatgaatcccattcccatcataccaatgacgagaaaatgcagttctttatctgtaaaattgtattcatacgcatcattcagacgaagaatgtggctgtgaatcttcgcaatccattccacaatccagtacagcagctctttcataattacctcctgcttctagtttttggaataagattactacgaatctcagccacatgcaagtcagcgtattagcggaataaaatctcagcacagtgtatttttgtacaccgttccccctttcataatcaggcgcagatgatcggtgtctgcaagaaccgatacactttttgtcggatctccatccaccagaagcagatctgcataggatcccgcctccagcacaccgatctttcccttcgggtaaggattctggtaggtcgtaagtgcaaacacctcgtttgcagtgcccgtcaaagccctcagcgcccgcattgtgccgaagcgcttttcgtaataccggatatcctcgctctgctccacctgataatccggtcccgtgatcatcatatccgttccgaacaaaagcctgatatcctcatgccggtttaagatctcggtagccgtcgcctccgcacagcacaccatctcgtctttcggcggcatgttctctacaccgagcatgtcctcatactttttaaactgaggcatgggatttaaaaatgctcctgccgccgccacctgctctgccgccgtctcgtcgatgagatgtgcgtgctcgagactccgcacgcccgctcccagcgcgcgcaggatcgccttcggcgtatacagatgcgccatgacgtaggttccgtaatctgctgccacatcgcaggcggctttcatctcctccgctgtaaactgtacggtctcaatcgggtcacagctggacatgcagccgccgcccgccatcagtttgatgtgggatgcaccgcggtagaactgctcgcgcactgcccggatgatctccggcaccccgtccgccaaaacggtgctggacggatgcctgtactggatgtcgcgataggtatgcgcatactccgaatctccatgcccgcacgtctggctgatgtaggcaccgcagggatagatgcgcggtcccggaagcaccccctcgtcaaacgccagctttaatccctcgctcacacttcccgcatcacggaacgtggtaaacccggccatcagcgcatccttacattttgcgacggtcagcaccgtggcgtaatccaccgggaattctccctttgcgaacagacatcccatgtgaacatgcgcgtccgtcattcccggcatcgccaccatgcccgtgccgtcaaatacctcgtcaaaattttcttccgatacttcatccgcagtaatctctgtgacaatatcgtcctcaatgacaatctttttcccttgcgccagcccgctgctgtgcccgtcgaataccgctgcgtttttgatcagtttttttctgtgtttttccatgccttatcctctgtgggactgtgcagtcttatgcacactgtccgtcttatgaaaatttatcacgcaccacttccgccaacagtctcgctgtcatatcgacccccagagttgcgctgttgaccatcagatccatatggttcatatcgttcggcaaataccccgcataccgcatatggtaggcatctctcgccttgtccacatcacggatcatccgcttcgccgcctttgtgtccatgccgagatcattgacacagttgacaatgcggtcttcgtacggcgcatagataaaaattctgatcagatgatcgcaatcctccagaattgcgtccgcgcatctgccgacaatgatgcaggattccttcacggcaagtttttttatcatctcgctctccgtcttaaacagggcatcctgcgtcgccgtggttccgctgccgagtgggaaactcataaacagatactttgccgactcctccagattgctcgcttcctttaacggaatgttatgaactttggacgcctcctccacaatatctctgtcgtagtattcaatttccagaagttctgccagtttctttgcaatcggtcttcccagacttccaaattgtcttgaaattgaaatcacatatttctgcatatctttctctcctctccgtcttcgcacacagctatgactcttcctttaaaatacgttttaagaattttctggttgcctcctccttcggatggtcaaagatctcctccggcgttcctttttccacaaccacaccgtctgccataaaaacaacctggcttgccacttctcttgcaaactgcatctcatgtgttaccacaatcattgtgactccctgttttgcgaactgtttcatgacatttaacacctcacccaccagctccggatcgagtgcggacgtcggctcgtcgaaaagaatgacctccggattcgccgccattgcccgtgcaattccgacacgctgctgcatgccgccggatagctgtgccgggtaataatcgtactttcctgcaagaccaaccttgtctaacagttcttttccgatcttctccgcctcttcctttttcatatggcgtcccacggtaagccccagcgtcacattagaaagaaccgtcttgttcacgaagagattgtaattctgaaaaacgaaggaagtatttctccgaatctccagcttttctttattttttacattttttaagttatattctcttccgtttaagaccatcgagccttcatccggtttttccagaagattcaggcagcgcaaaaaggtggtcttaccggaaccgctcggtccgagtatgacgatgacgtcccctttctgtacatcaagatcgattcctcttaaaatcacgttatctccaaaaaccttttttacatttctcacttctaatactgccatagccctgtttccttcctattataataatgtacgatgccgtaccgcatctcagcctgccagtgtcttaacgctctttgaaaatttccgttccacatagtggctcagccgctctaacacaattccgatgccccagaataccatagctgccgccacatacgcctccaggtaagagtacgccgcacttgccgcgttgatggaatccgtcagaatgtctgacactccgatgaccgacactaacgccgttccctttaccagcgagagaatatcgttcgtgagcggtggaatgaccgcccgcaccgcctgcggcacaatcacatggaaaaaggtctgtgcttttgtcagtcccgaggcatatcccgcttcatactgtcccttgtccacggagatcagaccgcttcttatgatttccgaaatactggcaagactgcagaacaccagagctgcaatcgccacatacatcagactgacatccttgatcgtcttctgtgaatgaaaaaatgctgcgatactggaaaactgcgtcgtccagatcagataaaagatgagcagaaccagattcatcggaaacgctttgctcagtgccataaggacatccataaccggctttagcaccggcactttatagactctcaccattgcaatcagggttcctaaaacgatacagatgaccagtgtgaccgcactcatcatcagatttaacgggatcgcccccactgccgccttcaggcaattccataacaggcttccttttatcataactgcaccgcctttctcctgcgcacagccggcatgccgcttctgccaaagtcaagtctcttattgatctggttgaacaggaattccaggatcaggcttaagactgcaaataccagtgcgcagataatgtaaccttccagggtgtgccccgtgacgcttcccagcgatctggtctttccgatcatatcaatgacgcctaccatgtatgccagcgccgtcgcctggaatgcatagatgaacgtcgtgcccatcatcggaagagatattctcgccgcctgcggtgccacaatgtgaacgagcgtctgccacccggtcagtcctgcggcatatcccgcttctgtctgtcccatgggaaccgccagcacggcggaacggatcgtctctcccataaatccgccgttgttcaggccgtacgcgatatatatgtacacaacccggtcgatcgcggagctgtcaattcccatctgccctaaaagtgccggaacaccaaagtagacgacaaacatctggcagatgaccggcgtacaccggatataggagataaagactgctgcaatctggcttaacaccggtattttttttattctgatccacgcaagcaggcatcctaacagcaatccgcttccgaacgagatcaatacgatttccagcgtcaccggaaacttcactatgacctttggaaaaaaatatacaaaacgttcccatgataacatacgatcaaatcctttctctcctgcttactcctcggtaagatcctcgccgatccactcttcacacagttttcctagcgttccgtcttccttcatctctgcaagtgccgtatcgaatgctgtctggaaatccgtctcattcttgctgaacaggaagtaaatgccgccattgtcggactgataaacgctgtccttggatacatccatgaaattgtcatactgcgcattgaagttcagcatctcgatgctggatgcaatatatgcgtcgtacagtccgtttttgatgccggcactgatcgtctcatagccgtccgggtactccagatgaatctcctcgtccggatgtgccgcattccagtcaagaacgatcgtctctgccaaaagtcccggcgtggttgccacggtctttcctgcaagcgatgccatatccgtaatatccgttcttcctttcagatagccgatgtagaacttgtcggcatttacaatcggcactgccgaatagctgtacttttccgcgcgctcttccttgtatccgaacgaacctcctgccgctgcatagtttccggtatcaattcccaccagaaggttcgtccattcgtccatcacaatatccatattgtactgatcaccgatgcggttctgcacttcacagagaatcgcatattcatatccctcgtactcctcattttcattcatgtacgaatacggcttgttctctgcgctgattcccacttttactttcttggcatccgccgatgcagtagatgcggtagtatccgccgtcgccgtcgttgtctccgcgtcagaggaacctccacaggcggtaagcatacccagtgccatcactcctgccagtgccgttgctgttactttgatcatcattgttctttttttcataatggcctccattctgaaagggttccgcctgtggcgcctgtacctttcgataaaatcaaaaggcgcccagagctgatgctctgaacgccttcgttccaaaagtggtttgtcataaattttgtttatagtttaatggtttgaaagatgattgtcaaccatggattttgacataatttttctaaaaattccatttatctttatgaattataactattctcctataattttaagttatttatctcacaatctctttcatcgcagcgataaacatcttacattcctccgccgttccgatgctgacacggttgtgcccgttcggcgcgccgatcaggatctttcgctctgccagttcattttttacccgcaccggatccattttttcccgctcctccgctgtggcatcctccggaattccgaagaaaataaagtttgccgccggcgggacaacctcaaatccgagctgttttaattcgtctgccacataattccggttttcgatgttgagcgccttcacttttttgatgtaatcctggtaatccagcgccgcctcgcatgccagaagtcccggaccgctgtaattccatgcctgacatgccttcatgatcgcatccgcaagcgccggctgcgtaatcgcataaccaatccgaagtcccgccagtccgtatgctttggaaaatgtccgttgcacgatcagcggtctgtcataccctttctgtaccatctcgatcatgctgtagtgcgtagggtcatccacatattcatagtatgcttcatcgacgatcacaaccacgtcctggtcgtcatccggatgaagtctggctgctttttcatgcactttccggataaatttctcgatcttcgcgccgttgatatatgttccggtcggattgttcgggttcacaaccacgacaagctttgttttctccgtgaccgcctcatacattccgtcgaggtcaaagtgatagtccgctgtcagagggatctcgactctcttaccgccataatcattgaccatatccgggaacgactcgtaggacggcatacaatatacgacctcgtctccgggattgataaaaatctctcccagcatatcgatcacggcgctcgatcccgcaccgatgatcacataatcctccggcttggaattctccccgaactcattggtctccgacgcagcctccgccgtcttgtccagtccgtagaagtccgcgattttctgcttcaggtcgatggcaaaaaagtcctggtactcgttgacgcgcccgatgctgtcgatcagaagcttcgtcacttccggtgccggcccgtaattattttcgttaaagttcagccgcgtcactcccttcggtgtggatgtcttctgtctggcgccgcgcttgcttgccggttttactttcatgctgtcccgcagtaatgctgttacatttttcataatttcctccaatccggtcactgacctctgccgttatgcgccctcgtggttaatcacggaagtcggtgtcccattcaggtaatttttaaagttgtcaatcgccatatcgatcgcacggaaccgtgattccctggtaagccatgcaatgtgccccgttatggtgcagtttggcgccgtaaggagcggtgtcccgtgccgcggcggttcctccgccaaaacatcgagcgctgccgcccgcacctttccggactttaatgcctccgcaagcgccgcctcgtcgattaagattccccgcgccgtgttgattaaaatgacgccgtccctcatccgggcgatcgtctctttattgataacgtgtgtgttgccgttctccgggaggtgcagggagatcacatccgctctcgcaagaagttccccgagtgaactcacctgctccacaaaggaatatgcctcgccccgcttcacggtgcggctgtaggaaatgacgtgcatgccgaatcccgccgccatcttcgcaaacgcaaatccgatcgccccaagtccgacgacgcccaccgtcttcccgtacagttcgatctgcggaacgaccgccttgcagaattccggcgcgttccccggatcgctccagtcgatctcccggactctctgatcctgcacctcaatgtggtgacaggtatgcatcagcagtgcaaacgcgtgctcggcaatcgtctgtgcgccgtacaccgtgttagtgaccgtcaccccatagcgtctcgtcatggcgtaatcaaacgattcataaccatgtcccagggtggcgatatattttaacttcgggtgctttttgaaaaatgcttcactcatcagcccttccgtaatccagacaccgaacagtgcatccgcatcctccaccagctcatccagttcttccatggacgggtaggtgtccacaatctgcagctgtacaccgcctgccccggggatcgcttcgagttctttccatttggagatcagttcctccgctgtaatgtccggctgaatgatttcttcccggataatcacaattttcatacgtccgccctccttttctatctgtaaatcgttgttttatgcatcctattttcacatgcagattctctttgtgatttttatgcataatttttttttatgatattgaatataattttattttatgatattgtcaagtacaagaacaaaatttttttaatctctgtttttcccttatatatccgcattttttcctgatgtgggataataatatgtattttatctatgcacaaaaacggtttgcggcttttcatatcataaataaaactaatgtcatatagctggtatgtgaggcaggagaaagagagaattgtatttgcagaatggagtgtgataaaatatgagaaaaaagaacgcaggcagcacaccggcgggcagcgcaccggtctcgtttcgcacatcggtcgcttcctctatgattaccatgctgcttcagagtgcctactctgtcgtcgacggtctgtttgtaagcaatctggttggagataccgccctggcagctgtgaatgtcgcgtggcccatcatcgctgtcatcactgccgccggaaccggaatcggcgcaggcggggcctcctatatgagcatcaagcagggcgaacagaagttggaagagtccaaccgtgtcagagccaatacgatccttgcactttttgcggcaggcgctgtgattaccgtatgcttccttctatttttaacgccgctgctaaaactgatgggtgcctccggcaatctgctcaccgctgcggaacagtacggcagaatcatgattgcaggcggcgtcatccaggttttatcctgcggacttgcacctatattaaggaatgagaaccggcaggtcggtgccatgaccatcatggtcctggggttcctctttaatctcacgatggatttcgtactgctttactttttccatctgggaatcggaggcgccgctctggcctctttgggcgcgcagctgctgaccaccgccctctgttttctcacacttttcggtgtcacagaccgcctccgcgcgcggctcggccttccgggctctgccggcacatctctctgccccctgcgcagggagcagttcgtctttgagaaagactgctggaagcgcattttttccatcggaatctctcctttcggaatatcactgacgccgtcgcttttaattctctatcacaacatcgcctgcctgaattacggggatcttgccgtgagcgcatatgcgctgatctcctcaaccatcggctcgtaccggattctgctgatcggcgttgcggagggaatgcagccgcttgccagcaaagcctacggcgcatcgcagaacggaaatgccactcccgcagagcggatcgccgcctacgacgagatccggcatatccgtaacaaagccatccggactgcaattgccgccagcgttcttctgtttttgttcaccatcgccaccgcctccttctatccggctctgtacggctatcagggagacgctgctgctgccggctatcacgcggttatgcttaccgctgcccagctcatctttaccggcatcgtgagagtaaccaacagcttcttctatgccgtaggaaagaaccgctattctttatttatgatctattttgatccactctgtctgactcctgcagcattggcagtgctgccgcatttcttcgggacggacggaatctggctgactgccgtgattacacagtttctattaaaccttgtcgccgccggcatgtttgtgcggcacaatgcgcagatgaaacgtgagcaggcagctctgacaaaaggagtataaccatgacactacaacaaatgagatatgtgattacaaccgcagaatgttattccatcacaagtgctgctgagaaattccagctgtcacagcccaatctgtcgaacgcgatcaaagatctggagcaggaactcggcatccagatcttcgagcggaaaaaaagcggcgtctctttaacccccgacggcgccgagctggtccgctcgatccagccgatcttaaaccaggtgcagcgccttgaggacacctacaaacagccgagcagccacaggatctcttttagcgttgccacacagcacatttccattgtgacagaggtcatgattgccttcatgaaggagcaggacccgcactttaacgaatacaatttccagtatctccagctgcgcaccaaggagatcttggattacgtcgcatcggaattctgtgagatcggcgttctgttgaaaaaccgtgagaaccgcgttctcgactgggagatggagcagcaggaacttgattttcatctgctggcaaccatgcgccccaaagtctatgttcccaagcagcatccgctcgccggcaggacgaaggtatcgatggaagacctggctccctatgtctacagccactattttcagggaatcgacagttccagagaccgcttcttctccgaggagcttgtggagaataccgtcgcaaaaaaaacaatcaccctcacggacgagatggcagatgccagcatcggcatggagatgaacacctataccatcggttccggcatgtccggtgagaacctgctggaaaaagattacgcagtcatgaatctggacacgcatcagaggattgaacttggctggatctcccgcagggatcatgaactaagtaatttcggcaagcgtttcctgactctgctggcagaaaaactcaactccatgcagttggattagcgaatgggtaatctttggacgcaaaaagggacagggggcgcacagcacttcgtgctgtgcagctccctgtcccttttctcctgtcatctgcaggcgtatcgcttagtaaacatgctttttcgacttgtgggcttctctcgcttcctcgaccgcctcatggtctgccatattcacctttgctgctacttttttcttcttcaacggatgttttggattcttatctgacatgatcatacgcttcctttctctctgtcatccttatccttcaatcgcaatgtatttcttctgctctactgcaggctttgcttccttcttcggaacaaccagcgttaagataccgtgcttgaactcagccttgatatcctcctcggttacgccctcgcccacatagaagctccggctgcaggcacctgcataacgctctctgcggatgtaacgtccggattctttctccttctcgtcctgatccagtcccttggcggcactgatggtcagatatccgtcatccagctctacggtaatctcatccttcttgaagcccggaagatcaacttccatcttgtagccatccttcatctcctgaatatctgtcttcatcaggttaccggctcttctgccgtacagcttcttgtcaaccttgcgcaaatctctgtcatcgaaaaatgggaaatcatcaaaccagtcatcaaataagttctctccaaaaatactaggtgttaacataagtcatctctccttttctacttcgtacctgccttcggcagatacactcatgctgtttccttgtttctttggaaccgggatgttctgggaactcatagaactcatttcctgttctccttttgttcctctcctttgttctgactatgttatagcaccgtttattagcactgtcaagtgttgagtgctaattttctgtgaactttttgtgaaatcctgcaattgcttaattttatggcatttcaagcgttgttatcgtccaactacgcatcatttcccttgattcatccggttttcttcccggagtaccggcatccggaagatctgcacgacgagtggaattaccatgataaaccacacgagcggctccgccacaatgacaccggtgtagcctaacatcggcacaagcgtggcggcgatcacgattttcccggccatttcaagcgaactcgaaatgagcggcgtgatatgatcgcccagtccctgcatggcgtttcggagcacgcagatcaccgccgtcacatagtagaacagcgtgtcgaatttcaggtagctggtcgcatttaagatcacaacctcattcgtgcttcccgtcacaagatataccagccagctaccgatcgtgtagctcgccaccgcggaaagcgtacaccagatgcaggtgtagaaaatgccgatccggatgccttttttgacccggtcgatcctgcccgcgcccagattctgtccgcagtaggtcgccatcgtctgtccgaagacgctgaacatcgtcataaaaatctcagaaattttccgtgccgccgtgtgcgccacgatgatgtcctgccccagcttattgatcgccgtctggagtgtcagcgagccgatattgaccagcgagctcataaagcccatcgacagccccgatccgagcatgtttttcaccatcgccgtatccgcatcccggaaatcctcccgcgcaaggcggaggatttcatatcgtcttagcatgtagatccagcagattacaaacgccaggatctgtgccagaaccgtggcggcggcagctccccgcacgcccgcttttaacaccagcacgaacagaagatctcccgcgatatttagcgccaccgacactgccagaatcacgagcggcgtgacggtatccccgagtgcccgaagtgctgcggcacacgcgtcatagagaaatgtcgcaagaagtcctgctatgatgataaatatgtaaggtcctgccaccggaatcagatgctccggcacatttaaaaaccgcaggatcggctgtaaaaacaccagtccaagcaccgtcagcacaaccgagatcaccgttccgagcaccaaggaagcggcaaacgattttttcacgccccggatatccttcgcgccgaaccgctgcgccgtgataatggcaaacccgttcgccagtccgagcaaaaagccgatgacgaggttgctgagcgttgtcgttgcaccgaccgcagcgagcgcatcctccccgagaaaagagccgacaattctcgtatcggtcacgctgtaggtcagctgcagcagattcccgaggaatatcggcagtgcaaacgcaagaatcagcgttgacggttttccttttgtaagatctttcattcgaccggtctctcctttttcgtcaccggcttacgccggattctgtgatactgcgggcggagtgtcacctccgacaccgccacgccctctctctgctccacgatatacgccaccgcgtccgcgacatcctgcggcagaagatagctctccgtctcctcccccaccgtaaagtctgcattgcggtacaattccgtcttcgtcatatccggggataccaccgccacccgcacgccgtatttccgtgcctcgtcaaaaagactgcgcgaaaagctcgcaagtcctgcctttaccgcgccgtaggcacagccgtgcggattcgactgctgcgccgtcacggatgcgatattgacaatgcagcccttgtttttcttaaacccgcgcagcagctgctggcttaaaatcatcggcacttccagatctgtgcgcaccatctcctgaatcttcttcgggcttaactcctcgtgcagtccgtagtacgcgctgccggcattgttgacgagcagcgtcaccccggcttccgccgcaatcccccgcaccagcttcaacattttttccgtgtccagaagatcgcagaccaccgcatgaaacagcggattatctgcagcgtccggaaactgttccgcgaaactgctgccgaacgagcgtccgatgccaaacacttcatatcccattttgcacagtctggcactgatcgccgccccgatcccggaggacgcccccgtgacaatcgccgcctcgttttctctacactgctccatgtattctctccttattccttccaccggaaaatccgctctgccggaagataagcggcaagtttttccgtcatatactgctccatctcctccatgagcgccgtcgggtaatggtacaccccgccgtcattctggtaggggaactgcaccaccgccgagtccggctcatttttccgcatcttcttcagataatcctgggaaatgcggaaggttccgacgctgacatccgccagtttttccagatccagcgtcccgcagacctgcgcaaacatcgcgtcatagtgcttcttccagtcgctgcaatagatcatcgggtcaaagcagagacgcaccgaaaagccttgttccatcgccgcttccgctcctgccagccgcccggcgagcgaagccgtaccgtgctcatatgcatcaatcacctgctgcggtgagatggtaaacgcacagatgacacctgcctccggccggaccgtctgccacaggctgcctccggttcccttggttctaagctcgatgcgcagccgctgcccgccggtgttcatcctgcgcacaaactcaatccagcgtgccgtataaccggtcagatgctctaacgccagcagatccgtgtcgtaggacacgcacaggtagaccgggtgcgtggcaagtctcttttccacttccgcaaaaatatcctccagattgacgaacaccaccaggttggcggacggatacattcccttcagatagcagtattcacagtcaaacacgcagttcatcacacaggaggtgtagtaaaaatgctcatttccaaagttctggcagaccggcgcgccggggtagagcagctcaccgtgcttcgccgccagaatcagattctgcgccgcatgctgcctgacatagtcctgcctgctccggcagaaaacatccttatagtggtcgatgtcaatcacttccgcctgcggaaactgcgtgagtatccgctttgtctccggatcttccgccacttcccgctccacataaatatgggaaaacggcggattataataagacctgtttaagttcttcaagccgcaccttcccttcccgcctgtctttgcacgggagcagcccccgcgcataccattcttccagttccgctttccagtcgtatccggtaagcgccgcatacgtgatatactgccgcgccgacgcccgcatcgtctgcgagcagtgcagcgccgcaaaaagccgctccagcaccgcctcgtcttcccgcaaaataccgtcgtttcgcagcgtctcctcctcgtctgccgcctcccgcagatttgtaagaaatgccgcgacctcctttacatgctgctccagcagccccgtgagcgcctccgccgtcattctctcctgccccgcaactccggagtccgataccaccttcaaaaagatcatccggtccggagaaaaaaagcggatgcctgcctgatagacggccgccgcttccatatcatataaagctccgtgtgccgctgctctttgcagcggctgcatcccggtcacaagttcacgttccttccacgggtgccggtacagaatatccggatagaacgttttcccggttgcctgctccgtgatcttgtgacacacgtacaggtctccgatctgtgcggcgtgtgccgccccgtatccgctgtccatatcccggtctgccggttcacagccacctgccgcgccttctgccgccgcgcagcagctgtccatgccccggtctgccggtttacagcagcctgccgcgcagcagccgatattgatgagaaagtctgccgcatctgctccatcccgcgcacagactgccgcggtcgcagcagccgcagcaatctcccccacaccggtcacaaccagccggatgcctgcgctctcattgtcaaacacctcaaacggcgcatacgccgtgttcttttttaattccagttcccggatgagtccgtgtgcctcctgataaagcgccgttaccacataaatcatcgtctgtctctagcctttccaatacgcccggatggcatcttccacaagattctctccgatcacaatcagaacgtcctgcccgtttgcaatcggctttcgcgtgatctcctgctgtgttgcattgatctccagccatgtgccatccggattctgcaaaaatcccttcacacggaaaatatgtccgcacgccggatctttcaacatcttcttcaccgccgccgtaaccgcatctccgtccagatgcatatccagaaaatacaacgactcaaacgcctgtcccttcgcaaagtccggcttctcatagcttgcgatataataaccgcaggagagaatcgcggcaaactcctgatctgggagcggttctgcgccctcgcacaaaattttctgatccgcccgctgcttgcagccgagcgccgcaagcgaccgcttcaaatgcgcgatcgtattctgccgctgctcctctgtcgccgtgtcgcacttgcttaaaatcatacagccggcatttgccgcctgcgacgccagcaggtactccgcctccggtgaaagtgtgtcctccagacgcgcgtccaccacagcaatcacattgccgatctcgtaccactgatccagcggctcctcatgcagcacgtcaaagaactcgtccatgtcgtagattcccgacggctccacgagcacgcggtcatacccgcacattcccatggcgatcagcttggtgcggaaccttctgcggtgcgtctcaggatcgcagccgccggagatcatctccagttcgcactgctccccctctaactcctgcagcagcatcatatcgacattgaccgcaccgaaatcattttccagaattccgatattctgcccctgctccatcaggcgcttcgcatattttttcaaaaacgtcgtcttccccgatccgaggaagcccgtgatcagatcaatttttaccatggcagtcctccctatgcatccgatctggaatatgcattcttcatctgactgctgagttcaaataaaaccttgtccagggtatctgccgtctccttctgcagcatcttcgcaatgctgcggtttgcctcctcgcgaagtcttctgcgcatcacagcatccgtctccttagcgaggagctcgtcgtagtgatggatcagctcatgcccctttgccatcacatgctcctgatagcgctcgatatggaacaccgagctccggtaggacgcgtctgccatcgccgcaatcaaccggctcgaccagtaaaagttctccgtggacacctcgcctgtcgtgttcgacagatattccggcgtctcctccacatcggcatagaacggcaccagcacgttaaatgcgtttgacgcaaatgccagccattcgatcacgccgttctcctgctccatctgcgggcgcatctggatcactgcgagaaaatcgttccggttgatgccgatcgagcggtatgcaccgcgcagggacttatccccgtaagcggcatacggatcatacggcgttccctggaaatgggaggacaagacgtatttgacgtcctccaccgtcacctttttctccggtaccatgcaccacggaagatcatccgaaaccggtgtgaaatccgcatgcggtccgtcccacaccttcgtgtgcggattcagatagcgctccatgaaccacgcacgcggcgtgttgtatacatgatccgcatcgtcatggctgccaaacgcgtcgcgcggatgaaactcgccatcctgtgagagatccagatgatacgtctttacgaattcttccagatccgccgagcacatatattccttctgctccccgagggcatcggaaaaatcaaaccggtcgattccaagctggttcggcatgaccacatagacatcatccggcactctgcgcgccatccagtgatgtccgccgattgtctccagccaccagatctcatcctgatcctgaaatgcaatgccgttcatctcataggtgccgtactgctccagcaggcttcccagacgtctgacaccctctctggcgctgcggatatacggaagtacaagacacacaagatcttcctcgccgatccctccacatatctccggctgaccatcctctgccttctggtataccaccagcggatctgcgccgagcacgcgcggattcgaggtgatcgtctccgtcgccgtcatggcaacatgcgcctcattcacgccgcttgccgcccagatgccttccccgtcgaccgcgttcggcaccgccgtgtagcgcatcggctgctccggcagctcgatcttcacatgtgaaatcacagactcataatgtcgcggctgctcctggggctgcacgaccacaaatttcttcggtgtaaaatgtcccgaacccgaatcgtcgttgcgcgcaatcatcgttgatccgtcataggatgctttttttcccactaaaatcgttgtacaagccattatccattcctccttggtatgtctatctgattttcctgcctcttcgccggaagcagaaattccctaaagcatattccacattgcataagaatcatagcacttttcgctcgtcttctacaagtcccatctaggaaccggacggaatccgcacgaggatccgctccccgccgcgctctgccatggcaagcaccggcacgtgctttttccggagcagatgcaccaccggatatgccgaaaatacatccccctcgacataaacagcctccggccggtactgcaggatctgtttcacatagtccctgttccgaagcttccagtcggttttttccatcgccacttcaccgtaactgccgtcctgctccagcccgggcagctccggcagcgggatatgatagatctgtgcttgcgccatccccggcagttctcttaaaagttcgtccgccgcatcgccgccgcccacgtttacaagcgccttctcatccttgaagctgtccagactgatccggcatgcctccaccgcatcggaaagttccccgaccgtcataagaaaacctcccttatggcagaaaacggcgctctctaagcccgatgcctccaccagctcttccttttccagtccgagccagcgttccgggaagcagcacttataatggagggaatactcccgcttctgcggctggatgcagtatccgccccggttcgacgggaaaatcacaaacgcaatcccggtctccgacaggcgtttctggcacggaataaaatagggcaatatcagaatcgcggcatcgcgctccgccgtctccccggacgttacggcacgctcatgcgccgccagcacttcctcgatctgacgatcggcgcgctcatttccgcgatagcgctcgaatttattttcaagaatcatgcctgccacgctgaccgcctgaaaaaaggcggcatcgcttccgccctgcgcatcccatgccgggttaaaattgccaatgagcgtcgccagctcgtttttctctccggtgttgtcgttgttgtccaacggctgtacaaacgcctcgtcaaattccgccgccagctcctccccgaggattgctcccccgagctcctcccacagcagcccgaacgccgcatagggcacgccgttctcccgcacccggctgtctttctgatgatggtcgtaccgtcctcttccgatgtcaaacacgatcccgtcaaaattctccggcaccctgttgccgcgcgtaattacaatctccggattcaggtaaagcagcagcgccgcggaaaacacatcgtctgcatgaaatttccctccgtgtgtaaacgccgccgcgtcttttctccgaatctgttccagtaagtcttccgtcattctttttctccctcatttgcttcttccatcacaacacgcgcctccggcgcgctgcccgcctccacataatcgaaccggagcaccgcctgctgccagttcacactgactctggcgctttttcctcgctccctgccggccgcggaaatctgttctaacagttccccaaagacctccctggtgagatacccgcccctccagtgaaaggtaaacgtttttcctttttttgctgtctgaagcgcacgtttatagacatcctccaccttcgtgaaggaaagctttttctcccgataataaaaatgctgtgcatccgtacattccggcgcaggcgcgatcagtggctgatgatcccggaatacgctcttgtcgcagagattgaaataatcgtaccggatctgtgctcccgcaccgagcgtgttgtcaaatgtggcatccagatgataatactgcccgccgatttttacaatattccacgtatggcggtatttgatccccttctctgggcagtttccgcacagagcaatcacgcaccagatgccaagcgcatcgcaaagcacctttactgactttgcgattccctcacagacgcccacaccctgtccgagaggacctatgatctcatgggaatacggctttttcagcttatcgtagtgcacattttcgcagataaagtcatggatgtatttttccttctcccactcggagagattctgcgccgcgcgcgccagtttttccacccgcgccttcatcgccttctggtgctctctgatcttgccttttccaaagaggtattccggcaggaacacaaggttcgccgactccggataataccggtacttgtagccggtcgcccagaaaatctccggatgatccagccgcagcaggaaaaatacctgatagagatcctccgcctcaaggcgcggcatcggaatggcatcctccaacgccaatagtccctgcagcatcgcatgatatgccgcctgctttgttttgtccattttgctgtaataatatgcttccatcgttgtctccgtgtagttatatgagctggactatgagctggggttcctgccaattccatactcagccttcctgcccggcaggcgtctggcttctccggtgcactctccgtctcacaaagtaaaagcagacgacttgtaaaataatggtgataatccatgacgccggataagaaataaacagaatcgccagtgatctgtgatatgggaaaatgccaaagatccacaccactctcgtaccaaccgttccgatgaccgacaacaccatcggcaccgcggaatatcccatgccgcgcagcgcccccgggaacagatccatccagccgcaaagaaaataggtgatcgtcgtgtatgcaaggatctccataccgcacgcaattacctcggcatcctccgtgtagatctgtaaaatttccggtccgaacccatagcagatgcaccccaaaactacagcgaccacgaccgataagatcatgcagtctgccagcacacgatccatgcgctttaattttccaacgccgtaattctggctggtaaagctcatgcacgcctgtgtgatggagttcaccgagacatacaagaagccgagcagattgtttgccgccgtgtagcctgccatcgccgtcgatccgaacgaattgaccgaggactgcaggagcacattggaaaagttaatgaccgtactctggattcctgccggaacgccgaccgaaaagatctgcttcaagtagtaccctttcatgccaagctcggaaaaacgcagccggtaactgctctccgaccggcagaggcaccgcaacaccagcacacaggaaatcatctgcgagatgaccgtggcgatcgccacaccggcaacgccgagcttgaatacaatgacaagcaccatatttaagcacgcgttgataactcccgcaatcatcaaaaacagcagcggacgttttgtgtccccgacggcgcgcagaatcgccgcgccataattgtagagcatgaaaaacggcattcccagaaaatagatccgcatataaagtgccgacagtccgatgacgtcgtccggtgtccccatcagcgccagcgctcccctggaaaaaacaagtcccaccagcgccatgataattccactgaccagtgccagggttatcgcggtatgtacggtctcagacacctctttctcacgccccgccgcatagaaacgcgccgtcagtacatttgcccccagcgaaattccgataaacagattcgtgaacacgttgatgagcgcactggtcgatcccaccgctgccagcgcctggctgccggaaaacctgcccaccacgataatatctaccgcattgaacatcagctgtaaaatgcccgacagcatgagcggcagcgagaaggaaatcaatttgtccataatcgttccgttgcacatatcaatctcatatttattcttttttgccgttgtccgttccacctctgtcacctctcctgttctgtgtcttatttgtttcagccactgcccgttctatcttttcttaaatccagttaaagtctccgccggtaattgcaaggcttaagagcgcatccattttcgccacttcctcctcgccctcgattttctgcagaagcactgccgtatctgtcacgtccgcaagcgtttcatccggcccgatctcataatcaatctccgatgcacaatccgggcagggaatccgcgtcatcgtctgcaaggacagaaaacgattcccgcactttttacattcataatatccacactgctttgtgccatccggtacataatacatggtaaaacctccttttgcctgtcactatctaccccattttagcatgatggcttttaaaacacaaatgcagggtatgtcttgagggcaagacataccctgcatgggagggtcggaagatgacggcaaatgacggggcaatggtctatccttaccaaattgattttatttgaattacaatttcttctccaccttctccaattcatccagcaatgccggttttcttggatatctctgcttcaattcctcaattaaagacttagcggtatcattacccttccattttataagctgtacaatattcttcgttatcttcttatattctcgtctatcctttgcctgagcacagctttcacttatttccttataacacaactcatatatctgctccggatattccttcaccaaatattttccataataaaacaaatcatacggattctccattacatcttcaagtaatctcttcttttcattttctgaaataagaacactgcggtagcaaacagttcgcttgctatcctttaattcatccaatagactctcgtaattctcattccatgcaccacactctctgtaaatctgtttcaaaacaccccagaacttctcatttcccattaataacagcttttttgcctgtgcgatttgcttttccctgttgtttgctgtcttatatatgtcatatagcacattattccaatcttccggatcaccactacgataatgccatgtattttctgcatttgccttctctaaacaaagcttctctgcttcatcataattcttctcttccatagcatccttaatcgctataatacggagttcatttatcaaaatattctgatataactccttctgcgtattctctttgccatataaatgtctatgtaaaagatatcttacaatcaaatcttcttttttcgtgtattctggaaaataatcctcccgcgaaatttccaacaaagtatccaaaaccttttcaagtttctttgcactcttttcatcacacaggcaaatcccacttttcagcaggttataacgccagtcagtccaaccatcaaacacactcttttttgcctcttttataattaatgcaagtgcctgatcccgcatttgtttgtcttctttttcgatttcttttgtgcatttgtctatcagttcgtatgtacacatgataacatctgtaagcattcccgaactactatccgcatgagatgctaacttaacgccagataccaaaatgtatgcagcagcctcaagtgcagccatatagccacgcatttctgaggtctcagcacacatatcaaggcatgcatatccatacaaatattatcgcagctgctccaaccaatgtatccccgatgggtgttacatttaattgatgcagcaattgtttttttcactatcggtataatatcttctgtgggtatcatagcagctcctttcttttattcaacaatatcaatcttatgcctttcacaccattgccttgcgatttttttataagcttcatcacgacgtatttttgtcatcgtgtcaggcgcaatttctgccttttacgcaaatcagatttgctcatttttttatccactaataattttcataatttgttatatgacacagccataacaatatctcctactcccactccatatcgtctattttttacacatttattatatcaatgaaactcggaataaactctctgaagtaccttctatttttccaatcatttatattaccaataaatgctattctatattttgctctggtgcatgcaacattaagtatattagctttctttaccacccaattcattgcacctgcacttttatttgaacaacctaataccaaaagtacctcattcgcatctttcccttgaaaagtatgtactgtaccaacacaatttttcgtccactttgacaaaatttgcttatcatatccttttactgaaaagtagctaatgataaacttacgcattgattctgcaactgttctaaaaggtgtaattataaaaatcttatcatctgtttcaaacaaatctgaatatatatgtactgcatcttccattaactggcatactctctctgcttgatttttcacaaaatgatccttaccaccattttcttccccttccacattaatccatccagatttttttatcaaaaatagattttccggtttcaaatattcttccttcttatttgttttattaaacattctattgtcatatgaaatcaaatttgaaatagaaaacattggttctatgcaccttctgtgaacaaccaacgggcaaccaacctgacgttccccgatcataccattaaactcatttatattatcagaaaaagtctgaactgaattttcaatcaccttatatgcatttgctacgcatgtactatcagctagtatatcaattaacactttaggaattgttacaacaggttctacttgcaacggatctcccacaacaacagcccgccttgttctataaattgctcctaaagcagactgtggaactgcctgcccggattcgtcaatgataagcatacctaaactcatattcccagcatgttttaaaaatcttcccaccgaagcaaaagtagaagacaacacaggtatcactactgacaatgaattaaacaaatgtggaaacatctgttgtttttctgctattgtgtattttccattgttatatgcttcatatacaaacagatttctttttatatatggcgattctaaaataaacgcttttcgcacttgtaatgaagcataaaacaatgcctccctcgccatatcatattcctcaaatgtccatggacacgcattctgcgaatcctcagattccttaatatttttatagaaattcctatccgcaaaattatttttgtatttgttttttaaagactcattatctccatatattttttcttcaagtatctgtacctgcttttctaaagtagagattatactatattgcttttcaatttttgtacatacttcttctgtatttttcacaaccaaactatatctatgtttaatatcttcgtgcttaattattaactcatcaatatatttttgtttttcagcaatatgcctgcctattttccctattccaaaaaggataagtagtttcttaaaaatagagctatgttccttaatatacttaatttcctcttcctgctctaaagtcaactgttcattactttctaattccgttcttacctcatttaactttacatttaactgctccttttctatgagcaactgttttaaatccaatttactcttcgcaaaactctctccttctttataaaaatcatccaagagtttttggtctttttttatgccttctcttaataacaaaacctttcctttagctacattaaacttatcaacagcttcctcccacaaaatactatcttctcttgcaagatctaatgtcactttatctgaagcatcattttttttagcaaatacacaagattctaaaacttctgtaacataggattttctacccatacgagctgatattaatccccatgcaccgccctctttacctaaaagattatctgctaccgctgaaaaatacacttctttatttatttctctgtcaaagtaatctgtcctagttttatcctttcccatatcgcaagatttcggtaaatcgagtgtgacattttctacagctccattattatttgataccacaagaattccatatttagaaatttcttctggtatttcataatattttctgtataactagcatttgatgcggattcaactttcctaggaacaaaattactaccacctattccttttttaattaaaacttctgctaattggacaacatttgaagctattatttctttcaaaagagttgtttttcccgttcctggtggtccatttactgaaaatattttttcttttctatccttttctgatatagctatgtttatagctatttgctgcattaatgtcggagaaaactttgatggatattttcccattggaaatctatctacttccaaccattttttcatggaacaaacatcgctatctatcattatccttttttgtttttcttccaataatgaagtggtatattttatcaaattctcattattctcatagtttttctgaacattttctatttcgtccaaataaaaactggtaaagtcacttgtttcatcttcttttttcaaacctttgcacgcatatactttatccgaagcactttttagcccaatttcattttcagacttaattctcagtttatcaaatataatattttttactattgttacatcttcaaactccaatattcgtacattattttgtttaagtatttcatttacttcttcatttagcttccatatattttcttgcataatattaacatttatgccctcggcttttatcatgcaaagtacagcgtaaaagaacgggctgacttgcaaaccctcttctgtaattttcccatctaaatctatctgaacagaaaaagcataaaaccgtcctgtcaattcatttatctccgcatatttttccctatccaatttgcatttttcagccattttttcaacaaaatctttagttctataacagccacaataaatatttgctcgattatataaactctcatcagatttgttcttctgtctcaaatactcattatgagccttgtatctttttaatggcaaacttctgatactgtgatcattgtaatacgcatcaaacggaatattctgttttccctcttttattgttaaaaccaatgccggataatctgatggtgtaaaatattcttctaatttccaaaaattaaatatcttattacattccgctgttaaagagctgtttatcattatatacctactttctaattggaacacacatggctatgcttcagcttcagctccatttcatcttccatttttacaaatccatacttttcatataacggtcgtcccatctctgtcgcctctaaagcaatctgtgatacgccctgtttccttacatcctttacaagtaaatctaatgtatgaaatgcaatcccctgtctccgatattctgatgccgtatacatattcataatgtacgcctttttaccagttggattatgatatgttggcataacctgataaaagctgacaccgccggcaccaataaaagtttcgttatcatacacaagatatgcaatatgctcaccattttctaatgttcgcttataatactcataggattctttttccaccaatgacatatccacatcatccgacagtttattggcagcacgaaggacaatgattcttgttcttaccagttcattgatatcttctatcgttgcttttttgtattcatagatttctttcatcctacacctctaccagcaaagactctccctcagaataatctccactagtccatttccatttctccgaaagttccattttccctttctctaacaccattggtacactatgacacttacgttccagataaactttcatgctgcggtaaccagcgactcccttgtgcgagtggtagatcttcttttatttgattctgtacttctgatttacgggtataacaatcagctttcctgcgttttaggtagttatagtaagcatttggacagatttccagccttctgagaaaccagcgccggccaaattcaatatgatgttgttctgtgaatcgataagcctctaatcgatttcctttgcaaagaatgccgctgtttttttaggaatagattctcttttttgcttcttccagttcttttcgtaaccggagattctccttcatgagttccatttcatttggtaaatcaggatcttcgtgagctttagcttgacattctttgcttaattcgctgcaccacttggaaatgctggctttggatagcccatactcagcagtgatgcttttgcaggtacatcctctttcgtatgaaggcgtacaattttcttcctaaattcaggagtgtaactttgtggcataacctattattatttttcatgaagcataaaatttttaatcatttattcagtaacaatttccttttcaaaaagccctatatcttctttgggatatgcgataccatatacttcactttttccttcattcttttctatatgtatagtacgtttattagccaaaaaataaaagctgtctttatcgtcatgtattttatacatccaagcttccttatttacaatttctttgcctatatttttatgtatgaatgaacctcgtcgtattccatttggttgactcaaatttccctccacaccatcttcctttgacagttcaattaaaatatcccaaaatccttcaaaaatccccatcaacatcatatactgtacaaacatcattctatctaccaaatcaataaaaatatcattcatccccttattacacagctcaggtttgtgctcacctatataaggaacataattactctttcttagttccaactcatattcatcattcattgataagaattgtgcattttttagcaagaaaacttttagcccagatctctcaactgccatttgtaaatccataactgcattctttactttcatgatttttaataaatctttaacatcatcgtcatcatattttgagcaaataatagcatcacttagtttaacagctattttccccatcttttcactaatatccgacatctttttaaactcatcattctcaagtacatacttcgcagtatccaaaataagcttatctccattatccaaatcattttttacatactgcttcattttttcataagtaattgaccaaccataaaagtgatttctggagcactcatgctctacacactgattataaatttgatagtgactaaccactttttctccatgcttgttgtgctcatctctaagagaaacatatatattttttatctccttacccaattctgttttatttaatgctttacctaatctaatggaatactcaataatattcatttaatcatctccccctcaacaactcttgtaatttataggtgataattcttgaaacaatccctatcatttttttaatacttgtttcttttatttcatccattccttttccatgtatcatagaatttcttttatttctaaagaaagctatcaatttcatttcatcttctgtaattggaacatccaatcgcttcaccattctttgcaatttactgttaaaacttgcttcttttaattttgaagccaaatagctattcatgtcgctttcaagcttctccaaaatctgggcatcagcattttctaaaccttccgtttttatttttacacttatgttttgagtaagtgttttcatcaatgattgctcttttatcccatactcattcaatttatcctcaacaatcgtattgcccttttccttatataaacagaattctaatgccattacgcaatatataatattatcacctttatttgtagagtttccaaccttgtttatccatcgtattgcattaaaaagactttcgatttttttatttttttcctgagtgcactttatgtaacatttctcaatccaatcagactctatattatttatgtccacatcatctaattctctaacatgaggttcaattcgctcgttacctgatacacaaatagcttgtctatccatacaatcttctatataagcaatattcatcaagcttatttcaggaaagagcttactcgcatcccaatgttcgcacatgtcccctataccaaaatactctgccagacaatcatttttagcaaaaaacgcaactaaatccacaactctcatcaacttttctttagctaacgaatatgcttcataatgattcgtggccctttgatctgtccatattataactcgctcatctgcacctcctttttcaagaagttcttcaaactccgaactgacttttatctcttctcctattcgtacatctccgacagagcaggatccatttagtaattttaaattatttattgccatagcaaccaaaaaggttctctctgccttcatttcatttggcaccgcaacaccattaatatctatatcaaccgactcaagcatatattttataatcacaaaaggatttcgtatgttttgaaacacaagattatttataaccatatgtcctaacatatacatcggataagacatcaattttaatgtatactgcttattgcttttatcaatcttgaatattatgcctttttctctatactcaatgccagctatatttattattaattctatatcagtttgaagacttactttttggattttctcatctaattgcatctcatgaatcgtgaatttgcatgaaaaatcttcaaataacgcccccactatttcatctataacatattcattttcattaataatcatctttatagacatgcttaccatatcagcataaacatcataaaatatttttgttccctttatagcaataatgcctttatctttaagattatctttatttcgctctactacatcatgaatgtcatcaaaagccacacctttgttaaaatgtaattctgaatcttgttcctttccaatcttacattttagtatttctatttgatgtaatgacaaaaaagttcctttatttctgagcacatcatatccaaatattgcattttcttttctttcattagtacaaaaaatgcttataaaacccatacccttttcgcatattaggtatacaccggtacaaacgccattataatctggcatttctatttttccatgtaaaacaggaagttctcttaagaatttttctccatcaagcatacaaacctcctcctattcgcaatttctaataattttcattcatgtacttgctaatcttataaacagaattatttgtattcccctctgattctacataacctgtcccaaccaatatcttcaaatatcttcttacggttgctgcagattttccactaactgcttcagcctccttcggtgttatttcacccttttcttcaataaatttgattaacttctctaatttactaaaatcgcttgcttttaaaacttcgcttaaaacttcgctcaaacttcgctcatttttttcgttcacttcgctcaaacttcgctcattaacgtccttattaaatgcttcatgtataaacaacctagttataaaataacttctatcctcatccgtctcatgaatatccttaaggacaccgcctatcctgttggcagacaggataggcatttttattttcgcctgctcttcctcgaaaagcttttctctttatcgagaaaggcaagcaacgctataatcaagctaccaaaggacatcaacaatgctaatatcccaatgaaaatcgaaatgatctcataagccgtcatcggcgctaatcaagcaccaccagacacttaacgccctgtcatgggtactttccttaaagagtaccctaacatatatcatatgttctgcaagaacaattgtaatttgaatcttattttatagactcatcccctatagataaaaacttatatcaagcacaaataacaaactaaccaaagtaattaggttcgtttcctaaaatattaatcaatataaaggctctatatcttgtttattgtataaaaagataaatgtgtattctaattttattattcaccttcttccttcatataatacctcttttttattacttctttgtataatgtagcctttcaaccatttttatatattttaactataaattaatgtttgggttattctctatctgttttgccagctcttttctaactagtgacttatttcctttaagtactttcgttaaatctttgttcatatttaatttaatttgagcttcaataatcaaatccaaaattccattgtatatttgtttgttagttccaaaaaacctcattctataatagaacaaaagtttcataataattaattttataattccttcagaagtttccttttgaatgtatctatgcagctctggtataacatttcctacatttaaatcgcatttaaggaactcaagcataaacttttcaaatggtttatacttcttttgttccattaattcatctattgcaacctcaagttttggagtgccgacattttctagtattacatgttgaagtgctattggaaatgatacttttatcatttctaaaaataattcctttgacttttcaaaatcttcctgcgttaagttttctccttcttcttgattttcttctatataatcttcaaaagatatttctttttttatattttctgataaagcaaaaatttcaccaagcaaaatattcatggcatacatataattctctaaatgttgtactttataagaattatccaataactcagcattttttaatatacttccataaatagaaactaacaaataaaagtcttctgcctcttcctgtgcaactttctcctttatgctttctgaatcttgcaaattttgtttattttctaaaaggacaggacttttctttttactaaactcatctggagttatctctttctgtgagttattactcatatcatctatttctttctgtgtaggtctattttcctctaatgtctttattaattcgtccttttcaattttaaaatcagtaataatctcaatattattaagtgtatcaacaataccaatatttttcattattgcttctataatagtatcagccataccatctagaagttttttgcaatctggtacaagacctgaatagaaacatatctcattcttaaaatgtattctattacctttctgaatcatgaaatttaaaaattcttcattatttctcgcatattcagcaagataaaactctaaaatgcttgtatgactaaagacaatattatcatctgaaatgcttaatattcctttttcaaaaaataatgtagaaaacctcgactccgattccttatatccttttgtcttatgatactgataaacaaaatcattgaattcctccctagagaaataatactcatttttctcaaacattttatatgcaagattgcttaaaaaatgctgtttgattttaaacgaatatgtacttctctcagcttcctttggggataacttctctagtaaaacctctaagtaattttccattacaattccttcattttgaggaacaaaatttttgtcagaatcccataataccataaaaatggaaacattgaatggtgtcttagcaaaatttattgattcacagtaaccatttattttttcaacaacttcagaaacatcctctacatcatctcttcttccagcccattttgtaacaagttctcgaatttgagcctttccaaatgaatttatatatagttttttaaaatcttttgtgtattcaggaagttttttaacgtcaatagactgaaaaaactcttccttcgttgttaaaatatatctgtttccactattttcttctataaactttgacaacaaaacagtatgattagcattggaaatatctatattatctattaaaaaaacaatcttgccattatcaataagttcctttaccttttcttttctaattgttgcatcatcaaacatatttttcataacaaaatatactgctgcatttgtcaatttatctgatttcttaggtaagttacgcatatcaatatgtacaggtataatttccaactcattatacttatctatatattttaaacctatttgttgcaatatggtggtttttccactttcttttttcccgaaaagaattacattatctgtatcatctaacaattcatctaagcaaatagtctcgacttttccagaactttctgaaacatattctgattcctctgacaaaattggttctacaaaaacttcttctatatctagtggtgaataagtatcaatttccttaatcagggataatgtctctgacatattagtaaaatagttatgtattccatttacaatattaaattccatttgtttttcagctatattgccatttagtggatatgatacttgtccattttcaacaagattaattgcactgtcaaagtcgtttctatctttggcataatatgttcttaagaagatgttacaaaggctattattaaaatctatatttaaaatagaatatccgttatacccatcaactgcccttccaaaagcatagtccaatggatatatcttccctgctgtgctatatattgtcttcatactttgtctacatacctctttatggtcattttcatgaacgtgaccacgaagaacgatgtcaaacttagttaattctctttcaattattgttgattcataatctgatagccaatctgttggatgatgcattaaacagatttttatatcagcatccttaatgtgcttatataaatcatttatctgcttttgtccgacatacattattcctttttcacaaccgccctttccagaagaacgccatgcggaatcaatacatgcaataccaatctttttaccatttatttctcgtaaaaacgcatacccaattttttctcttataatgtcatcgtaataattatcaatccattggtagaagtaatctaatcgtgccaaatacgattcattcatatccgaaacattatcattaatttcttctagtgaatctaccaaaagccccttctcagttgctttgactattttctttacatcaacttcatgatttccaggtataattataaatttattattttccaatcccaaactattcaataatggatttacaagaatttcttctgcaatttccagctgtttctcgtcatctaaagccttgtctccacgttgaatcaaatctcctgtaaaacaaactaaatctatttttatatcttgttctttttgtactttcaaagcatcatttatcattttcaccacaatctcagaaacttcttctttagcatccaattgtatatgtgcatccgaaatatgtaatatatttaatgaattcaactttatctctcccgtcatattttattattatttgcatataatatatagtagttttataaaagaaacggagtgtcctatgaccaattttgaattattaaaattaatcattctttcaaaagacaaaaaacacttaatacatttattaaataaatatcgtatttctgaacaaaaatcaaagtattgctaaaatactctttctattaccactaaaatattttactgcatctttgtccatcagtgcccagtatttatgatttatagattttattttcattagtactatatcatatgttttttaggctcatgaagttgacatttataacggtcacaatattttgcaataatctacaatcaccaaaaactacactttatatgctagcaacagcaatataattataccgcattaattattcatcgtaaatatatacctatttatgccaaacataattcgattatgtcgcgtctcccatcttcgccttcccaatcgcataatacagcctgttcacatccaccttaaccgccaataataattcgcttttttaatgttatgctgcttacaccattcgtcaactgtcatatccttgggacgattctgacaatcctgaatctcctgtgcccattggttcagccgaacctgtgccgcaacctgactttcttttgatgccatagactaacctccattttttatttagtctaaaaagtaaagtcaacttttcggactaaacgatttagactttttcgatgttgggtctattatctcagaaactgagatacatcacaaggtacgtgctattgggcatttacatcgtttacgaagaaaatgccaaaaagaaaaaggcaaaaaagaaaaaatagacatcaaaaaaaccttaccgatattcagttttcattctgaaaatcagtaaggtttcctaatatctataaagtatttttattcattgaatgagaagaaaatgttgccaaatcgttgccaaagcttaactaaatttgtttggaaactgcataaatactggctttttcaaggctaacatctcactcaaactcgacaattactaatcaattttgtttagagattattggttgccgtgttcgcttttctttcaattatttgatttatccatattatcctgcctatatgggctaatgttatcagtttgttatcggtgttgataacactcgctccgtaactgtggataataacaatatgttccgattcagattataaacggttttgcttagaaaagcaacagtatataattaaaaacagtaaccacttcagacaaattaaatacaactactattccttatttatattcgccatcttactaacgccgatatacatttttatgaatttccaataactgctttaacacatcctctatcatctcattattttcggtataaaaaatgttctctttctcgttcaaagtattttccatgatctcgatattgctatctttatcaaagcaaccttttatacttctaaaatgattaaattcaatagcaaaatcctctccatcataaatagaaatactaatctctatatcttcaatcataaaatcggcataactgttttttacatgaaagtccttctttaagaacgggagtttttggtttggcagtcgataccgaacattgtctttttctaattcgtaaagttctccttttacgaatcctaatttctctgcattcatttcaaatgcttgattcatatttctttctgtaattttccagttaataaatacaattgcaaatataagcaaaccagccaacagacacatgcccactaatcgaattgcctttttatatttattgtaaaaatctattttctcaacaaactctttatcctcgtttaatagcttatccaaagaaacatgataggtgttacagatatcaatcaacatttgaagatctggcagacttcttccattttcccaactggaaactgtctgtcttgaaacaccaaattttgctccatattctccttgagtcatgtttgcttcagtccgagttttttttatcatctctgcaactgtcatttcagctcacctttccattgtataataatgcgctgtctcaagtatgccataatcgtgtattttacacaagatattatcgttttacatgcatgtaaagtaaccttatccttctaaaatccaactgtaaaaggctatttgctttatttttttcttccaacaacctatactttcattaacaacagcaattgccgtacagatttagaaaggatgaattttatgaatgatattattagaacccaaaacctttgtaaacattacaaagaaacaatcgctttagataatgtttcccttcatattcctcgaggtgctatctatggattgattggaaataatggtgcaggcaagacaactttaatgagaatactttctaatttgcaaagtccatcctcaggaacagttgttaaatctgaaaatattaaaatcggtgccattattgaaacacctgcattatatcctaccttaagtgcaaaaggaaatttgaagtatcagcttaaaatttgtggatgtccatcaaaggaagtaaagtcgaagattgctgaactattagaactggtacatctgaaagatactcgaaaactggtaatgaattattcattaggtatgcgtcagcgtctggctttagcaatggcacttgtaggaaatccgcaattcctcattttagacgagcctcttaacggacttgatcctgaaggcataaaagatgtcagagctatcatcgcaaagttaaatgaagagtatggtgttaccattatgatttcaagtcatatcttaagcgaacttcaaaaagtggcaaaccactatggtttcctcaaaaatggtgttttaattcaagaattctcttcatcagaaatagccgataccgatttagaaactttttacttcaaaaattttttatagaaaagcagaaaggagacttaaactatgaataaacttttatctatggaactaaagcgtgctgcaaaatctccaattctatggcttggagtaatcgcagtaattgccatcaatgtttatggaatcttattaaatggatatggtttcaaaatctttacaacaacatttttattggaaaattctgacctgatatgtatcattttggcagtgttgattccgttatacttagggagtgactttgaaaacagaacaatcaacaacaagatatccgcaggatatacacgaaaagagatttatattgtcgaactaatcgtcagtagcatatgtgctacagttctctttgttgctgatatattatctgttttcacaagctcaaatattgctggattagaatttagtgataaagtcaatgtaactgaatttgcatttcatgctgcgattgcttttgtgtgcatcatcacagtatctgctttgtacactatgattgtaatgatttcacataagcaacttatcagtcttggaattgcagttattctaaccttagcattgttgacattaggtggaaagtcagtttccagcttaaatcaatcaagcacttggactgatcctatcactcatgaaattgtggaaaaccctctacgaatagatagttttgcccgtacagcaaataacattcatgttttagtatcaccgtttgcgcaggctgaatttcacagttatctgctatttgaatcagaattcggcacaaaggaagaaacttctcttattttcaaagactttccttaccacatagaattttgcctgttcaatattctggaaattcttctgttttacaagattgggattcgtatttttagaaagcaggacttgaaatagtaactttaatagtctttgtcccctgcattataaatatgcttaatacagattttattaagaaggtaaaaacggtcgcaatatacgcctgcttttaccttctgatattaaattcatgaatttatgatttataattatatacatcagccgcctacattgtaaagcaaaaagcaagccattttagacttgctttccgccactcttattccttattgataaatgatttctttatctacaatctccctcgcacacgcctgtatattattcatcctgcctacccactcccacgcattgtctgcctttaaccgttctgtaattccttgtgcctgtttcatctgctctacaattctttcaaagcgttcctgtgcctgttcctctatatctaccagataactgttcagtctgccgctcatcatcagatccagatatacattcctgcggtattctttcaaatactgcaaatgtctttgtccccatactccaacaaatctcggttcttcttcctccggcaaagtaaggttggggataaagtaatccccacatcttacataagtgccgcccatttcttcaaaaattgttttcttcattttctgttccacctttctcatcgtcctctgtccattgatttcttctttgctgtctgttttggctgttgcctgctttcctgctgatagcggtgcaatttttcccgtatgcttgcctttttcgacggttctgatagcttctcttttttcggttctgtctgatttttccatgctcgcagctcctcattatattccctgaccagtttttccgatttctgatatgtctttgcaaaggactgaacatctggatatcctgcctgttttacagtctgctccatatccgtgtggatacgtttttcctgtttctctgactgttcaattttgccctctaaagatttccgtgctttccctttaaaaaatccagttgtctcggaaagctgtttcttcaatgaggaaatctcctgctgtgtggatttcattgcctgtgactgcttctgaagtttctccatcagcttccgcatatcattccattcctgtaaatcaatcttcggtactggcttcggcggcagcttaaacttgaaaatcatttcctgtaagaagtcttttgcaccacggataatctgctgaaacatatctggcaaccaaccatgtgtccgtatagattgcaatgttttgtctgtgattttctcacgcttaattgtcaaaatatcttcttcgggaacaccctcaaccaatgctacatctaccgtccgattccattcctgccttgccacattgtccgcccgtatctctgcttctttcgggttgttcttcccaattttctttgttgccagatacacgccgccctgctgaaatacagacagtttttcggattcttctttcacatggctgttaatgatttccgtaaacatctccttaacttctctggtaaacgcatcgctcttaaaccactcatctttctttgtaaaaatatggctttcataaacctcccctttgggaataatgctgcatcctgcccgaagatttccctgctcatctaaaatctctttcttcgtgcgtctgtgcttgccctgctcatcataaaacatatttctggtagcaattttcacttcgggatgttctaacattttccgttcgctgaatacgagatgaatatggtaattggtcatttttttgttatgatgaagtgctgcactgcattccacaccataccctttatgaaagctgtctgtaaaaagccttaccacatcatctgccttgtactcaacaaaactttcaggaagtgcaataataaactcccgcccttcaatacatttccctgttgttccgcttgctttaaaatccaactgattctctctggcaagattcttccagaactctggtgttgctccctctgtctgataggtcgcataaagatgttcctgtcttttcggattggaaatataatcaattcttcctgccacatcagacagcttgttttgtctgataaatgaatgtctgcctataagcattctcctttccggctctcgcctgctttgctgtgagtaggtgcataggcacctgtttacgaactaactgccgtttccggcacaaatagctcccggcagggcgaaataccctgagtacaaatctctgatttgtgcgatgggtgtatttcgctctcaaacgccgagggctttataaggtgctatcttcctctgtcatgttccggcttggactttttattttgggcgtatccgccctttttatttgcccgtatccgggcttattttttatctctgacaccaaaccgattctttacttttctgtctgatttattccggtatccttgcccgtacatactccagatcaccgcaatagggcgttcccaccagataccattccctcgccagattcatttccatcctggtctttacccactgatcatctaccagaacttccatacactctccgcagtgaaatcccgtatcaatccataagtccattgacagcaatccatatcttccattttcacagttataacctaatcttccttctctcattgcatgattctcctttccagatttctccttgtctatgcttaacaggggcgtgccacgctcctgttcttatcaccaaggaagaattaccatcggaaactctccggcactccacgtctgtccagatactcttttctcgcccgttcccgttcttcctctgtcggagcagttttaaattttccatacaggtcacgcatgaccattctgtccagttttttctccaatccctgcttgatttctttctcacagctcccatcttcaaccaagtgaaagcggagcaactgcataaataattcctgtgatatttgcacatttcccatcttatccatcctttccgtgacggtatgtgacagtcgtgacggttattttgataccgccccgctgtcaaaaataccgtcacaaccgtcacgtactgtcacgcattctctgtattgtctttccagagccttagtttccgtccctcatggacacgctcactccgaaagagaatcccatgctctgcatacaaccttcctgcaagaacattcagctttcttgtaataacatgaggttgaatgtccacatttatcagtgcaacaagtgccgttggagaaccctcccaataaggattgtctttcataacaagctccgcaatctcatccagtaacggctctggcggttctttccataattccgtttctgccttttgcaaatcccacaacaatgtttctgtattgcggataagatacagcttctggtcttgctgatctctgcccgatacttccagtgttgcggcattgcctgtccgtttttctttctgaagaagaaacgctccgtctgccgccccaagcagtccgcttgtcccggaaatcatgtcaaacttatcatccgcattctgctttctcgtgtggtgtacgagcagtaagcaaagtccgtgagcatccgcaaaacttttcagtcttgccataatctgataatcatttgcataactgtaattatcgccgccaacctcacgcactttctgaagcgtatcaatgataatcagcttcgtgtccttatgctctgccacaaatcttgcaagctgttcatccagtccatttccaagctggctggcagaaacagagaagtaaagattatcggtactttctgtcccgaacatccggtacagacgctcctgcaagcggcggtaatcgtcctcaagtgccagatacagcaccgttccttttcgggtggtataattccaaagcggtgtacctgtgctgacatggtaggcaagctgtgccatcagaaagctcttccccagtttgggcgaacctgcaaagatataagtgccggggtagagcagaccgtcaatcaacggctgcttactccgatactgtgtgtcaaacagttcattcatggagattgtctggagataggacgggtctgatcgcaactgcatttctctctgcaattcctcaaaactcttgatatttccaccattctcggatatactacttgtagtgtttttacgaattggctgctccgtatctgcgccaacagatacatccggggcagtcttttcttttttattttccatcctcgtcctctcctttcagaccgcccataataacagcgatcagttcaatgacattcagcagttcttcatccacaccgtttcctgcttcaatccgttttaattctgtgagcacagtggcaagttccgttttaagtgccttgaatattctgggattgccctgtaccactacatcctgattcagacagcggcggtaacagtattcctgctttggcagtcccgataaggcaactgccttgttaatgagttcattttcttcgggcgatacccgaaaccctactgtgatgtttctccaacggtttttgttatctctgttcttagctgacattttcaatctctcctttccctaaatcgtctaatctatctgccatttccgtttgctttgacgggaacagatgagcgtactggtaagtgatgtcaatgctttcatgccctacacggtctgcaatcgccaccgctgaaaatcccatatcaatcaacaggctgatgtggctgtgccgtaaatcatggatacggattcgttttacgcctgcggctttcgcacctctgtccatctcgtgatgaagataactttttgtgactgtaaagattcggtctttcttcttcaatccgtaaagcatctgcaaatattcctgcatttcttcacataggaacttcggcattttgatgatgcggttacttttctttgttttcggtgtggtaatcacatcttcgccgtgtaatcgctgataggacttattgattctgaccgtttctttctcaaaatcgaaatcagcggcggtcagtgccagcagttctccttcacggatgccgcaccagtagagcatttcaaaagcgtaaaaggaaacaggcttgtccatcatctcaaatgagaatttcttgtattcttctttcgtccagaacagcatttccttgtgttcctcacttcccatatttcccgctttagcggctggattggaacgcagctcataataccgcaccgcatgattgaagatagcggacaactgattgtgcagcgttttcagataggtctgtgagtatggctttttcttttcgtcccgataggcaagcatctcattctgccatgcgataacctcttttgtagaaatctcgctgattttcaacttgccgaaataaggtaaaatctttgtgcggatgatatgctcctttgtcagccatgtattctccttcagacggcttttcatatcccggatatacagttcggtaaaagcttcaaaactcatatccatatcagaggagttctgcaactgaaacattcgctcccattcctgtgcttctttcttggtagaaaatccacgcttgcatttctgcttacgctcgcctttccagttgacatatctcgccatcacataccatgttccattgctctcgtttttgaataccggcattattcatcctcctttcctgctccgtagagcctttcatagaaatactggcggtttacccgtcctgaaatagtaataaagcctttttctttcagttcctcattcaactgacggattagcttgtaagcatacggctttgatacgcttagttcctgtgccacttcttcggcacaaataaatctgtttttcatataatcagtcctttctttcgtttttgattgccgttctatccgaatgaagttccagcaggtattccctgttcggcactgtgctgtcccgatataccgtaatagatcaggcgctcgcttgccgtctggcaaggtcttggcggtttatactgttcggacggtcattttgtttttattaaacttatttgcttaatttgaacttattatactaagcatatttgcttgtgtcaagtggcttttctgaaaatattaaacttttttgttttgtattatcttgacttctcctaaacatatctgctatactcattgtaaaatacatacaaggagtggacacgttatggcgattggagagagaatccattttttccgcattctgcgtgggatgacacaaaaatatcttggtacgattgtcggctttcctgagcgaagtgccgatgtacgtttagcacaatatgaaacaggaacaagaaaaccgaaagcggaacttactgctgcactggcacaggctctggatgtttcccctcatgcccttgatgtgccggacattgacagctatatcggactgatgcacactttgtttacccttgaagatttgtacggtctgactgtcagtgaatcagaagacggagaaatctgtctgaaagtcgatacttccaaaggcaaagacgctcacgaactccggaaattgctgtatgcctggaaagaacaggctgacaagctatcttctgaagaaatcagtaaagacaaatacgatgagtggcgttaccactacccggagtttgataccactcaaacatgggcaaaagtcccatcacaggcacttagcgacactctggtcgaaatgttccaagacaaactcaaaccagataaataaatacgacaaaaaagcccttagccatgagtttttacccacagctaagggctttctaaataatatggatttattagttgcacaaccacctgtcaatcattctctaaccttaaaaccaccggattataagaataatggctctcatgcaactgttatcaatttgttatcaaaagacttttaaaagtgctgcaaacccgcataaacgccggttttactaagcatttttgtttattcaaactcaatcgttcccggtggcttactggtcagatcatagaatactctattcaccccgcgcacctcattgataatccggctcattaccgtctgcagcacctcgaacgggatctccgccgcctccgcggtcatgaaatccaccgtattcacggcgcgcagtgcaactgcataatcataggttctctcatcccccatgactccgacgcttctcatattggtgagcgccgcaaaatactgaccgatcgaacggtccagtccggctttcgcaatctcctcgcggtagatggcatcagcgtcctgcacaatgcggactttgtctgccgtcacctcgccgatgatgcggatgccgagtcccggtcccgggaacggctggcggaataccagattctccggaatgccaagctcaagacccgccttgcgcacctcatccttgaacagattgcgcagcggctcgatgatctccttgaaatcaacatagtccggcagacctccgacattgtgatgcgacttgatgactgcggattccccgccaagtccactctccacgacgtccggatagatggttccctgcgccaggaaatccaccgcaccgatcttcttcgcctcttcctcaaagacacggatgaactcctcgccgatgatcttgcgcttctgctccggctccgtcacgcctgccagcttcgcatagtagcgctcctgtgcgttgacgcggataaaattcaggtcgaactgaccgtccgggccaaatacgctctccacctcatcgccctcattcttgcgcagaagaccatgatccacgaacacgcaggtgagctgcttgccgatcgctctggataaaagtcctgctgcgactgaggaatccacaccgccggacagtgcaaggagcaccttgccgtcgccgaccttctcgcggatcgcctcgatcgtgtgctccacaaaatgatccatgcgccaggttccggcacaaccgcagacaccgcgcacgaaattgtgcagcatcttagtgccctcctgggtgtgaagcacttccggatggaactggattgcaaaaagcttcttctcgcggttctccgctgccgccaccggacagtctgccgtgtgcgccgcaatggaaaatcccggagcaacttttgaaatataatcaaaatggctcatccagcagatcgtcttctccgacacatcgccgaaaagcggcgatgtcgtatcgacaaacacctctgtcttgccatactcacgcaccggtgccttttcaacctttccgcccagcacatgcatcataagctgcgcaccgtagcagagtcccaaaaccggaattccaagttcaaacagttccttcgtgtacgtcggagaatccggctcgtagcagctgttcggaccgccggttaaaatgatacccttcggattcatcgccttgatctgctcgatgtctgtacggtaggaatagatctcacagtaaacattgcactctctgacacgtctggcaaccagctggttgtactgaccgccaaagtcgatgacaatgaccttttcctgtgaaaaattgttgttcatttccacactcttttcctcctgatgtttttccgccgcaaaaggcggtttgctcaattgctactattataagatacgctcccgcaatttacaaggcgcatttctatattttccaccatttcacaattcaataattttcaatgttccggttatactatctccatgaaaaaacatgaccgccttccggatttttccaaactctgcgcaccggagcagactcctatatcatttttcctctcccagcagatttatttcttctttctcggctcgatcggcggatttctatgggaggttgccatctttctatatcgggacaagacctttgccaaccgcggcttcctctacggtccgtggcttccggtctacggcatcggcgcagtgcttttctatctgctgctgggctgccggcgaaaaaaaatccacccgaccggcgtctttttcctcagtgccgccatcggcaccggtctggaactcctgatcggatggtttctggatgccttctggaatctgcgctactgggattacagcggctatcctttacattttcatggctatatctgtctgtacgcggcggtcggtttcggcatcgcgggcgtgctctggatctgtgtgctggaggcgccgctcaccagactctggaaacgtctctcccccaaagtgcgccttggattaaacaccctgcttctgctgctctttgccgcggactgcgctgctgcgctcattttcccaaaccgcggagcaggcattaccttcccttaagatagcgctccatctccgcccgaagttctgcgaactgcgcgtttgtcacagcgttgcggctctcaaaatgcagcagtttttccagataaccctgctcttttacaatccgcacactctccggaaataccagttcaaacaccagcgagatatgtcctaccacatgatccaccggcgtgcgcttgatactgcgcagcgtcgcatgatgttcataaaagctatccatcactgccggtgtgacggctgcgttgcgcagttcctccgtcgtggtattgtaaatctcctccagcggcacatccacattgacccgcagaatatcgatcttgtcggcgtcccgcaggatatggcacagcttttccgtgcgcggcgcaagcccctccggaatccggtaggcactgtgcactcttatggcagtctcaatcacctcatcctccgccgcatcgtccacatacgtgcggatcagaccttccccttcccggagcactccgccaaacaaaatgtctgctccgagcgctgcatgatcgatggaatccgcatcgctgaatgtcccgtatctccggagttgttcaaatcttcccacatcgtgcagcattccaaggagccatgccagatcaacctctgtcttctccatctgctctgccttcgcgatccgctcgcacagttccgccacccgataagtgtggtcaattttcagttttattttctcatcggtcgcatcataggcatccgtatactcccggaatgtttctctgacccgttcacgctcgattttcatctgcggtatctccttctgactttcttatacttttcccctgtccggttggaagccttttcatccggcttaggtgcggttcgcctttttcgcagtcttctcctcgtacatgatggcatctgcctcgcgcacatagtcgtccagatcgcgcccggttgtcatatccgtgtggacacatcccgcactgacggtcagcggaaacggcagtttcatctccgctgaccgctcccgaatctccttccggatctctgcgatgatcttcccgatctcagcatccgcggtctgctccagcacaacgagaaactcatccccgccgctccggaccgcgaccgctccttccggaatatattttaaaatcgccgacgcaatcgtcttgatcgcccagtccccatagatatgcccgaattcatcgttgatgcttttgagcctgtccatatccatgaaaataatcgaaaggttctcccccgtctgcttctttttctcaaacatacggcacgccaacttctggtaaccgagccgattgtacattcccgtcatggcatccttcacgtacagttctgacagcacctgattcagataggcaaggcgctccttcttatgcagattctccatcgcagacgtcagtacgttgataacctggaacagatactgcttctccatcagatacacagcattccggatgacaaaatatcccaccgtgtgttcccggaaatgaagcggcagaaacagaaaatcttttccgccctccgcgtaatcgaaggtcgggaaaatcccctccacgaccgtctcctcactctcttttaccacgccatcctcataggcgaactccatctgcattttctccggataaccgtgcacgcagaactcttcatcctcaatcagatgcctgtcataataatcactcagtttccggaaatcattcatgtgctcatccatgatcagatacatcgcgtcacaccgcatagccggaatacatttcggaatccagcgcgacatctcacgcaccgtctcgcactgcagcaattcatactccagagaaagcacctgctcctcaaattcgtccgtctcgattccatagacaatctgcgccctggaatgttctgcctgatccaccgcatgaccggcgtcgcagccgcagctttcccagaaaatgcactggtgccccgtataattaaaccgcggtaccgtctcgcccctccacagccgcagaagaatatccgcacagtgatatcccacctgctcgcggatatgtccgaccgttgtgatgtgcggggaataatagctcgccttgtcaaaattatcgaatccggtcaccagaaaatcgtcgggcgccttatagccgtgggctgccgctgtctcacacacgccgacggcaatgttatcgttggcacagataatggcatccggaagtttcccgtgcagcgtgagcaatttttcaaatccatgcactccacacttgtattcataactctcgcagtagagatccctggcatcccacaaaatcccgtgtgtctctgaaaaatcgcgcaacgcagccacacgccggttgctctcgtaattatcgtccggtcccatgacataccagaagcgcctgcagccgtgcacctcatagagatgcgccgctatttcctgcatggcggaatagttgtcaataccgacatagtaaaaatccgcaatctcatttgcaatggaaatcaccggcttcccggtggcctttgccgaggagatcacatactcccgcaccttggaatagcggatattgttcagatctacaataatgccgtcgaaatcgtttaagtccggcagccgatagatgttgtactctccgatattgtaatcctcatccctgctccaatctccggaactgttgaaaatatacagattcacgtcctcattcgtctctctgatacgctccaacactccggcgggccatgcatatgtgaagaatcgcttccatccgtccatgatcaacgctatcttcttcatctgcgcttatcctccatctatcctgccgttatcttctcctattatataaaaacgttttcatgccgtcaaatgcttctgcgttttcacacatgctgatgcagatacttctcctttgtcgccatcccgccgcggatgtgccgctcggacttgttgatgtccagcaccttgcgcgtctccgccgcgagcgacgggttgacctgcgcaaggcgctcggtgacatccttatgtatggtcgtgacgatttagagctgttttgtcttctgtttcctctgctctgtcgttaccttcaattaagacagtttcatccaatcccagctcaccaataagacgcagataaatatctacattgccatccttgtccacttcaattttattgatcagacgttttaactgtgcattcgtcaaaagcttcctcctcaataatacgaagttacggtcaaatcgtatcaaacctctctgattcatcatcttctttgctctgatcagtaatgatctgcaatgcatttctgttttccctgtaattgtatgactaatttcatcaggtctcatgacttccttcagcttgtaataaacataactctagttgttccccataaatgtatcaaaataacttttatcaatgccaatattatttactactgcattaattcttgttgctaaattaggaacgtctttttcgagagttgacttccacaaatttgacttgtatgagaataccctaatagtattatcaatatcaaatatctgtcctgtttcttctgtcttaattaaaatgacaggctttttaagtgctatagcaatccccaattcaaataatacattagggttatgctccgtcaaatcagccataataatttccgcattattaattgccttaacaatcgtcgaatgaataatatcactgccatttctatccgcagtttctgcaaaatatcctgccgctttagctgccggcttaattaattctgctaatacttcattaaaaaatcctttagaatacttacccgttttttcactaaatggcattataacaaaaattttcttttcgctagattgatgcatcgtactgcttataatctggctccctgtagaaacacttgaaaaaatattttctgtttgtttttcaccaaatgtctgaaggaaatgacggttttcacgatacacattcaaaaaatcatcatgtaaactttcatcaattccaaaagttgatactaaagcatttctaaaaaaagtctcatcagagggttcgttccctttataatattcatacactttcttaaaaatctcaatattgttgaatgcagaccaaacagcctccaacaaatcctcttgggattgagcatatacgtattttctaccaagatcatttaattccacattgactgtttctcttgttccattcgtgaacccataatctctagatgacgccgttaaataataaaaattattaccaccttttttcatattcaatgctcttgcgagttgctccgttgcccatggatttccaccattattttccttaatcaaggttggtatctttaacgcctcttcaattgaatgacttggaaattttttaataggttttactgttctcttccttgttttggtcacttcatctgcaccttctgttttttcaataatatctgtcgtgctcataccttttatcctttctttgatatttaatcattaaaatatttttgcacttcttccggcaaatactttgccagtttctccaccaactcatacacctttgttcccggcgcaatctccgttggtgtttttcctgctccatccttaatactcctctttgcataccgaatcgccagcttaggattcccatatttcatcaaaatcgtaaaaatgtcattcatgttcttttgatattttccgattcccagttctttaaacttatcattcaagaatgaaatatactcggtccggtggttattagctgtataatacgcaaaatgaagaagaaaccagaactcaatacattcattactccacgccgcatgatactgtaattctggcttaatcttattcaaactattggctcgttcctcaacaccgttgaaatgttctgctggaaagctatccttatcatacacgcaccagacttgtcccttctgaatttcattcttcttaacatagtcctcggctattccaattactcgcatggtttctgcctgacatggttcaatttcaatcaataccatatccttgtaaatcggattttcctctatcagcttcttaaaccccaaaaaataatttggttccgtctgctgtccttcgcaaaagatatagtacctatactgtttcatctccaaatattcctggcgacgcttcttcttccaagcgagcctgctcgattttttctgcattccggcttttttaggcattcactttcccccaatctataattcttttgaggtacggatcagcgccgtacttaccttccagatattgcttgtcgaacttggcatcctttctgacagattcccctttttcattcttgaactctaccaaagaataaagtttagaattctgtgcatttccttttgccacaaaccagatttcatctctgcggaatacttcgctattcatcgttgacagatcgtgggatgtgaaaatcaactgtgctttatgtctattgatactcatatcattgaacatcataataatatggcgaagtaaaaccggatggatttttgcgtccaactcatcaatcacaagcactgtcccagaaatcagactttctgcaataaacggaagtaatccaaataatttccgtgttccactggattcatcaaacaaattaatttctgtttccacatcatctacgcaatgcttcgtgaatatattaattctttcattctctttttcttccactctgaaatcaacaatgtctaagtccatctcctgaatcatctgaagcattaactttttcacgtcttccgatgtagacacagccattttaagttcctgtattgggtttccataattcaaaaattcgattccatattcaaaccagctcaatacatccttaaccaccgcatttcccttataagcaattcctaaataagaaagtagcgtaagtgttttagataattcatcgctgactttcagttttgcaaaagcccccttcaaaacaattccgttttcatccctggtaaaaagggcagattttctgcctgtttcaagtttgactctatccaagctctcatataaaacgatatcacgctttacgtgcaaaatgtatctgtactctgaaactgtagttcgaaagaacaattcaaattctgtaggctcgtccttactctttgaaaaagcaaatggttctacaattattttcctttgaagcaaaaccttttcctcactatcctctgtggccaaaagaggacgtaacacttttgccaccaaggtatgcaatgcagccaaaacattagattttcctccgccattcgggccataaacagctgacaccggtaaatatttttcctcatctttatctataatgattctatcctcatgctccgatattgcagccgcctgcatatcaaatgtcacttcatctcttatacttttaaaattttttactgtaaactggcataacatgtcttttaccctccgttatgtctttattatatccctataattcatatttgcaacaataatttgagatattttctcatatttatttctatattttttacttttgtattcgataactatacaaagatcagtaaatcgcatacccaaagcaattatttccaacttcctccttaccaagcatacaatataacagagcataaataaggacaattttttaagtttctgatttgtctaaaaaattgtccttatttgcaagtttttcacacatgctgatgcagatacttctcctttgtcgccatcccgccgcggatgtgccgctcggacttgttgatgtccagcaccttgcgcgtctccgccgcgagcgacgggttgacctgcgcaaggcgctcggtgacgtccttatgtaccgtactcttgctgatcccgaaatgttttgccgcctgccgcacggtcgtgttattgtcaatgatatatctggcaatctccatagctctttcctcaatataacctttcaaaccaaaacccctgcaatacttgtttttacattgtatgcaagggtgttttgcattatgcaggagcgttccttttgacacataatgctttgcaaatatttcttgttacatttttctgaggatttcgctatttattccacttcatattccatccatcttcgtgtttctttaaagccagttgcctgataaaattcaattgctgaatcatcaaattcccagacatctaactctatcttttttagctttctcttcctggtatctgctatcataaaatccaataattctttcgccacgccttgccgtctgtaattttcatctacggcaatttcctgcacatgataaaagcttcttgcctttccgtatgcagtctctggtctatgcacataatccacgcacgccattccgcatatttcaccgttacgttctgcgacaattatatcactattttctccgttcatgagcgtgtatgcataatcccttaattctactccaaaccccgctttaaatatatccgggcgcccttctacatgtatatcgtttacttgttttctcagttcattaattctacctaaatctttttctttggccaaacgaaccatacccatttccacctttcttaacatcatatctttctaatgaataacgcgcttcattgctgctcatttcatactttcataaaatctcctttctgccattattgcaaaaaaatacaccaaacattgatatgtctggtgcaaaaattctaatacggtattctgtaagattatataaagcaaacgcttactttatccgaactttctgcacagacatatcagacctgcccgctgtaaccgtgcatccttcccggattctttacagttacaaacgtgcacgtccgtaatacatgtacatataattcattgtaaaatataagttttgcattatatggctctccttagtttcttgaattataattctgttcaattaacttgtcaactaccccaaaatccttttcccatatatacagtttttccagctatttcacgcttgcaaaatacttcatcagaatatccttcatgaattgatatcttcttgcgtaagtgttttcaatacggatcagttcaaaaccatgctctctgcagatttgatttttcttcctgtcgcgttccatcaccacacttttctcctgatgctctcttccatccaattctatcgcaagaatcggaatatctatttttgtccttggctgtctctcatatacgacaaaatcaaacctgcctgtatagaacaaatcgttatactcgcaattatcctgaaaaacatgtgcgatactcacttctttctgaaccgtgcatttatgatcggtattcaaaacattatccaatgcatgattcagattctccagaaaagcctgttccgtttccgtgctataaggtttaattccgagtgcccgtgacgcatttgttttaggagtaacattggtttgcccattatgttttacatactgcaccagttcgtaaagatcatcatcaccctccctgtcatgtaagcgttccagttccttactgctggacaaaacaatcaactgatccttagctcttgaaacagcgacattgattagctccttgttatttttcagccagctataggttccccggccagtcttatccgtaagcgcaagtgaaaataaaacaacatccttttcatcaccctgaaatgcatgaacggttccacaggtaacattgtccagaccattatcttttagcttctgattgattagttccttctgatttgtaaacggtgtaatcaccccgatgctcttatctttatgcagctcagcataccggacaatctcatctgcttccaaaggtgctgtatttttatagtaggtgctgtttcctgttatatcccgaaaaaccaacgaattctctgcgctactctgactgcagatctgcagttttccattgtaatatttcttgttattaaattgaatgatttgcctattgcatctgtaatgatggcttaagagaatctccctgctgacagaatcgcatgccagaaacgctttgtaaatagaattcttaatataatcgtactcatccgtgatctgatacattttgcgaagtttctgattcaccaccggattcaataaaataaccggatttagctgctgtggatctcccacaagcatcaggctctctcctcgaaggatcggaaccagtgacgtcgcaatattaccctgactcgcctcatccataaccaccatatcaaaatgtactcccggttttccaaccttatgggcggagatcgatgtggtagcaataatcggaaagattctctgaaatttctttaaattttcatcgttgcgtaaataatcattaaatgcttttaccttctcttctttgtcttccattgtaacaatgtccaaaaggtccgcattctttggttcctgtatacgtttgatacattttgcggaagtataatacaggtaacttttaaaagcatcctcatcctctaaaatcagatttaatgcttcttcatccgtataatcttttgatttactgattttatcctcaacctgggccaactgaattccctgcaactgtgtctgaaaagtcaaatgtttatttgactccatcagactgagaatcgcttcttttgtttcaaaaagcttcaaccgttcttcatattcctgcagcagagccgtcagctgtcttgttcttgcgattctgtctgacttcctttttttcaacgtttcttcataaatattgatactctttgtactctcatacaatctctgaatatactccaacgcctcagctactttgtcgtcgtttcccagccggataataggaaacggaatattccccttctttccatttgatatgtgctgcagtttttcacacacaccatcaatcgggtgattattgtacgaaacaaaaagcactgtctgttcattgaaaaaagctgtgacaagcgtatttacgatcgtgtttgtcttccctgttccaggtggtccctggatatatgccaaaggatatttcatggcattgtggattgccagcagctgatccagattaatctgcttatttaacaaagcaattggaaatactttcctacttgccggttcctgtaccagattcccaaagaacgcccgaattggcgccgtcacctcttcttgctggaacatttcatcaatggccttatattcctcgtgaagatctaacataatgtctcttccgatcgcaatcagatatggcatatcatccacacctttgatttgtggattacattccgtgattcggttcttaatcgtttcctgattcttttcaaaatcatttaacagttcgtaatcgtccgcatccagaaatctgcgtatgctctggcttgttccatcaatggtaaactcggtgcaaatcgtaacctcgtcagcaggtctaagacatcttcgggcaacgtccagcttcatctcacgataagcaaggacatataatccctgcttcatcggcacacttaatatatttaatgccaactgcctgatccttttattcttcgtattactggtgcatccatattgaaaatttgaaactatctcctgaaactgatccggtgccaaatgataatcccctctacggatacaatcaccatcaaaatggcggattaaactatattccgttttatatggtacagagtccattttattgcaatcaatgtaataactaagaatttttaaattggacacattatgaaataaagaaatatatttctgctgatttagctgaatatcttcttttaatgattctttgacatcaaaataagacccttctataacattggaggataaaatagaatctatataaatattcagacctatggttgataattgtcccagatgaagtccttccacacaaagtgatcttttcatcggatttacatccataatcccaatccagtatttcgtaataccctcctgtttatttttatattcaatactcaaccacttattttcatgaatcgctctaaaaatatcacggcataccgtattcattttctcctccaaaatgcatgaatatttttctttatcataacaaaaaaattggcaatatccaatataatttgaatattgccaaccaattttatacatttatagtttttcttaatcccctgcaatacttatttttacattgtatgcaggcttattttcgtatatactatctttatcagatgtaaaggaggatattgccgtgccatttatcaatacgaaaaccaccgtttccctgagcaaatccaaaaaggattccctgaccgcagagatctgccgcattaccagggagtgtctcggcaagggagagaactgggttatgactggttttgaggacaatgccagcctgttctttcagggggattctgccgctgtcgcttatgtggaggtcaaaagcttcggcacgccgtccgctgcaggcaccagccagatgaccggaaagctctgccatctgctctccggcgaactttccattcctgccgaccacatctacgtggcatacttcccgactgacaactggggctggaacggaagcaacttctgactacagcagaaaaaatgcgggaattcccgcattttttcattttctctcttccgccttgatcgctctctttttctcgtacatcttcacatccgcacggttccttgtctcttccatatttttatcatactgctcgtcaaagatcgcgtagccgtatgctatccgcatcgggacgtccgttttcccttcattatatttccgctcgagatattccagtctgcgcagacattcctcgacccactcacttctggcatggcggatcacggcgcagaattcatccccgccgatccggtagcacaccccggcaggttcaaacacttccgagatcagctttgccgcatcctgaatatacttatcgcccgccgcatgtccgaacgtgtcattgcagtacttcagatcattcagatcgaacgtcacgatcgccgtctctcggtctctggcattttccgacgcccactcatcataagcgttgcggttgtacagtccggtcggcatatcatgctccgccagttcccggtagatctccgccttgcgtccctcatcaatcttctccatcgacaccgcagtcgcctctctcgccagcaggcagataaacaacaggaatccaaatctgccgatcacatccgttcttctccatccgatgtagtacgccgacatgtcgaccgcgtaagacactagcagaattacaagtccccagatacagacacgcacccgccggtccattccgcgcgcccggtaacgctgcaagatcacatagagcagatagagcaggtcacatgccatcagaaaatgcgtgcaaaataccgtatttttaaactcgcagatccccgtcatgtggagtacggtacacactacaacattcgcaaatgaacagatgcagataatatttgatatatacttctcctccacctcggagaactcctgcaaaaatgctgcaaacggcgcaatcatcagcataatcagcatataaccggcgtacgaggccgccgtccggctttttaccatgtaggcaaccagctccgcctcattcatggaccacattcccatcatcagcgtaaaaatgccaaaatacaggatgcccggtcccatctttactttgcgtcttgcaattgcataataaatgagcagcataataccgatcgctccgtcaactgtgctgaccatgatctccggaaccgatcctctcatcgtctgatagaccatctgtccgtcattctcctgatagaacctcgtcacatgatcccgcactgccgggtacaccgcctcgatccgcacactgaaactcttcacgccctcctgcagctggatcgtattccatccggttccgggcgtcctcccgaacaccgtactgctcttttccaacgaataaatctgctcgccgtccgcatacacttccacgcactgatgtacgctaaaaaatgtcagttccgaaaactccgactgcatctgattgctgtcgaaataatactccctgacatcttcacccacttccaccacgcgatcgggctgcagttcgattcgtctggaatcctccgcaaagcttgtattctttttacctgcaaacgcaaagctcaacgccatcagaatgaatccgatgacaagcagcactccataaacggtcgatactgattttttcatttgtcctcacctgtggaaaattctggcaaacagaggttttttcgtattctctgcactggttgttatctccgcagcggcaagcgtctcttttcctgcctcttcctttgtctccggcagagcctcctcgaggaagaactcgtcgaacacatcatccctcttgttgatcttctcgcacatatctttggtgacctccatcatggtctccatcatatgtcttgcattctgccccatgcggtcttcaaaagtcatcccctgatccggtgcctcctcaccccagatacagtcatcccccagcacacgcagcttattcagccggtcgcgctgctccttgcggacgacgctcaaaaaccggctcaccatcacgttgtgctcattttcgtccgtataacacaaaaactcttccagcgaagcgttctgcggataaccgatttgatagtaggtattataaatccggcagatccgctctgtcgtctggcgcagaatgatgccgcactcctgcggttttctccaataataatgctccgcacgctccagttcctgcagaacattatcatacatcgcctgaagttcatccgactccagtctgcactctcttataaactcaaaattcatctcctgctgcccctcttatgctctgttttctaccgctttcaggatctcctcactgatgttctccacatccttgccgtccgtgtccacgcagatatccgccaccgcttcgtagcgcggccggcgcttctccatcagttcccgtatatattccacattcatattcccgtttaaaatcgggcggttcgtgctgtccttgactctttcgtagatcgtctccggcgttgcccggaggaacacgatgcagccgttctccttcatcaacgccgcattctcatccctgagtacactgcctccaccgcaggaaaccacatatcctgtgctctctgagaaagaccgcaacaactctgtctccagatcgcggaaataattctctccatgtgcggcaaaaatatctgtgattgccatcccctgttgttcctcgatgagctgatccatctcgattcgcttcgacggacattttttcgcaagcgctctcgcaatggtacttttcccggcgcccataaagccgatcagatataaattcttcatgccgcagtttcacctttctagctaaaaaaacgctctttgacttcctcgaccggcatatcttttccggtatacagtttaaaggcagccacgccctgccacagcagcattcccttgccgccgatacaggttgctccggcttccttcgcctcccggagcaatctcgtctcctccgggttgtagacggcatccgccaccactaaccccggtcggaatgcagaagtgtcctttaccacactctcattttccatcggcttcatgcctacaatcgttgcatttgcaaaaatatcactggacgcgatctccgcagtcatccgcgcagtatccgcaatatcatagacatttaccacgcacgacggaaccgccgcacggatcttctccgccgttttcagcgttctctcaaaaaaagcatccttgatattaaaaatggaaatctcccttgcaccgtcaagcgcgcactgcacctgaatggcagtagcggcaccgcctccgcctgcaaccgtgatcttcttgcccttaatatcgatcccgtgatccttcagattatgcacaaatccctcgccgtcagtaatatggccggttagtctgccgttgtcatttacgatcgtgttgaccgctccgatgatctgtgccgccggagacagctcatccatgtatttgacaacctccgtcttgcacggcatggtgacattgcagccgcgcatcttaaatgtgcgcatggcggcaatggcgtctgccacttcctccaccttgatatcaaaagcaacatacacataatccagtcccagccgctcgaagctgtaattatacattgccggcgaacccgaatgtccgaccggcgaaccaatcaatgccaataatcctgtgtgtcctgaaattctgctgtccatatttcctcccgctccggcgtccgttttttctctgcgccaataacagtatcatagctgttttttcttatcatttcaatacactaaagcaaaaaagcatcccttttctactctgtaagtatcggcttaaaatcttccgtatcgccgcagaatatgccgccgcattcctgtaagatgtgccgcattacaggcagtaccttttcatattcttccgcggaaaatgttaccagatatactctgttgcagccgtgttcctctgcaaataccgcagtcacctgatcccggggatggattttcccttcctccatgtccatggaggcttctccgccgtacataatctcaagtacgcctgcttcctgccagatttccatctcacaggttccttccagcacgtctgcaatctgccgcacgcccacagtctccggtgcaagataaagccattcgcccggcacatctgccttcttcatcgaagctgcttttcccgttgctccttgtcccgctttctttcccagctttttcatcctgcctcctgcttaccagcaaagaacctcgtggccgtcctccgtcacaagcaccataatctcccactgtgcagacggaagtccgtcctccgtgtagacctcccagtcgtttgcatcatcgacatagatgtccacttttcccatgttgaccatcggctcgatcgtaaagatcatgcccggcaccatcagcatctcctgaccgcgcttgctgttatagccgacccacggctcctcatggaactccagtcccacgccgtgtccgccgatctcacgcacaaccgtataaccgtttgcgaaggcgtgatcgtgaaccgcctgccccatatcgcctaaaaatccccacggttttacctctgcgagacctttttccacacactccttcgtgacatccacgagacgtttcttctccgggctgacgtcgccgatgcagaacattctggaagaatcggaaaaataaccgttcaaaatcgtggaaacatccacattgataatatctcccgacttcaaaatgacatcctttgacgggaatccatggcacacctgatcgttcaccgaagtgcacacgctgtacgggtagccctgataatgcagcggtgccggaataccgcccatgctggtcgtcatgtcgtagacaatcttgtcgatttccgccgtattcatgccctcatgaatgtgctcctgaatataatcgagcaccgcgatattgatcttgcagctctccttaatccctgcaatctgatctgcattcttgataatgtcatgggtcgggacgatatgtccctgcgcagcgatcgctgcaatcttctcgtcaaatgcctgatggcatgccttgtatttccggccgcttttgcaccagcacggatcatttcttccaatttttactgacatattcttcttctcttctctattttattttttatattatattctgcctgccgcaaatgctttcttcacatatcagcgcatatcctgcttcacgtggtggaaactctctggctttcccgctttgctcaatgatctaccgtgatgctgccgaacggcacgcggtcccaggtagtctcgtctaactcacaggtatgctgtgccagaagtttttcgtattccgtgccgccgatggaataatcctcgtaatcgacctgttccatctccgcaagaatactctgatatttctgcgccagcgccatttttcgcatggatgcatcaatcgtttcctcatcgacacccaggcgcgctctctgttcctcggtaaggtcactccaaaaatcctgctgatcattggcaagatactgttcctcctcctctgagagcgtgattttctctgctgttgccatctgccaaaacagcgtatcatgaatggtcatatccaccaccgtctgtttggcctgctcacgcaaaaacgtgtgattggtatacagccgccagtattcgtccgtattatccggattgtagatgatggccgcatcttccatgctgccttcctcatacgcgatataaaatgccatctcccgcagagtcacctgctccccgtccactgtcaccaccacaagatccagtgattccgggaacgacagcttctgccgctttccctgttcgcggtaggatgctgtccccagaacgatgaccagaacgaccagaacagcggtaaatcttaatttctgtctcatgcctgacaaagctttgctaccacctgattgatcacgctgccctccgccttgcctttcagctccggcataacagccttcatgatctgtcctttgttgtgggtttctaccacgtccgcgaacttctccgtgatgaacgcttccacctcgtcagccgacatcattttcggcgcatattccataaaaatatcgtagcgcgtcttatattctgcaagcagatcttctctggatgccgggcaggtatcgatctgttccttcactgacttgatctcctttaaaatgacccggtccacaagttcctcccgaatgtcatcgcgacagccctcatcgattgccaccttcttcgcagccgacaccagtgtggagattgcatccttgcgcaccttgtctcttgctttcattgcagcgatcatatcatcctgtaactgtttgaactgcatgttccattcctccatctcttatttcatttctatccagattatagcattttgcttttgaaaatacaaacctacaacacacgccgtaccgaagtgatcgtacggtaggttgcatttccgtagcagatgccggttctcgggttggacgcatggataatccgtccgccgccgatatagattgccacatgtcccggatagcagataatatcgccgggctgcgcattttcatagctgactgcctgtccacagccgctctgcgaataggaagatctcggcagggaaatgccaaaatgctggtagaccgccatgacaaaataggagcaatccgttccggatgtcaggctggtacctccaaggacatagggattccccagaaactggctcgcataggacacgacgtcactgccgctgactccggtcgtgtaggacggatttagtccgccgtccgtcagacctgtggaagagctgccggaggtactgctgcccgaagtcgaggtatccgtcccggtcgaagcggtatttccggtcgtattcgaggtcgttccggtgccggctgtcgaggcatccgttccggtggtgctgccggtcgttcctgccgcagcagccgcctgcgccgcctttttcttcgccgcctccgcagccgcctgttttgccttctccgtcgcgatgatctggttctgctgcttgatcgtctgcgcatactggcttgcaagactctgtgcattggcaagctggctgtcaaaatccgccatctccgaacgctttgtcgcaatcacctgctccagagagctctgctgctcctgatagctgatctgaagctcctccatctccgccatctcactctcaagctgtgccgtcagatcttccacctgctgcaccacttcctgatagttcgtcagcatatcgcgatcatactggtagacgtccgagacatattccacccggttcaaaagatccgtaatgctgtccgcgccgactaacgccgtcaaaaaggactggtctccattctcatacatatactgaatccgctgcttcatggcgtcatactgctgctgttcctccgctttcgcattttccagatccgcgtttgcctgttcgatctcctgctcctgcgtatccatatcgctctgcaggatgtccatatcggtaagcaggctcatgagttgattgtcataattattcatctctgcctgaaggctgttctgcgccgactggatattctgaatctgctggttcacctgattcagttcctgctgtgcctcatcctttttatcctgtgcatccttgattgccgaagcagacacagacgcatagtttccgattccgactgctcccgccagaagcagtgccagaacacgtttcttaaaatgtctcatgcggtatctccatcccaaatatctgaattatctttcattgcgtacaaaaaacgggtatgactctgttatcatacccgttgattatatcatacttccttataaaattgtcacagtttccataatttttcgatttttcggaaatcagatcaatcccatccgatatacatcagttccagatcgctcagctcgccatcatagaatgttacggaaatggagttttcatccatatcctcgtaggtgtcgctgtggctgtaccactgataagactggtagtcgccggtatccgactcatactcataatccggctcgccgtaagcagtcataaagtcgtcgttgaccgcatcctttgtcagaccgttcggcagaaggatctccagatcgtcattgtagtccatgctggtgaatgagaagccgaacaccgttccgtctgcaagtgtctgcggatcgtcggttacatttccaatgtacacctctcccagctcatttccctgtgcatcgtagaatgtcggatagtaatattcattcttgttggatacatactcctcatcctcggagtcgatggaaaaaccgagtgccttgaaatcgctgtagctcatcggaagctgcaccaggataccgttgacggtaatgtctccactgtcaaacgcatcccctgctgtcacgtcaagcggagctaccgttttggcatcctctgtatcctcgctgtcatcggcaagaaaatcgtcggtgtcgtactcttcatcaccggaatcacccatgaaatcatccgtgtcgtaatcatcgcttacacctgcggcctcgttatatccttccataaacgcatcctcgatgtcgttgctgtaaagtacgctgaaaataatgctgaagaccagccataccagtgcgatcgcaaaaccgatccacaggcagattgtcgccgacttgctgttgcgcttatattcctgcacatctccggacttgtaggcactgttcgccttgctcgtgaatacgcatccgataatacccataatcatggtaatcaggttgcatccgcagcagcacagaatctcaaggatggagaatgtaatcttcattccgaacgagttcttcactggctgaccgttctcgtcgttgagcaccgtcgcctcgccatagtttacgccagcatatgcatttcccgcatactggccgttcgcctgaccatacgcctgctgaccgttcgtctgctgtccataggcattattctgtccgtaagcgttattctgtccataggcgttattctgtccataggcgttattctgtccgtaagaatactctccctggccgttcgtgctctgctctccgtaattctgctgaccgtaaggctggctcacattcccctggccgttcgcattttctgcctgaccgtagttctgaccgtaaggctggcctgcattctcctgtccataaggctgacctgcgctttcctgtccataaccgtttcccggctggccgtaagcattcgctcccggctggccgtccggctgcgtcattccgctattcgctgccacgtccggctgaccgtatgcaccctgtgctccctgctgaccgtacacatcctgcgttccctgctgattctctgcccccgcagatcccggctgtgtctgtcccgggtcgttctcaaaattgtaatttttgttctcattctgatccatcttttgtctccctgttttcaaaattcctttcaaaaaataacactcattaccactttagtataacagagcgtcttctattactcaagcaaatctgtgcaaatagtacctttatcctatctgtttgacgatcagcaccgcatctcccggctgcagatttttttccgtccagccgttggtttccagaatatcctgtatggtcgtatgattctccttggcaatcgtccacagatcatcgcccgcctttgcaatatagcccaccagaccggggcggttctgtaattcttccatatctaaaggctcttctgtaatctcttcgatgttctgtattttctgcggcaaaaacgccatcaggtttaactggatcaccgctttgatctcaatatgttcctgatccatcatcaccgcggacagctgctctaatccgcagtccatctccgcctccacgtccggctgcatatcgggaatctcaaggatctgggaaaacggatagatttcccttgccgactggatcggcatattgtcatccgttgtgatatagagaagttccgccgtgatcgttccctccgcccggattccgttctccacaggctcgtatttttccaggcgcaccgttccctcgcaggcacagatctgcaggattttctcctggctttccggaatttccagctgttccgttacccggcattttgccgcattttttacaaggagtctctcaccgatccgctccctgactaccggaacggctttttcccggagcgagtagagatcggtcagaagttccatctcttcttcccgccacacgcggacatcgaccgagacggagagttcgagcacaagaatgcgctcctccccgtcgtaatccggcttgatctccagttccgccgacagcgggacagccgatattttaaaaatgcaattctccccggcagcgtcacagtctgccgcacattccagaggaaccgtcgtctcataccactgcaggcgctcgctctcctcttcctcgctgtagagcaccgccgccagaatctcacctgtgacgaccgccttcccatcctccacatggctttcgacgttgcggagttctacactgcgccacagaatttcccgcacattgggtttgttcgacggcagaacaatctcactcttctgccggcagacatcccggcaggatgcgagcagattgagcgctccccaggttcccgtcttctgctggtaatcccccggcagttccagtctggacgtaaactcctccaacacctgttcctccgccgaggcacgcagcacaaccaccgcacggatgctcaattttctcgaattgattacgccgactgtcagatcctcgatctctccggcggcatgtacctctccgttctcctgcagcccgtctatattgagtttctcctgaaacggaatctctcctttgaggcagctgatttttccatcgctctgctcacactggtaaaggatgtgaaacaccaggcttccttttacccacaccgccttgtttgccgccttcacctcgtcaaaccgcagttcgccattttctttcaaaaccttcatgatgtccggccggtagtccgggacattatagtcatcatccagcgtgatctggctgaccgccgtgccattctgctgtattctatgtatctttactttttcgagttccaaaaaaatatcccccatatccgaatctttgaaacatcttattcgaatacggggaatattatacctgataccttatgttaacataatttcatccgaatatctcttgtaatgatatccgaataactgaatgaaagtaactgaggcggattttcttcctgctcgtcattcaccagtattgtaaaaacactcggatatgcgttctgaatgactccttcctggatgtcgaccttgttgcgtcctctgtcaagctgaatcagtaccttccgtccgcactgctgatacacggaagcgcgtaccttatggatgtctgcctgttgcattgtctacctccctgttccggcttcttatcgtcctaacaccgaataccattccgctttagtttatcactgtactaaatttttgtcaaacaaaccggagaattttttaaaaatatcaagaaaattcactcaaatatggtactttcgtcacgtttttcggtctttattacaatataaggataactcggtccgctgcttacctgttctccctttctcggtcccacaagttccgtatcgaacaaaatcgcattcgacgtcagatacagatcccggatgcagatgctgtaacctcccgtctcctgttctccatacccgcgcactatgtacagatccccgtcgagttcataggtcgttttaaaatcagccgcctttttttcctctatcacagccttcactttctccggtatctgcgcctcctccacgatctcatagtcaagatcggcaaccttcgctccgtttgtcgtctcaatgctgcacccggcagcaagcagggccgccgctgccaaaaagaccagacaccccttcttccatctcttcccataccaaaacatctgacagtcccccaaattttcggttctatccaaagtatatgccgcatcttttttaaatatgcctgcgaattctcttttccgcgtcttgtgtttcctcttttcaggctttataataaaaactatgtaaaaatctacggggcgcttgcccggaaaggaccttcttatgttacgagccatccttgctctgctgtttgccattctttatctgatcatcggaattcccgtcctcggaatcgaatggatcatcagcaagttcaaccgtaaggctgccgacatcagccagctacgcatggtacagtgggcgtttcgcgtcattctgttcatctgcggaaccaaagtcaccgttatcggtgaagaaaatgtaccaaaggacgaagccgttctgtatatcggcaatcacaaaagctacttcgacattatcatcacctatgccagatgcccaggtctgaccggctacgtcgccaagaatgacatggcaaaagttccgcttctttccctgtggatgaagcgtctctactgcctgttcatcaaccgtgatgacgtcaaggaagccttaaagaccattcttgccggcatcgatcacatcaagaacggcatctcgatgtgcatttttccggagggaacgcgcaacaagaccgacgacctgatgcttccttttaaggagggaagtttcaagatggcagaaaagaccggctgtgcgatcgtccctatggcaatcaccggttccgccgatattttagagaatcattttccgaaggtaaaagcaacgcacgtcatcttagagtacggcaagccgatctatccgaacgagctggataaagagacaaagaagaaaatcggtgcccactgccagggcgtcattgaagagatgctcgtaaagaacgaaaagctgcagtaatgtcagacatgcagcaggagacagcggttcgtcggatcgctgttgctcgttaaagggcataacgcgagcgttccagcgaaaaacaggcgggaggattctttggaacaaaatgcgagaatttcttctctgccgtttttgccagttccttccgtgtcttggccacgttttgacactccgcgaggatgtgtccgacaagccgcagacaatgagcgaactttctggtgcccctagcggcaccacttcacagacaatataaaaccgcgcgaaccgaaactcgttggcatctgctattgaaaacagggcagatgccaattcaaacatcggcttcgcgcggttatgttttgtttagcggtgccaacaaggggcactcacaaaagtccttaaattgtctgcggcttgcggacacgcctccggagtgttcaaaacttggaaagacacggatcatcacatctggcaaaagcggcggagttagaaattccgtattttgtgatcagaatcctcccgcctgttttcgctgggacaccggagttacgctctttaacgaggatcaccggtacagccaatcttcgctgtctcctgccgcaatatctgtcattgccgcagcttttcttctattccgtcgcactctccgtgacggtctcggtctccgtatcctgcactgttgtggtgaacaggttgtcaaatgttaccttcgcccacacggaatccttcacggtccagtcgtgctcatcttcccagcctttgagcgtctcgtcgtacagatcgctctggcgctggctgataatgttctgtctggtcgtctcggttgcatccgcatccgtcttctcatccagacgaactacatagtaatcggtatctgtgtcgatgacacccgacacctccccttcgtccagtccctgcagtgccgtaagaaccgcctcatcgagtgtgctgtcgtcggcagtaaacgttccgctgctcaccgtatagtcatactgctctgccgcatcctccagcgtgcccgccttggcgtccatgtcaaacataccgaccgtcttgccgagcagtgtgagctcggtgtcggtgtactccacggtattgccatcctcatccgtatgggactgcttggacaccttgacatagctgtaggagcttgtgttggcttcctcatccgtcacattggtatcggcatccgcaatgatcgccgtgtgcatccggttctggatcgtcgccagtgtcagataacgctccacagtctcttcatctgcaccaagtgcatccaatgcatccttgctgttgtctgcaataaacgcagccgctgtgtctgcgatctccgccttgtcatcctccgtcagctccacatcgtactctgccatgtgcgcttccagtgtatacatatcgaacagtgactgcatcacgctgtccttgatattgtcctgcatcgtggtgccgttgttgtacagatcggatgaccatacgtcttcgccaaaatatgccacataaaaatcatcatatgttgcctgcagaaatctcgctgcaaaatttgctactccaagcggcacttccgtctcatcaaaagttgccactgtctcatttttattcattccacatcctgttaacatggatgctgccataacaccgctaagaagcagtgcgctccatctctttgctctcataggttcctcctggtatatgccatgacagcttgccatggcagtcttgctctattatagtgcaattttctccgggtcgcaatatttttcatacttttttcaagcttttccgacgccggagagccggtctcccggattccaaaaagccggctctctatcgcctttttcagccttcccttggtgcttcccgctccgccagaaatttcccggcatcggcaaggaactgctccaccaccgatttgatgtccacattcttgtccctcgaattctttttcaggtgatatgtgaaatacgggtttttcggatcagcggtaaacgtcaccttctgaccgtatgcagccaccagttccggaatcttcgccacatcaatccgtgctttctcatagagagtaaaacggacactctcacccttctgcgccacttccgtaaaataaagccggtgcgccattgatttgatttttgcaatgtaaagcagattttccacggacttcggcggatctccgaaacggtcgatcagttcctccgtcatctcctccgtctcctcctgcgtctcaatatctgcgatgcgtttgtagatgtccagtttctgcagttcgttcggaatataacccatcgggatataagcgtcgatcacaatatcaatcgacgtgtcaaagctttcctccaccgcgatgcccttcgcttccttgaccgcttcgtttagcatcttgcagtacagatcatagccgaccgcttccatatggccgtgctgccgctcgccgagcaggctgcccgctccgcggatctcaagatcgcgcatggcaatcttaaagccgcttccaagctccgtgtactctttgattgcggcaagccgcttctctgcgacctccttcaacatcttatcccgcttatacatcaaaaaggcatacgccgtgcggttcgatctgcccacacgcccgcggagctgatacagctgggaaaggcccatattgtccgcatcgtggataatcatcgtattcacgtttgaaatatccagtcccgtctcaatgatcgtcgtggatacaagcacatcgatctcgccgttgataaaccggtacatgatattttccagttcggtttccttcatctgtccgtgcgcatatgccacgttcgcctccggcacaagctccgcaatcttcgtcgcaacatcggcgatctcgcgcactctgttgtatacaaaatacgcctgcccgccgcgcgccagttccctggagattgcctccctcaccagttcctcattgtactccatcacatatgtctggatgggcacacggtccatcggcggttcttccagcacgctcatatcccggataccgatgaggctcatgtgcagcgtccgcggaatcggcgtcgcggtcagtgtgagaacatcgatgttggtcttcagctgcttgattttctccttgtgcgccacgccgaaacgctgctcctcgtcgatgattaaaagtcccagatccttgtagaccacatctttggacagcagccggtgcgtgccgatgatgatgtccacctgcccctttttcagcttttcgatcgtctttttctgctccgcgctgcttctgaaccggcagagcagatcaatgttgactggaaaatctttcatgcgctgcacaaagttgttgtaatgctgctgggcgaggatcgtcgtcggcaccagaaatgccacctgtttgccgtcctgcaccgccttaaacgccgcacggatcgcaatttccgtctttccgtatccgacgtcgccgcagatcagacgatccataatcttcgtgctctccatgtccgccttggtcgccgcaatggcaagatcctggtcttccgtctcctcaaacgggaacatctcctcgaactctttctgccacacagtgtccggtccgaacgcaaatccctgttcattctggcgcactgcgtaaagcttcacgaggtcttcggcgatctccttgaccgctcccctgactctcgacttggtcttgttccactcctgtccgccaagcttgtttaacttcggctttttcgcccccgcgcccgcatatttctggatctgctccagctgcgtcgccagaatgtagagattgcccccgcctgcatactcgatcttgatgtaatccttctcggtcttatccacctcgatcttctcaatgccgcggtagatgcccagtccatggctctcatgcaccacgtagtcaccgatgttcagatccgtaaagcttgcaatcttctctccctcatagatgcgcttgcgcttctttttcttcttctcgccgccgaaaatatcgctctcggagatcacaacaaacttcagcatcggatactcatatcctttttttatcttgccgtaacccgtcatgatctcgccggactttacctcgtgatcgtagtcttccgaataaaaagcgttcagcccctccgccatcagatcatccgccagacgcttcgcacgcgttctcgatcccgacagcaggatcacctgatatccgttctttttgtagcgctccagatcctttaccagaagttcaaagctgttgttgtacggattgaccgtcttagactggatattcagatgtgtcccgatctccagatgcggattcttaaggtcgagtgccaccagcgagatgcatctgcgccccgcaagttttccaagaatctccttgcaggtaaaaagttcccgcatctgtcccggcagtagataccctttttccaggcgctgcttcatgctctccgaaaattcggtctccgtcgccattcctctctcaatgctccgcggtgtctcatccagaaacaccagcgtatcctgttttccaaaataatcgagcaaagagactcgttcctcgcaaaaataggacaggtaggcgtccagcccggcagagagccccagctccccggcttcctccgccacctggtccgccgcagacttgacgcggtacgcctcctcggtcttcatctccccgcggagcttttccgaaacctgctttgcttctgccagaatgcgcgcaataccggcgtcgcgctcctctttggtcagcaccagttcgcacgccggatagatgtggacctcatccagattctcgatcgaccgctggctttccgcatcgaatgagcggattgaatcgacctcatcatcccacagttcaatccggaacggattctcctccgtcagcgggaaaatgtcaatgattccgccgcgcacggagaattcaccgcttgtctgcacctgataattcttctcgtagcccagttccgccaggtgccttgtaaactgctccagatcgatcacgtccccgaccgccactttccgcaccgcactgataaactgatctggcgacggcatcggattcatcagcccgtcaaacgtcgttacaattgtgcacgagcgcttttccgccatcatcttgagggcattgatacgctccgctgtcagcacatttccccggatatccgactggtaaaacagaatatcctttgccggataataggcaacgttcggatcaaaaaagcggtattcctccgccagttccttcgctttttgttcctgaaacgtaacaatgattctgtttccagaaccattgccaatgctgtacatcatatgtggtttggctgcatcgatacagccggaaatctgaatgacgccggatagcttcggcagtgccgcctccaggtcttcaaattctttcagcccctgcatgggctgtgtgaatgtcttcatgactgactctcccgctttttcctgttaaaatcattcattgcctgatcaatctcatcctccaggatcatctccacagcctttacggattccttcaccgcttcctcaaatgccgcgcggtcttcctcactcatgcgtccgagcacatggtccgccagatcccatcccgccggcttttcgccgacgcccaccttaatccgcttaaagttctccgtcccggtcattgcaataatgttcttgattccattatgcccgccggcgctcccttttttgcggatacggatgttccccggcgccaggctgatgtcgtcaaaaatgacaagaagctcctcctcgggatcgatcttataataatgtaaaagttccgccacgctctcgccgcttaagttcataaatgtctgcggttttgccagaatcaccttctgtccgccgatcatccctttgccgaaaagcgccttgtgtccgctttcgctgatactgatattatatttttccgcaagggcatccatgacatcaaatcccgcattatggcgtgtatgctcatactgcctgcccggattccccagacctacgatcaaaaacatcgctatctcctgttctttgctttgttgcctgcgattctccgccggatcacgactgctgcagccgcaagctgctcctgatcgttgacccctgtgatatcctccgggtcatccagcgcatacgcatccaccttcagtcccttttccttaataattgtgagcgtatccggcagatagtattcaccctgcgcattattcggctgaatcagatccaacgcctcacgcagctccttcgtatcaaaaatatacatacctgagttgatctcgcgggatgccagttccgcctccgtcgcatccttgtgctccacgctcttcacaaaattgccgtctgcgtcgcggataattctgccgtatccggtcggatcctcgaccatcgctgagagcactgtcactgtatttccactcgcaatgtgatgctcccttaatttctttaaggtctctgccgtgataagaggggtatctccaaacagaatcagtgtctgtccttcctccccgagaaagtcctttgcacaccgcaccgcatgaccggtccccagctgctgctcctgtaatacaaactttacgtccttgtgcgaaatgctctcccgcacgatctcgtatttgtagccgaccacaaggcagatctcaccggcgccggctccctctgccgcctcaatcgcataatctaccagacattttccctctatggtatgaaccaccttcggcagatccgacttcattcgtgtcccttttcccgctgcaagtatcactgcttttaactgactcatcatactcctcctgccatctattgtaattgacgatttctgctgtcttttgtttgatcttgtcacagttcacgtttcattttaccttagtttgcggattttacaagagttttctgcaccactgcctgatccctgcgcgtataaacgaatgcgcacaggctttaccttcccgtaaaacctgtgcgcatttattttcctgggtaagctgccatccggcttcttcccggtattattcctcagcagccattgtctcctggtatttctgaaggatcagagtctgtatccgctctcttgtgtccgaattgatcggatgagcgatgtcgcggtattccccgtccgcggcctttctgctcggcattgcgatgaacaatcccttgtctccctcgatcaccttgatgtcgtgtaccacgaactcttcatcgatggtgatggacaccaccgctttcatcttgccttccttctcgacttttctgattctcacgtccgtaatctgcatagattctgtccccctttagtcccttctctacagtacatacctttcgttgttctcggatacaatcttgataccgttgtcgccgcagtaataggtgttcgccttgagtgtatcacggctctcgacaatgcagttctcaatatgtgtattgtcgccgatataaacatcattcagaatgatggaattcttaatcacacaattcttcccgacaaataccttcttgaacaggatcgaattctccaccttgctgttgacgatgcatccgctggcgattaagctgttgcgcacatcggaaccgatattgtattttgcaggcgggagatcatccactttggagtaaatcttcggctcatcatggaaaaagtatttccgcacctccggttttaagaaatccatgttcgtctgatagtaggattctacggtcgcaatattgctccagtattccttcatcttataaccatagatctgtttcatattcttatagcggatcagaatatccgtcacaaaatcccagcgttcttccgctgcgctgcgctctagcatctcaatgagctgtcttctgcgcacgatatagattccggtcgataccgtgttcgacttggataccatcggtttttcctcgaactctacaatcttggaatcttcattcatccggaccacgccgtatctgctgacatcctctcccggcgccatatccttgcataccaccgtaatgtctgccttcttctcaatgtggtaatcaagtaccttattataatccagcttgtaaatgcagtcaccgctcgtgataatgacatatggctcgtggcgcttcttcaagaaattgatgttctgatacatggcatccgctgttccgcggtaccaccagctgttatccacggttactgtaggattgaatacaaacaatccgccctgtttgcgcccgaaatcccaccacttggaggagctcagatgctcgtttaacgatctcgcactgtactgtgtcagaaccgcaacagtctgcacatgggagttgctcatgttgctgagtgcgaaatcaatgcttcgatagcttccgccgatcggcattgccgcaatcgccctcttgttggataattcctgcatacggctgttattaccaccagctaaaataattcctattgccttcataccgagtcacctgccttaatgattacttcaccgctctcaagaattccgttcgggtaatcttccttgtccgtcgtaccggaaattgccgtgttctttcctatcttaacaccgtccggtatcacactgtcttctccgaccgtcaccagaccaaaggaatagatgctcgcattgagcttattcggtgcctcttctccaatgccaagctcggtgttcgctcccacctggcagttctctgctataattgatttatcgatgatagcattctcgccaatcgttgttcctttcatcacaatggaatcccggatcactgcccccctgccgatcgtgacgcccggtccgatcacggaactatgtacctcgccgtatacctcggttccttcaccgatgatgctcttctccacaacggaatccgcggagagatactgtggctcgataatatcactcttcgtgtagatcttccagtattcctcgtacagattgaactccggaatcaggtcgatgagctccatatttgcttcccagtaagagccgagtgtaccgacatccttccagtagccgttgtattcatatgcaaagagacgttttccattctcgtggcaatacgggatgatatgcttaccaaaatcacatccgctctgatccttcatggcatagagcgcttcttttaaggtatcccagctgaaaatatagatacccatggacgccagattgctgcgcggcttttccggcttctcttcaaaatccatgatcttcttgttctcatctgcgatcacgataccaaaacggcttgcctcctcaatcggcaccggcatcgtggcaatcgtcacatccgcatgattctccttatggaaatcaagcataacctcataatccatcttataaatatggtcgccggataagatcagcacatattccggatgatactgctccatataattcatattctgaaatattgcgtttgccgttccggaataccactcgctgttatcgctcttctcataaggcggtaacaccgtcactcccccgctgttacggtccagatcccacggaataccgattccgatatgggtattcagacgtaatggctgatactgggtcagaactccgaccgtatcaattccggaattgatgcagttactcagagggaaatcgataatgcggtactttcctccgaacgcaactgcaggtttggcaaccttcgctgtaagcactcccaggcggctgccctggcctccagctaatagcatggctatcatttcttttcgaatcacgtcaatcacctctcgtctttctagtcagtctatttctctttgcacttataattataacataatcgtccacccatgtacatcatttttcacaaatttaccagcgcatttttctattttttgacattttcgccaaatcttttttctttctacactcttctttcactttctgtcgaaaatattttatcccaaaagaatttgcaaatcagtaagataaggttataatgaactttatcatagaaagaaaaacaggcaggtagaattataatgtataaaatcaattttaaagaacccatacatatccattttatcgggatcggtggcatcagcatgagcgggcttgccgagattctctccgaagagcattttacggtatccggatccgacgcaaaggaatccgatctgaccagacacttagagcatcttggcatcaaggtttactacggtcagacagccgcaaacatcacggatgatattgatcttgtcgtctacaccgccgccatccacgaggacaatccggaattcgcctgtgcgcgcgaaaagggaattccgatgatgccgcgcgcagagttgctcggacagatcatggacaattaccgcaactccatcgcggtggcaggcacccacggcaagacgaccacgacttccatgatcagccagatccttcttgcagccaagtgcgacccgaccatcacagtcggcggtattttaaaagcgctcgacggcaacctgcgggtaggcaagtccgatttcttcctgtcggaagcgtgcgaatacacgaacagcttcctgcatttttatccgaaatacagcatcattctgaatatcgaagcagaacatctcgacttctttaaagatattcaggacatccgccattcattccaccaatttgcatccaacacccgggaggacggcgcgatcattataaacggcgatattccggattatacggagattaccgccggattaaagccgcaggtgatcaccttcggtcttggcgacagctgcacgttccatccggcagacatcacattcgatgagaaagcctgtgcaagctttaccgccatgaaaggacaggagcctctgatgaaagtcacgcttcacgtcccgggcatgcacaacgtatccaacgcactggctgccattgcgctggcagatgatcttggtctttccaccggtgcggtcgcaaagggattatccgacttcggcggtgccgaccggcgtttccaatacaagggctgtgtggacggcgtcaccatcatcgacgactatgcgcatcacccgacggagatccgcgcgacgttgaccgctgccaagaactatccgcacaaacggctggttctctgcttccagccgcacacctactcgcgcaccaaggcatttttagaggattttgccgatgtgctctccctcgctgatgtggttgtccttgccgacatctacgccgccagagagaaaaatacctacggcgtctcctcccgcgatatcctctccaagctcagggaacgcggcacggaatgctattattttccgtcatttgaggagatcgaaaaatttttattaaaaaattgtgtaaacggagacttgttgataactatgggcgccggagacattgtaaatgttggtgaacatcttctcggcaaataagttatccactttatccacattcaattggggaaaacttcaacttttgaatgtggatttttttgtttacataatccttatacacgtttcctgcacttttgccgcctttgccgtcttttgcgccaaacctttcgcttccataatccggtttccaccggattcgttttctttatccacattatccacatttctgcggtcgattgtctgtgccggatgtgttccggaaaagatacttctcattccagttttcctgtgctataatgcatcagggaatgtcggcggctgccgtacattttgcttgttacgtttgagaaagaggagtcggtttcaatggccaatattaagctacacagtgacagtccagtctctgcaaccagtgtttccaacacgtttatcgatgaatatatgtctgatgccaacggggaattcgtcaagatttacctctacttgctgcgccttatgaatgcgccgcaggcgtctttttccatttcttccatcgcggacaagttcgagcacacggagaaggatgtcaagcgtgcccttgcctattgggagcgcatgcatctgctgcagcttgaatatgacaatgataagaatctgaccggtatccgcatgctggattcttcgtccagagatgccgcaccgtctgatccggggacttccggaacacagacagagccagtcggcgcaccggtacagaacgcccctgcttccgccgctttgtcagaaacaccggcaccggcgcagacagttcctgccaaaaagagctattctgcggacgatattttgaatttccgccagaatgaatccgtcgcagagctgttcttcatcgcagagcgttatctcggccgcaccttaagcgccaccgacatcaatacgcttctctatttttatgatgtgctcggattttccaccgagctgatcgtatacctgattgagagctgtgtgagcaacaatcacaccagcatccgatacatagaaaaagtcgcacttggctgggcagatcagcatatcacgaccgtcgaggaggccaagcagggttccccggttcttggcaaaatgtactacgccgtgatgaacgcgttcggcattaccggacgcaagctggtttccaccgagatcgcttatatcagccgctggacgaacgagtacggttttgactccgacatcatccttgaggcatgcaagcgcaccatggcaagtctgcatcagccgaacttcaaatacacggattccattctttccgactggaacaaaaagcaggttcaccatctgtccgacattgcaaaactggatgcggcgcaccaggaacgcaaaaaaagttccgcttccgctgccgccaatacagcatccaaaaacaagttcaacaatttcacgcagcgctcctacgactacgacgaactggagcagatgcttttgaccacgaacgtacactgatttaaaggggaaacagatgccgctaagcaattcacagtatgacgagatattccgcaaatatgacgaaaaacagttagccagccagcaccagctcgagcgccgcacaaaggacgtctacgcccggattccggcacttaaagagatcgatgacgcgatcgctacctgttctgtcgagcaggcacgccggctgttagacggagatgaggccgctctggccacgctccgtgaaaagctctcggactaccgcaggcagaaggagcagctgttgcaggagcacgggcttacttctgattatctaaagccggtgtaccactgcccggactgcaaggataccggttatgtgaacggcagacgctgtcactgttttgaacaggcagccatcaatctggtctatacccagtccaacttaaaagagattctggaacgtgagaatttttccacgttttcctttgattactattctgcggatgacatcaatccggcaaccggacgctcgtcccttgagacagcaaaggatgccgtcgcaaaatgccacgattttatcgatcatttcgacagcacgttctccaatctttacctctacggagataccggcatcggcaagacctttttgtccaactgtattgccaaggagctgttagaccgcggtcattccgtcatttactttaccgcattccaattatttgatatattaagcaagggcgtgttcaaacgggacgaggaggcactgctttcccaccggaatattttcgactgcgatctgctgatcatcgatgatctcggcacggagctgtccaattcctttacgacctcgcagttatttttatgtatcaacgaacgcattctgcggcagaaatccacgatcatctccacaaacctcgggatgaaccaacttgccgatatttattcagagcgcgttttatccagaatatccagcaattacacattattaaagctcttcggcgcggacatccgtatcttaaagcgccaccgttaacatttttatccctgtatttcattagagcaatctattgaaaataaaacctatgtaactattctttaatggaggaaccattcatgccaaacgatgaaagaaacttagaaaccatgcctgacggagcattgggtctcatcccactggaaagctgcaaagaacttggtcttaaggtagaccagtaccttgtcggctggcgcgaaaagagacagcaccagcaccagaacgaccctgcgttcaagggctatcgcagagattcttatatcatctcaaccgcagtgccgcgtttcggaaccggcgaagcaaagggtgtcatcaaagagtctgtccgcggctatgacctgtatctgatggtcgacgttaccaattacagcctcacctactctgtatgcggttacgagaaccacatgtctccggatgaccactatgcagatttgaagcgtatcattgctgctgtcggcggaaaagcaagacgtattaccgcgatcatcccgttcttatatgagagccgtcagcacaagcgcaccgcccgcgaatccttagactgcgcacttgccctacaggagcttaccgctatgggcgtcgacaacatcatcacctttgacgcgcatgacccgcgtgtacagaacgccattccgctcaagggattcgagactgtacagcctgcttatcagttcatcaagggtatcttaagagaagtcaaagacttaaagatcgatgcagagcacatgatgattatcagcccggatgagggtggtaccaaccgcgccgtatatcttgccaacgtgctcggtctggatatgggtatgttctacaagcgccgcgactacagcaagatcgtagacggccgcaacccgatcgttgcacatgagttcttaggttcctccgtcgagggcaaggatgtgattatcatcgacgatatgatctcctccggcgagagtatgattgatgttgctaccgagttaaagaagagaaaggccaaccgtatcttcgttgttgcaaccttcggtctgttcaccaacggcctggagcgttttgacaaggcggttgcagacggcacaatctacaaggtcgtaaccaccaacctgacctatcagacaccggaactgcttgcaaagccatattatatcaactgcgacatgagcaaatacattgcttatatcattgatacgttaaatcacgacagctcgatcagcgatctcttaaatccgtatgaccgcatccagcgtctggttgcaaagtacaaagcagagcagaactaaactaaacacaaagaaggggctgacgctttttgcggacagtccctttttgttgttataagtaatctgccgagaagaccatacctttcgatttctgatggaaatgcagatggaatattcgttggagaaaaatgtaagcatttcttccggctgaatgttcgcatcgaattccgtgtctcttccacgtttggacaatccgacggggcatgtccgacacaccggagacaatgggcggactttctggtgtccctaatggcacctcttcacagacaatataaaaccgcgcgaaccgaactcgccggcatctgctattgaaaataggacagatgccgactcagacagcggcttcgcgcggttatgttttgttcgacataaaggtggcatttatgccatctgttgtctggtgccaataagggacacacacaaaagtcctacaaattatctcccgggatgcggacatgacccgcggagtgctccaaacttggaaaaacacggatcatcggagatgcaaacattcggctggttagaaatgccacattttttgaaccgaatttccagatgcattccatcagaaatcgaagggtatgtttttttagtctatttttatcacacaaaaagggactgcccgctaaaagcgtcagtccctttattatgcctatgtattaaaacaagtctactctgccagcaattttctgattgatcacataatacgctgcgttctcttccggctttaagtagagctgaagtgatttgatcgtggatgctctgtgaccttctgccacaaactgctctgtcactttcttaatggcatcctctaccacgccttcacgtccctgatactggatatacacttcaggcttaagctcttcctttgctgccttcttcgctgtctttgttcttggttttcttttctttgcggtctcagctgctgtcttcttcggttcttctacctttgtagccgcctttacctctgtctctttggctgcgttcttcgtctcctcgacttttgccacaacctttgcagttgcttccttcgctgctgtcttggtctcctcaaccttcgccgcaacttttgcttctgctgcctttactgctgccttagtctcatcaagtttcgctgtcgtctttttttccattatgagagccctcctcctcatcaaaaaaactactcacatactaaaaacttttccattgctactaatgcttcctcttcatcactgccctcggcaacgatgttcaccgtcattcctttggacgggttaaatgccatgattcccataatactcttcgcatttatccggcggttgttactctcaagtgtaatatcactgtcaaatctgcaggcaacctgaaccagttctgcaatcggattactatgttcctctgagacattcgatacaacaatctcttttctgctcataatctctccatttcctcttttcaagtactacgtctcaaaatataacccatctatttccaatttgcaatagaagaacatgaaatctgttaaacttacacgaataatttcctactttaagagcttttttatgcactttcatttcaccagatatgtgaaaaatacatttcctgccgccgtaaacatctcatccgcctcggtcagcgtcttccggtatgtcgttcccagtgcaggatcaaatatcacgacgctgttgctgtcatatccgataatcagcaccgcatccgtgcttcctgtcatggaaaataccggactgccgcagctgacatagtagagaacctcctcgatattgcatccggtcagatccagcacctgcatatccttcatcgtattgttcaggatgcttttcggcgtctctccgccctcaatgagtgcgttcacgctgatattgattccttctttttccagcatggcattgatgcactgcgcaatgcttcctgctccggcatcctccgcaccgaccgcaatatccgacagtgccggctgtgcggactttctggagcgtttccacacatactgaaggttatctccaatcacgactcccatactgtcatttgctgccgtgacggcctctgtgacatcatctgtcgccagcaccacattccccttcacgtatacataataatgctttgtgctgccctcttccttgattgccaccgtgcgctcctcttctaaaatcgtctccttcggggtgagaagcttcggcgccttttccgcggatgccccggcaatcgtaagctgtacctgggtctccttttccgcagaactgctcgttgcaatattgacaagctttccggagtctccctcacggttcatgatcatatcctgatccgccgggacatatgccgtgccgttatactggatgcggttcaagtgcatcgtgtagtcctcgatggacacgctgcttacaaaatagccgctcttttcatatgttttctgcacaataagatcttttgtcgagacatccacaatccggatctggtgcatcggaaatgtcacatttccggcggcgtcctcgaaaatatccgactgtctggcaatgccatacacaaaatcctcatccatgaagccaagcggcttgatggcttccccggtgcccgccgcaatctcctgcgtgctctgatccgacagattcatcacgtggatcacactgctgcccatctgggaatccccctccgtctccatccatgcaaaatagcggttggacgcggacaccgcaaaatcctgtacgctcagattcgtcaccagttcccgcaccgagagggtatttaaatcgattccgtagacacacccgtccagcatcaggaaaagctctccgccctcatttacatacatgagctgcccgagttccgacttcatcacctcatacgacttatccgacggaatgaagaccagttcctcatcggtattcgctaggctgtcgtaatgatagaccgcaattccgacttccccctcatgaattccgcggttcatgtaaccgtacacgatataatccacgcttccggcttcgtccacaccgacgatcttgatgtcgtgttctccgtagttctcgcggctgtcaattccctcgtaaccgcggaaactgaacacttttgcaagcgtattttccaccgtattgtagctccagagttctccctcctgcacgaacgccacactggttcccgcctcattcgccttgtattcaacgttcgcttcgcggattccaagctggatatactgatcgtaaacgctgtcattttctccgcggaaaatctggttcatggtgcgctcgaaattcagcagatagatgcggcttgtggtgtagcgcacccggtaatattcttctatattatagtattcgatctgaccgctctcgttgacactggataccacataatcaagcacgatcacgttgtaggtcggtgtgatctccttgatcgatggaaccggctctgtcagacgctctcccttaaaatccgcccagctcacctgctttagagaagaatttaacgacacgaactgcagcgtcgtgttatccccggtcgtccgctccatgtaagtcgccagtgttccggaggtctcatcgttgaacgtcttatcgttaaaatccttgacgaatgcgacgcactcgctcacatagcagtcgactggctccgcgatcctggtatagtaacagatcgaacggtctccgctcccgaggcggataatcatcagatattcttcgccctcttccagcagattctggatctgcagatctgccgtgatcttcccgctgcgctcctcatacgaggtgacatccgcattcgcgatcaggcgtgtggcatcgagactgcggatctcataggaaatcgtgtcgaccgccgtctgattcgtctgtatcacaatcggaagcttccggtcttcccccaccggcgtaatggtatcgcgcatatatgcggcatccatctccgtcacatacccgtgtagttcattcagctcctgatcgccctgatacatggtgatgaccggcagcgtcgcctccttcatctccgtcgtcagatcctcgttagtatcattcataaatcttccaaatataagcactgctccgatgaacactgccgccaagactgctgcctttatggttcccttccgcaacggtcattcctcctatataacgcaaaataactaccgcgcacaaaaacgcgatagttatattaacacaaaataactatcgcacaaaaacgcgatagttatattgtatgcattttaaaataaatccgcaatgactttctctgatttttaagaattgttttcgatcttatccggggcttcgcacccccgttaccaccagcgtctgcagcggcggtgacggcagcgtctccggtacatttcgttgtttaaaatcacaccgatcagctcccgcagatgatcattctgtccgggcggcggcggtggcggcggtctgtgtccgggcggcggctgcatgcctccgtgaaactgctctgcctccagttcgccgtcttctcctgtaactttcttctggatgcggtctaccaccatctcaatcatcagacggtccggatactcatcaaacatcaggctgccctcgtattccattctgtcacattcgtcttccacgcactccacaatcctgccaacctctttgggatacagttccttcatgcggtccatatccttctcatactccatctcggtcagatacagattctgcatggggtagctcatataaaaaggcatcttgggcacatcaaactgcgcgcggaaaaactgctcctgattatagtccactctatactccctatagataacttcgctatatcatatgcagtgcgcgcgcgccgggttactgcgccagattctttaactcgtccaataaatccagatcggactggagcaccttcatattggtcgtgatcggctcctcgcccggcttggtaacggtgatttcaattactgttccctccgtaatgcccgcagaaaataccgcgtttaaaaacgccgcaaacttcggatggttctcaacgaacttgtttctcgcattcataatcttcataagtgaagccggattcatcataatatcatactccctcgtattataaagtagtagtgtttatagaccctctccaaggtctgtatgctatacttttggagatactgtggattgttttcacactcctaccacttgatggtttaagaaaggctacaaccacagt

SEQ ID NO: 14 - DNA, 123837 bp, Roseburia hominis
tagaatgctcgtcgataattattcagtgttttacacaatccgtgacgaaagggtaattgtaacggatgtgttatacacggcatctgatatagaagcacgtttgagaggcgagctataaaagcacgcgattatttgaatttggaagtgatatagtctacatggctatgcttaatgctattctggttatttatctatcttagaaacagaagatttagttcaaatggacatttcaatttactttacgggcaaaattatttacgatacaaaagagtaacaaattcaagtttgactgattagaaacagggaaaggcgcggcggacaatgtagtgatctgcgacttgtaatttgtggtgggatatagcgaaagaaaaaaggagagatcgcacatggttttattggttgtcgatgtacagaaaggcatcgtggatgaacgcttatatgcgttcgagaagtttgtcagtaatatcaggaagctgattgagaccgctcgagaacatggggtagaagtttgctatattcaacacgatgatgggccgggtactgggttttccatcggggacgatgcgtttgaggtctattctgagtttcaaccgatgcccgctgaaaaacgattcgtcaagaccgtaagcagtgcattcaagaaagagagtggtctgctggagtacctgacagcaaagggcgaaaaagacgtgatggtctgtggcattatgaccgacttctgcatcaatgctacagtagaggccggttttgagcatggactgcacatgatcgttcctgcctatgcaaattccacgctggacaatgagcacatgactggggagcagagctaccgttactataatgagtttctctggccaaaacgctatgcggattgcgtatccatggatagggcattagcattactcaaaaaagcgatagagggatagatatatgttgataaactttaatgatcggcacgctattacagtgtccggcataaataattgccccggcaaggccatctgtgatggagatttagttttgtttactatgaaaaaaacaatctatctgctggtactggtgttaagcatgggaatttataccggatgtggtaaagagaatacagaaatccaaaattcccgcatggaagaacaaactacaccggagaacagtgaaaacgatgagattcatttggaggatggactgaaaatagactttacccgcgattattctgaggatattaaggaagatgtagacgatgtagtggcggcttccacatctctgcaggaagagttgacgaatatggagaaggtcacacaaaagtatacgccattagctgaggcggcacaaacgcagggcgaaatgaatgtagccgctcattggctctatacgatatgggatacggaactgaataatctctggagcagattgagtagttcagcggaccggcagacgaaggagaagcttctggcagagcagagaaactggatagatctgaaagaagaagtgactttattaaatattggttccagagaagaaaacggtagtatgtatccgcttttacaggactcttatctggaggaaattacaaaaaacagggtgtatgttcttgcaagagagctggcgaagataaaaggggaagactttgctatgccggaagtttccgcaaagtacggaacctttgtagataatcagggaactggtgatatatacagttctctgatcaccagacagaattgggaaggaacagatgaagcggtgatctctatttacagacagggggaaatggaaggaagctttgtggatcatggaaatggagaactgagctttacatcagaagacggaagtgtaaaaggaatgatcaaaatcgacggatggaatggcgcaagttttaaagttacggaaacatacggagaatctccttttcctgcaggagaagagtttgaatttccttttgccgtttgatttgtgatactctgtgtctttcaaggcgttgagcgctccgcgggtgtgtccgcagagtgtcaaagcgtggcaagagacatggaatgaaatggggagcgcggcaggaagaaattcctgccctttttcaattaccggtctggctatgaacttccggacacagcatcccgccgaccggattctctctgtgtgcctacagaagcggatgctctgcgcgcgccttaaggcggtcgtagcgccggtcgatctccttctggatctcctcggtcacggagcggtactcctccttcagcagatgcctggtgcgtcccatcatacccagccattctgtgacagggattttcttattgctcgaagcaggatcataattcagcgctgtgatgccacgttcgatttcgtagagcggaaaatagcagcagtccacggcggcggcaatgacgctccgctccagattgggcttatcattccagttcagcggacaggcggacagcgctttgatataggcagtgccaaactctctggaataggcggcggcttttgccgctttccggataaaatcggccggattcgattctgcgactgttgcgacatatggaatgtgggtcgcggccatcagctccggcgtatccttgtggaagaagttcttgccgtactgcgtctttccgacatgggaagtagaactctttgcgccgagcggtgtggagtaggagagctggtagccggtattcatgtagccgccgttatcgtactcaaaaatgatcagcttatgtccgcgcagggcggtgccgagtgccgatcccataccgatatccatgccgccgtcaccgctcaccatcacaaaggtaatctcgccgtccgggtattccccgcgtttctggcgctggtgaaacgcctccacaacgccgcttagagtcgccgcgccgttctgaaacagattgtgcagaaatggaacacggaatgcggttttggggtagccggttgtcactaccatgccgcagccggtctgaaatagcaggacgacgttgccctcgatgccctttagcaggaggttcaaattgatcggaatgccgcagcccgggcaggcgccgtgtcccggtgcgacgcgcatcggcatggcggtcgtatcttttacagagccgccggagaccttcattttcccggctgcgtgatcgaagatgcaggtggtgagacccggtgtggattcttcctttgtgacaggcttaaaatactgcggctgcatcgcagaaatctccatcgccggggcggctttgccggaattgcccgaagcctggtccgctattgtgcggtcagccctgccggaggcacttgaagtcatatcttcgttgatagaggctgcctggtgtgaagctgtcggcactgcgtctgtcccggcggaatctgtcccggaggaagcagtccgatccgatgcttccgtgcccgcagtgacgccgtagtaatcgaacgccggggcgtccggcgagagtgcctctttaaagagggcgagggcgtcctccacgaaaaagtccttgccgccgagaccgtagatccggcttaaaatgcgcggcgggtgcggcagggaagagagagcggcctttaattcaagcgacatgttgccgcccccggcgccgtagctgtcctgccggtctgctgccagaatcgtggaagcattgtggcagagcacccgaagttccttagcggggaacgggcgcagaacgtagagggtgatcacgcctgccgctatgccgtcctgccgcagccggtcgacggcttccatggcggtatggtaggaggaaccgagcacgaaaagcagaacctcggcgtcctcgtgccggtaggcaccgcagaaggaaagttccctgccggagagggcggcatattctgtaaacagcttcggcagcttgtttctcgcggcttccatggcgagatggagctggtagcggttattgatgacatccggctcgttcatataggaaccgatggaaaccggatgcgcgagatctaagacgctggcgtaaggaagctccccggcggcgccgcaggtgccggtgccggcaaatgcggagaccttcgggttgtcacaggaaagcttttccccgatatagcgggtgacggtgtcatcattctcaaatacaaggcacttgcgcttctgatggctcgtaaaaaagccgtcgaacgcgactgcgaccgggagacggacagcttcggcaagttttaggccgagcagattaaaatcatagactttctgcggttcatcggcaaaaaggatgatccagcccgtgttgagcagatacatgacgtcgctgtgatcgcccttgatgcacaaagggccggaaaccgtgcggcatgcaacattcatgaccatcggcatgcgtgtgccggactgcaccggaaactgttctaaggcgtataaaagcccgttggcgctggtggcattaaatacgcgccctccggcggctgaggcaccgtagcagatgccggcggcactgtgttctccctcggcggcgatcagggcaatgtcgtgaagcccatccgcgcccatgacatccagattttctgcaatctgtgtagagggcgtgatcggataataccccatgacgtgatagttgatctgctttgcggcaaatgcggcaagctcattgccgctgtcatacataattttttgtttttccatatcattctccattccgcagacgatgtgcgccggtacgattctccggtgctgcctgcatttatacgacgcctccgtcgacccgcttctcatcggtaaaagaatcgctcgtgatccaggaatttgcgccgacagtctgatagcggatggcgtcgggcagcagatgctgattcggaagaaaatgcggtttttccggataatctttttcaagtgccgccacgagtgcgttggtggggcagacttccacacagcgcaggcagcccttgcagtgatagtagtcaagcccccggttgaccatgcagttttttccgcggtaggtaccgggagcaaactggaagaccatatccgggcatgccgtgtcgcacagtccgcagttgatacatttttcctggatgaaaaggggaatgtacccttcgcgcgaggcggtcagatcgttggacacggtgctgccgatccgcggattgacgccgccggctggagcgttggcatagccccaagcataccggtccgccggggcgtccggcagaggggcgaggttgcggtcgccctgagccattttgacattttcatatcccaggcgcagacccgcgagattggcttcgatgagtgcggggtattttttcccgaccgtatcgcggcagagcatttcggctgcttcccgtgggataaagccgctggcgcgcaccagggcaccgagcatgaccatgttgatgcgggaatgactttccatcgcaagtgcgagggcatccagacaatagagttctccgatggaaatatggtatttatctgccgcctcgtcagcggacaagggggtatttaatacgattttggtgtctacggtgacgccgtccaagaccgggtaggtgccgatcagtccttcgtgaaagatgccgagcagatgtggccgggtcacggggctgttgacgcgcagcgggcggtcgtctgcgcaccagcggacatacgccttgaccggtgaaccgcgcttttcggagccgtagctggaaaagcttaaggaattgagcgaaagcgacagtgcgccgagctctccgagcatttttccgcagagattggcgcccagcccgccgatgctctccaggcggatctcataggagccgttttcatttgtgacaggtagggatattgtatttttcacgtaaatctccattcctgcgcgagcagacgggcattggaaaatgacaggcgccggctgtgcgcatgtagcgataacaggctatcttgtggtagtatgccgctttttcagaaaaaaatcctatgcaagtgcaaaaaagagaagtagaataggaaaggaatttttagaatggaacagaaaagatgatggacaacatgttacagaagatcatagattttataaaaaaagaaacggtactcacgatcgccacggttctcgctgtggtatcggcattctgggtgcacccgggccggcagtacgtggactacattgactggcgcgtgctcggcattttgctgtcgctgatgctgattgtggcaggatttcagagcaacggattgttcgatgcgatcggcagccggcttctggcaaagacaaagaataccgcgcagttgatgctggtacttgtttttttgtgctttttttccagcatgtttatcacaaacgatgtcgcacttctgacgtttgtgccgtttgcgtgcacaatcctgcagaaatgccaccaggagcggctgattgtgacagcgtttgtgctgcagacgcttgcagcgaatctggggagcatgctgacgccgatcggaaatccgcagaatctatatctttacagcatctccggtgccgggctgggtgaatttgtcggatggatggcaccgtatacgctcgtgtcaggtgtgcttctgctgcttgtcgtgttcgtgctcagcgcgggcaagcgccggatctcgttggagacgggggcacttttgcagacgcccggggcagccggcaggaagaaaaacgggatttatctggcgctctttgtgctaagcctgctttcggtagcgcgggtgcttccgtgggagctgatgctcgccgtggtgctcattgtgctcatttttacggatcgcgcggtgtttttgcgggtggattactgtctgctgtttacgtttatcagtttcttcatcttcatcggcaatatggggaatatcgaggcggtacggtctgtcctgcaaagtcttgtggcgggcagggaactggcggttggcatcggtgcgagccagatcatcagcaatgttcctgcgacacttcttctggcggatttcacgcaggatataaaaaatctcacgatcggcgtgaatctgggcggactgggaacgctcattgcctcgatggcaagcctgatctcttataagatctacgcgcacaattataataagaccaagggacggtatctcctgtggtttacgatcgcaaacgtactgtttctggcagtactcgtgctggtctatgttttcatttcataggaagcggcggatgcacggatgggagaatacggcagaagcgcggatggagaatacgacagaaacccggatgggaggaatggatatgagtgataaaaaaatgaatgcggaaagtctgcggggaacggtccgcgtactgttatcggcagtctgtttcagcaccggaggcgttttaatcaagtcgattccgtggtcgtcggtgacgatccagggagcgcgcagtattttctcggtgctggttgtgggatgttacatgcttctgcgccgccagaagtttgtgtggaataagacggtgctcttcggtgcggtgtgcaatacggtgatggcgtttgcctttgtggcggcgaccaagctcacgacggctgccaatgcgatcgtgctgcagttcacagagccggtgtttgtcattctcctgatgtggctgatctttcacaaaaagccggggcgggatgcggtgtttgcctgtgcgggagtctttgccgggattctctgcttcttttatacgtcgctggatgccggagccatggcggggaatctgctcgcgattctctcaggtcttgcctatgcgcttgtgatgatgcagaagaaattccgcggagcggactttgaatcgtcgcttctggtatcctgtgcgctgagcgcggcgatcggaatcccgttttacgggcaggagaacgagatgtcactgcatatctggttcttcgtgctgctgctcggcgtggtgcagtttggtctgtcctatgtgttcctgtcgcggggactggatgcggtctctccggtcacggcgtcgctgacctcgacgatcgagcccatcttaaatccgattctggtggctgtcttttatggggagacaatcggtgcaactgctgtcatcggcgccctgctggtggtcggttcggcgacggtctacaatgtaaggcaggcaaaaaacgctgcctgaatccgtacaaaaaggctggaagaagtcatacaaaaggtacaaaaaagacaaaaatatatgagcagccggtaaaatatttgttaaaaaaggaaattgctgaacaaaaagtgtcatgctataataacttctaaattcagatatcagatgacatgtgcaagggagcaccgcggtagcggctgctctctttttttatgtaataggaaacttcgttcctgttacataaaaaagctccccggggatcgcactgcggcggagacgaaagatgtcgcaagagcaacccgccgcaggcggagaatcctgcaggcaggattcttatttaatgtaataggaaataccatattgcgctaagatgtgaaagcctggctgccgtagataaaaacaaccgcgtaatcatattatgagcggcagacacagacaaaaaaggacgattttttgaggaggagaagaatgcagacggaagagattttaagtgccggaattgatattggaacgtcgacgacgcagcttgtgttcagcaggatgattctccagaacacaggcggatttggcagaattccacagatcaaggtggtgtcaaaggaggtcatctacgagagtgagatttattttacaccgctgtcatcccgggaggagattgacggggagcgcgtgcatgagatcataaaaaaggaatatgagaaggcgggtgttcgtccggcagatcttgcaaccggagccgtcatcatcacgggggagacttcacggaaaagaaatgccgagtcggtagtgcgggcgatcgccgatgtggcgggagagttcgtcgtggcgacagcgggagcggatctggagtccgttctggcaggaaaaggcgcgggagccgcggatttgtcccaaaagacggggaagcgggtagtcaatctggatatcggcggcggcacgacaaatatctgcgtctttgagaacggaaatatggttgatacggcatgtctcgacatcggcggcagactgatccgcgtgaaggatggcagggtgatctacatggcgcccaagctgcaatggctgtgcgacaggcttgagattgatcttgcggagggcgggacggcagaaccggaaaagctgcgcagactcaccgctgcgatggcggaacttcttgcggaggcagtgcatctggcgccggaggcagcagagctttcctacatgcagaccaaccatcttctggcggatagcacgccgcccgatattgtgatgttctccggcggggtggcggcatgcttcggggaagaggagaatctgttccgctacggggacatcggaatccttttggcgcaggcgatccggaagaacgaagcgttttgtcgggcggcagtgacggatgcgcgggaaaccatgcgggcgacggtgatcggcgcgggcaactacagcatgaacatttccggaagtacgattgagtacacgacgaaaccgtttccgttaaaaaatattccggtggtgaagcttccgctggagcgtgaggaagagattgaaaaactgccggaaaacatgcaccgggcgctgctgctttataaggaggagcaggaaaaagaccggcaggtggcgcttgccatgaaggggttaaagtgccctactttcgcacaggtacaaagaattgcagaactgattgcgggtcagtatgtcagggagtgcggcatgggcaggcatctgatcctggtgcttgaggaagatatcggaaaagcaatcggtcaggcgctgcatcacagactgaaagagaagtgcagtgttatctgcatcgatggaatcagctgtgggagtggagattttattgatctgggtgaaccggttgcgtcgggtaacgttatccccgtgatagtaaagacattgatatttaatggttaggagcagcttatgatattaaagacacggatgctggggcagacctatgaatttaaggatgtaaaagatgtgctggcaaaggcgagcgagaaaaaatcgggagacgagctggcaggtgtgggagcggagagcgccttagagcggattgccgccaaggaggtgctggcacagctgaccgtggcggatttaacagagcatcccgtggtgccctacgaggaggacgcggtgacgcggatcattcaggatgatatcgatgaaacggtctacggcacgatcagggatagaacgatccaggagatgcgggagtggattctctgtgacgccacagacagcggggcgctgatgcgcgcaagccggggaatgaccagcgaagtgattgccgcgatctccaagatcatgagcaatatggatctgattcttgccggaagcaagatccgggtgacggcgacctgcaataccacgatcggaacggaaaacgtgctcgcgtcgagactgcagcccaatcatccggtggatgatgtggaaggcgtggcagccagcaccttagaaggactcagctacggcatcggcgatgccgtcatcgggctgaatccggcgattgatacggtggacagcacgcttgcgatctggaaagtgctcggggacatccgggataaatatgagattccgacacagacctgtgtgctctcacatgtgacaacacagatggaggcgcttagaaccgggcagggaagcgccgatctgtgttttcagtcgattgcgggatcggaggcggcgctctcggcgtttggcatcaataccgggatgctgtcggaggcggagatgctgtttcgggaggagggaccggcaaagggtcccaacgtcatgtattttgagaccgggcagggttcggaactgtcatcctcggcggcgtttggcagcgatcagcagacgatggaatgcagatgttacggtctggcacggcactatcatccgtttctggtgaacacggtggtaggtttcatgggaccggagtatatctacgacaccaagcagctcacaagggcggcgcttgaggacgtcttctgcgggcatctgcacggactgccgatgggctgtgacgtatgttatacgaaccacatgccgaccgatcagaacgactcggagacgatcctgacacttctgggaacggcgggcgttcactatgtgatgggactgccgcaggcggatgatattatgctgatgtatcagtctaccagctatcacgatgtggcgagtatccggcagctgctgaaaaaggagccgataccggagtttaaggcatggcttgaaaaacggggcatctgggaaaacgggcatctcggtccgaacgccggagacccgtccatattctttaaataggaggaacaggatttatgagtgaaaaagagaccgcctgcctccgcgatattacagagacagacattatggaatatatgcaggtggagcacccgcataatgaaaaggaactctggaagatgaagcatgcgacgcctgcgcggatcgggatcggacggtgcggcgcacgctacacgaccgaggcacagctccggtttctggcggcgcatgcggcggcaaacgacgcggtgttcaatgaagtgccggaggaagtggtaaaggaacttggcgtttttgaggtgcggacaaaatgttccaataaaaacgaaatgcttctccgcccggactggggcagggagtttttgccggatgccagacaaaaaattgcggaaaactgcgtccatcatccgcaggtacagatctatttcggcgacggtctgtgctcgccgtccatcaaggcgaacattccggatctgtttccaaccataaaaatgggtctggaggataagggaattaccgtcgggacgccgtttttcgtgcggtattgcagagtgaataccgcgcggacgatcggaccgcttctggatgcggaggtaacctgcgtgctcatcggggagcgcccgggtcttctgacgtcggagagcatgtcggcatatatcgcctaccacgcgagaccggacatgcttgagtcggagtatacggttgtatcgaatatcagcaggcacggtgtgccgccggtggaggcggccgcacatattgcggatctgatcgcacagatcctggaaaagaaaaaaagcggcgtagaattttcaaaagcagaataaagacatggttgcgaaggagcacaggcgggacgtctgtgctctttttctatagaagcagcaagacagacaaaggaggatacattatggagaaaaacgaaggaggtcagctggtgcgtgctctcggactgaaagagtcgatcagtatgacgataggaacggtagtaggagtgggactgtttacctgtggttcctcacagattggatatgtcggatcggggattattgtaattacatttttatccctgctcatctcgatctggccctgtctgatctacggcgagatgtcggcggcacttccgtgtgccggaggtacttacaattatgcgaagcgcggactcaaccgggtctgggcgaatctggcaggctggcattacatcatctccgtggtcggcatcggcgcgggcgagacactggcattttccaattattttaaaattctgttcggagaactcggcatcaatatcgagggagtggattctcggatcattgcgattgtgctggttctgtttttcctgatcttgaacttccggggaattgagatgtccggaaaagcgcagacgggattcattttcttcttctggggctgtgccgtggcatggttcttatatatgataccgcacattcacctggactatttcggcgggatcgccatggattccctgccgccgtttaaggaaatgatgtacattttcggactggtatggtggtgctataccggatttgagacctgtgtatcgatgggtgcggagacgaaatatccgcagtatacgcttccgagagcgttaaaagtatcggtattccttgtatttgcagtcaacgcgttattccagtggtttcttgtcggactggtgccgcacgagttttaccacatccttgcagtggcagacgcaccgtatgcggagggactccgggctgccggactggtgggcttcccgatcattctgctctgcatcggcattgcattcggcggcgatctctccaccatcaatccgggaattgcggcaccggcgcgctacatctacacgatggcggaggacggttccctgccgaagttcttgtgcaaggtacatccgaagtataagacaccgtatatggcggttcttgtggtcggcatcatcaatattatcctgattgcaacagggtcaatcaattatattgcgtcggtatcgctgatctcactcgcagtatgttatatgattggctgtctggcttaccttggcttaaagaaacactatccggatatgaaccggccgtacagggcgccggcaggaacggtcggatgctatgtcacgattgcagcctacactattattctgattttcgcagaccgcatagcgcttctgacggcggcggttgtgactgtggcagcgattgtctactgggcgcttttcaccagaaagcatgagaataagattccgtccattgaggaggagatcggtatcctcgaggagccgtccccccaggaaaaggcaaagatggacaaggagtaccggatctggaaagccggcacgatccttgtgacggtgatagcacttggcatttacattattccggtcttattttaaaatttaagggattggaaaggagcacggtatgagactttatgagggtaacattttaacctgtgacaaagagaaccggattgcacattatttgttggaggatcaggggaaaatcctttactgcggggacgagctgccggccggctgtgtggcggcggagcgcgtgtccaccggggagggggcattgattccaccgtttgtggacagtcatatccatttcgcaagttacgcgacgtttcatgccgggctcaatgtcatgaatgcgcggagcaatgaggagattcttcagatgctccgagagcatgtgaagaaaacgaaggaaaagctggtgatcgggtttggcgcatcgccgtattccgtgtcagacggacatctggtgcgcagggtgcagctggatgaggtgtgtcccgacaaaccgctctttctggtaaagtatgacggtcacgcgtgtgtcgtcaacacggtgctgttaaacgaagtgcgcggcaaggtgcagcatctgcgcggttttcatgaggataccggggagatgaaccaggaggcatttttcgccgtctcggattatatcacagcttcgctctctacggtgcagctggtggcgcacatgcagaaggcgctggacgatctggctgcgcgcggcatcggcatgattcatacggtcagcggcgtcggctttgcgagagatctggacgtcgatctggagcgtttttttgcgcgcggcatcacaaacggcatgcagatgcgcgtgtttatgcagacgctcgatgtgaataaggcggtaaagcggaagcttccgagaatcgggggctgttttgagacagcgcttgacggatgcttcggttccatggatgcggcactgctctcgccgtatgaaaacacgtcggactgcggcgtactctactattcggatgaaaaagtgacggaattctgtaaggcggcaaaccgcgccggtctgcagatcgagatgcacgcgatcggcgataaggcgtttgcgcaggcggtgcgtgccatcaaggcggcgcttgacgatctgcccagagaagatcacagacatacgatcatccatgcatgtctgccgactgcggaggagattgcggtctgtgagcggtatcacatcaatctggcagtgcagacggcgttcattgactggccgcaggagccggacagctatctggagcagatcctcggagagcgtgcgggcaggctgaatccgatccgcacattctgcgaacacggactgattttaagtgcgggatcggacggaccctgcacagatccggacccgcttttatggatgtataaggcatgcaatcacagcaatccggcagaatccatctccgtgcggcaggcgctgcgcatgtgtacctacaacggatattacacgacctttgatgagagggagcgcggaagtctggaagcgggaaaaatagcggacatggtgttgctggaccgcaatccttacgacatcccgaaggaggaactggcttccgtcaaagtgaagcagctctaccttcgggggcaggaatataaaaaaggaaacggcggcggagccgcacagattctgcgcggaatgataaagcggggaaaatgctgaccggcatttttcccagttagggtgatcttacagatattttacatatcccttctaaattttacacaacgcacccgaacaattttacaaacctccgatatgatagaagaaataagaagctatcatatcggaggtttttgtatacatggaaaaacagacactggtatgggcgcaccgcggcgcaagcggctacgcgcctgaaaatacactggaggcattccggatggcggttgagatgggcgcggacggcgtggagctggatgtgcagctcacaaaggatggagaactggttgtcatccacgacgagacggttgaccgcaccagcgacggcagcggctgggtcaaagattttacatacgcgagaatttccagatttaattacaaccggacgcataaggaagggtacgagcgggcgatgatcccgacgctcgaggaagtctatgagctgttaaagccgacgggacttacgatcaatgtggaattgaagaccggcgtggtcttttatccggagatcgaagagcgcgtgcttgatctgaccgcccgcatgggtctggaggagcgcgtgtggtactcgtcgtttaaccactacacggtgcagcgtatcaaggagctgaatccgcaggcgaagaccggcatgctctactgtgacggaattgtcaatccggtcagctacggcgcgctcgtcgtgggcgcggacgccatgcatccggcgctctacaatctgcagtacccgaattacatggaagactgtaaaaagcacggaaagcgtgtgcatgtctggacggtcaacgaggagcaatacatgcgcatggtgtgcgagatgcaggtggacgccatgattacgaattatccggacgtgggcaggcggatcgctgccgagtatctggatggaacgctgacaccggagctggtgcgcgtgataaagaagcaggggaagcagggatgatgccggaggctaaaagctgtgcgaaagaggagaagactgcttatgcagtttggatggcagagacggtagaaccttatctgaaagagcacggcgagaagggctatcttaagatggaagatggcatgtcgatcgcttaccggcgatattctctgccggatgcggggaaatgcgttgtgatttcccacgggttttgcgaattcgcggaaaaatataacgaagtcgcataccagtttttgcgggcgggatactcggtctatgtgccggaacaccggggacacgggtattccgggcgcgaggtggatgacccggagttagtgcatgtgcaaagctatgacagttatgtcacggattttgcgcggtttgtggagacggtcgtaagccccaaggaggaataccggatcgtgtttgcacattcgatgggaggcgccattgcgatccttgcactggaacgttatccacagctgtttgaggcggcagttctctccgcaccgatgtgcgccatgcagaccggaaaatatccgcggtttgctgcacggctgctggcggagttctgctgtctggccggaaaaggaaaatgctttgccgcactggcgggacagcagggattttcagagacaccgcaatttgaggggagcagctgtctctcaagagagcgttatgactatatgtttcaaaaacggctcttagaggaacattaccgaacctacggcggaagttatgcctgggttcgcgcagggcttcgcgccagccgcgaacagatgcggcgggagaatctggcaaagatcaaggtgccggtgctgctttttgcagcaggtcgtgaccacatggtggataacggtgcgatcgcgcggtttgcggaggagacggagcggacaaagcttttctttatgccggattccagacatgagatttttaatgcggatgagcggacgcgtgcgaaatattatgatgaaatattccgctttattaaggaaaaagaggtaaaagattatgaaaacgaaaatgagcagactcgaaaaattctgggtactgtatgacgtcggaaattcggcgttcacactgctggtgtcgacgattataccgatctactacaaaaacatggcgtccgcaaacggcatcagcgcatcggactccaccgcatatctaagctacgccatctcgatctccacgctgatcgtggcggttttaggaccggtgcttggtgcggtcgccgacaataagaaccgcaagaagccgctgtttacatttttcatgatgatgggagtgctcggctgtgcggcgcttgcgattccaaggacctggattctgttccttgccattttcgtaattgcaaaagtcggattctccggaagcctcattttctacgattccatgcttgtggatgtcacgacggatgagcggatggatgaggtgtcctcccagggctatgcgtggggatacatcggaagctgcgtgccgtttgtggcgagcctcggtctgatcctcggcgcggacgcaatcggcatttccggcacggttgcgatgatgattgcattttttatcaacgcggcatggtgggtggttgtgacactcccgctgctgcggaactatcagcagaaatactatgtagaagcgggcggcaccgatgtgcgcgggatcttttccagactcggcaaagtctttgcggagatccgggatgacaaaaaggtgctgtggtttctggcagcgtttttcttctatattgatggcgtgtataccatcatcgagatggcgacttcctacggaaaagacgtcggaatcagcgacaccagccttctgatggcattgctgctcacgcaggtcgtcgcattcccgtgcgcgattctgttcggaaaactgacccagcgctttgcagcttcaaaactcatttcggtctgcatcggtgcctactttgtggttgcggtctatgcactctggctggatgcggcgtggaaattctggatgatggcaacgtttgtcggcgtatttcagggagccatccaggcgctctcccgttcctactatgccaagatcatcccgaaggaaaagtcgacggagtatttcggcatcttcgatatttttggaaaaggagcttcctttatgggaacaatgctgatgggaatcaccacgcagctgtttgatacatcaagagccggtgtggcagcgatcgccgctatgtttgttgtgggatttatctgctttcagatgcagcgccggtgcatggagggggagacgtcacagagcggtgcgatgggaggcgcagcgggttttgccaaagaatgattctaaaaagaaaaagaagcgaatagaaataaaggaaaaacaaaacggagaacaaaaattgccgaatgaggacctgttgagtgagaaactgttacagccgatggtgcagctatcctatgccgctgccatggatctcgtacaggcacgattaagactgatcaatgctgacctgacggaacaatgccaccgccaggtcattcgcaatatgtcctgccgcatcaagacgccggacagcgtcaccaaaaaactcaaaaagaaagggcgggaagtctcttttgaggaggcggtgcagactctcaatgacatcgccggcatccgggtcgtgtgctttttctgtgacgacatctaccggattgcggatgccatcaagaagcagaaggattttcatattatcaaggaaaaggattatgtgaaaaatcccaagaagagcggctatcagagtattcatgtgattgcgggcgttccggtgacgtacaacgacacggtcacggagatccgggtagagatccagatccgctcgtttgcaatggattactgggcggagctggacacacagatgtgttataagaaggatgccggacagatcgccaatgtggagcgcgagacgcgcggctactcggatgtgatcgcaaaggtggacaataagatgttagagctgcgccagcagatcgaaatgatgtgacaggatttttacacaggttttacataagtgctcttctgcattttacattcctcccgtaaagtaaaccatgttctaagaaacgaggtaaaagaaaaaacggagaagaaattccgtaaaattgaatggaggattcaaaatgaagaagaaagtaatgtgtatgttattgacaggtgttatggcagcgggcatgttcgcaggatgcggcagcagtgatacagcagacaccaccacagatgcagcagcaaccacagatgcagcatccaccgcagacgcagcagataccacaagcgaagctgcaccggcagagaatgcagatttcgatcatacatcagcaatcgccgtatattcccgtgaggatggttccggcacaagaggagcattcatcgagctgttcggtgtggaagaaaaagatgagagcggcgagaaagtggataacaccacagaggaagcgatcatcaccaacagcacggacgttatgctcacatcggtagcaggtgacacctacgcaatcggttatgtatcccttggttccttaaacgacacggtaaaggcagtaaaaattgacggggcagaggctaccgtagagaacatcaagagcggtacctacaagatcgcaagaccgttcaacattgcaacaaagggcgaggtcagcgaggctgcacaggatttcatcaactacatcatgagcggtgacgggcagaaagtaatctccgacaacggttatatcggagatgattccgcagcagcattcgagtccaacggagcagaaggcaaagtcgtagtcggcggttcctcttccgtatctccggtaatggagaaactgatcgaggcttacaaggcagtcaatgcaaatgtggagatcgagcttcagacaagtgattctaccacaggtatgaccggagcagcagacggcacactcgacatcggtatggcttcccgcgagttaaaggattccgagactgaggaaggacttatcgcaacgaagatcgccatggacggtatcgcagtgatcgtaaaccaggagaacccggtagaggatctctcctctgacaccgtaaagggtattttcacaggcgggacaacaacctgggatgcagcaaactaggacggacagcagaaatagcatagcaggacggaccgggggaacagaatgttcttccggtcctttcgtggaacatacacattatttaggaaaaacctgtaaatggaggttctgatgaaaaaaagagagaagatcatggaatatgtatttctgttggctgcggtcatctccatcgtggcggtggcgctgatctgcatattcctgtttgcaaacggaattccggcaatgaagaaaatcggatttgcggaatttctgaccggaaccaagtggaagccgggaaacaataaattcggtatcttcccgatgatactgggaagtatctatgtcaccggaggcgcgctgatcatcggtgtgccggtcggtgtactcacatctatttttatggcaagattctgtccggaaggactgtacaagctcttaaagccggtcgtgaacctgctggcgggcattccgtctatcgtatacggatttttcggactggttgtgctcgtaccgttcatccgggagcattttaagaacagcaacggacagagtattctctgtgcgtcgattcttctgggaatcatgatcctgccgaccatcatcggagcgtccgaaccgacgatccgcgcggtggagcagagttattacgaaggagcgctggcgctcggggcaacgcatgagagaagtgtctttactgtcgtggtaccggcggcaaaatccggtattctggcggcggtcatcctcggcgtcggacgtgcactcggggagacgatggcggtcatgatggttgtgggtaaccagccgcgtgtcccgaacagtattctgcagggcgtccgcacactgacgacgaacattgtcatggagatgggctatgcgacggatctgcaccgggaggcgctgatcgctactggcgtggtgctgttcgcgtttattctgatcatcaatctgtgcttctcggcaatcaagcgaagcggaaaggagtaggggatggaacagataaatccaatcaacaaagtaacattaaaagataaaatgaaatcctataccagacatcccggctctttgatcctgctgcttctggttttgattgcagccgcgctcacggtggtgacgctgctttttcttgtggactacatccttatcagtggtattccgtacctaaagccgagcctgtttgcattacattataattcagacaatgtgtccatgctccccgccatcatcaacacggtggagatggttgtggtctcgctgctgttttccgtgccatttggtgtgggggcggcaatctacatgatcgaatatgccagaaagggcaataaattcgtggaggttgtccgtctgacagcggagacgctgaccggtattccttccattatctatggtctgttcggtatgctgtttttcaacattgcactgcactggcgctattccatgctctccggagcggcgacgctcgccatcatggtgctgccgacgatcatgagaaccacggaggaggcgcttttgtgtgtgccggattcctacagagagggaagcttcgggttgggcgccggaaaactgcggacgatttttaagattgtgcttccggcggcaatcccgggaattctatccggtatcattctctcgatcggacgtatcgtcggagagaccgcggcgctcatttacacggcgggtaccgtgaccggtgtggcgggacttatggattccgggcgtacgctcgccatccatatgtatgtgctttctaatgaaggtttacataaaaatgaagcaaatgcgactgcagtggtgctgcttgtcattgtccttctgataaatggagtctcatccttgatcgcgaagcggtttgaggcagtgaaagaatagcgcacagcgcggaaatgaggaaaacatgggagaaaagtttaatatatcgaatctgaatctgtattatggcgatttccacgcgctcaaggacgtggatctgtccattaacgaaaaagaaattaccgcatttatcggtccgtccggctgtggaaaatccacctttttaaaatgcttaaaccgcatgaacgacctggtacagggatgtaagatcacaggacaggtgctgctcgacggggaagacatctacagcggcatggacgtgaacctgctgcgcaagcgtgtcggcatggtattccagaagccgaatccgttcccgatgagcatttatgacaacatcgcatacggaccgcgcacgcacggcatccgctccaaggcaaaactggatgagatcgtggaaaaatccctgcgcgatgcggcgatctgggatgaggtgaaagaccggttgaaaaagagtgcgctcggaatgtccggcggacagcagcagcgtctgtgcatcgcacgtgcgctggcggtcgatccggaagtgattctgatggatgagccgacgtctgcacttgacccgatctcaacctcgaagatcgaggatctcgcggtggaactgaagaaaaaatacacgatcattatggtgacgcacaacatgcagcaggcagtgcgtgtgtccgataagaccgtattcttcctgctcggcgaggtcattgagagcggagatacggaaaaattgttctccgtgccgcaggataagcggacagaggattacattaccggacgtttcggttgatgaaaggagcaagcaatgagaaacagatttgagagacagctgttagaactgaacaatgaactgatccagatgggaagcatgattgagcacgcgattgagatggggatctccgcgctggtgcgccaggatgtggagaaggcgaagaaggcgatcgcctacgacgaggagatcgacgagcaggaaaagaccgtggagtcgctctgcatgaagctgctgttgcagcagcagccggtcgcaaaggatctgcgtctgatctccgcggcattaaagatgattaccgatatggagcggatcggagaccatgcggcggatatttccgagatgacgattctgatgtccgatgcgacatacgagcgcagcgcgatcaacattgatctggtggaaagtatggcgaaagagactactgatatggtcatcaagtgcgtggacgcattcgtcaacaaggatctggagctggcgcgcacggtgattgcgcaggatgatgtggtcgatgatctgttcgcggactttaagcagcagctgatcaaaaagattaatgagaacgtcaaaaacggcgagcaggcgacggatatgctgatggtggcaaaatattttgagcgtatcggcgatcacgcgacaaacattgccgagtgggtcatctattcgatcacgggagagcacgagaagtagaaaattggtctaaaaaccgtgattttacacagattttacataaagcttaccggaaaattacctgaaattaaaaaattttaccgactccttggattgtaattgcaaaacgtcaaaaaatacgttataaatgattatgtatgcgtatgtaaaaaagatgtaaagcaatgagatgcaaaggagattagaatggatatttttggagtattgtccctgattggcgggctggcattattcttatacggaatgcacgtgatgggtgcaggactggagaagatgtcaggcggaaggttggagcgcattctggagaatctgacatcgaatccgttaaaagcggtactgctcggtgcaggcgtcacagcggtcatacagtcatcttccgcgacaacggttatggtcgtcgggtttgtaaattccggtattatgaagctttcacaagcgatcggaatcatcatgggtgccaatatcggtacgacgattaccgcatggctgctcagcttgacgggaattcagggagacaacctttttataaatatgttaaagccgacatcgttctcaccgattctggctatgatcggtattattctgctgatgtctggcaagagcgataagaagaagattaccggagagattctgcttggattcgtcgtgctgatgtacggtatgtcggcgatgagtggtgcggtggagccgcttgcggacgtgccggagttcacgaacctgcttaccatgttcaagaatccggtgcttggagtgcttgcaggagcgctgcttacggcggtcatccagagttcttccgcttctgtcggtattttacaggcgctttcggtaaccggtggatttacatttggcacagcgatcccgattattctgggacagaacatcggtacctgtgtgacggcaatgatctccgcaatcggtgcgaacaagggtgcaaagcgtaccgcgtttgtacatttatatttcaacatgatcggtacggttcttttcctgtgcctgttttatctggggaatgccattttcagctttccgtttacgaacgacgtcgtaaatgcagcggatattgcgctggttcacagtatttttaatgtatttactactctggttctgcttccgtttacgaagggactggagaatctggcatatcttacgattccgaagacagaggatgagaagaagacggcaaacgatgcgtttgtaatcttggacgacagattcctttcttcgccggcattcgcgatcgagcagtgccgttcactggtaagccagatggcagagatgacaagagacggatttctggaggcgatggacgtgctgggcgagtattcggaggagaaagcgcaggatgtcattgacaaggagaaccgggtcgatgtctatgacgacaagatcaccgcatatctgacgaagctgagcagtgagaatctgtcctataaggacagcctgcaggtgacgtcgctgctgcactgtattacggattttgagcgtatctccgaccactcgatcaatgtggtggagagcgtacagcagatgcgcaaggaaaatctgacgttttccaggaaaggtgaagaggagatgaatctctacggtgcagcaatccgtgacattctgacaagaaccacggatgcgtttgtgaacaacgatcaggcactggcacatacggtggagccgttagaggaagtaattgatgaattaaataaagatgtgaagaaacatcacatgaagcggctgcgcaagggcaaatgcagtatggaactgggactgctcctgtcggatctcgcaatgaattatgagcgtgtggcagaccactgttccaatattgccgtgtacatgatgcagctgaaggatacacagctggaggagcacagctttacagagcagctggatgaggcggagagcgcagagttcaccagactgctggatgagtttggaagcaagtacgcgctgtagtctgtatcttcgatctggtgtgcacagggagctgtggaagagaggagaacaatggcaaccatttatattgtggaagatgacgtcaacatccgtgagattgagcgctatgcgctgaagaacagcggatatgaagtggaggaattcgagagcggtgaaagcctgttcaaacggctggagcgggcggttccgtcccttctgctgctggacatcatgcttccggatgaagacggtctggagattctgggaaagctccgggcgaataaaaatacggcagctattccggtcattatggttaccgcaaagaccagtgagctggacaaggtcaagggattggatctcggagcggatgactatatcacgaagccgtttggcgtgatggagctgatttccagagtgaaagcgctgctgcgcaggacgcagagtgcggcggaggagacaaagatctgccacggcgagatccggatggacaacgacaagcatgcggtatttgtcgggaatgagccgtgtgagctgacgttcaaggaatatgaattgttgaaatatcttatgatcaatgcggggattgtcctgtccagagacaagattatggatcaggtatggggctttgagtacgagggcgagagccggaccgtggatatgcacatcaagacattgcgccagaagcttggggcggcgggaagctgcatcaagacgatccgcaatgtgggatatatgatcgagtagacaaaaacctatgaagaaaaaattaaattccaaatttatgttgattgcggcaatcgccattctggtgactgccgtatgttctatcgggctgttttacagcattctggtacaacagatctatgatgacttaaaggcaaatgcacatgtgatctcccggctggattttgaggatgcgtcgcagaaagtgtgcgatcagctttccgaggatgggctgcggatcactttgattgctacggatggaacggttctctatgacagcatggaggacgagacgaagatggagaatcacagggggcgtccggaggtcgagcgggcgcttgcggtcggggaaggccgcgggatgcgcaaatcgacgacttccgcggagcacacattctattatgcgatgcgcctctcagacggaaatgttcttagaatcggaaaagagagcggcagcatctaccatctggcatggaatatgacgatgcttacgctgggtgtgggattgtgtgtattcctggtgtgcgccttttttgcaaaacgcatgacaaagcgctttgtggagccgatcgaaaagatggcggacaacattgtgctcgtcgatgagcgggaagtatacgaggagatgcgtccgtttgtgtcgatgatcaagcagcagcatatggatatcttaaaccatgcacagatgcggcaggaatttaccgcgaacgtatcgcatgaactcaagaccccgctcacggcgatctccggctacgcggaactgatcgcaagcggcatgaccaacgaaagcgataccgagcattttgcaaatgagattcaccggagtgcggaacgtctgcaatctctgattaacgacatcatcaagctctcggagctggacaacagcgaccttaagctggagtttgagccgatcgatctctatacgctggcgacgacctgcatcgatcagatgcagatagcggcgcagaagaacgaagtcacattgctgcaggaaggcgggccggtcacgatcaacggcaacaagacgctcatcgaggaactgctctacaatctgtgcagcaatgccgtgcgctataataagaagggcggcagtgtgactgtcattacgggcatgaagaatcagagaccggcgctcacagtacgcgacaccggcatcggcatcccgaaggagcagcaggatcgtgtctttgagcggttctaccgtgtcgacaagagccgttccaagtcgacgggcggcaccggactcgggctcgcgatcgtaaagcatatcgtcgtgcagcacgaagcccagatcgaactctccagcgaggagggcgtgggcaccgaggtgacggtaatcttctagcccgcgcgacgcggcagaaaccggggcgctttggtatattatgacggcggccggagaaatccgccggattctgccagttgccgggagtcgcgattcgatcgcaaaaccggcggtttctaacaatgccgttctcacatctgcgatcgtccgtgtctttccaagctttgaacacgctatggggagtgttcgcacagcaaaagacaattttaaaatttttgtgcagtgcttggcacaccggtgagcaaaatataagaaattgtcgcaataagcaaagatctctttgaagtgataagtaatattacaggaataccagagaacaaaaagttccagaataaacagacggcggcaaattctttgaagcaaaattcgtgtatttcttccatgccgtggctggcatcccattccgtgtcttggccacgtttggacactcacggagtgtgtccgacaagccgcagacaatgagcggactttttggtgtccctaatggcacctcttcacagacaatataaaaccgcgcgaaccgaacttgccggcatctgctattgaaaataaggcagatgccaactcagacatcggcttcgcgcggttatgttttgttcgacataaagatggcatttatgccatcttttgtctggtgccgcaagggacacacacaaaagtcctaaaattgtctgccggcttgcagacacagtccgtggagtgctccaaacttggaaagacacggatcatcacggatgccagctgcggcatggttagaaataccggattttgcggtcagaatttgccgccgcatgtttatctggaacttttaagtatctatttctcgtaatattacttatcaaagcaaagtgcgatatgcttattgtgacagttccttttattaaatctgtaaagaggtgtaccaagcgctgcccaaaagtccactcattgtctttgctgtgcggacacacccgcatagagtgtcaaagcgtggtaagagacacgaacccggacgttccattcggcatggaagaaaccgcgctattttgctcaaacgaatcgtgactcccggcagccgacagaagcttgcggatttcttccagacgtcagcatgaattgccgaaccgccccgttctatgccgtgtggagcgcctgccgggagattgctgtctcggcgtcggtgtccgcgtcgtgcaggcggtggtactcttcgataaaaccgttcattttgccggcttcggcggcaagctctgcgatgacgttgttgacgctcttgaagcgctctgcattgtcggtacacattgcgttggtctcctccgcggaggcactgatctcctcgcttgtcgaagagagcgtgttggtctcatcgaccagcatggtgttggtttctcttaaaatgcgtgtcttttctgagattgcagcggcattttgttcaaggccggtaagaccggagcggatgccgctgaaattttcttcaatatcatgaatcatgctgacctgattgccgattttgtccatgacatgatccatggaggcaatcgtgtcgccggcatttttgttcagctttgtgatgatttcttcaatattttcagtggactgtttggtctgctcggagagcatgcggatctcctccgcgacaacagcgaaccccctgcctgcttcccctgcgcgcgctgcttctatcgtggcgttcaaggcgagaagattggtctgtgcggaaatctgctggataatgctgataatttttaacatatcctgcgtgtgtgcctgcagtgcagtcatattttccttgacgagcttattctcagattctacttccgccgtctgggtgacaatgctgctcacgagagtctgcccggtagctacatttttaccggaagactgggagatgttggtaagtgcgtctgcgatcgacacggtatcggcaatgatgtcctgaatccgtccggtcatggaagcctgttcctgaatgcttccgactgtgctctccatgcttacggtaatgtcgcccattgcctggctgacgcagccggttgcctctgtcatctcctcgatcagtgcatgaatggactgggtggattcattgacggatgtgccgacggtcacgatggaattcatcatatcctcctgctttttcttgtgggcttccagttcggcgagttcctctgtgttgtgcaggacggccacgcgggacgccaggcaggtgattgtgttgatgacaataataatggagcagatcacaaagatcatattggtttcggaaagagagttggttccaagcacatggacagagtaaacaccgtttaaaatacagcagaccatatttaatactccggcgcagatttccagcttcaggtcaaagtacattaacagtgcgacaagtatgggaatcataaagagattatagacaaaaagttttgaggatagacagctgacttcataaatgatcagaaagcatgtaatcgctacattgcggtagcgtatggaaacaggattaaaaaaatagaacaatgtactaacagctgcaggaagggcaatcatgcctgcaatgacaaaaagacggaaaagagcatgatttccctgcagaattgttcctataaacagaaacatcatatagatggaaatgatgagaactgtaagcatcagacaatagttggcacgctttgtggagcgttcctgtaacgttaactctcttgaatcgttcatgatagacctccttttcctgtacgaaagtaccagatgtttgtgatactaacatagaccttggtgcaggtctaaggtcaataggaggttgaaaaaatcaggagtcttccaacggaagatatacttcgtaataatccaggatgacatccggctgtgctatgctgaagacgtagaaagcgtaagcttccggtttgcaggaaagctgatgttccccggcgtatttcaggacggcggagagatcccagagtatctcctgctcgggcgggaatgcgactacggtgtagagacagcggcagctgtcccggctgggcagattggtggaattgagctgggtgagagcaagcatcggctcgcggatggcaaactggaaggcgctgacctggcaggaaccggacggttccacggagaggatgtagctgaaattcctcatcgaaaacaacggagaatgaaagacatcctttagcgtgcggtaacctaaaaaagcggaatcctgatggtagagcggatagacagcgggaagcgtccggatgcttatagtgcggctgccttcatccagggtatccaggtgctgtttcatataagacattttttcgacttccagggtaagccgcccgatctcttttttgcgcgaatcaatgaaaccggaaaagctttcggaaagatcaccaagggtggagacagcgagaagccgcttgatctccgcgatgctcacgttgagcttgcggtagagacagactcccatgatgcggtggatctgttcggtgtcatagcagcggtagccgttctccggattgcgggtgggtgagacaagaccctccttctcgtagagccggatggcgtcggtggagatattaagcaaaccggcaacttcatggattgtatattgtatcatgacagacccccataaaaaataagaagtatttcaatcacaagatatgtaccattgtaccatattttgacaaaaaaattaaaagaaaagaatgaagaaaaaaggattttatggtacaattatatgtcagagaacagagggcaaaagcaggaggagaggttatgttttccgtatcggatatcaaagaggatgtgtatccggcagtctaccggagaggaaaggaattatatgagacagggggcgtgctggatttcgcgtatgatatttatctggagcatgatctgcccgttgccgaggtgcgagcggaggtacgtgggaaggaacagagcagctaccgggtgacggcggttgtcgatgaggagtacggcacggtgtcaagcagcaactgtacctgcgaagcgttttataattatgagggaatgtgcaaacactgtgtcgcagcgcttcttgcttatgttaaccgaaggcaggcgaaggacattctggctgcgaagcgcaccggacatgaggcgggggagcagggaagcgccgcggaggagaagcctgtcgccccgatgcagacggcaggagcgttcaagacgcttttgaaccagtattcactgcgtgccggtgtgagctatctgattccagagagcgtctatggaaaggtggaactggagccttattttaagctggattacagttatgcgacggtggagtttaagatcgggatggagcagaagtatgtattaaagaatatttctgcctttttacattccatcgagcggaatgaaaaggtgcattacggaaaaaagctggacttttatcacaacagacaggcatttacagaagatgcatggcggatggtagagtttatgcggatgcaggatgacgacaagaagcgccagagcagatttcatgcctattatgcttacaccgggggatatgagcgcacgatggagctcgatgaggtcggcatcgaccgtttttttgacgccatcggggaaatgccgttatctgccgaaatcgggtatctgccggaggaggagtatcatgtgcaggaggaagagcgcaagccgaagcttgagatccgcgcaggggcgtctggtgttttcgttctgctggaggatctgcaggtcataaggggaagcagattttactatttttatgaagatggcatgatctatcgcagcagtgaggcgttaaaggcgaagacgggagactttttcgactatatggagcgtcaggccggcggggaatgttacattgcggcggatgaactgccgtcgttctgccgggatctgctgccgcttttaagggagacgttccgggtgacggcggagggcttcgatgagacgctctatgtcccgaaaaagccggagtttgagctgtatctggacaagcaggacaaccagacggtcggtgcgaagctggtcgctgcctacggggacgacaaatataacgtattacagaagattgagccgggcgaggtccgggatctcggggaggagatgcgcgtgcgcacgctggtcgagccgtacttcaacgaatacgggctcgggcagacgatattcatcctctcgcacaatgaggacatgctctatcagctcatcagcagtggtctgcagcgcctcagcgagtatatgtcgatctacacgacggaggatttccggggaatgaaagtcgtttcttcaccgtcggtttcggtgggcgttgcgctaaagagcgatcttctggaactgcagattcactcggatgagatgtcgcgcgaggagctggcatatcttctgacccggtacgatcggaaaaagaaatacgtccgtctgaaaaacggagattttcttgatgtgcgcgaggatggtctggggctgcttgcggagatcagtgaggatctccgcctgacagaatccggactgaaaaaaggtcatgtgaacgtaccaaaataccgcgcgatgtatctggacgcggcgttaaagagcaatcaggagctttccgttgagaaaaaccgcgagttcaagggcatggtccgcaatatgaagacgatcgaggacagcgattatgaggtgccggattcgctccgcagcatcatgcgcggctaccagaagagcggttttctgtggttaaagacactgcgcgagaacggattcggcggaatccttgcggacgatatgggactgggcaagaccctgcaggtcatcagtctgctcttgtcggaacaggagagtgccgaggcaggagagcgggagtggcaccgttcccttatcgtatgtccggcgtcgctcgtctacaactggcagaaagagatcagccgttttgcaccgcagatcaagacgacgctcgtgaccggactcgccacagagcgccagaggattgtcagacacacgaaggaaggggaagtgctgattacgtcctacgatctgttaaaacgtgacgtggagctgtaccgcgatatggtgtttgcgattcaggtgatcgacgaggcgcagtatatcaagaaccctggaacccaggcggcaaaaggcgtcaagcagattactgcgggtttcaagctggcgctgaccggaacgccgatcgagaaccggctgagcgaactgtggagcatttttgattatctgatgccgggatttttatatacttatcagcggttccgggaggagatcgagatcccgatcgtggtaaacggggatgaaaaccgtatgcagcgcctgcagcgcatgatccggccgtttattctgcgccgtctgaagggggaagtgctgcgggatcttccggcgaagctggaggagaatgtcttcgcgaagctcgaaggagagcagcttgcgctctatgacgcccatgtgcagcgcatgaaggagagcctggagggcaaatccgagaaggaattccgctccgagaagatccagattcttgcggaactgacgagactgcggcagatctgctgtgacccgggacttctgtttgagggctataagggagaatccgcgaaggcgcagatgtgcatggaactgatcgagaacgcggttggtgccgggcacaaggtgttattgttctcgcagtttacgtccatgctggaacgtctggcggcagggcttaagaaggccgggattgactactatatgctgaccggttctgtcggcaaggaaaagcgcatgcagatggtagagagttttaatgaggacgacgtgccggtgttctgcatctccctaaaggcggggggaaccgggctgaacctgacggctgcggatattgtgatccactatgatccgtggtggaacgtggcggtgcagaaccaggcgacggaccgcgcccaccgcatcgggcagaagcatgtcgtgacggtctacaagctggtatccgagggaacgatcgaggagaagatcattgcgatccaggagcgcaaaaaagaactggcaaaacaggtgctcgagggggagggaatggattccgtttcctttaccaaggaggaaattctcgaacttctgggataaaaaggttgtttttttgacaaatttggttgacaaaaaatgcgggctgctatatagtaaggaaacagcgttattgatgaatgcagattccgtgagggagtagttcgcgcagagcgtgatttgtcaacagaccggtcagacagcctgacctggcaaatcttaaagaatgagactcatgtatatctttggtttcacatcgcagacggagacggaagcggtgcgcagaggatatacatcagtctctttttttatgtgcgcgccgacggaaaatgcatcattcgggctggatgtgtatgtgtgccctgtggcaggggcagaataaaatgtggaggttggtatggctgtttttattgaattgctgctcattggagtgggcctttcgatggacgcgtttgcagtgtcgatctgtaaaggtcttgcgatgcgcagggtaaacaaaaaacaggcgtttgtgatcggtctgttttttggaggatttcaggcgctgatgccgtttatcggctgggcgctcggcacacagtttgagagctacattaccagtattgatcactggattgcctttgtgctgctggtattcatcggcggcaagatgatcgccgaggcggtgcgtccggaggatgagaatgtggagatcgacaagctggatccgccactcgacttaaaagagatgcttgtgctggcggtggcgaccagtatcgatgcacttgcggtcggaattacattcgcatttttgaattacccgatcggggaggcagtcacgatcatcggtcttaccacgttttgtatctccatcggcggcgtctatgttggcaatttttttggaaaccgctataagaaaaaggcagaacttgctggaggtattatcctggtgctgatcggcgtgaagattctgctggagcatctcggatttgtgggataggtgccggattaccggaagtcgagataactttgagaaaataattacagtagagaaaacagagaggaatggagattattatgacagaaatgctttgggcagctgtgctgcttgttgttggatttgtgcttctgattaagggagcagatttttttgtggagggaagctcttccgtggcaaagatgctgaaagtgccctcaatcattataggacttacgatcgtggcgatgggaacaagccttccggaatgtgcggtcagtattacggcatcggtaacgaacaataatgcacttgcagtcagcaatgctattggctctaatatttttaatctgatggtggtctgtggattctgtgccctttttaatccgctctatgtggaaaagagtacgctgaaaaaagagtttccgttttctgtggtctgtgcagtcctgcttttagtctgcggatatctgggaatgcagcttggcagggcagacggaatcatcctttttattgtatttgtcgcttttctggtctggatggtgcgctcggcactgaaagcgcgtgctgctgccggagatgatgagtatgaggtattgccggtgtggaaatgtattgtgtttatcgtcggcggtattgtggcgatcaagttcggtggggattttgttgtaaacggcgcatccacggttgctgcgaagctgggactcagccagaatctgatcggacttacgattgttgcctgtggaaccagcctgccagaacttgtgacctcagtggttgcagcgcgcaaaaatgaactggatatggcgctcggtaatgtgatcggctccaatattttcaatattctgtttgtgctcggtatcgcagcaacgatcagtccgatcacatttatcatggaaaatgtgatcgatattgtgattctggttgtgatgagcgtactggtgtgggcgttcgcctggacgaagaagaagctggaccgcttcgagggcattgtgatgctggcgctctatgcggtctatcttgtgtatatctgcatgcggtagtatgaaaagattttgaagaaaaagatttttcctgttttttcgattgctgtaaaggaaaattggcgttatactggggaaaagaaaacgacagggaggaaaacttcatggaattttttgataagttaagcgagtcactggtaagtgcggggaaggatgtcagccagaaggcgaaggatgtatccgagattgcaaagttaaagctggatatcaagtccaaggaggactatgtgcagaagcagtatgaggagctgggacgctcttattatgagaagcacaaggatgaggaagaatgtgaagaagcagagcagtttttcctgatcagggaagctgtggaggagatcgagcgcatgaaagccgaggttctgcggatccagggttctgcagaatgtccgaagtgcggtgcgaagatgccggaaggtgctgtatattgcagcaactgtggtacgaagatggatgatatgtatgaggaagagtagcagatacgcggcataccttccgtttgtgctggtggcggtgatcggactggtctaccacgtcgggatgaagccgatggcgggggacgacatttttttccgggatgccacaaaagacacgacgctgtgggcgtatctgacgcagcgctatctgacctggacgtcgcgcgtggtgtcggagtgtgtactggtcaatgtcatacagtgcccggttttgtggagaatcattgattttctgctgtttgcgacgctgcctcttctgctgtccggtcttttcggcggcgggaagatgatgaactggtgcgcggcagcggcggttctgatttttccgtttcatgatatgggtacggcgggatggattacgacaacagttacacatttctggccgttctggggatttttttatgtggcgtgggtgataaggaagcttgcgcttgcggagaaaattcacccggcagcggcagtgtccgcggttcctgtcgcggttgtgacaggaagtcatgaacagtatgccgtgattatgacgctgctgctcgtgcttagcggcgtgtatctgtggaaagcgcacagaaggccgggaaatgcagtgcttttttggactcttgcggtgatcgatgtggtttcactgctcgtaattgcactctgtccgggcaatgccggacgcaatgcggtcagtattgcggatcttccggtttatgcgacgtttggattcggacagaagctgtatctgggacttttgagtattgagcgcgtgtttattgccaatgcggacattgtattttttctggtggtgctgatctggacatggcttgtctgggagaagacaaaagattaccgcaggacgtttctctcggcgcttccgctgctcattctgttcgggcagacagtgttaagaactgcatatccggggctctcggggctgttcgtgatgccgggggagattctggagtggagctggagcgatctgtcgacgtggattcctatggtgtatctggcagtgacggtggcagcgatgatttatgcgctgtaccagctgttcggcgacgatctgtttaccttcatcagcgtgctgcttctggtggggtgcggctttggtgccgggatggtgctgggctttatggcgacgatctacgtctcgggagagcgcgtgtatgcgccgctgtacgggattcttctggcggttacactgtttggcatctgccggcagcgcaacgtgtggaaggagccggcggctgtggcggtatctggacggaaagcagagccggcggcggatgcgggcgtgactgcggcggtttccaaagcggctgtgccttccgcagtgtttctgacggcgctgacagttgtctgttgtgcggtgaacgtattgtttatcgttttgtcattgtaagatggaagtataaaagatagaatataagtttcatacagggagcagattttacagggcagaatctgctccctgtttttttaatacatagtcagagagaggatataatccttaaaaaatagatccagataaaggtgaaatgaaggttgttgaaggtatagagggaaattgagaaatggaatcgaataagaaaaggaaaaatataattggcattacacaaagcggtcttatattggtattggtagttcttattgtctttatgatggtacagattaacaggttacaggggactgcacgggtaataaattatgcaggtctggtacgtggagccacacagcgtgaagtgaagttagaaattacaggaaaccagaatgaagaattagttcaatatctggatgatattctgagcggattaagatatcaggatggacattatgatctgataaagcttcatgataaagaatatcaggataaattacaggttcagagtgactactgggaaaaattaaaaatagaaattgaagcggtgagaagcagaggatatgaaaatacagatattgtaaatatgagtgaaacttattttaagatggcagatgaaacggtatctgcagcggaaaattattcagaaaagattgcgagaaagattcgtaccatagagattttgtcagcacttgatatgttgtgcctggtaatattggttattatgcagacgctgatggcaatgaagatggcagtgcaaaacaagctgttagaacagagggcatatacagacagccatacaggattacccaataaaagtgcttgtgagataatacttaataataaagagatcattaatgaaccgacagcatgcataatgtttgatctaaataatttgaagacggtgaatgacacaatgggacattcgtcaggagaccagctaataatgaattttgcccggcttttacgcagtgtgattccggaagaagattttgttggaaggtatggcggggatgaattcatggcagttatatatcataccagtaaagcggaggttgaggatattttaaaatacttacgcagggaaaaagatagattaaatggcaatgaaaatcctatgtcaatcgattatgcatgcggatgggcgttatccgaagactataaggaatgtacaatgcagatattattggataaggccgattcttatatgtatgataataaacaattatgcaagcagcataccctttaggtattttatggagcgtcggcaggctgatcggaattgcgttggagcagcttgaaaagtgaaatgttttcccatgtttttatttgacaaaagaatgcggcagtgatatatataacatattctgttatatatatcactgccgcgcttttgttgtgccggaaaaatattgctcatcatgccaaagaagcgcagaaatacaggcagaaagtacaggaggagaccgatgcttaccatcatggagcggaagaagggcgagtccgcgcgggattacgtgacgcgggtgctcatagacaatatcgtaaacgtacatttggaaccgggggagaagctgctggaaaatgatctgagcgggcagctcggggtgagccgcacgccgtaccgggaggcggtacttgcgcttgcggagcggcagctcgtgcatataagaccgaagaaaggcacctatgtgtcgcacattgatttgaaactggtcgaggaggtgcggcatctgcgcagcattgtggagaccgagctggcagtcatggcatgtgaccttctgacggaggaagatctggatgtgctgcgcgagaatattgccatctggaaaatgtacatggagcggaagcagacggacaagatactgcaatatgacaaggaatttcaccggcatttctatgagatgtgcgaccggaattactggtatacgcttctggagagcctgtcgccgcattttgaccgcacgacggtgttaagcttccgctgccgtccggtcaacggcattgtatccgaccacgaggagctggtggatgcgattgcggcgagggaccgggagcgggcggcggagaccgcaagacggcatatgctccgctacaccgagaacatcgacacgatccggcaggcgtttccggaatattttgcgtaggaaaggaggcagagggttatggaactggcaatcattacggcaaaacaggttgtgatactgtactgtctgatcctggccgggtttgcgggtgtaaagagtggtgtcataaagccggaggcaaaaaaggcgttttccaatctgctgctctacctggcggtgccggcgatggtcattcattcctatatctcaaaggcagaccgctccgtgcttgccagactgccgcagacgtttgcgttcagtgtgcttgcgattctggccggacttgcgattacgatgttatgtacctgccggatgaaaggaaaggaacgtccgatcctgcggtttgcctgtatattttccaatgcggcatatatggggttcccgctgatcgaggcgctgtttagcgcggagggactgatctatgcgagtgtgtacgtgacggtgttcaacattctgctgtggacggtgggatttggcatgattacaggaaccgtggagccgaaagaggtcgtccgcacagtctgcacaaatccggtgctgattgccgtggtgatcggactggtgatctacctgtgccagattcctgtgccggaggtgatcgaacagccgctcgcgctgatcggaaatatgaatacgccgctctccatgattattaccggaatgatgatcgccggaagcaatctggcgcagatgctttgcgaccggcgcattttatctgtgatgggaatccgcatgctgctgatccctgccgtgtgcttcgcgctgttttttgcatgcggcttttccgggatggctgcaggcgtggtgctgctgctggaagcatgcccgagcgcggcgatcacctccgtctttgcggtgcagtattcgtatgatgaagaatttgcggcgggcagcgtggtcattacgaccctgctcagcattgtgatcctgccggtatgcgccatgcttctgccgggaatgtagaaaaccgcgggaagaagtcatgtggaagccatatagcgggaagaagccatatggcggaagaacccggagatggcatgggaagcaggcaggataagaaaaaggagagagtcacatggaaatcagatgtgtgtatacagaaggaaatcagaatgtcattcaggaggcggtggatcgccttcctgcgtcgggaggtacagtaatcgtgccgcgcggcgagtggaaaagcggtgcaattcatctgaaaagcaatgtgaaactgtatctggaagagggatgcgtgattcatttcagttcctgcatggaggattaccttccgccggtatttacacgctgggaaggcgtggaatgttacaattattcgtcgcttatctacgcggcagactgtgagaatgttacaatctgcggcaccggtgtgttagacggtgcgggaagcgcgtggtggcactggaaaaagctccagcagaatgcggcggatcgcctgatccgggcggaaagtcaggggattgtggtagaagagcgcgtatttgcgaccagggaggatgcgctccgtccctcgttcatccagttcataaattgtaagcatgtaacgctggaagattttacgatcgaggacggaccgcagtggacgattcatccggtgtactgtgaggatgttgtggtgcgtggggtgacagtgaacaccaagggaccgaataccgatggctgcaatcctgactcgtgcaggaaggtactcattgaggactgtacctttgagaccggcgatgactgcattgccatcaattccgggatgaacgaggacggatggcgagtgggacgtccctgcgaacagatcgaggtgaaaaattgccgctttataggaggacacgcggcagtggcaatcggaagcggaatgtccggcggcatttgtgacatccggatccatgactgcgtggtcagagggaccgagcgcggcatccgcatcaaatccatgcgcgggcgcggtggctatgtaaagcggatcaatgtggaacggatgcagatggatgagatagaaaaggaagcgatcgaagtgagcatgaattatggttccagcacggcgatgccggtgtcgtagaaggtgccggaattttcggagatccgttttgcccatataaggggaaaccatgcagccgtcggtgtctcgctctgcggactgccggaaagtccgctgcgaaaacttaccctggaagacgtggtgatcgatgcagaagacccgctgcgggaggagtatgtggaaaagtaaaatactttttctcggggctcctgtgcttacgaacgcttgactttccgcaggtttggtgctaatcttaaaaaagtcgatacacacaaacacgaggaaaaagagagtacatctgcagatactttacagagagatttccagctgcgcggttgcagcttgctgcgaggaaatgaggaagggcggatggaagatggctttggagtggcaggactgaacactggacgttactaaggacagcgataagttctgacgggaccgcctgttacagcgggggatattggttgcgatatccacagaggcacagagtgcagattctgtgtgaatagaagtggtaccacgggagttatcccgtcttctggtggctatatcagccccgaagacgggattttttgttttattaggaaggagcagacaaaatgagtgacaagggaaaattttacatgacgaccgcgattgcctacacatccggcaagccgcatatcggaaatacgtatgagatcgtgctcgcagatgcgatcgcgcgttataagagactggagggctacgatgtttatttccagaccggaacagatgagcatggccagaagattcaggagaaggcagaaaaagcaggcattacgccaaaagagtatgtagataacgtggcaggtgaggtaaagcgcatctgggatctgatgaacacgtcctacgataactttgtccgcacgaccgatgcagaccatgagaaacaggtgcagaagatttttaaaaagctgtacgatcagggagacatctacaagggatcttacgagggactttactgtacgccgtgtgagtccttctggacagagtcccagctggtggacggcaagtgcccggactgcgggagagaggtaaagccggcgaaggaggaggcatacttcttcaagatgagcaaatatgcggatcgtctgatcgagcatatcaacacccatccggagttcattcagccggtatccagaaaaaatgagatgatgaacaatttcctgcttccgggattgcaggatctgtgtgtttccagaacgtcattttcctggggaattccggtggactttgacccgaagcatgtggtttatgtatggctggacgcgctgaccaactatatcacgaagatcggttatgatgtggacggcaattcttctgatttatttaaaaagaactggccggcggatctgcatctgatcggcaaggacatcatccgtttccatacgatctactggccgattttcctgatggcgctggatctcccgctgccgaagcaggtattcggacatccgtggctcttgcagggcggagacaagatgagcaaatccaagggaaatgtgatctacgcggacgatatggtggatctgtttggcgtggatgcaacccgttactttgtactgcatgagatgccgtttgagaatgacggtgtgattacctgggaactggtggtggagcgctttaattccgatcttgccaacatcctcggaaatctcgtcaaccgcacggtttccatgagcaacaagtattttagcggtgtggtaagaagcacaggcgtgacagaggaagtggacgaagacttaaaggcggttgtgaccggagccagagacagagtggcacagaagatgaaggatctgcgtgtggcagatgccatttctgaggtattcggcgtgttccgccgctgcaataaatatatcgatgagacggcaccgtgggtacttgcgaaggacgaggcaaaatccgaccgtctggcagaggtgctttataatctggcagagtcgattacggtgggcgcatccctgctgtacagcttcctgccggagaccgcagagaagattgtggcacagcttcatacacaactccgcggttttgaggaactgaatcagtttggtctgtatgagaacggcacgaaagtgacagagacgccggagatcttattcgcacgtctggatgcaaaggatgtgatgccgaaggtggaggcgatccgcgaggcacagaagaaggagtttgaggcggagcagaaggcgcttggcgaggaggctcctgcagaagaaaaagcagaagacgtcatcgacatcgaggcgaaggaagaaatcacctatgatgattttacgaagcttcagttccaggtgggagagatcatttcctgtgaggctgtggagaagtcgaagaagcttctgtgctcccaggtaagagtcggcagcgaggtgaagcagatcgtttccggtatccgtaaatattacacgccggaagagatggtcggtaaaaaagtgatggtactggtaaacttaaagcctgcgaagcttgcgggagttctctcagaggggatgcttttatgcgctgaggatgcggaaggcaatctggcgctgatggcgccggagaaaccgatgccggcaggtgctgaaatatgttaaaaggagacaccggagcgaaacggacatggttttatgaaaatggtgcatttgtggcggcggcgcttgccgccgtcctttggcatgtggtattgtccacgaatgtcggcgatgatatggtctattttaaaacccttctggacggtaacagttcactcggcgagatcctggcacaccgctatgagacatggtcatcgcgcatggtgatcgaggcggtgttaattccactggtgcactgtccgctgctctggaaaatccttgatattgtcatctttacgtccctcccggtgctgctctgcggactgctgggtgtgaccgggcgcggacgctggtttgtaaccggactggtgctgctctatccgtttgcggatatggcatccgccggatggattgcgacgacgaccaattatctctggccgctctggggcgttctggtgatcggcatggtgttaaagcagcttcgatgcggcagaaaagtgccggtgtgggaggtggcagcagcgcttctggcgtgtgcttatgcgggcagccaggaacaggctgcggtgctgctgcttctgttgcttggcatggaagtgctgcattatatctcggaaaagtgtatgaaacagccgcttctctatgcattatgcggcatagatattatttccctcatatatattttcagttgtccgggaaatgcaatccggagcgcgcaggagatggcggggagaatgccggagttcgctgattttacattcgcagagaagctctacatgggacttgccaacgtggaacggatctttattgcccagcttgatccggtctattgcgttgtggcagcagtgcttgtgctgcttgtgtatcgtaagacaggcgattaccgtaagacgcttttggcggggattccggcgctgctgctgtttggacaggcggtggtgcgtgtcagccacccatccttgaaaaaggtgttcgtgcgaccggaacagacgacacactgggactggcatgctctggtaacctatatgccgctggtatttctggtactgtctgtttgggggattctatacgccctgtggcagctggcggacggcgtgtggaagcattacctgtggacggcgtttttactggcaggcggttttgccatgggggtggtcatgggattttcaccgacaatttacgcatcggcaaaccggccgtacctctatctgtattttgtgctgatctatgtgtgcgcggatgccgtgtggaacatgggcggcatgaaggctgtctggaagacaggcagttcggatgctgtgcggaaaatgccggtgccggaaaaactgatgtttaccgtactcgggcttctggtgctggcaaacattctggatgtgacccggatgtgctggctgcttggaaggattctgtgaccgtttataacagaaatccgctgtttcatgcaggaaacctaacgaaaaatccaatttcagccgatgtataccatatgaacggattcagttagggatacattcagggaggaatgtggatatgggaatcagcatcaatgcaccgggaagtgtgagcaatcaggcatcgatgacaggcacactttccatccgaaaaagcacaaatacatttgagcagatggcgggggtcagtagttcagggggaacctcgaaaaaacagctcaattataatcacagagatatttccggacagctgctccgggcgaagaagccgcagagtgcatccgcggcgctgacccgtgcaaagagcaaggtgtctatgcttcagcgtgcggcggcatccggacagtatgattccaaggaagtggcgaatgcgcttgcgcatgcgagacggatggtgcgctgtgcgcagcttaaagtgcgcaatctgcgcgaggaagagcgcgagcagcagtctgcgcagaaggaaaacagcggtaagagccagaagaaggaacatgaagtgaagcgccgtgtggcacagaaagagcgtcaactcaagcagaaggtatcgattgagaatacgcaggaagtgcttcggcagaagaaaaagaagaacgagatagcgcagaagcagcagagacatcgctcgcaggagcggggtaagattgcggaggcggatttcaaatacatcaagtcacagctcgaggctggcaaaggctttggcggcggcagttcttattgtgaggacagtggatttacactggatatcagtgatgccgcaatgtcgatggtagaacttgagatgatggcacagaatcagatcgaagcggaggcagaggcggaagtggaagcggagatgtcgcttaccgacggaggaactcttgcagttacgacagcgggagccgtgacggcgggcagcggagcgggaactgcatcggacacagcgccagccgctgccggcgcatctgtggatgtgtcagtgtaacaaaacggcgaggaacactgccccatgaagcaggcggtgtcctttgaaggctaagtcatgttataagaaaatcacacttttcgatttcaggtagaatgcacaggaaatattttgttcaaaaaatgtggcatttctaaccagccggtggctacatctgcgatgattcgtgtctttccaagtttggagcactccgcggagtgtgtccgcaagccagaagacaattttaggacttttgtgtgtcccttattggcaccaatgagcagaacataaccgcgcgaagccgatgtctgaattggcatctgccctattttcaatagcagatgccaacgagtttcggttcgcgcggtttaatattgtctgtgaagcggtgccattagggacactagaaagtccgctcattgtctgtggcttgtcggacaccctccgggagagtccaaacgtggaagagacacgaaatcagatgcagtcatccggctggaagaacggcacacatttttttcaataaatctttcctatgcagttctacctgaaatctatagaatgtgttttggataatatgacttagcacttcaaaggacagcgttgcctgcctatgtggcagtgctcctgcgctgttttgcagcgacagcggtcagggcaaacatggcggcagcaaacaggagctggatgccgatacatttccagtaaaagcccaggtcgaagacttcctttccgaagcccgccagcatattgttggcgcggatgtaccagtaggcgggaagaaaacgtcctacggcaagtacggaaccggagagcatggactgcgggacaaagacgccgcagaggaaggacatggacagaccgacgatatttgccagcatatttaatacattgtcatccggcgagaacgtcgagatgagcagggagagtgcagtcgtaaaaagcagaaaggcaaggctgttcaagatggcatagccgacatagggctgcagcatggctttccggtagaatacgagaccaagcagcagaaagagcagccagatgccgagactgtacaggagacagccggatgccatggcaagagtacgtgttcttccgggaagagcggagcacgccgtccgggctttcatgtcgcggctgtttaaggtaaccagaatcggagccatgccggcgaacaggattgccagaaagatatacggaagatactggaagaaataaaaaaccatgctgttagtgtcggcgtcggacatctgaaaagatgtgacggagactttgggaaggtcggaaatggtatgatccgtatggtcgatggcctcggcaatggtgtcaccgcccgccaggtagagctgcagtgcctgcacatactgcgtaatctggttgtccacgtactggctgctgctgcttcccggaattgtcagggaggagacaaggtctttggtctcgccggcgagcacccggtcttcaaatccttccgggatgaccatggcatagttgagcgtgcggtagtagattgcatctaacagtgcggtgtcctctccaggctccggtgttgttacctggtggatggatgcgaggtaatcgcacagagcgcggcttgcatccgtgttgtcttcatctgtgatggcgatagagcgctggctggctttgaagttctcgttgatggaatcctgcgagagtgccgacagcagcagcgtgatcaccgcgtagacgcccaaatagatcaatgcggcatttcgccgtttttttgcgattgcgaaaaatgctttaaagactggcatattttttcctccttaccagtgcaagaccgccgagacagaaaagtgccgagagtaacaggagtcctgcgatatttgtaaaaaaccgtgtgtaggacgggtacacgacgagtgaatacagcgcatcggagatgagagctgcaggattgatgcggttgagcagcgggcagaaatcttccacaagtgcacgcatgtttccgatcatcagaccgcttaaaaagcagcagatcataattgcagccatcaggaaaccaaacttggtctctttggaaaactgcccgatacaaccgaccagaaatcccagactcagcccggcaagacaaccgcagaggcaggtcagcgccacaccgccgagatggttttcgaaatcaaccttaagaaccagtgtcagataggcaatggtgatcagcaaggaggaaaactcaaaaatcagagctccggtcagatcaccgagggtggcaagcagccggggaaccggcgagacattgcgtctggcacccagatctgacagatttgcctgattggagatggcgagcgtgttgccgatcatggcagcatagaggcaggtcatggcaatcagattaaaaaagtaagtaagggattcatccacggagccggcaccaagggattcgtgccggatatagctgacttccgtagaaaccgcatcaagcagtgccggaagcttcgtgggatctttcattgcggcctgggcgatggcactgtattctatgttgaaacgatccacaagcacacttaaaatactctggtacagaggatcggaagtcatctctgcggagagtgtcagcgatagaggatatgtggaaacatccttggcggatgcggcatttctataatcggaaacggttggcagatcagcggtaatgatgccgtagacttcttttgctttcagcagttcactggcatccgcagcggaagcataggtaacttcaaggaactgatcttcgccgggtttggacagggaatcaaacatggagcgcagctcggaggattcctcttgcatcacaactgcaaccgggatggcggaaaaactttcgccactccccagtccgccgaatgcaaaatggaacatcgttccgagcagaagtggaaaagcgatacaccagaatacctgacctttatcccgcagcagattaagcagtgtatatttcatcgtatgaaaaaacatggtggtacctcctaatcacgaagttcttttccggtaatttccagaaagacgtcatttaaggtcggaagttcggaatagactcttccgaaagacacattttgttcctgcagatagttcagaatgtgcggcagattgtgggaaccgccgctgcacagcacttttaagcagtgatgttcaaaggtcacctcatagacgtgctttatgtcacggatcgctgcaatctgcgcaggaagaagatccagaatatcaatcgagatgatctcgctctttttgatcattcgttttaactcttctgtggttccaatggcaagatttttgcctttgtccataatggcgatccgggtacagatctgctccacctcctccatatagtgggaggtataaatgatcgtggcaccattgcggtttaactcctggattccctccagaattttattgcggctctgcgggtcgactgccacagtcggctcgtcaagaatgatgagctttggcttgtgggcaattccgcacgcgatattcagacggcgcagcagaccaccggaaagctttttcggataaaatttgcggaaatcgttgagaccgacaaaatcgatggcctcttccacatactggcgccggagcgctttgtcgcggatatacagaccacagaaataatcaatgttctcatagacggtcaattcctgaaagacagcgacattttgcatgacaacgccgatctgacgtttcagatcgtagctgtccggccgcatttcctgaccgaagacccggacggttcccttgtcaaaggcaagcagtgcaaggatgcagttgatggttgtcgtctttccggagccgtttggtccaagcagaccgaagatctcaccttcctcaattgtgagattgaagtgatcgagggcgacaagctcctgatagcgttttaccagattttctatttctacaacaggtactgacataacaaatcctcctcgtttgatggtaattacattatagcgggtggcgcccggcggtaccagtgagcagcgtcagatgtttgatgtgacaaatgtcataaatctcttatttttcaaaaaagatgtggcggcagccctgtaatgatgatatggttatcataacgtgtgcgggaaagtggaagatatcccgggaatatggcggcatatgtggacagggagagggtagaatgaagcggattgtggataaaggactgttgcttgccggcggtctgcttatggcgggacagtcgggaaggcttgcagcgccggtcatagcgttgctgttggcgatgactgcggcggcatatggcagctgtgtggacaacagacgatggcattgtgtgtgccttgcggggatgtttgcggtctgctttatcctgccggaactctgttttttcgtgccggttcttctgtatgactgtgcggaaaaaaaggagatgcggctctggttcttgagtgttccggggctcgcttttttctatcgggaacagattatccggcagccctttttgtgggcggcggacggtatgctgatcgtggctgcgatattgctggcgtgcagaacgggcagaattctgtatctggaacaggagatgatccgtcttcgggataccagcacggaattgaatctggtgctgcaggaaaaaaacaagaacctgatggaaaaacaggattatgagatctaccttgcgacactgcgggagcgcaaccgcattgcaagagagattcatgataatgtggggcatatgctttcaagaagtattctgcagatgggggcactgattacgattcataaggaggagccgctgcacggacaactcgccggggtgggggagacgttaaatcaggcgatgaacagtatccgtgagagcgtgcacgatctgcacgatgagtccattgatctgcggcagtccatcgcggaggcgacccgtgagatgaaggagcactatcagctcacggttgattacgatatgtctccggagattccacgcaatgtaaagtactgctttatcacagcggtaaaagaagccatgtcgaatattgcaaaacactccgatgcggataagatctccgtgattttgcgggagcacccggcgttctatcagatgaccgttgaggacaacggaacggtgggacgaaagggacagagcggaccattgtgggaggaagaggtcgtccgtatggacggaaaggaagggattggtctttctaatatgaaggagcgcgtgcaggcactgggcggaaccttccggattcatacggaaaagggatttgtgatctttatttcgattcccaagagggataaaatgtagatacggtaatgaaggctgggagagagaaaaatgagagttctggtggttgatgatgataaactggtggcagtatccctaaaaacgattctggaagctgacggggagattacggtcgtgggtcttggagaggcgggagatgacgccatccggctttatcgggagcagcatcctgatattctgctgatggatatccgcatgcagggaatgtccggattggatgcagctgaatgtatcttaaaagaagatcaagcggcaaaaattttgtttttgacaaccttttccgatgacgaatacattgtaaaggcactgaatatgggagcgaaggggtatctgctgaaacaggactttgagtcgatcgttccggcactcaaggctgtctacggcgggcagagtgtattcggcggacagattatgggaaaaattccggtgcttctggcaggaaaaggcagcttttcctatcatgattacgacatcagtgagaaggagcagggcattattgaactggtggcagaaggcttaagcaaccgggagattgcagaaaaattgtatttgagcgagggtacggtgcgcaattatatcagcaccatactggataaattaaagttacgagaccgcacacagctggcagtcttttattataagaactgcggctgagccggcggtacagcaatcgcacagaagctgtgccgacagacagcgacatgaaagagacggcaatgcagcaacagggaagatgaggaaaacaatgatatttgagacacatgcacattatgatgatgaagtatttaatgaggatagagagcaattattagctgggctcccggaaaagggaatcgggagggtgattaacgtcggtgcgtccattgagacgacgaggacgacgctcgcgttggcggaggcgtatgattacatctatgccgccgtgggtgtgcatccgagcgatattgacgggctgaacgaggagacatattcctggctcaaagcgcagacggcacatccgaagacggtagcggtgggagagattggtctggattattactgggacaaggagccggaagtacaggcagcgcagcgggaatggttcgtgcgccagctgacactcgcaggggaaacagatctgccggtaattatccactcgcgtgacgcggcggaggataccatgcggatcttaaaagagaccggaagattccgggaacatcccggcgtcattcactgttactcgtactcgccggagcaggcaaaagagtacgtgaagatgggatactgcattggtgtgggcggtgtggttacctttaaaaatgcaaagaaactcaggcagacggtggagcagatctctctggaacacattctgctggagacggactgcccgtatatggcgcccgagccgcaccggggaacccgcaacgattcctccaacctctcttatgtggctgccaggattgcggagatcaaaggcgtctctgtgcaggaggtggaacagacgacctgggaaaatgcctgccgtgtatttggcgtccggtaggtgtctgcccgaatcagcagaagcgggaatattccggggtgtctgcccagtagcgcttcgggattaactgcatctgcaaacccggatttttgcgggattctatggcaacatgatcaaaaaaggtcagccagagctgccggaaggcttcctcgtcggaggagtaccggctgactttctccagatccagatctgcggcatctgtgagaacgtagctggagagcgctttgtgcaccgcgacagactgatgtgtggcgtcatagatcataaagttctcggagggaagacggtcggtaaaatgctctgccagatagggaaggacgttgtccttcggatggatcgtggcaaagagaacaccgttctcaagctcggagaagcgcagaaattcgagatgatggcaggcttcgtggttggtcgcccggcagagctcaaaaatccggtagacacacggttcgcctaaggaaagaagcactttttgtccgtctccgcttgcgagtgcgaggaggatggtctcatagatggcgtctgccttgtccatcttcctgccggaggatggctcgccggacattgcagcttgatagatcgactcatagaactgcatgccgaaacgggacgtgatggtgcggatcaccttgccggtcttatccgcggagggagtcacgtgaatatattcggaaaaaagctcgtaattctccggttctccggtggcaagccggatattgcggtgaccaagccggcttgcgcaggcgtcatagacaccggtaaagataccttcaaggctgttctcacagataaatacatacatgtaaaatacctcttttctatgtgtaatcagggcggtgagctcacagggcaagccctgtgtcaaacagcgacaactgctgataaccgctgttgcggagctccttcggaacctgcgtgtggtctgccatgagatgagagcagatatagtcctcatcaagcttcgtgcggtacatcatccggccggaacaggtgatgaaatacagggcacgctttagcacaacgccgatctttttcagatcgtcaaaggtaagcgcggtatcccgtctggcggcgacgatccgctgggcggacttgtatccgattccggggacgcgcagaagtgtctgataactggcgcggttgatctcgactggaaatgtgtcgagatgacgcaatgcccagtcacacttgggatccagataaatattaaaattcgggcggtcttccgacagaagttcatccacatgaaagcggtaatagcgcagcagccagtctgcctggtacaggcggtgttcgcgcagcagcggaggcccgccggggagcaccggcagggacgaatcgccgttgacattgatgaacgcagagtagaaaacgcgcttcagatgaaacttctcatagagtgcctcggacacatgcataatctgatagtcgttctccggggtggcaccgataatcatctgtgtgctctgcccggcgggcacgaacttcggcgctttgcggtagaccatcagctcattctggttctccgtgatgccattctgaatctggcgcatgggggagagaatcgtgtgtcttgatttgcagggagcaagctgcttcagcccgtttgccgtgggaagctcaagattgatgctcatgcggtctgcaagaaacccagccttctcaatcagtgccgggtcagcgccgggaatcgcttttacgtggatgtaaccgttgaagtgatggacggtgcggagccggtagagcgtctggtaaatgagatccatggtgtaattcggactgatgaggatgccggaacttaagaacagtccctcgatataattgcgccggtagaattccatggtgagcgtgcagatctcatccggggtaaaggaggcgcggggaacgtcggagttgcagttattctggcagtaggcacagttaaaaatacactcgttggtgaacaggatcttgagcagggagatgcatcttccgtccgcggcaaatgcatggcacacgccgggagccagacaattccccatgtgccggctgtctcccctgcggtcgacgccgcttgaggtacatgccacgtcgtacgtcgctgcatcggtgaggatggcaagcttctccatgagggagagattctgctgaatgttcatgtgaagacacctcctggcaaaacaaatgttcgattaaagcatagcacatatgttcgacaaaagcaagacaaaatcgaatatttgttcgggaaagattatggttcacttggacagtgggtatatggtataatgtacgtaagcaatgagcagtgccagacgtgacagtcacgagatatgcctgcttgcaggctatatatcgcgactgttgcggatgatagggcgaatgcccgttagtccgggaaatctatgatttcctggacgagcactgcgaagacgtgacatttgccggagcgggcatcggagactttagacggatgatagggcgaatgcccgtcagtccgggaaatctatgatttcctggacgagcactgcgaagacgtgacttttgccgtagcggagtcgtacagatagaagcccccggacgggctttggaatggagaaagatggatacagatatttttgagcagttcccggatcgggaaacatttgacaaatactggaacgagaattatcagccggtgacatacgaggatgtgcgcgagacgttcaccgattttgtgaagtctgcggacggtcacatctacctctcggattacgaggagaaggggctgatctcccgggaagattttaaggaaaacctctcgcaggaggcacagtttacatttgaggacggactgacggaagttttttacgataagaatccggagctttatgagacggcgtttgcgctctatgaggagtcaaagcttaccggaaagggagatgcatcggtggcgcagacgtttcacgagacgtttcgcgcgctctatgcagagtttctggacagactgtatgatgaggtgctggcagcatggcaacattaggaatcccgcagaatacgattacggttctgcagaagtatcattttaattttcagaaaaagttcggacagaattttctcattgatacccatgtgctcgagcgcattattgaggcggcgggcattacgaaggatgactttgtgctggagatcggaccgggcatcggcacgatgacccagtatctgtgtgaaaatgccagagaggtgacggcggtggagatcgatcagaacctgatcccgattctggcggacacgcttagcgcttatgacaatgtgacggttatcaatgaggacattttgaagctggatattgtaaagctcgcggaggagaagaatgccgggaaaccgatcaaggtggtggcaaatcttccgtattatattactacgccgattatcatggggctgtttgagagccatgtgccgattgacagcattacgatcatggtgcagaaggaagtcgcagacaggatgcaggtcggaccggggacgaaggattacggtgcgctctcgctggcggtgcagtattatgcaaagccggagattatcgcaaacgtgccgccgaactgctttatgccgcggccgaatgtcggcagcgcggtgataaggctgacgcgtcatgagaccgtgccggtgcaggtggaggatgaaaagctgatgttccggctgatccgggcatcttttaaccagagacgcaagacgcttgcgaacggtctgaataattcgccggagattcatctctccaaggaagtgattcaggaaagcattgaggagcttggcgtgccggtgaccatccgtggagaggcgcttacattggaacagtttgcggcgctctcgaatattatcggacgcagaatgaagcagcaggtatagagagaatagggggaaacagacaatggatggacagcagaacaatcagaatggatggaacgggagcgaggcgcccagaacatacggtgaggatacgaaaatgtatcagaaccggcagaacgcgccgcagcagccgaattacggaagcggtcagaacccgtatcaacagccgaattacggaaacagccagaatgcatatcagcagccggattacggaaatgcacagaacatgaatcaacagccgaattacggaaacagccagaatgcatatcagcagccgaattacggaaacggtcagaacccgtatcagcagccgaattacggaaactggcagggcaatccgtatccgcaggagcagcacggaccggtatccgatgttctgtgcaatattctcctggtgatctttatggcgcagattattatcaattttgtggtatttggcgcgacatggaatgcgatggcaggggaaggaatagacgcttatctcgacggatccgtgagccttggcagcccggtgcagatgctttccatgttttccaatctgctgtttgtggcgatgcttgtgctgttgattctggatattataaaaatcagcaatcagaaatacaagatcaccggtctggtgttgtttgcgattttcttaagaccgggctattacatctggagagcacatgtgcttaagagaaaaatgacgttcccgatcatctataccatcgcttacagcggagtgaccgtggcatactttttctattcgttttataaagttttttcactgacatttgggattatgcagagtctgaactagtgccgcggctttgtaggaatggaagatctccttggttcatataataatggacaaggagatttttttatgcggaaaaaatggaaatactatattgatagaatgcttacttttgcgctaattggcatattattgccgctttttgttacgataatatgtcagcgtatgcgcctggaggaagtgatttacggcacgtacgacgcgataacggaggcggcagaaagagagggcggggaggaactggaagaacagctgccttttattctggcgaaggagatccgtgcggacgcggaggatgcggcgcttatggcgcagtgcgtgattgcgcggacaacactgtatgatgccgcggcgagaggggaggaacagccggctgctttttcggaggaagaattaaggcaggcgctgggggaaacatatgaaaaggtcatggaacggcttgagacgtgcgtggaggagacgagtgggcaggtgctctcctggaacggcggctatgcgtatgctgcatatcatgcgatcagtgcaggaagtacgagagatatgagccggtcggcggaagcggcggtgccatatcttcctgcggtggagtgtccggcggatctgacggcggagggtacgctctcagtcatttattgtgaggaaacggacattttaaagcagtgcgcggagcattttgcggaggcagacgtgtccgcggtgtctgatatccaggttacagagcgggatgcggcgggctatgtacagcaggtcatgctgggggagtatgtctgcaccggggaagcgttccgtgaggcgatgggctggaattccgcgtgttttacgatcgcgcagatgggggaaaatgtgcggatcgtgacaaggggactgggacacgggtacggcctgagccagaatgaggcgcgcgcgatggcgcaggaaggaacctcttacgaggagattttacaatatttttttccgggaacaacgcttgtgacagcggatcagataaaataggcggcgctctgcataaaccatccgtgcagggggaacaataggaataaaaataaataatatggatggtgaaaaaaatgagaaaaagcagattttgggcattcctcgggcgtaaacaatatgtgattgcgggggcgattgtgattgcggcagcagttgcgaccacggtaatttacagcgatcatgaacaacagcagcgcgaacagctggaggaagaactggcacaggaaaacacaccggaggaagccggacttgtcgctgcgacggaaagtacggaacagacagcacaggcatccgcagttattccgccggagcagaccgcggagacggaaaagctggagcagaaagcggcagagacgacagagagtacggaagtggcgcaggtggaaaaagaagcggagaatgagaccgcagagacgggagcaggggtcaatgcccttcattttgatccggaggacggcatgctctggccgatggagggaaatgtgatcttaaattacagcatggattctaccatatactttgcgacgctggaccagtacaaatacaatccggcggtgattatcgcgggagaggtcaacaataaggtatattccgtcgcaaagggaaaagtcatcggtctctccaacaacgaggagactggctgtacgatgacggtcgatctgggtgacggctaccgcgcgatctacggacagttaaaggagccgaactttgcggtgggtgattatgtggaatccggccatgtgctgggctacgtggcagagccgacgaaatattattcggtggagggcagcaatctgtattttgcgctgcaaaaagacggacagcctgtcgatccggtagcattttttcagagctagtttgtaaaaggaagacaccggttcttgaatatgttggatttcttcattataatgaaacaagagataagggaggaatcggtacatggaattcaaggaatacagtaaagctgtgatggcgtgggtggacggagtgatgcagaaccgcggcgccgatgccgagaaaacattgaaatactgtgcggatatcgaacaatatgcaaaacagacgggggatccaaagcttctggggtttgcctactattatgcgggcgagacctactatgtgctcaatgagggcgagcagcttcttaagaccattaccagagctatcacctatctggatcaggcggagcagtgggacatggttgccagggcttataatatccttgcgattgcctttttgaaccgtggaaatacgccgattgcgctggattactatctgaccggactcggttattgtaaaaaatataagctggcgaacgaagaaaacgccatcaacttgaatctcggaaccctctatctgggcaacgaacagtggaatgaggcgcagagatattttgaaaaagtctcctccgatatcaaggcatatccggagaccccgaattattacgggctgatgagctgtgtagcggtctgtctggggcggtgctttatgcagcgggaacagaatgaacgcgtgcaggcacagatggattatctggatcaggtctgctgggagcacatgcagaagatcgagcgcctctccgcgctgatttttaaggcggaatattatcaccacgtgggaagaatcacacttcgtgaggaatgtattgagcagatccgcggacttgtggatatggacatggcggttatggatatctttgatgacgtgtacgggctgtgcagactgttgctggagatcgataaggaagacgtcttctgggacatcgtggcggtattggaaaaattgacgaaaaacgccaatattgcgaatctgcagcggaaaatagtttccttaaaaatcctctgctaccgcaggaaacaggacgaggcggcttatctcgaggaggcgggccggttctatgagctgaccgaggcgctggatcgggagaaccattatatgattgccaacatgctctccgtgcgcagatcattagaacatgcgaatgagaagcggcgggagatggagaaagcgaatgagcgtctgctggagaagtccgagacggatccgctgacgcggctggcgaaccggttccggctgaatgattatctggagcgtgcgtttgagcggacgcgggatgaccatagagcatttgcggtagagattctcgacattgactacttcaaggaatacaatgataactacggccatcaggcgggagatgcctgcatcgtggcgattgcggatgagctgcggaaaatgcagagccacgataccttctgtgcgcggtatggcggggatgagtttatcattatttacgagtacaagacggaggacgaggttttttccatggcggacagtctgcgggagcgtattcttgacaggcggatcgagcatatgtgctcgaaggcgcttccggttgtcacaatctcgcagggaatctgttttgacgtggctccggagggaagccggagctgggatttcctgcatgcggcggatatgatgctctacgaggtgaaaaagcgcagccgcaacaatatttcgctcggacatctggatgcaaaagaggcgagatacggagaagagaggaaacttttatagattccggcatagaatatactgtaacggaaaatccgcaatcgagccttttacttttaccgaagcgcagcagtatgaaaaagtacagatcaagtaaagtacgcatctgtcgattgcttttcataggagtattgcccaaagccgcgagcggatttgggttacatagacagaagttcggagatttgcgcatttcttgacaaaagagagatgccgtgctatgattcaaaatactgcgcagtcggcagaagtgggcactttctgccggtgctgggcatgcgtcagagaattggctctggcgtgacagaaaggaaaaagatggaaacagttagatttgatgagttagatttatatcctcaggtgttaagagcgattgcggatatgggatttgaggaggcaacgccgattcagagccaggcgattccggttgtgatgtcgggcgtggatgtgatcggacaggcacagacaggtaccggtaagacggcatcctttggtattccggtgcttcacaaggtagacccgaacagcagaaagacgcaggtaatcattctctctccgaccagagagcttgccattcaggtggcggacgagatccgcaaacttgccaagtatatgcacggggtcaaggtgcttccggtgtatggcggccaggagatcggacgccagatcaaggcgttaaaaggcggcgcgcagattatcgtcggaacgccgggacgcgtgatggatcatctgcgccgcaagacgatccgctgtgatgcgatccacacggtggtactcgatgaggcggacgagatgctgaacatgggcttccgcgatgacatcgagacgattcttgagtatattccggcggagggacgtcagacgatccttttctccgcgacgatgccgaagccgattctcgatatcaccaggaaatatcagcacgatgcggtcaacatcaaggtggtaaaaaaagagctgacggttccgagcattgagcagtattactacgatgtcaagcgcagcgacaaggtagaagtcttaacgcggcttctcgattactacaatccgaagctctcgctggtattctgcaataccaagcggatggtggacgaacttgcggaagaattaaagggacgcggctattttgcagagggactgcacggagatatgaagcagtcgcagcgtgaccgcgtgatgaaaggattccgcagcggcaagaccgagatcctcattgcgaccgatgtggcggcgcgcggaatcgacgtcgatgatgtggaggccgttttcaactacgacattccgcaggatgacgaatactatgtgcaccggatcggcagaacgggacgtgcaggtcggaccggacgcgcttttaccttcgtgaagggcaaagaagtctacaagctgaaggatatcatgcgctactgcaagaccaagatcgtggcaatgccgattccgtcaacggatgatgtggcacagatcaaggcagagaaggtcatggaggagatcggcaggatcatcgacgaggagaacctgtcggacatgatcgacatgatcgagcgccaggtgaatgcttcggattacaccgcaatggatattgcagcggcatttttgaagcaggcactcggccaggtcaatctcgacaacggcagcgacgctgactacgacttcgacaataccggcgcggaggaagggatggtgcgtctctttatcaacatcggtaaaaaagaccgcgtcaagccgggagacattctcggggcgatcgccggggagtccggcatgccaggcaagctggtcggcgcgatcgacatgtatgacaagtatacctttgtggaagtgccgagagagtacggcagagaagtcctcgagggaatgaagaacaccaagatcaaagggcgctctgtcaatatggaaccggcaaatcaaaggtagatttaataaatggaacgctatcggaatctggaattgccgcaataagcatagacctctttggggtgataagtaatattattagaataccagagaacaaaaaagttccagaataaacagacggcgggaaattctttgaagcaaaattcacgtatttcttccatgccgtggctggcatcccattccgtgtcttggccacgtttggacactcacggagtgtgtccgacaagccgcagacaatgagcggactttctggtgtccctaatggcacctcttcacagacaatataaaaccgcgcgaaccgaaactcgttgccatctgctattaaaaatatggcagatggcaattcaaacatcggcttcgcgcggttatgttttgttcagaggtgccaataagggacacacacaaaagtcctaaaattgtctgctggcttgcggacacagtccgtggagtgttccaaacttggaaagacacggatcatcacggatgccagctgcggcatggttagaaataccggattttgcggtcagaatttgccgccgcatgtttatctggaacttttaagtatctatttcttataatattacttatcagagcaaagtacgctatgcttattgcgacagttccattttctgacaggcgttccttttatttttctatgtgtttgccgaggagcgcctctcttttgcggaggagtccggggacgacggtcacaaagacgatcgtcgtgacgacggcggcaacgacatcggagagcggctcggcatagaacatcgccggtgcgccaaagcgaatcggcaaaaagactgccagcgcgatgtagatccctttgcggaagaaggaaagcggcagcgaggcacacacgaggctcatgccggtcagcccgtcaacgagcgcatattgtacggcaagcggtatgacggagagtgtgtagatgtggataaaatgcaccgtcatagatctgtaagcggcattttgcgtaaataatccgacgaaaatgccggcactgacatcccactgggcaaatacgaacatgatggtgcagaaaagcagtgccgtttttaaaatatgcttctcggcaaggcggatgcgggcggtgtcgccggcaccgtagttgtagccgagcaccgactgtgtcccgccggagattccactgagcggcatcgtgataatcagcatgaagctctgcacaatcgtgttgcaggttaagagcatgtcgctgtcggcgccgccgtaatttttcaacatgacattctggacgatgatcagcacattgtcgaacaggataatcaaaaacggcgtcagtcccagcgtgaggacatcgcggcataccgggagggagtaaccgcggaacgtgatttttaccggcacgggaccgcggaacagaatgtacagcgaaaacgcgcaggaagccgcctgtgagagcacggtggcgacggccgctccgcgcacacccatgtgcagggcgaagataaagagcgggtcgagcagaatatttaaaatggcgccgatgatgacggagaccatgcccagattggaaaatccctgacagatgatgaactggttcagtccgagcgagagcacggcgaagacggttccgatcaggtaaatgcgcatgtaggtttctgcgtagggaaaaatgcgctccgtcgcgccgaaccataccagcagggcgtccttgcacagatacgctccgatggtcaggcagactgccatgccgatcagaagcacaaagcagttggcgaggatggcggaagcgccctccttattctgttcgccggatttgatggagagtaacggcgctccaccgttcccgatccaggcggcaaacgcggagatcatcgtcacgatcggtccgcagattcccacgcccgcgagcgcaatgtccccgacgtttgcaatatttccgatatacatgcggtcgataatgctgtagagtacattgacaaactgggcgagcattgccggaagggcaagccggcgcaccagctgtgggatgggatcgctcccgagatgattgactctgaccggatgttttctcctgattttcacattggcacctcttttgtattctctatttcacacgaaaaatccctgaaaaaagagtttcttctatcatatatcaaagcatgcaggaagatattagaatcaaatacaagaaaagtcaagacgggagaaagtaaacctgatccaatcagaaaaaattattttctgcatttgcaagaatctgatacaatgtacgcgaaggcaaaagtgagcatggagcaaagacggacgggcatgcttgcatgcgtcgaacggatatatggccaatcagttagggaggagcataacttgataaaagtagaacacgtaaagaaaagctttaaggaaaaagaagttttaaaagacatcacatttgagtttttgccggatcgcgtctatgtcatcattgcaccgaacggaacggggaagacgacgttcatcaataccttgtgcggctttatgctgccggacgagggtacgatctctttttcggacggaatggatgaacagggatttgatgtgatactttcgggggagagaaatctgtatgtgaaaaatacggtatatgagaatctgatctattttagcatgctgaagggaatgtccaaaagtacggcggatgccgcgattgaccggggaaaagagaaattcccaatctatgagacggtgaaaaataaactggtcgaaacgctctcgtacgggcagaagcgcatcgtatcgctgatgtctgcggttgtgacaggcgcaaaatgcgtgattattgacgaggcgacggacggactggatattgataaccgaaagctggttgcggataccatacgcagtgtccgtgatggcagaagtatcattgtcattgcgcatgatttctcatttgcatcggatgtcgcagatacgcttattttcctaaaggacgggcgctttgcagaagtcgtggagaacgccaggggggaagaaatcgagcagatttataagaaactgtatcatggggaggtgcggacagatgcttagaatgttctggtatgagataaaaatggatttcctgcggtcgatccgctaccggtttggaatgatttccgacttattggtctatttcgctttgtttacgatatttatggtgacggattccggaaattcttacgcacaaacctatcattatggaaattacaaggaactggtgcttttgggatatgttgcctggatctatgcaatctcagcaatttccaatgtcgcgggatcgctgcagagtgagctgacacacggaaccttgtacaagaaggtatcctcaaaatatccgttacagtatctgtttggaggattatatgtctcctcggtactgcttgagacgattacgattgtgattgttgtaatcatttcaaagttcgtgtgggggattgaattttcttttcatccggcgtttctggtgccgattctattagaatccctcggaatgtacggcataggtctgattgtggcaggtatcgcaatttactttaagcggacgggaacgatcgtatttctgatacagaccgcgcttctttttgtgacggataccgtgccgaccagtgatgccatattaaagattacgcattacattccgctgaccagatgtaacgaaatattgcgtcagatcgcggttggcggtgaatatacaggcatgctgccgggattgtgtatcgtggcgctggtgtggctggtgataggaagcgtgttctttgatgtgatgctaaagcaggcaaagaagcggggaaatctgctgttctattagtggacggtcagaaaatggcttaaatgcaggatagaaccttataattaaatgtaaatataaaaaagacaggaggaaagacgccctcctgtctttttgcgttcttcatcaaatcttaatgaattcactgcttttaacttcataaacattccgctacaataaaatcagaatcaaaaagcgtcaaatagcggcaggcggcatgtgtggcgcggcttgcggggagtttacgcggaaaaggggagaaaatgtacaacatactggtgtgtgacgatgaaaaggacatcgtgtcggctctggaaatctatctgacggcggacggctatcaggtatttacggcatacaacggaaggcaagccgtagatatattaaataaggaagaaatccatctcgtgctcatggacatcatgatgccggagatgaatggtatctccgccatggtgaaaatccgtgaaaaaagcaacgtgccggtcatccttctgacggcgaagagtgaggacaccgataagattctgggactgacggtgggagcggacgactatgtgacgaaaccttttaacccggtggaactgcaggcgcgggtaaaatcacagctgcggcgctatatgcagcttggcggcagtacgaagcaggagcgggatgtgcttgccatcggcgggattgaactgtgcgaccgcacaaaggaggtcacgctcgacggggagccggtatcgctcacgcgcacggaatacgatattttaaaacttttgatggaacacccgggggaagtattttcgccgaaccagatctatgagcaggtgtggcgggacaatccctacggcacggagaatacggtcgcggtacatataaggcatttgcgggaaaaggtggagtataacccggcggagccgcgctacttgaaagtcgtgtggggacggggctataaaatggaggaaacagtgtgagaaacagaaaagacagtgtgggagcaaaagcggcggcgtgggtcggcatcacgctcggtgcggtggtatttttcacaggggctgccggcgtgttgcttatggatcaggcgggcgtgtatgagatgtcgcgcgagcagttccttacaaagagttatcagagtgttgcagatcagtatgccatccgggcgctggattacagtgtgaacatggaaaatggtgcaaaaccggaaaataatcgctggaaagacacatatttccgctatggaatcattgaagcggaaaatattgattccgtagatctcaacgaatcgtacacttatgtggagcgcaattttgatgagaaggtcacaagggacaagctgtactgcaaaagctatgacatcaacgaggtgacacgctacgattacagcatgacgctgtggggcgggtacagcctctacacggatggcggagattacgctgcgcaggtggagattgagaagcggtgttacaatgcagatgacggcatattttattatgaaacgccggacgcatacatcccggtaaaacatgtgagcattctgatgctgtcgccggatctggcgacaggctatgattacacgtatgacgcagatgtgggaaaatatctggatctccatgcgtacagcgggacctatgtgacattcgacgatgcagacagtctgagcgaaaacacgggatttcagacggtcgactggacgaacagtgtgattctggacggagtcacctgcggtgagcttgtggggataccggtcactgtaatcgggaactctgatctggagcaaaagggaagcgatgccaggacaacgtaccagcttactgacggcatgctgcagatgaactacacggcggaatcactgcaccggaaatactgggtagtcacgattcttccggagaatgtgccgcttggctggagtgacgatttgtttgtgcaggtgacgacgcttacggcgctgatgtatggcgtccgctatgccattttcccgattctggcggcggcatttgtgcttgccgtattctgcctggtgtggctggtgcggtcggcggggcatcacgcgggagaggacgggattacgcttacctggctggatggcatgccgcttgatgtgtatctcggatttgcgctggtggcggagggatttctgtttctgatcctgatggaagctgtcaacggcagaaatgctgcagcgccgatgcttgtgggggttctgttttgcctcatagcgggaggatggattgcgcttctgtcgctgttgacctttgctgcgcgcgtgaaagccggggcatggtggaaaaataccgtcatctacatggcgcttggcgtgatcggcaggctctgcggcgcggtgacccggaatctgcctcttttcttaagggcggtgcttgtttttggcattgccatgatggcggaagcgcttgccggcacgcttcatacaggaagcagcatgggagcgggctggcggtttgtaaaagtcgtagagttcgcatgcatcttctggggagttttacagatgaagcgtctcgcagagggaggcgagcgccttgcggagggcgatatggagcacccggtcgatacggcacacatgtaccgggatttaaaggaacacggcgagcacctcaacagcatacagacaggcatggcaaaggcggttgccgagagcgtgaagagtgagcggtttaagacggaactcatcacgaacgtctcgcacgatattaagacgccgcttacttccattatcaattatgtggatcttctggaaaaagaggagctttccaatgagacggcagaggggtatctggaagtgttagagcgccagtcaaaccgtctgaaaaagctgattgaggatctgatcgaggcgtcgaaagcttccacgggcaatctcgccgtacatctggaaaaactcgaggcgggcgtttctgtggtgcagatcgtcggagaattcgaggacaaactgaacgccgcagatctgacgctgctgatccagaagccggagacgccggtgtatgtgatggcggacggcagacatttctggcgcgtgattgacaacctgatgaacaatatctgcaaatatgcgcagccgggcacgcgggtatacgtggatctgcgggagaacggcggacaggtggagctcattttccggaatacatcgcggtatccgctcaacatatccagtgaggaacttatggagcgttttgtccgcggggacgaatcgcgcaataccgagggaagcggactcggtatctccattgcaaagagcctgatggaactgatgggcggcagctttatgctctatgtggacggcgatctctttaaggttgtgcttggatttgcacaaatggaggaagaaaaagaaccacttgatgaagataaaagcggaaaatagatacaaatgcaatttttctgacactttctgaaaactttgcttgttttttgataaaccctctgttacaatgcaaaaaaagacagaaccgcaggaaacggaaagaatgcacacaggagaaagacagaaggaaggcggtctgtgaggaaactgtggttacgttcggaggaagagttatgagagctgtgaaaaaggaatggttattaggaatgttgtgtgtgctgtctggcgtgatgcttatggtgatgcatccggtacaggcacaggcagggcaggcggatcgcgcggcgtaccgtgcggtgtttgacgcatcctattacagtgcggcgtatccggatgtggcggcagcctatggaaataatgcagatgcgcttctgaaccatttcatcagctttggcgtgaaggaaggccgcaatgccagcgcggaatttaatccgcaggcatacagacagcgttatgaggatctgcaggcggcgttcggcagcgacatggcggcttactgcagacattatgtggcatatggaaaagccgagggcagaaacggcagcgcggacggacagccggtggtggcagtacagcaggcagacagccaggcgcagcagacggacagccagactgggacacagaacaatgggacagcgcagagcagtgcaccggcacagagcacgcagcaggcatccggcacggtgatcggtacctgtacgacttcttatgttgacaatattccgcgcgcaacaaacgtggcgcttgcggcacagcgcattaacggcacggtggtacagccgggcggcagcttttctttcagcaataccatcttaccgcgcacatctgcgaacggatatgtgacggctccgatctatgtgagcggcaaaaagggcaccggcaccggcggcggtgtgtgccaggtatcgtccacactgtatgcggcgatggtatatgcgggacttccggcaacggagcgccatgcacattcccttccggtagactatcttccggcgggacttgacgcgacgattgcaggcagctatctggatctgaagtttacgaatacattttcacagccgctgctgattcaggcatcagcgaatggcggaacactgaccgtgacactcgtattgcagtgattgccattgcgcagtgaattggctgatacacagtgaaacggtttttatacagcgaattggctgatgcacagtgaaattgtttttgcacagtaatggtatctgcgggtaagcaggtgcttgtattcaaatgaatggattcatatacattattttgcaggggattgcatctgcgccttaagaatgactctgagggcagatcaatgcccttgttttggtgccgtcaatgatgaaaataagacgaaatctttttatctcataaaaattatcactaaggaaaaaaccaaatcatccgatatattgactagaaaagttatttttgcgttacagaatagaaaggagatgccattatgcgagtagaagcgtataacagcgtggcacagatttataagacaaacagagcagccggggcatccgcagcagcaaagactgagaagagccgggatcaggttgagatctcttccataggatatgattatcagatcgcaaagcaggcagtagccgagacttctgacatcagagaggacaaggtggcggcgctctccgcaaaggtgaaatccggcacttacgatgtgagcaacgaggcttttgcagagaagcttctggagaaatatcgttcctttatgctgtaggataagagaaatgagggcagattgtggctagtttaatggaagaacttctgggagttctggaaaaagaagaaacggaatatctgacgctgattgatctcgcggatgtgaagagccaggcgattatcaaagcggacattgcgaagcttggcgaggtgacggagaaggagcaggaggcggcgagcaccctgttaaacctgtcgaacaagcgcacgcaggtgcttaatgacatggcgacggttctcgggaaaaagccggagcagatgacgatcaaccgtatgatcggttatctggagaaccagcccagagagcagcagatgcttgcggagcgccgggacagacttttagaagtgggaacgaagatgcagacattgaaccatcagaacgaggtccttttaaagcaggcgatggagatggtggaatttgaccttacgctgctaaagagcatgcggcaggcgccggagaccgctaattacaataaaaacgcctataatacaggagacctgcttggcggcagcggatttgacgcgaagcagtagatagagcagcacggaggaagataccatggcaaatggttttggaacattgtttatcggcgtgtccggcttgcagagcagccagaacgcattaaatacaacggcaaataaccttgcaaacgtagataccacgggatatgtacgtcagcaggtactgtttaccgaccgcaactatgtaacctttaatgagacgacggcagtcagcaagcagcagtccggtctgggtgtttacatcggtgatgtgattcattccagagacgtatttctggatcgctcttaccgcacggagtcgggacggcaggcattctatgcggcaacttatgaggcgaccaacgaggtcgagacttattttcaggagatggagggacaggctttccaggatgcactgaaagatttctggacctcttttcaggaattgtacgagacgccggatgacagcgtgagccagaatctggttgtccagaaggcacagctgttcgtgagccgcgcgaatgcggtttattcgggattacagagttaccagtacaacatcaatacgcagatcagcgacaatatcgatcaggtcaacaagctcggcgataccatccaggatctcaaccttcagatcatgaaagtagaggcgggcggcatcgagacagccatgaccctgcgcgatgcgagagaccaggcgctggatgagctgtccgccctcgtggatatttcctacaacgagacagccgatggtattgtgaaagtcagcattgagggcacggagtttatcgatgagagccgttgctatcatatcgagaagaaaacagacaagctgaccggttttatcacaccgtactggggctacctttcggatgtgaacaagggaaaatacgtcaacgtatttgattttggcagccgggatatctccacagagaacaagaacgatatgggtgaactgaaagcgctggtactggcgcgcggcgaccatatcgcgaactatacggatattgaaggactggatcaggatacctataacgatacgaccggaatgtccgtcatgctgcgggcagaggcacagctggatcagatgatccacggcatcgtgaccgcgttaaatgatgtgctttgtccgaatgtgactgcggaagatacgattaagaatcttacgaacggtgctgctacaacgctggatgtgatactggcggacggctcgaccgtaacattaaatgcgaacaccaaaattctggatgcagacaactgcgcgaccggttccgacaagcagcttccgccgcaggaactgttctccagaatcggaacagagcggtacacaaaggcgacttacacctatcagccggtagatgagaacggcaatccgaaagtggacgccaacgacaacccggtgacggagaccaaggagatctacatttacaatgaagaggacccgaacgataccacaaagcagtacacactgcagagcttaagtgtcaacgaggcgcttgtgatcgatgaaacgctgctgccgcatctatgccagaacggtgatgtcgattatgcactggcagcaaagctggccggtgtgtgggatgaggagcggcttacgctgaacccgaacgacaccaaggcgtgcagttttaaagattactacaaagatatgatcggtgagatggcaacctacggaaatgtctacaattccacagcgaccagcctcacgggaacggtggcttctgtggacaatcagagacagcaggtcatcggcgtatcttccgatgaggagctgacctacatgatcaagtatcagaatgcttacaatgcagccagccgtttcatcaatgtggtcaatgagatgatcgaacatctgctgacccagcttggataattgagcgcgtaaaaagaaagagagggtgttacatgccatctacattttttggtttaaatattgcatcatcaggcttaagtgcctatcaggtcgcactgaatacaacggctaacaatattgcaaacgtgcagacgaccggctactccagacagcagtcgaaccgtgtggcatcggatgcgcttttggtgcaccagcagtacggagctgtgggaaccggtgttacaaccgtgtccgtcaagcagatccgaaatcagtattacgatacaaaatactggtacaatcagtcatcggtcggactgtatgagacaaaattgagctacttacagcagatcgagaactattttatcgatgacagctcctccaaaggctttacgacgatcctgaacacgatgttcaattcactggatacattgaagaacaatgcatcggatgtcaacacccgtcagcagtttattggaagcgcacagaatctggcaacctacttcaacagcgtgtcggagggactgactgatatccagaaagggacgaacgatgagatcaaatccacggtccagaatatcaacgcgatcgcggagaagatagcggtattgaacaagcagatcaacgtcattgagattcagggcggctacgcaaacgagctgcgcgaccagcgtgcgctgttgattgatgagctgtccgagattgtgccgactgaggtttccgaggtgccgatcacggatacaaaccatccggacgagccgacaggcgccaattactacactgtaaaaatcggcggtcaggtgcttgtagatacctacaattacgagacactcgagtgcaaggcgagagattataaggtcaatcagacagatgcagccggactttatgatattaaatggtcgaagacaggcaatacctttaatgcgggcggaagctcgatgtccggcacgttaaaagcgctgtttgacatccgtgacggaaataacggcgagaatttctcaggactggcaaaggtgttgaacagcaccgaggttcagattaccaatccttccatcacgagtattgtgggagtcagcatgccggaggaaggcatattgacgatcaatggaagagagtacgcatatgagggatttacctttgagcaggatgcggacggcaacatcacttcctatacctttaatatgaagagagcgctcacggcggaagagcaggcacgtgtagacggacgcacggcatcggtcggaacgtcgattgacgcgatgggtattccgtattatatgagtcagatgaaccagttcctgcgcagctttgcgacggaattcaacaatattttgaaaaaaggtgtcgatctggacggcaattccaccagcggatatgcatttttcaccggtacagacaccgtgaccggcgaagagttttccttcgacggcaaagatgcgaacgggaatgcagtcaacggatctggctcagacacgtattacaagctgacagcagcaaatatctgtgtgaacagtatgattgtcaaggatccgacaaagctggcgacaaccgttgacatcaacggaaagggtggcgtggatgcgtacgatctcgtggaagaacttgcgacgttaaagagcggcaaggtgctttaccgcggaggtacggcggacggattcttaaaatgcatgattgcagatatttccgtggacacccagcagtcagaaattttcagcaagaattaccagaatgtggcgagcgcgattgacacgcagcgtatgtcgatttcgggtgtggatgaagatgaggaggcaatggatctgatcaaattccagaatgcctacaatctttcttcaaagatggtatctgtcatggcagagatttatgacagactgatccttgagaccggtgtatagacaaggacatgaggaggaatcataaatgcgtattacgaataacattatacttcacaatacgacgggcaatatcaatggaaataaggtgaatgtcaacaatctgaacaatcagatgacatcccagaaaaagattcagagaccttccgagaatccggtcattgcggtgcgttcactcagactccgcacaacactcagcgagattgaccagtattacgagaacaatattccggatgcagaatcctggatgaaagtgacagagacggcacttgccaatatgaagacgattctgacggacatccgtacacagtgtacttatggagcatccgatcagattaccgcagatgaccgcaagacgatcttaacccagttagagaagctgcgggatcaggtctacgcggagggaaatgcagattatgcgggacgtaccgtctttaccggttaccgcacgaatcagaagctgacctttatgacagacgacaatacgacatcttacaatatcacacagggactttcctataagaatctggaagagcaccgttactacagcgatgaggtgacactcccgaccacagcggcggaggtgacaggcaacaccatctcgaatccgaagcaggcgacattcgaccgtatccgtttaagctacggcgagatcgacagcatcacggacaaggacggcaatgcgctgtcggcaaacggtgcgaccggaacgctcagctattcctacacagatgcagccggtgtgacacagacggacggcgaactgaaggtaaccgtatacgatacgtttgaggactgggcaaaagcatcccagactgcggacaacacctacaatatcacagacggtgaagcggtatttattaaggagagcggtgagctgatcttaagctctgatgcgtcatcgacgatcaagagcggcagggcaagcctggatgtcaactacaccaagaccggatttaacaagggtgaggtacgtccggagtattactataactgcaccaacatcacggatgcggcaaaaccggtggaatatataaagtttgaaaacggcaaggaaatctatcaggatatcaattacgtcgtagcggcaaaccagaccctgacggtcaatacacaggcatccgccgtatttgatgcatcgatcggaagagatgttgacgccatgatcgaggcggtaaagttcgcgcaggacgcaaacaataaagtcgaggaactggagaaaatgcagaaaatgcaggaatattcttccgatgactgtcaggcggcacttgaggactggattgcagcggcgaagaaagaacgcgattacgcggacgataatctgcagaagctttataacagctacatcggtaattttgacgattatctgcagaaggttaatctggcgaacacggacctcggaagcaaggggcagagcctggatctgaccaagaaccgtatggcaaatcagcagaccacgatggaggaattaaagtccaccaacgaagaccgggatctgtccgagatcattattgactatgcgtcggcgtacactgcatatcaggcatccttacaggctgcggcgaagatcaatcagacaacattattgaattatatttaacagacaccaaacggggaagctggaggagaaccgatgaaagcaaacacaagactttttggggaaatcgatattgcggatgacaagatcattacgttggaggatggaatgatcggacttccggaataccggaattttgcattgatatttgacgaggaaaaggaaaaagacaagagttccgtaatgtggttccagtccatggacgatccgcacacggcgtttccggtcatgcagccaaacctcgtgcgcccggattacaatccgatggtgagcgatgagatgctccgtccgctcggcgggatgacagaggacaatacttacgtgctcgtcacactcacggcagcgccggacccgaaagacacctcggtaaacctcaaggcgccgatcgtcattaacacagacacccgcaagggagcgcagatcattgttgaggatgattatcctgtcaaatataagatctatgacgtagtaaaaggaaagaagaaagcggaggaataaggcatgctggcattgacacgcaaaaaaggagagtcgctggtcatcaacaataatattgagatcacggtgttagagatccgcggagatcaggtcaagatcggaatcagtgcaccgaaggaagtgccggtataccgcaaggaggtttacctccagattcagaatgagaacaaggcggcattgaacgcaacagatgcaatggaggcgttgaagaatcttttctgatgcggttaataaaagccatagtttctccgatataagacatagaaaaccgggaacatagaggagccatgtatcacacggaggtggtaagagatggaaatagagagtatgaagagcggagcagcagcgtcgtatcagggaagtgcggcagcgacatccacaaaaacgccggatactgcggtacagccggaagcatccacacaggcagggctgtcgcagacagcagataagaagcccgcggtgcagaacttttttacagagaaggatcaggaggataaggatccgtcccaggaaaaagatgcaaagcagggaacacagttaaaaaaagcggtcaatgatctgaacaaacagatgaagaactcggaggcgatcttcggaattcacgacaagacgaaccgtgttacaatcaagatcatcgacaagaccacaaaggaagtcatcaaggagtatccgccggaggagacactggacatgatcgccaaggtatgggagattgcgggaatccttgtggatgagaagttatagaaaggaacggtgagcatatgccaattcgtattaccggattaaattcaggactggacacagaggcgattatctcggctctggtatcttcttataactataagaccaataagtacaagaaagcacagaccaagctttcctggaagcaggatgcgtggaagacgctcaataccaagatttacagcttgtattccagcgtgggtaatctcaagctttccagcgcctacaatctgaaatctaccactgtatctgacaccaccaaggcaacggtaacggcgagcaacagtgcaccgagtggcacgcagtcgctgaatattatcagcgtggcgcaggcgggatatctgaccggcggtcagctggatagcagcgtgtcaaccagtaccacactggcagaactcggctataccggtggggacggtaagataaatttgacaaaaggcgacggaacaacgacctccattgaagtgacacagggaacaacagtcggcagtttcattgcgtccttaaaagatgcgggtgtcagcgcgaacttcgatgcaacaaatcatcgtatttttgtgagctccaaagagacaggaaaagacaacgattttacacttacgggcggcaatgctgacggtatcagtgcgcttaccaaactgggattgaatgtaaaatccgatgcaaccgatgcaacctatacatcctatacacagtattatgatgcagacggcaataaacttaaccagaatatcaccgatgcgattgcggcttacaagacggcgcaggaagattacaagacaaagtcggcacagaatgccaacctgaccgcgtcctatggttatgccagcgcttattcggcaatgatggatgctttaaagagcagcggtctttctgatacagatcagaaaaaactgcagacactgcttggaatgacggcatcccagcgtgtggattccctgatggatgcaaacggaaatgtctacacgaagtccgatacggacagtcttggtaataccatttacagctataaggatgagaacggtgatacaacctatatccgcaggatgattacctatgaggatggcagcaataacgtttacaccaagaatgacgacggcacatacacagatggtaatggtcatgtatggaaagcaaccggcgggaaggacacagacggcaatgccacgtattcatatacggcggatgacggtacggtgaacactgccacgatcaaggagaacaccaattactatgaggtaaccgcagaatcgcgtggaaccggttattacaagtatacagacagcaatggtgtgacctacacacagaatgacaacaatactctggcaggttctgacgggaatacatacaaaatcagcagtggcaatctggtacagatcgacagtgacggtaatgaagtagcagacggcaagacagttgcactttctgcctgcacacagagtgaaatccagaagatggtgtatcatcagaaagccgcagcaacagatatcggccgtgccgcagatgcgcttacagatttaaaagaagcaaacaaggacaccctgacagatgattttgtcaacaagatgacctcaaatgttgagaaagtcaatgcgtttgaaaatgcggaggatacgttagacagcgctgacagtgcttccagagcgagcattgcagcagcggtaaagaatgcctatgcggcgagtggttcagcgggggtgacgacgcttaccaatacctacgcatcacagattactgccaacaagacagccatgaaggcagaccaggatgccattgataagaatgcggtattgtcgaagctcgcggcgatggatgagacatctgcagagtatgcaaccgcatttgcagactttgtgagccaggtgcagagtgcccatgagattcagaacggcacgaacataacgtacaattcagatgctaagaagatcgatggtacagattccgagattcttctgaatggaatcaaatataccagttcgctcaatacatataccatcaacggtctgtcgatcactgcattgcaggcaaccggtgcgggagatacgaatgcgatttctattaccacatcgacagatacacagggaatttacgataaagtaaaggatttcctgacacagtacaatgcgctgatcaatgagattacatcactctacaatgcggattccgcaaagggttatgagccgttgactgatgatgagaaagatgctctctcggattccgaggtggagaaatgggagcagaagatcaaggattccctgctgcgccgtgatgagagtctggaaaaagtcatgaatgccatgacatcctcaatgagcaagggctatgaggtaaacggaaagacctattatctgtccaactttggcattaagactctcggctacttcaatgcgccggagaatcaggaatatgcataccatattgacggggacgaggatgacaccgctacgtccggaaatgccgacaagctgatggcgatgatcacttctgatccggatacggtaatttcctttatgcagcagctgacaagcggtctctatgatgcagtcggcgagaagatgaagtcatctaccttaagcagcagttacaaggtatataatgacaaggagatggcatcagaatacagcgattataccgatcttatcaagaaatgggaagaaaaactgcaggacaaagaggattattattacaataagttttccgcgatggaaacagcattatccaagctgaacagccagacatcctcactgtcgagtctgtttggaaattagacggcataatgccgtgaaagcgtctctgctgagtgcataaaagcaccggcagagacgaatatatgtatggaggacaaccattatgttagcaaatcagggatatgcagcatatgccaataacaagattatgaccgcttccccggcagaacttactttgatgctttatgagggggcaatcaaattcgccaatcttgcgatcgaggggatcgatgcgaatgatattcagaaagcacacaataatattatgaaggtgcagcgtattattgaggagtttcagagtacacttgaccataaatatccggtggcaaaggattttgacgaggtctacaactatctgttgatgcgccttcgcgaggcaaatatcaaaaaagataaagacatcatggaagaggtgctaaagcatcttcgtaccatgcgtgatacatggaaggaagttatgagaacggcacatgcatcaagatagaagcaacggtgtgtcggttacagcagattgacaggagcagcgaatggagaagaatccatatcttacaatcatgatccagagcctgaagaaaaaaagtgcggttctggatgcgattattgaactgaatatacgacagaaggaagaactggagaatccgggtcttgatccggatgactttgacgcctgcgtggaggaaaaagcaaagcagatcgaacagttggagcttcttgacgccggattccaggaggtttacgataagataaaagcagatctgcagaccaatcagcaggaataccgcgaagagattgcggaaatgcaggaatacatccgcaggctgactgataagagcgcaacgattcaggcgcaggaggcgcgcaacaaagatctgatgacgcagaagtttgcctctgtgcgcaaacaggtcaaggaagtgcgcaagagccagaaggtcgtcaatcagtattacaagagcatgatgaagtccggctatatggagccgcagtttacggataataaaaaataattgcagatagtaaaaagatttttcttttttctataaagtatcgtgactttcgtccgatatatattacaagtaaacaagataacaattgttacttgaggtggaagcttaagcggagcgtacggccgggagaggcagaaaccacattacaaagcacatgcagcatggatgctgcatcatattcaaggaggaaacaattatggtagtacagcacaatcttacagcaatgaacgctaacagacagttaggtatcacaacaggcgcacaggctaagtcttctgagaagttatcttctggttacaagatcaaccgcgcagcagatgacgcagcaggtcttacgatttccgagaagatgagaagccaggttagaggcttaaataaagcttctgacaacgcacaggatggtgtatcccttattcaggtagctgagggtgcattaagtgagacacactccatcttacagcgtatgaatgagttagcaactcaggcagcaaacgataccaatacaacctcagacagaactgcagttcagcaggagatcaaccagttagcatctgagatcaccagaatcgcttctacaactcagttcaacacaatgaacctgatcgatggtaacttcacaagtaagaagcttcaggtaggttccctttgcggacaggctatcacaatcgatatctctgatatgtctgctacaggtcttggcgttagcgaattagtagtatcttccttctctgcagctggtaaggcaatgtctgcagctcaggatgctatcagctacgtatcttctatgcgttctaagctgggtgcattacagaacagacttgagcacacaatctccaacctggacaacatttctgagaacacatcttctgcagagtctcgtatccgtgatacagatatggctgaagagatggttgagtacagcaagaacaacatccttgctcaggcaggacagtctatgcttgctcaggctaaccagtctactcagggtgtattatccttattacagtaatcattattgtagtaaatttaaaagccggcagtttactgccggcttttttcagcttaaaggtcagatagcgaatgagtaagatagaggaacataatcgatggatactgtaaaattaagaacagacatagaacatgcaaccgagtgcctgtaccagaacagggggcaggatggattggaagcagtccgcaatttattgccgcagtttcaggaaatgatacaggcaatctatgcaggggcagacagtgcgcgtgcgctcgaatttctggaagtgttaaaaactttaatcgagaactatcaggctcaggatatgctggggatggcggactgcctgaagggattggcagaggaaatgatcctttgcctggaagcagaagagaatcagagtccggagaaataaggggaacgaacagatgacattgctcgataagaatgaaaaagcatggaaacagagaaataaagcgcttctggaacagctttattctataacgatagataacaatatcataacggcagagacagagaagcaggagaagatctttggaattcagacgacgaacagggtctggtatttaaacagcagactggatccggaagcagcggcaagctgctatgcaaagcggtatccgccgcggatttacgagacctattttgtgtttggattgtcggatggacgacatattcgggaacttcttgggcagtgtgacgacaccaaccatgtcatcgtgtatgagccgaacgcttcctttttttatctggtgaactgcgtcatggacttgtcggatcttattgcggatgacagactgcagatctgtgttcccggggtgacagcagatatagaaaccattatgagatttacgctgcaggatctgaatttcatgattatggaattctgtattctgccgggatatgatgtcttgtaccatgatgcgtgtgagggattcatggatgcgatacaggaacgtctgcaggaagagattgtacataagagcacgcggctgacctttcagcgcatggtgccgcagcatacgctgtacaatatgaagcatatgatcggatgcagaaatatttaccagatcaggcaggcacttgagggattaaacgtcgaggagataccggcgattctggtgtccgccgggccgtccctggataaaaatatttcagaattgaaaaaagcacagggaaaggcatttattgtggtggttgacgccgcgctgcgcacggtgctgcgggcgggcgtaagaccggacatggtgtgtacgattgacccggaatccccggaccgtttctttgaaaatctggatgtgacggatctggcatggtgctgcaaccgcattacccgtccgtgggtattggaacactgtgcgaagcgggtgtactattatggcttttttgaaaagcgctggaatcagattctggatgagaacatggagtacccgtttccggatattccgtccggcggctgtgtttctgcgacggcgtttgcccttgcgtgctatctgggattccgcaagctgatcctgattggccaggacatggcgtttaccggcggaatctcacatacggcgggaattgaaggggcgttcggcgataatgacgaatatataaagagccgaaaccggattcaggtcgagggaattgacggaaccatgttagagacggatttccagatgtggtactacaaaaaatggtttgagaaggcgatccgtgcgaacgaggggctgattgaggttatcgatgcgacagagggaggcgcacgcatcgagggaacccggcttatgacattgaaagatgtcgtcgcggaatattgcagcagaccgcttccgttcgaggagattgagaagaacattccggatgcatattcggcggagacgaagacaaagctggcagcggaatggcataagatgcgccagcagattgacagcattgacacgcaggtaaagcagggacttgcgatacaggagaagctgctgcaggaactgcgccagcagcggtctgtggcggaactgatgccagacctgaagcgtatgatgggtcacaacgaagaactggaacagcttccgctgtttggtatgatggtgtcttatgcgcagacagaagaatatgcgctgggagatgaaatctatcaaaaagaagagatgggaatcgaggaactcgtagagaagaattatactctttatcagggatatgagagagccgtatcgcttctgacggaagacattgaaatgtatgcctaaaaagactgccgcataaaacgggaggttgatttgaggtgttaagtaatatgataagaaacacatcccaacgatttcagatggaaatgccgtattttttgatccgaatttccagatgcattccatctgaaatcgaagggcatgctcttctcctcatattacttagcgcgtccaaagtgactgtccgtttcatgcggcggccttttttagataacattcaacatagcgttgacgcggtggacaaacgtgtgggattccgacattttcccaaggcagtttgccgcgatctgtcttctctcagcatcatgtgagaggtagtaagtgattttgccaagaaaatcatcctcgctctcataaaatacgagatcttcgcccggctgaaaatcatccagaaaatcttcctgatagttcgtcagcaggaaaccgccgctgcccatgatgtccatgcagcggagcgggatgccggaatgaatactctttaacgtgatgttcaggttgatgcggctgtgctgaaaaatgtagggcatcgtgtcgtaataatcaacgggaccgatgtactccgcctttgggagaagaggactgggatggtgtgtatacaatttgagaggaaagcggtcggaggcaaggcgcagcagtgacaggcgctcgttggatgtaattttcctgcacaggaagtagttggcatatacaaatgtcgcggattccgtgccgtccggaagcggctggtacgggcatgcggcctgtagatcctcaaggataggcggcgtgagcagatcctcaagaaaaaagtagccgtagacgttctgctgcgcgagcataatggaatcgaggtagcctttggtatagtcggaaagaccattcagccgttcaaaaagattgtgctcctcgttgtatagcgaccccacaaatgaaatgtcggaggatacctgcggaagcagtgcgtccgggcacttcatggcagaaaggcgggatacgtttgccgcgagcggaagataatatacggttgggattcctgcgttatggaatttcagataggtcgccttgtcaaaaagaaatacataattgcagggattgatcagcgtgtaggagtacagcgtgaccagggggctgtcgtatacgtacgaaatgtatttcagatgatgcttcatacagcagtttgacaaaatcggaaaataattaaaggaaaaaacaaaatcgtaggaaaaacgggaaacggcggcgtcaaacttctcctcgtaagaaacattctgcctgtcgttgtacgcctcatgaaaaaagaggtcgcaggtaatgccgcaggcggtaaaggcgtctatcatatcctgtttggcaaaagccggtgagtctaaaaataaaattcgcataaaatcctccgtctaggaaagaccgtaagccagtgcaatcatctgcagcagccgttccgggtaagtgtggtatttttgaactttttcaaaaccgttgtgtgcaatctctgcacggtccttgtcatgggacaggtaatattccaccttggcaagcagatcatcctcacaagagaagcagtcgagatcctcgccgatcgaaaaacagtccggcagttcactctgtgcattcgtgagcaggaaccctccgcatgcgagaacatcgaaaatgcggagcggaagcccagtccggatggaacgggaggtaatgttgaggttgattttactgttcgcaaatacaagaggcatctgggtgtgcgtctttacgcgtccgcagtttctgaccggaagcccggtggtgtcgcttcccgtgtaaaggcataccgggtagcggctgccaagcgagcgcatgatagagatgcgctctgtggaagagatcttgggacacaaatagtactgcgcagccacagcacggtcatcgcgcctggaattctcaggcggaatgtagaattgcggcatggcatcgcggaaagaatcaacgatgatgtccggcagcagttcttcgagaagatagcagccgggtaattgcatctgtgcatccataataccttccagatagcccttcagatacgcatcttcggtctgaagccggtcgtaaggacatttctcggtgtataatgagccgacgaacgaaatatcggcggaatatttccggatcagatcgggggtggcgttcctgatgacgggtgcgtagcgggcaggattgccggctaacggaagatgaaagatgcattccgggttcagcggatgaaaatcctcatactgcgcgcggtcaaatagaaaaatgcggttccacggaagccggattgaattggaaaaaagctccagcaccggagcgtccaccgtcagacacagatagcggatctgaaagatattacatacttctgcaataaaagggtaaaaattgatgctgaacacgaagtcgtaactgtgacgcatcagctcgtccttcagtgcggtcagtccttcgagcggagttgtgtttttgttgtagatttcaagacatatctcagagacctgattgccaagttctttaaagccgtcgattatatccggttctacaatgctgccgtagcggtaacacaatatattcatagatcgttcctcaatcatcaaaaaaattgaattccatatatgattattatataataattacatgcacactgacaagggtcagcggggataagaaatgaggagacagctcatgaaaaggatactggtgataagagggatttcagcgtatgacgtactgggaagagcagcggatgaaatctgtgaggggttccgcaaatgcggatatcaggtggatatgatcggggcgacagatcccggagcggatgacaggtttatagaatgcctggagcaccgggatcagtatgcgttttatttttccatacaggcgatcctgtggaatctggaaagcgaaaatttgccggagcttgcggagatgaagcgtgtcggctggattgtggacgatccggtgtaccaccagaaaagaatctggggaagcctgggaacaaacgcccgtcttctgatggtgcgcgattcgcacgcggcgcagctgcgggaggaattttcaaagttcgagcgggtggagacgctgtatcatggcggatttctgccggagggctgggtaccgtaccacaagaaggacattaccctgttttttccgggaacgtacaaaccgctgcgggattccgagagcaggattgacgcgatacctggcgtgttcggaaccatagcaaaacaggtaatgccccgcattgtgggagagcatctggcgagctcctggacagaggaagtgcggaactatctccgggagatcggatttgaatacagtgaggatgagttctttgcgatgcagaaagtgctcgaaccgctggaccagtaccagagagactatatgcgccagagcatcatagagacactcctgacaaacggtctgaaagtcgcggtggtcggtgctggatgggatgcctatgacggcgcgggcagggaaaatctggaaatactttcctcagagggcgtcgatatcacagaagtgataaagctgatgcagcgctcgcgcattgtgatcaacaatacgaacatactggatggcatgcatgagcgcatttttacggcgatgcttgcgggagccgtgtgtgtgacaaacgagtacacgctgttgagcaaattactggtacctgaaaaggagattgtgaccttcccgctgaacagactggaggagcttccgcttcaaatcaaagatcttctggagcatgaggaacgggcggcggaaattgccgaagcggggtatcagaaagcgctggcacatcatacctggcagcatcgcggggagcagatcgtaaaatggatggaagacggcggcgattttcagtatgaatagaggttatgagaacggacaaaaagttcgatataaactatgatatggcaacaggatgttgcgggaaagtaggaggcttacatatgttaaacggaaagacaatattggttacaggcggaacgggatccttcggaaatgcgtttacgcagtatgtgctggatcattatgatgtgaagaagattattatttattccagagatgaatataagcagtttatcatgagcaacaaatttaaaaagtacggcgataagctccggttctttatcggagatgtcagagacagggagcgtctgtaccgtgcgtttgacggagtggattatgtcgttcatgctgcagcattaaagcaggttccggcgtgcgaatataacccgatggaggcagtgaagaccaacattaacggagcgatgaatatcgtcgatgcagcattagactgcggcgtaaagcgcgtggttgccctgtccacagataaggcggtaaatccgatcaacctctatggcggtacaaagcttgtatcggacaagctctttattgccgcgaatgcatatgcgggagccaaaaatgtctgcttttccatcgtgcgttacggcaatgttgcaggaagccgcggatcggttattccgttcttccgtaatctggtagagaacggggagaaggcgcttccgattaccgattatcggatgacacgtttctggatcagcctggatgaaggcgtgcagcttgttattaaggcactgtcggaagccaagggcggtgagacgtttatttccaagattccttcctttaagatcacagatctcgcgcaggcgatcctgccgggatgtgagatgccggaggtcggcatccgtgagggagagaagcttcatgagatcatggttacgcgtgaggactccatgatgacctacgaatatgagaagcatttcattgtatatccgcacttcgagtggtgggatgattccaagatccaggcaggcggcaagcgtgtggagcagggctttgagtacagctcgggaaccaacacggaatggctgtcggtagaacagattcaggaaatgcttaagactgtgaaagaacactaatggaggaaatcaatcatgattaaatattgcaagagatgttgcctgccaagtaccaaacctcatctttcttttgatgaagagggaatctgtaatgcctgcaggaattatgagaaccgcaaatccgtagactgggatgagagaaaagcagagctgatggagattctggaccgctatcgttccaaggatcactcaaactgggactgcattattccggtcagtggcggaaaagacagtacctatcaggtaattaccatgctggagctgggcatgaacccgctctgcgtgaccgcgacaacctgcgatcttacaccgatcggaagagagaacatcgagaatatcaaaaagatgggtgtggattacatcgaagtgacgaccaaccgtgtggtacgtgcgaagctcaaccgcatcggactgacagaggtaggagacatttcctggccggagcatgtcagcattttcacggtaccggtgcgtatggcggtgaactttaacgtcccgctgattatctggggagagaattcgcagaacgagtatggcggaccggcggcagcagttgaaaataacgtgctggaccgcagatggctggaagagttcggcggtatgctcggtctccgcgtgaatgacctgatcggtcaggaaggcataacgaaaaaagatctgattccgtttacgtatccgacggatgaagagttgaagcgcgtcggcgtgacgggaatcttcctgggatactacattccgtgggaaggcctccacaatgttctggttgcaaaggcgcacggatttaagagctggggcaaagtggtcgagggcgattatgacgactatgagaatctcgataactatcaggcgggaatccatgaatacttcaagtacctgaagttcggattcggacgctgctcggatcaggcatccatgcatatccgcaggggacgcatctcccgtgaggaggcaatgcaggtggtaaaggagcgcgacggcgcattccgctggacttacctggacaaaaagctggaggatatcctcgagccgatcggtattacggtagacgagtttatcaagatctgcgatgagtttacgaacaagaagcttttcctgacggacaagaatggtaagctgatcaaggataaaaacggtaatctgaccaagataaactatgacaatgtagaagagaaagacaacaaataatggaaacagtcattatagattatggaatgggcaatctgctttccgtacagagagcgtttgaaaaatgcggatcggatgcggtaatcatcgataatccgctcgaccttagggaggcagagcatattgtgcttcccggggtcggcgctttcccggatgcaatgaataatctaagagacggcggatggattgaggaattaaaccgcgccgtgcttgaaaaagagacaccgattcttggaatctgtcttgggatgcagctgctggcagagcggggctatgaggtctgcgagtgcgagggactgggatatattccgggcgagatcgtgcgttttgaacagacacaggcgaaggaaagaatcccgcatgtcggatggaacgacattgaaaagcgcgtggaaacgcctctctttgatggaattgaagatggaacgaactactactttgtgcacagctatcattttaaagtgagggatgaggagaatattgccgcggttactccgtactgcggtgagtttgtctcggcagtggcaaaagatcatattgtcggtacgcagtttcatccggagaagagccagaaagccggttttcgcctgattaagaattttctggcgatgtgacggaagagagaaagggagcagagatagagagatgttaaaagttcgcgtgattcctaccttgctgtacaaatcagtaggcctggtgaagggtgtgggatttaactcctggagaagagtggatacggtattgccggcgattaaagtatacaacatgcgcgaggtggacgagctcattttggtggatattgaggcaaccaaagaggggcgcgatccggattacgagtccatccgtgatttttcgagagagtgttttgtgccgttctgcgtgggcggcggaatctgtaatatagagcagatccggcagctcctccgggccggtgcggataaagttgcgatcaacagtgcagcgtacgacaatctggaactgataacggaaggcgccagattattcggatcacagtgcattgtggcaagcatagactgcaggaagatcgacggttcctaccgctgtttttcgcataacggcgaagttgacacgggatattcgctggaagaatgggtccagaaagtcgtggaagccggtgccggtgagattctgctgacctcggtggaactggatggaaccatgcagggctacgatgtagagatgataaagatcgcgacagagttagtgaatgttccggtgattgcatccggcggtgccggcagttacgaagatatgtaccaggcaattacgcagggcggagcatcggcggttgcagcggcgagcatctatcattttacggaacagacacccagggaggcaaaggaatatctgggagagcggggcataccggtacgaatcaaataatggttttgcgggtgcgccaaaataaggagcgaatatggaactcggaacattcatcggacaaatctgccgttatagcaggcaggaatattttgaatgttatggacagatagaagaacggcttcataatttggagaaaatactgggaacgctggaggaatcgcagcgcagcatgatattggagcagatggagcaccaggcaggagaagcacctgtctggatgcggatacatctgctttctttttgtatgaaagtgtcaaagacgccggcttatacgcaggagctgctgcaaacagtgctggatgcagactggaatgaagtgggggaatatgagaagctcagcgattactggcagattggtacggctgtgtttgccgatgcgcggctcaaaggggagcggacacaggaacagctcgcggcgctgtaccggatgctgtttgatgctttctgcggggcgctgggaatcaagggacggaactatgttccggtagaggagagagacgggaatctggtctttgtgatgacctcacaggtgctcggccagaaccatgcgccgacaaagacattgctcgaccgttgcctggtgctaaagaagtacctgaggaagaaggtcgtgatcatcaacacggcgatgcagatttccggaaaaggtgcggggccgttctacgatctctgtgaggcgggctatctgccggaattgtgcagctttgatcacatcgagtttcagggagaagtgttcgagtttcatcaatgtgcgaatgatatgccgaatctggatacgatggtacagctggtgcagatgattcgggagcggaagccctgttatctgctcgatatcggaggaagcgacatctgtgcggatatttgcggtatgttcgtgccggagattacggtggggacggttttttcggcggtggcgatgtcctgtggggaataccagttgctggacggaaagccgggaacaggagatctgcctgtgctggaacgcctgggagtggatgcggaaaaaatagctgctgccagatttacatttgtatttaagccgcaggaacaccactataccagacaggagctggggatctgggaacacggatttgtcctgatgatcgtgggatggcggctggattcggaaattgccgatgattttctggcgatgctggatcggattgccgcacaaagagagaatgtgcaggtagtctttatgggacgctatgagtcctggcaaagcatacagacgggctatgagagactgtggaagcatacgcggtatctcgggaaacaggaggatgcgctcgccgttttcgcgtgcggagatctctatgtgaatcccagacgtgcaggcggcggaagctctgtggcggaggcgctgtatcagggactgccggcggtgacgctgcccgaaggagatgtctcggctgcagccggcgaggcgtttcgcgtgcgtgattatgaacagatggagcgggagatcctgcgctacatggatgatgccggatattacggccggcagtccgcccgcgccagggagcgtgcgaaggaactgctcgacagcagaaaaagctttggggaagcgattgaaaagctggaggagaagataaaagatggtgtgtcgtgctaagcataccttgctttgataagtaatactataagaaacacacttggggatttcatgtggaaatgcaactggaaattcggatcaaaaaatatggcatttctaaccgaccggatgtctgcatcttcgatgatccgtgtctttccaagtttggagcactccgcgggtcatgtccgcatcccggaagacaatttgtaggacttttgtgcgtgtcccttatggcacctctgagcaaaacataaccgcgcgaagccgatgtctgagtcggcatctgccttattttcaatagcagatgcccgcgagtttcggttcgcgcggttttatattgtctgtgaagaggtgccattagggacaccagaaagtccgcccattgtctccggtgtgtcggacatgcacccgtcggattgtccaaacgtggaagagacacggaatccgatgcagacattcagccggaagaaatgctcacatttttctccaacgaatttccatctgcatttccatctgaaatcccacgatgtggtcttcttatagtattacttatcacccaaaagggggctatgcttatcgcgacagctcgttctttctaaaatgatctcgtatttttcgataatgtcgagcagctgcttatgctccagccggagattgctgatataattgataactgtcggatctgtcacaatctcatgcagggtgtgttccatcagatcttcataaaagggaacgtctttcgcataatcccaccagagctgttcgatgtcgcagtgaaaacagttgccctcccacggcttggagccgcagaaatgaacgatggcagcctgcgtgcggacggtctcatagtgcagattgtgtgcggtatacgctgtccgtgcgggcaggttgtagactttgggatcaagcggaagaacagcggaaagttctttttgcaggaaaaatggctcccaggatgcgtcacaatccagattgaaaagcagtaccccgtctgcaatgccggacgctgtctggcaggcagcgagcatatgatgcgtcaggtcggctgcatacagcgcggacaggggggcattgacaatgacgtcggaatccagatagaggatgcgcggcaaatctgccgggagaatccggggaatagacagataaaagagactctctggggctgccggtgcagcgttgtcatctgcggaaagcggaatctgatcctccgatagccggcagtcgtttatgacaagcggatgcgtgtgggtcagtgtgcgcaaaaaatcaaaatcggcagggcacagttcccgatgcaggacatagacgtcaatgggacatgcattatttttcagaagggaatgaagcatgacataggtgtatggcagatagtatttgctgacagataccgcaatgttcattggttcgggcttcatgaaatggttcctccgtgcgtttctaaaagctgttcgtaggtttcaagtttctggtagagtgcggcgtttttttgcgccagatccgcaatgtacggattgagcggggagtccataatattttcgcgcagggcctcctccaataactggcggtaaaacggcgtgtgttttgcgtattcccaccagagccattcgatgtcatagtgtaggaagttgccgcgccatggtttggaggacgcatagtgaatgatgacaccccgctgctttaattcgtcgtaatggatattatagtcgtcatatccgtatcgcgcattcagattgtacagaaagggatcgacaaaaagtgtgtcctggtaatgacagtaatttaagagatcctgatccggatattcgatcgcataatgcagtttccttgccgtatccatataggtctggaaggaatagtccgggcggagggcggcgagattgtaaagaatcatgccggagttgaaataggaaaaaccgtgttcaaagagcggtgcaaataaaacatcccggtaatttccgaacgggggatggcaggtaaattctttgcaggcagcgataagctttgaaccaaaatccaactcatacagatcatagaccggcgcatttacaataatgtcggtatccaggtaaagcgcacggtcgaccgaagcgggaagaagatctgtgatcgcaagccggaagtaggcttcgatcccccagctgctggttttaagaacttcgggtggaggaagcagggaatccggaacatacaccagggatatatgcacggcaaactgctgacttaatgtctgcagggtggcttcatcctcgggggtaagctcatgatgcagaatatagaccgatacaggttccgggtgatggcataaaaaagagtacagcatcacataggcgtactttacataaagccggttgatagcgatgaccagattgataggcgtatgattcataaaaaatatccttttctgaggttataatatcataaggttatatcggtttagacggagggaaagttaataaatggatcgcagataccgatataataaagtagactttatgaggatttgagaatgataaaaacagtaaaaaaatcacaaaacagtaactggtttatggatcttctgcttgacgaaacaatctgtgccggaaccgtggcggttccgcgtgaaatggtccgtctggcaggcggggtgaataaaagactcggggcaaaacagaaatatgagctgctgctgcggatcgccgcagagacgccggttgagtttgcggagacaggcgaggacgcgtgcggacaggagaatatgatggtattcgacgatgtagagacgccggagaatgccggcatgggctggcggacggactgctacgttctgggaaagtacagcgcacagctgcaggaagccggctattttaatgctgccatcgaggcggtgctcgcggaggcacagatggaagggcgctatgaagagacggtttcctatctggaagggatgatcgggcataaggaggaatattaccggattgatgaggcagcacagccgattctgatctacaagggagacccggtatgttataacatactcacgatctttgcggaacagctcggagcggctcttgaacgcatgggagagcgggttctttatttcgatcaggaagaacacgatccgcgtgaaattatccagtttaagggaaggcattttaaggcggtgatcggggtacagtcctgtgcgttctcgattaagatggaggacgaggtccactatctgcacgaatacatatacggtccgaagtacaattttttcctggatcatccgatctggggaaagccgcactttgaacatcattatccggattttcatgtgctggtactggatcagacatatgccgatttcttccggcgcttctacaaacaggatgcgattcttttcccgccggcaggaatggagacgggggaggatttcatagagcggatctatgacctgacattcgtcggcacctatggcgggtatgagatgcagctgcaatggatccgggaacaggaacgtccgttgcgcttcctggcgaaccgtttcctgcttgtcatgcggaaatatcccaacctgaccgcggaggcggcgttttccagaacgctggagcactacgggatagagctgacggatgaggaatttgtggaaaaaatgtatgcggtcagacgggtgatttacggcgcgatgcactattacaggcaccgtgtgatcgagacgatcttacaggctggaatccggctggatgtgtttggcgacagctggacgcactgcccgctccggaaatatcccaatctgatctgccatccgggggtcaccgtggaggagggacttcatgtgtggagacagtccagaatgtccttaaatgtgatgtcctggcacaagggcggttttacggaacggatggcgggaattatgatggcgggagccgtgctggttacggataacaccgggtatctttccggcaggtatgatgagaatgatatggttattttcgatctggaacatctggaagaactgccgggaaaaatcaaaaacgtgcttggggatgaagaaaagagatgccggatggcagagagcggcagagagaagacgcggagggaacatacctgggataagcgggcggagcagttcctggaactgctcgacaaccggtaatcagcagtcttttgattctgcggcaaagacggtcagcatatgggacagctgggtgtgataggagaaaagatcacaggcacgcctgtatccatgtgcggcaatggcacagcgttcttcctcatgcgccagatagtagcagaccttctgctccagatcatccatatcgttaaagtagacaaaatctacatccggagtgaaatattcgcataattccggttgataattggagagaagaaaaccgccacagcctaaaatatcaagtgcgcggagcggaatgccggaagtgatggaacgcagcgtgaggtttaagttgatccttgatcggtagaaaacatccggcatttctgcggtgtaggataccgttcccttcgagagaacatccggacagcatgcggtgtcggaaccggtgtagagggcgacggaatgggaggccgccagacggttcacggcttcgatccgttcctgtgaggtgacctctttttgaatgatgctgcaaaaaacttcctttgcagtcagcatttcatattccgcaccggaataaggcatgaaagcggtgaattccgcgagccttccgggagtaagaaccggcgagatgaggtcgattccccacacttccttctgggcagcaatgatgcctgccagatagccgcgcagatggttcggcgcgtagcggaaggaactgtaatgggaactctcatagagagagccgacaaatgaaatatcgtgcatgtaagtatcgggacggagcagaccgccttcggatgaaatgccaagctgttccttaagccgtgctgtgttgacagcaagcggaagatggaatgcgtgtctggcaccgcgccggatgactgactggcacatatcccggtcaaacagaaaaagatagttacaggagttgcgcatactgttagaataaagcgtatagtgaggacagtcaaaaacccagcagatatatggtatgtgaagggactccgccatatcggaaatcagcgggaaaaagttaaaggtaaagactgcatcataggtctgcgcctgcagctggtcccggatgtcggacttgacgccgccggaaaagtaataggaaagctcatgcatacagggggagacctgatgtcccagcgcctgcatggagaataaaaaatctgacgtcgtattttcttgccaactgtagtagaggatatgcattgcatgtacttcctttccgagacttgtctgataagattatataaaaaaacagggaggatggcaacgattatgaaaatagcggtgattacctgtgtgaacaatgaggaagagtatgcacaggcgctttcttatattgaccgtctgcatgtgccggacggatatgaactggatgtgattgcagtgcgggaagcaccgtctatggcagccggctaccagatggcgatggaacatacagatgccagatataagatctatatgcatcaggatacattcatcatcaacagggagttccttcaggacatgctctccgtttttcggagcgatgacaggatcggggtgatcggaatggttggatgtgatgatgtcccgatcaatgcacaggcggttgcggcatggaacgtcggatgtgtctaccataactgtatcccggccagggtgcagtacacacagcgtgtagacaggcagccggttgacgtggaggcagtggacggactgttgctcgcaacacagcatgatgtgcgctggcgggaggatctgtttgatggatgggacttttacgatatttcggagtgctttgagatgcggcgggccggctaccgtgtggtagtgccgtaccaggatagtccgtggtgttatcatgacaatacatacagcaaaatgctgaattattacaaatactgtgaaagagcggtcggggagtatcaggacatcaaaccgtttgtggcaggcgaggtaagtgcaaggcgcagggaatatgacagactcagagaggattcgagagaggaactgaaacggctggtcaacgctggaaatcagggagaactgatagaaatcttttccgacccgaacaaccggggttatctgcatctgcgcgaatacgagatactggcggacattgcgcgcggcgaacgggcggagggcgagatgcggttctggcaggcgggagagacctgtgaggagctcgtccggaagataaatgatctgaaatacagattaaaaagagtggaattcggtgcggatcagggaaaaccggacattctctacatcctgaagaattattctgtctgtgcgataaaaacggttgcagcggcatatgaagtggtggacgaacgggtatggaaacggctcgcggaaaatatgtaagataagaggaggagaaaagcgatatggagcgaaaaaatgcggttgcggtcattacggcgcgcggaggaagcaagcggattccgcacaagaatataaaggagttctgcgggagacctattatcgagtattcgatagaggcggcattaaagagcggcgtgtttgacgaagtgatgatatcaacggatgacagcgagattgccgagattgcaaaacgggcaggggcagcagtcccgttttaccgttcaaaggaagcggccggagattatgcggcaacgcacgaagtaattctggaagtgctcgaagagtatgaaaagcgtggagtgacatttgaaaaagtgtgctgtatttatccgacggcgccgtttctgacggcggatgtgcttagggagagcatggagcgcctggagcagacgggggcagacggggtggttccggttgtggcatattccttcccgccgcagagatgctttgtcattgagcaggacagggtgaaatacaagtgggaggagaaccgcttgaagcgctcgcaggatctggagcggtattatcatgattgcggacagttttatctgctacgggtagaagcattccggaaggagcgcagcatggtcttacacaacaccataccatacattatggatgagatgaaggtacaggatatcgacacgccggaggactggaagcttgcagaagtgaaataccggcttggcatgtaaatacatgcaaaggatggattcttaggtaaggagatagaaggaaaatggagtttccacagaactatttttgcgcggaagtgagagacgattttgagattcccgcaatgatgaagcgcgcctgggcggcagaactggaagtattaagcgtgattgcggatgtatgtgaacggtatcatctgcagtattttgcggattacggtactctgcttggcgcggtgcgccacaagggattcataccgtgggatgatgatattgacatctgtatgctccgggaggattacatggagttgatccgggttctgccggaggagctgccgcagggattttgcatggcgggaatgtacgccggggaaaagcgcctgcagatggcggcgtatgtgccgcatctgagggttatggcggatgaacggatgtggaacatcaacacgtacatgcagcgttttcacggttttccgtatcagcgcataggaatagatattttcccgatggattatgtcccgagagatccggaattgagccggcttcagaaaaaaatcgtggagacgggaattgccctgctgcgtgactgggagcagcttcagaacgaaaatttacttgaagataaaataaaggtgttcggggaactatgcggtattcagattgccccggatgcagacagacagaatgagatatggcgtatcatggatgccgtgcaggcgttataccgcagggaggaagcggacgaggtgacaaattacgtgttctggctcaaccgggagcagctgcacatccctaagacggcgtatgaaaagacggtatacctgccgtttgaacatatcaggcttccggcgccgtgcggatatgatgaggtgctcacggcggaatacggagactatatggttccggtgaaggggacggccgaccacgattatccgttctaccggcatatggaagaagacttgaagcgggagctccaaagggtcggttttaaaggaaccgtggaggaattctgtgaaaaggtatctgccggtgaactttatgtataaaattttgtggatgcagagtgctgttacgaaagcatggaggagaaagagatgagtggggagaagggtacggaacgggtgctgtgcaccacatctgaggaatatgcaagagagcgtgagaaagagtatatgctatgggagacatgccatagtggtgatttgaatgttttattagaaaagacgaatttgcttttgcaaaaaggcgatgaacacgcacgggaagaattgatgcaattatatttaaatgaagagattgtgaaaccgtatattggcattgataatagaatcattgaactgcggacaataatggagatttacagtttagaagtgaaagcaggagaggaatataccatcttaggaagaaaaaatattgcaaaaggatggacgttggagaaaatcagaagttatatacgtgaacttaagtttttgctgtggcgaatggaatttgcggatgaagcggaaacggaagcaggagagaagctgatcggttttataaaggaaaacagtgtttctccggtatatttgatacagacaattcgaacgacagcaatggagacgtttgacgtgatggtaaacattgttgaaattatgattgattcgtctatgtacaggcatgcatactggatactacgagcaatgcaggaggaaaaaccgcaggaagaaagtattcaaattatggtacaagaattggggaaatatgtaacggaataatatatgtggtcaggtggagttggtatgaacgataaaaagtttgcatttgtgatgtgtgcaaataatgaacagtatgaaaaagaagcgttatattacatagaacgtttggaggttcctgagggctattcgtgtgaaagtgttgtgatcagagaagcagagagtatggcagagggatataatcgggcaatgcaattgagcgatgccagatataagatctatatgcatcaagacgtaatgattacggaaaggaaatttctgaaaaaaatactttccctgtttaaaaatagagaaataggaatgataggactggttggttcaccggtatttccggagaatggtgtcatgtggtatggcgacaggattggaagtttatatacgcaaggctcggaaggatatggaacatatatttttggacaagttgcggctccgtgtgaatacgtggaagcggtggacggatttttaatgataacacagtatgatgtaccgtggagagcggatatatttaaaaaatgggatttttatgatgtatcccaatgctttgaattttcaaagcggggatacaagatcgctgttcctgcaatgctgaatccgtggtgtatccatgattgcggtgcatctgattatcatgactattttggtgaacgcgaaaaatttttgcaagaatatagaaatagttgataagagttccttttacaaaaaagatattaagcaaatggaaaaaggaaccgatatatttaacagtataattatgagaaaggaagccgggatggctgtgctgcgggtgcagtgagggaaagatcatggaagataacagagcagaacagatagaagcactggaggttttgacagagttcaatgaccgcctcgtgcataatatggagattattgtaaaagagttaaaaggggagcgtctggacgataccgatcagtttttgaaaggcattgtggatgccgtcaactgggagatacaggttgtcaacggaacgctggatacgctcaatgacggaaaggtccgtgttgacaaggcaggttttaacacggcgattgtagcgttaagcgatgcgattgcggcaaaggatgatgccagaatggcagtagaatttgaaaatgtaattccggtatttcagcaactgggcgaagcggcaaaggaagtaactaaataaagcgtcatagaaccggctttgggatgaccagaagccggttttttgcttggatataggacatcatcaggagatattgtgtgggaaagatactttattttcaatggaattcatttatgaatgacggaattgagcgtgcacttcagaaaatgaatataatctatgatactttttgttatcagtttgcggactgggaaaaagatgacgcgttttgtgagcagtttgaggcaaaaataaagacaggggcgtatagggcggtattttccatcaactatgcaccgctgatttcaacggtatgcgcgcggcatgatgtgcgatatatttcgtgggtgtatgattgcccgattcatatccgcaaccttgctacgctgaaaaattcctgcaatacaatttatttttttgaccgggtacaggcagaggagtaccggagccggggaatcgatgcaaggcacatgccgcttgcggtggatacggaattgtaccgacggatttatgagacagagtctgagcgtgcggagagagaaaaatacgagacggacattgcgcttgtgggaaaattataccggacggagtatcagcactatctacagccgctgtccgcttatcagaggggacgccttgagggcatcatcgcagcgcagctaaaagtgtatggaggctatctgattccggatcttgtgacggacgaactgctggcggaattaaatgactcatatgtgaaggccagcggcggcaaagtcagcatttcccgcagagaactggagtttttgcttgcctgcgagacaacgggaagagagcggtttcttgtcttaggactgctgtcccgccactttgcgacggcattgtggtccaatgagaaggacgagcgtctgacagaggttcactattacggatatgcggattactataagcagatgccgcatatttttcatgacgcaaagatcaacctgaatattgcgcttcgggtcatacagaccggaattccgctgcgtgtgctggatgttatgggctgcggcggttttgtacttacgaattacagggaagaaatcgcggaacattttgtgaacggcgcggagtgcgtgatctacgaggatatcgaggatatgtatgcaaaagcacaatattacctgagccatgacaccgagagacggcagattgccgccaacggccttgcaaaggtacagcgcgattttacatttgaacaggcattaaccggaatgttgggagcagagtagagagatgacggcgagagatttggatgagctgctgcaggaacagactgcatatgagcgcaaatgtcagatcataagtgaaatagccgcttacatagatggaatgagcaatcaggcggcatacagggagcagattgacctgctgtttgcggcgctggagaagagcgcccgggatctggagagcggcggagggctggatgatgtgtgcgcaaaagagattgtcggccgagtatcggatttaaagagagagcaggaaaaatatcaggtatggcttctgggggaggcggcggactgtgcgccggtggaaaaactgctggatgtcagtcaggttcatctgcttggcaccgtaagacagatttcggacgggcagagggaaagtgattacatcattatatgttcccagtatgaaaatatagcggggatacactggttcgggaaggtaagactgctccggtttgatcttttccgtctgatgaacgaaatcagcccggaggcgacgtatcagcagataaaaaataaaaaagaggtcacaacggcggcaggcgtcgtatgcggaatgagctacgagcagaagggcatctgctatgagagactggcgcgggatatcatgtgtctggcgggaccgtcgcaggatctgtacacggattattaccgctttttgtgggcatatgacgaaatcacggacagacaaaaacgccggatggagtattgcatcatcggaatgagcgcgtaccggctctggtgggatctgtcacggggatcacagagtctaagagtgctgggattctacccacagacgaaaaagctgcatcatctggactgggcagaggacgccgccgaggcatgggaagaccaaagaatctgtgaaaaactgatggggcaggacttcctggagcgcgactttctgggacggtttccgggaatcgcggagatttgtgagacgaaaagagaggaaatctatacgccgtcaaaggagcagcgcaaagaggatgcaaagtccatcgagcgtatttttcacaaaccgtatcccgagacatacaaagagaatcttgcggttttagaacgctggctggagtttttacagaaaaacaacataaaggccgtgtttctcttcatgccgttcccggcgcagttttgtgagctgacgagcggggagatgaagcggcagacgtatctggtgctggaaaatctctgccgcaaatacggcgcggatctgattgatctgggcggggatcagacggcatttacagatgcggacttttttgattggtcacacttaaacgccgcaggtgcggcaaaagtgacgcggtacctgaatgaatatctgatgcgtgaaacaaagcaggaggacaggatgcgggggctgcatttaagaccggcggatgcgcaggactgccgttttttgtacgagctaagaaatgatccgctcgtccgggcaagttctttccatacggaagagattccctatgagcagcatcagaaatggtatgagcagaagcggaagaatgagaactgcaggatttacattctggaagacgccggtgcaccggtgggacaggtgcgggcggaccgggatgagcggggcgaaagcgcagaaatatcctatgccattgcagagtgggcgcggggaaatggctatgcgtcgtggatgctcgcagccgcagaggagcagctttcggaaaaaggattttgcagagaattgcttgcggaagtaaagaatgataatatagcatcacagaaagtttttcagaaacttggctatgaagagcagagagaagactacggtttttcttaccgcagggcaatcggacagaacgcagacggtaaataaaggagaaaatatgaaagtaatcattgtcgcgcataatcagttgaaattagtgcagatggaaatagaggcgctccgcctgcttgccggaataggggagagagatctcattattgtggacaacgcttcgcaggacgggctgcgccagtggctggaagagagacccggcataaattatcttgtctgcgatgagggaagagagaattacagcaccattcttaactatgcgaaaacagagtttgtcacagatgaggacattttgctgcttgatccctgctatatgatactgccggatgctattgaagaaatgcagagattactgtactccgacagcacaatcggtgcggttatgccgaaggtgattcagaacggttcagagaccgcgccaagctacacagaggcaatctcgcggatacaggcagggcagattgcggcggggatgaatctgcagaagctggaactgaccgcaggctgtgtactgctaaagtatgcaatgctggaagaagtgggagcctttgatgagaagattgcccttgcggagaatgtgatgtgggattactgtgtcagggggatcaagcttcagtacaggctgtttgaaagcggcggtgcgttcttctatcagattgcggaaaagagaaccgcggacgaagacgaggaatgggcagtgtcagaccggcagattctgaagaaaaaatggaacatgaactactttaatgccgttccgaacgccggactgctttcctacatcacagatccggaagatgcccccatccgtgttctcgagatcgggtgtgactgcggggcaaatctgctctgggtaaagaaccgttatcccaatgcagagctttacggcgtggaaatcaacccttcggcggcggagattgcgaactgtattgcgaaagtgaccgtgggaaacattgaagaacgccagatggattttggcggagcgacctttgattacattgtattcggggatgtcctcgaacatctgagagacccggaaggaaccctgacatattgcaaaggctttttaaaaggggacggaagcattttggcgtccatccccaatctgatgcatgtctcggttgtgcgggggctgatcaacggcaattttacctatgaggacaggggactgctcgacagaacccatatccattttttcacctacaaagagattcttagcatgttactgcggacggaactggaagcggaggagataaggatgacctcaaacggagtcagctccgaggaccgggaatttgtaggcaggctgatggaactgtcggagattaccgacgagaacctgtttttcgcgtaccagtttcaggtacaggcgaagacgaagcgcgtagaatagggattcgtgttgaaaaacggtttggaacgtggaaaagaaaagggaggcggctgtcacagatgaaactatatgagaaaatgaacagcggggtctatgtgattgcagagatgtccgcaaaccatgcgggaaaaattgagaatgcattcaaaatcattgaggaggcggcaaaagccggcgcggattgtgtgaagatacagacctacacggcggatacgctcacgatcgactgcagggaggaaccgtatcagatcaagggcggtctgtgggacggctataattattatcagctctaccaggcggcctataccccgtgggaatggcagcaggcgctgcgggataagtgcagggaggtcggtgtggattttttgtctacgccgtttgaccggacagcggtcgatttcctggaggatctggatgtggagttctacaaaatcgcgtcctttgagctggtggatattccattgatcgagtatacggcgagcaagggaaagccgatgattatgtcctgcggaatggcgtcggaggaagagatcagggaggcacttgaggcgtgccggagacagggaaacgagcaggtggtgctgctgaaatgctgcagccagtatccggcgcagtatgaggatatgaatgtggcaacaatcgcggatatgaaggagcggttcggcgtgccggtgggactgtcggatcactcaatgggatcacttgcggatgttgtggcggtgtctgtgggagcgcaggtcatcgaaaagcatgtatgcctggatcggacgattgacaacccggacgcagcgttttccatggagatcggtgaatttgcgcagatggtgcaggatgtgcggaatgcctgcgtgattaagggaaaggcgacctatgagctgaccgaacatgagaagagcagtttaaaataccgcagatcgctggttgcggtaaaaccgattgcggagggggaggctttcaccgaggagaatgtgcgcagcatccggcctgccatcggtatcaagccgaagtattatcgcacgttgctggggcgcaaggcgaaaaaggcgtaccgcttcggagagccgattcttccgggtgaggtggagtagacagatgattgtatttcgggtggatgcgaacgagcaggtggcaaccggacatctgatgcgcacgctttcgatcgcgtcggcgtgcaggaagcgcgggctgacgtgtgagttttggctggcagaggaaaaagagacggagcggatcgcaaaggcaggatttccctatcggattctagagacgcgctgggatgcgctggaggacgaacttccggtcatgaagcagcggttacaggcacagccggtggactggctggttgtggattcctactgtgcgacggtgcgctatctggcggaattaaaccggatggtgccggtattctatgttgacgatttcagaagggaacactacgaggtgtcggcgctgcttcaatatataccgtgcagggagagacagaagacgccggaggggctgcatgaaaaggacggggtacagtaccttaccggacttttgtatgcgccgctccgggaggagttttcgcatctttcctttgataagccacgggagaagagtattcttctctcgacgggcggaaccgatccttacaatatggcgggcagaattcttgcgtacggcacacagatgcaggaattgcaggactatctgtggcatgtgattgtcggaagcatgaaccggaatgaggacatgctgcgtgaactggcggcagcaaacccgaagatcatacttcacaagaatattcccgatatgtggcgctacatgcagcagtgcgaggtggcggtctcggcgggcggtacaacgcttctggaactgtgcgcctgcgggattccgacggtctgttttgcgtttgcggacaatcagctggaatttgcggaggagatggcagaacacaacctgttaatttatgcgggggatgtgagagaaaaggatgatgcgccgcatgtaatctgtgaaaatctggtctgctatacgaaagacgccgggaagagggcgcagagctttgagcggatgagaaggctggtggacggaaagggcgcagagcggattgcggcatttttgcagcagtataaaagagatgtatgaggtagaaaatcatgccggtagaggacagaaaagacacaatcgcattcattatatgcgtgaataatgagctgtattttgaagagtgcaagtattacatagagcatctggaagttccggcgggatatgacatagatgtgatcggcatctgggaggcggattccatgtgcgcggcgtacaatctggggatgcgaagcagcgatgcaaaatataaagtctatatgcatcaggatgtttttatccgcgacagccgtttcctggagaagacgctgcgtatttttaaggagcacccggagacggggatgatcgggatggttggaggaatcggcattccggagaacggcgtcgtctattcttcctggaatgtgggaaaagtggactgcagggagccggatctttcctatgtcctgctgtgcgggccgaaccagaccaaggatcagaccgtcgatgcggtggacgggctgctgatgatgacgcagtatgatctgccgtggagagaggatctgttttcggattttgatttctatgatgtgtcgcaggcgtttgaattccgcagggcaggctatgagattgtggtgccttatcaggaagaaccctgggtggtgcacgactgcggattcgcaaagctcaccaattatgacaggaaccggaaaatctgtatggaagagtatccggaatttttcaacgttccggagggggaggagctgttctcgagcggagagtgggatcagctgagcagtcagctggcagcggcgatccgcaggatgatagaccaggggcaatgggacgaggccagtcaggccatcgggatctatcatcagagccagatgaagagctccgagctggagatgcttgcgattatctgtgagattgagcagacggatcgcagggtaagcaaaagatcgtcgtttctggcacaggcgggcagctgtgaagcgatatgccggacctatctctcggtacgctttttgctgcatcgcatggagtttgacagaccggcacaggattatcaggaattgattcacgcggtagaaagcggtaacatatcagtagatgccattctcattctgatcttacatggcgtgctggataaggagaaggttctcgggcagctggagacatggcatatgccggatccaatgagtgcagagcggcttagatcctttcacaggcggatgcagaaggaaaacaggggcattccgtattcctacagtaagagggcaaagatggaactggaaaagtacagcaaggaggaacagtgatgataccatacggaagacagacgattgaggaagatgatattgaggaagtagtaaaggtgctgaaatcagattttctgacgacaggaccgaaggtggcagagttcgagcgggcagtggcagagtatgtcggcgcgaaatatgcggtcgccatttcaagcgatacggcggcactgcatgcggcatgccatgcggcgggaatcggaccgggggatgaggtaatcaccacgccggtcacgtttgcggcatccgccaactgtgtgctgtactgcggcggaacgccggtttttgcagacattgatccgcagacgtacaatatcgatccggaggacatccggcgcaagatcacggataagaccaaagcgattattccggtgcatctggcaggacagccctgcgatatggatgccattcatgcgatcgcaaaggagcatcatctgatcgtgatcgaggatgcggcgcatgcgctcggctcggaatataagggacggcgcatcggctccatgtcggatatgacgacattcagctttcatccggtaaagccgatcacgacaggcgaaggcggtatgattgtgacggacagtgaggaactgtaccggaaattagtgctgttccgcagccacggaattaccagagatccagatctgatgacgagaaatgagggatcgtggttttatcagcagctcgatcttggctataactaccgcatgacagatatccagtgtgcgcttggctgcagccagatgcggaagctggaccgtttccttgctcgcagaagggagatcacaaagcgctacgatgaggcgtttgcggactgcgcgaatattgtgacgccgtatcagctgccggagacgaacagcggatggcatctctatatcatacaggtgaagaaccacgacagaaagaccgtgtttgagcagcttcgggagaacggcatcgcagtgaatgtccactatattccggtgtattatcatccgtactaccaggaacacggttacagagaagtacattgtccggtggcggaggaagtctactcgcacatcatcagccttccggtttatccggggcttaccgacgagcagcaggatacggtcattgaaacggtaaagcggctgacaaaatagtttccggacggtgagggagaggcagatcttcagaaacagcaggagaatagagcgggatgggatatgtaagattaaagcaacttattgagcagaatgcgtggagggaagccggaagagaactcgcgcagtatatgaacggggaatgggatgatgaactcgccgtgctggcagcaacggttttctctgcgctgggcgactgggaaggcgcctatacctgtatcgcgcaggggctgcagtataattacagaaattatgaactgtatctgctgctgggcaattattatgagcgcaaaaattgcaatcaggcgtggctctgctatgaaaatgcgctctattattgcagcgatgaagatgatcgcaggatcatacagcagcacaaagagcgtgtacagcaggatgaccggtggtgcgtgcataaggtttcaattgtgatattgacatataacctcaaagacatgaatatgcagtgtatcggcagcatccgggacacctgcgctccgtcgagctatgagttggtcgtggtggacaatgcatctacagacggcacgctggaatggcttcaggagcaaaaagatatgacactcgtgagcaaccaggaaaacaagggctttccggctgggtgcaatcagggaatcaaggcggcagagccggaaaatgatatccttcttctgaacaatgatacgattgttctgcccaattctattttctggctcaggatggggttatatgaggaggaacggatcggcaccacgggaagcatgtcaaacagcgtgatcaacgggcagagaattgaggcgaagcttgccggtgtggaggaatacataacatacggcacggcaatgaatatccccatggaaaatgcgctggagaaaaagacctggctggtaggatttgcgatgctgctgaaacggaaggcgctggatgaggtcggacttctggatgaacggttttccccggggcagaacgaggatgtagatctgtgcatccggctgaatctggcggggtggcagatgcgcctctgccacaatagttttatcgtgcattacggtcatggaaacggcaggaactcgtatatctggaagcagacgttctcagttacaagtgagaagttccgggaaaaatggggcttcgatatgtcctattatacctacagcagaaaagaactgattgcgatgatttccgagccgaaagagagcagaatacgcgtgctggaagtgggatgcggatgcggtgcaacgcttgcgcatattgcgtatgagtggccggaagcgaaggtgagcggaattgagatccaggatgacattgcgaaaatcggtgcaaattatctggatatccggcagggaaacattgagaccatgcagatcccgtatgaaaaagatacgtttgactatatcatactggcggatgtgctggagcacctgcatgatccggagcggattctgcagaaattactgtcctatctgaaggcggacggcagtattctgtgcagtgttcccaatattttaaaccgccatgtaatcagcgaccttctgcgcggaaagctggagtaccaggacgcaggaattttagaccgcacgcatctgcgctttttcacaatggacagtattgtgagggtatttgaacggtgcggaatggaagtcacacagatgatggcgacctatgatacggaagagctggatgcggaagcggaagaattgatgaacgcactgtatcagattccgcatattgcggacagacagttgtttcaggtgtaccagtatgttttccgggcaaagagggagcgggaggcggaatgaaaaaagtaagtgtaattgtaccctgccacaatgcggcgaaatggcttccgcaatgctttctgtcgctggtgcagcagtcgatcggaatcgacgggctggagctgatttttgtggatgatgcatcggatgatgagggcgcgacatgggcactgctggaggaatttgagcgcgcgtatcccgagagcatcatgattatccatctggaagaaaatctgcgtcagggaggcgcccggaacgtggcgctcggctatgcgacgggggagtatcttgcgtttgtcgatgcggatgattttgtggagaaggatttccttgagaaggtataccggcgtgcggtggagagcgatgccgatatcgtacagtttgattatgtgtactatacggaaagacttggaaaagtggcgtcgggaaggtcggccgcggacgagagtatccggattcagacaaaggaggagcggaagcgttttcttatcagcgagaagatcacctacggctgctggaacaagctgtaccggagatcgcttgtcgagcgggcgggcgtccgttatgccgagcatgttatttatgaagaaccgctgtttgtgtacccgctgttgttctacggaaaccgctttgaaatcatggcggaagctttttactgctaccgccagaatgaggtgggaaccatgcgccgggatatgcgtcagatgacaacactgcagatgcacgcagatgtgcagcttgccgtgtggcattttatgaaacagacaccgtttttccgggagtattatgaggagatcaagctgtattttctgcatacgtatttttatgagacgctgctgtttgcggtgcagcgcggatttgaagtgccgtattccatgtatgagatgctgcgggataccgtaaaagcggaggtggcagactatagagagtctccctatgcggcgatgatcccgaggcagatggagctgtaccggatagagaatgaagaaaaaaatagagaaaatatacagaagcgggtaaagtcatttataagtaaaatgtgaaaaatacttgtgaaaattgttttgaagttatgcggtgatgaagggagaaagaaggatgtatgaagagttaattgcgaaaatgaatccatgtcctaaacttaatctgcagtggtataagaacgaagatttatattctgatggcgaggtagaagattttataattaagataattgcagaaaatagaccagaagactacagcaacgctgtctatgagcaatttaattggccgatatattatcatctgtcgccgctacgaaaaaatattctaaattggtataaattcaaaccggatagcagtgtattggaaattgactgtggtatgggcgcaattacaagtgtactgtgcgatgaatgtaaggatgttacggcagtggaactctcaagaaaacgtgcaacagcaacgcttctccggtgccgtgaaaaagaaaatcttgagattattgttggaaacttgaatgatattgaatttgataaaaaatatgactatattacactgataggcgttttggaataccaggggacttatacggaatcaacaaatccgtacatggactttttggttaagattaagcagttgctgaaaccagatgggaaattgcttgtcgcaatagagaatcagtacggtttaaaatattggtgcggaatgccagaagatcatgttggaataccgtttgaagggataaatcagtatagggatgttgagagaggggtaaggacattttcaaaaacagcgttggacacattgattaaggaaagtggctttcataatacctatttttattatccatatcctgattacaaattgcctacagttatttattcacaggatgttttaccaagtaagaaagacacgataaattctgaaaatttcagggattatagctcggctgataaaaatacattaattgcaaatgagaaaaagctttatacggatattgtagaaaacggagtattcgagttttttgcaaattcgtttttggtggagtgctccgacagcagtcagctaggggaaataacgtttgcgagattaacaagcgaacgcaaggaacaatatcgaatggcaacacgatttacgaagcagaatacagttgaaaagaaaccactcacgaagatgtgtgagcagactcatgtaaagcaaatgctgaaaaatgtagatcttataaaacaagcaggtataaaaatagcagaatatagagtggatgacggaattttagttagcagctatattcaaaaaccgattttggaagacgtaattatggaggcgttaaaagaaaacaatgcagacgagatttacagattaatagatcaggtgtatagggaaatattgcagtcttccgaacaggtttcatggaaagacaatatattatatacattaggtctggaaatagaggagaatgaagaggcatttggacctattttaaaggttggttttttagatatgagctttagaaattccttttattgtgatggggaaatactttggtttgatcaggaatgggttttggaagcagtacctgctaaatttattttatactatgcattgacattgttgtattattcatatcctcagttggaaggggcatgtccgtctgcggaggtaattgcacgttatcatatgcaggatgcttgtgaagcatttgaaaagctccgggaattgtttggatacttagtgtccgatgaggcacaggttatgatgggaagagcattcagtattgatagtacaatggattatatatcaaatgttaagaaacttatgaaataaaaagttgaaagtagcggaagtgttatgctaaagaaacagcacggatgattcgatataaatatcagaagtatatcaaaaatctcagggaagaggtagaataacatggtggttaatcataatatggcggcaatctgtgagagcaggcagctgcgctataacgtgaagaagatggaaaaatcttccaaaaagcttgcgacagggtacaagctgaacacagcaaatgatgatgcggcaggcttgcagatatcagagacgatgcggcatcatgtgaaagggctgaacaaagcctcccggaattcacaggacggcatcagtatgctgcagacggcggatgcagcgctccaagagacgcaggatgttctcgatcgtatggtggagctgacgacgcaggcagccaatgacatcaacacagactcggatcgcagggctattcaggatgagttggatcagctgaacaaggaagtggaccgcatcgcctatacgacgcacttcaatcagcagtatatgttggcggagggaacgccgcaggcggcaccgggatattaccgcatacagtccggggcactgaacggacaggcgatagatatccattttgtaaatgcgagcaaggagagccttggcacagacaaagtgaatgtatcttcgcatgcgaaggcgtcggaatccatcacgatggttcaggacgcgattgaacaggcggcgctctggagagacgagttcggcagccagcaggagcgtctggaacatgccgtgcgcaatacggacaacacatcacaaaatacgcagagtgcggagtcagggatcagagacaccaacatgaatatggagatggtattatattcgaccaaccggattctggtgcatgcatcccagagtattctggcacagtataatgatgatgcaaaatcagtgcttgagattttgaaatagtcagacacgataaagagataagaggggcagtttgttgatacgaatgcccttcctatctctttatgagcatttttaagcagataggcatctgggatgacagaggcgtcccgggcgtttgccggggaacatggagcaatgaacaactgggataagatatggaagaagcggaccgcgaagattgagaatcgcgcaaccgtatttgaaatgtttaaggaattaaaacgggcggacggatttgatacacaggatgtgcagggatattatgaggcgtttttcctgcagtgggagtgcatggcgcagcggatcgagacggggtgtgcgggaacgatcggcagtctgtatgagattggctgtggaagcggtgtgaatctgtatctattttccgcgttgaagcatgtggcggtgctcggcggtctggattactccaaaaacctcatccgcatagcccaaagcgtggtgccggaggcggacgtgggatgtgaggaggcgctcagggtgccgacagagccgaggtacgatgtcgttctggcagacagtgtgtttcagtattttaatgatgctgattacgggcagaaggtgctggaacgcatgtgggcgaaggcggggaagatggttgttgtcaccgaagtgcacgatcaggagaaaaaagacgaacacatggcataccgccggaagtgagttgagaattatgatgaagtatatgcggggctggacaaaacattttacaccagagagatgttcctgcaatttgcagaggagcacgggggcagatgtgagatcgtacaacctgataacgaactgtactggaataaccggtttgtgtttgattgctatttgtataaagaataatgcgtgaagggtgacggtatgcaggcaattattttagcggcaggaatgggaaaacgtctgggaaagcttactcagaacaatacaaaatgcatggtggaagtgggcggcgtgcgcctgatagagagagcactatacattctggataagaagaatctgtcgaggattgtaatggtcgtgggctatcagtgtgaaaatctgatgcagtttgtcgacggactgggaattgatacgccggtagaatacatcatcaatgaggtgtatgacagaaccaataacatatactcgctctccatggcaaaagactggcttgtgaaagaggatacccttttgctggaatcggatctgatttttgaggaagcgctgattgacctgttgcttgaggattcgcgcgagacgctggcgcttgtggacaagtttgaaaactggatggacgggacatgtctggttgtggatgaggacgaccggattgtcgattttattccgggaaagctgttggagtattcgcagaaggagcgctattacaagacggtcaatatctacaagctgagtgcagatttttcccggaatgtgtatgtgccgtttctggaagcgtacgccagggtcatggggaataacgagtattatgaagcggtaatcaagctgattctgatgctggataaaaacaccatgagggcaaagcgcctggaaggacagcggtggtatgagattgacgacatacaggatcttgatattgcggaggtactgtttgcggcagatgccggggaacggtataaaaaattgacttcgcggtatggcggctactggagattccctcatttaaaggacttctgctatctcgtaaatccgtattttccgccggcgcgcatgatggaagaattaaagtcgaactttgacatccttgtgcggcagtatccgtcggggatgcgggtcaactgtcttctggcggcaaaaacattcggtatttcagaagaacatatcgtgcttggaaacggggcggcggagctgattaaggcgctgctggaggagcttccgggaaaagtgggcgtgatccgtccgaccttcgaggagtatccgaaccggtgcagtgagcagtgcgtcgtttatgatgcaagacagaatgattttgcctacacggcagaggatctgatcggctattttgcagagcatccggtacagacacttgttctgatcaatccggacaatccgtccggtcactgcttcgggaaaaaagaggtgcagcagctgctggagtggacaaaggagcgccgcattgcgctgattctggacgaaagttttctcgatttcgcggaggataaggaggcgtcgctgcttacggatgagatgctgaaccgttatcccggactctacatcgtaaaaagcatttcaaagtcctatggggtgccgggactgcgcctcgggattctggcgtcgcaggacaaggagcggctcgaccggataaagaaggcggtgtccatctggaatatcaattccatggcagaattttttatgcagattcttgataagtataagaaagattatgaagaggcacttgtggaactgcggaaagagagagaacggttttaccggaagctgtgccagatcgagggattgaaggtatatccgtcctcggcaaattattttatgtgcgagctggtcaatggcaggaagagtgaggaactggcggcagagcttctggaagagcagattctgattaaggatctcacgggaaagattgcgaacggaagacagtatgtccggattgcggtaagaagccgcagggagaatgagcagctggcagaggcattgaaaataaagtttttgtaaggatagccgatataatatataatgaatgagaagcgcatggatggctgtcagaaaatcatggaagatatataatgtgatcaaaaagcatccggtagcaggatgcttttttggtttgcgcgccatgggcgcgctctaacgggtgaaagtcccgaacacgcctaggcaacgaggaagtgtatagccgaacagcaagggtgtctatcgtgaggtggaatctgaaggaagctgt

SEQ ID NO: 15 - DNA, 120683 bp, Roseburia hominis
ccggattgctggcagaatctgatgtttctggcatggcgtctttgctgctgcaggcggacattcctaatacacaaaccgtcatgaaaataaaaagcaatgctctcttcatatgaacacctcctcaaattccgatttgtcataatcattctatcataccgttatgaataaatcatctcatgcaaaacaatttcttctgcccggttgtggatattattgcaccgctgcacccattccatttgacgggtacgcttcaagtcctcggtcacgccctcggcagctttcatctgctccatgatagtgtctaaccgttcctgtgcctgttcgttcaggtctgcaagatatgtccacaattctccggtcagtatcaatgtgttcaatctggctgggtggacttctcttaaatattcccggtgcatccgtccatactttccgatggggcggcgttcttccgacagtttcaagtccgggatgtagtaatctccgacaaggatataatcaattccgttttccgttattcttggtttcaattcgctcatgttccttacctcctgtggaagcaggctcgtctggtactaactcaatcacatcggtaatctcacaattcagcgtttcacagatacgggctaatgtgtccatgctgatgtgctttccctctttgctcatgttggcaatcatattcgttgtcataccagcggcaagccttaaatcctctttcctcatatcacgctctaacagtgtgtgccagagtggtttatagctgatgtgcatattgttttcctgcctttctacccataccaccggggcggctgccccggcaggaacttttctcttattatagcaccaatcttgtgtaatcacaatttattcttgtatcctgccgctgataccgtctggattgtgcttttcctttctttttgttccctttaattagccataaactgttttacaccaagaggttattttctccgggtaagtggtaacactttcccgttcctgtcacattaaagtgtctttaacttctctacgcccgcatccagataagcgttctccatcgttgcaaacgctcccttgtctgcctgctccgcaaacgccggatcaagcggaagctttccgaataccgggatcccgagctcttttgcgacatcgtcgatatgactctcgccaaacagcttaatctcttttccgcagtccggacacttcaggtagctgaaattctccaccagaccgagcaccggcacatgcatcatctccgccatgttgtacgcctttttcacaatcatctgcacgagttcctgcggggacgtcacaatcacgattccgtctaccggaagcgactggaacaccgtaagcggtacatcgccggttccaggcggcatatccacgaacagatagtccacgtctccccagactgtctcgttccagaactgttttaccacgccggcaatcaccggacctctccagatgacaggtgcctcctcgtcatccaacagcaggttgatcgacatgatcttgatgccgttctccgtctccatcggaaccattccgtcgtccgttccgtatacctgtccatgaattccgaacatcttaggaatcgacggaccggtaatatccgcgtccatgatgcctaccttgtatccggcgcggttcatcgctgcagcgagtgatgctgtgacaaatgatttgccgacgccgccttttccgctgacaacaccgatcactttcttaacgttggatgccgcattcatcggctccttggcaattccgccgcctgctttattcttcgcgttgctcggacatccctcgcagctctcctttgagcagctggacgctccgctgcaattactgttctctggcatattctttcctccttaaatcgcttacatcttctctatcaggcttcttttttctctctggcacgcttttccttttctgcaaaaatcgccgccagcgactccgtgtaaggcgctctcgccacaccgtattcggtaacgatgcctgcaatcagctcatgatccgtcacatcaaatgccggattgaagaccttgatgccctccggtgccatgcgctccttgtaccacatttccgtgacttcctccgccgggcgctgctcgatcttgatctcagctccggtcggcgtatttaagtcgatcgttgacgtcggcgcgcagatatacaccggcacaccgtaatattttgccacagccgccactacggacgtaccgatcttattcgccgcatctccgttcgcagccacacggtcacacccgacaaataccgcattgacccagccgttcttcatgactgtcgccgacatattgtcacagatcagtgtgacatccacaccggaagactgaagttcaaatgctgtcagtctggcgccctgcaatagaggtctggtctcatctgcaaatacatgaaaatgatagcctcgttcctctcccagatagatcggcgccgtcgcggtgccatatttactcgtggcgagctgtcctgcattgcagtgcgtcaggatgccgtcccccggctttaccagagtcaggccatgctctccaatcatccggcacacccagatatcttcctcctggatcgccacagactcccggtgcaatgcctccttgatctgcgctacattctccccgctgtgtgcctccacaacacgctgcatccggtttaacgcccagcttaagttcacagctgtcgggcgcgaagaatccagatactccttctgccgtacaaactcacggtaaaatgtatcgtaatcctccgtatccatccgttttgccagcacatagatcccatatgccgccgccactccgatcgccggtgctccgcgcacctgaagcagatagatcgcgttccagatttcctgcgccgtgtgaagcgaaatgatctctatttttcccggcagcttcgtctggtcgatgatcaccactgcattgttctcatcatccagccgcacggtgtcataatccataatattcctgctctgctgttctcccacactttcacccctctattcttattcatcacagactattatactctcttttgtcgatgtttccaagaagacgcccgctttctcgtgttcttttttgcagacaaaaaaggaattgccgcaataagcatagatcgtttgggtgataagtaataatatgagaagaccacaccgtggaatttcagatggaaatacaaatggaaattcgttggagaaaaatgtgtgcatttcttcctgctgaatgtttgcatcggattccgtgtctcttccacgtttggaaaatccgacgggtgcatgtccgacacaccggagacaatgagcggactttctggtgtccctaatggcacctcttcacagacagtataaaaccgcgcgaaccgaaactcgccggcatctgctattgaaaataaggcagatgccgactcagacatcggcttcgcgcggttatgttttgttcgacataaaggtggcatttatgccatctgttgtctggtgccaataagggacacacacaaaagtcctacaaattgtcttccgggatgcggacatgacccgcggagtactccaaacttggaaagacacggatcatcaaagatgcaaacattcggctggttagaaatccacattttttgaaccgaatttccagctgcatttccacatgaaatccccaagtgaatttcttctcataatattatttattattcctagtagcggagtgcttttttcaatgccatggaaaccgctgttccgataacgaaacatacgatcgcctcgacaacaccgttcacgccgacaaatgctgcgataaacggaatcactttcgtcatgccgaactgctcacgcattgttcctgcgaacagggttaccagtgttcccataaaaaatgtggtgttcagcaacggacagcaaaggctggcaagcgttaccgaacctgcggaaggtattttcgtcttcttcagtcccttgtagatcagtccggtcagccatccgtccagaatacgtgtcggcacacataccagaaatgtgaatactgggtttacgcccagaaggagcgtaccaaacgcgctcattccaaaacactggataaaactcgtgataccgaacacaccgcctaagattgctcctgccgccggtcccaatgttacagctcctaccgcaactggtatgacaatcagggtaatctcaagacctgctgtctttatgtaaccaatcggggtaaaagccatgagtaagatgatggcaaccaaaagcgccatctccacgagatacttcgtagaaaatttcgacttcgtcatagtcttttcctcttttctgtatactttgtttatggttcctgtctgccaggaactttttgcatcttttgcagtatatcactatgtgaaatatttatcaagcagttggcgccacaagaccacattttttccgccaggttcccgccagatatcttcccacaaaacagagtacgcggaacacccagtcaattaccatggcagcccacaccccgactgccatccatcccatgtgaacgccaaacaggtagctgaaaccgatgcggaaggtaatcatggaaaaaatcgacacgaccatcgtgtattttacatcgttgcaggcgcggagcatattcggcagcacaaacgacgccggccacaggaagatcgccattccatcatgaatcatgaccagaatgtaggacaggcgcgtcgtctcctctcccagtccatagatctgtaaaatccacggcagcagaagtaaaatgatgctgttgatgaccgccgtataaaaataggtctctcccagcagctttttggtgtaatagcgcacctgtccttcttctccggctcccacacagcgtccgatcacagtaatcatcgcaaggctcatcgcctgtcccacaatacatcccatggaatccagactgttcgccaccccgttcgccgcgatctggctggtgccgaacgcagctatgatgctgaccacaagcacacgtcccagctggaagataccgttttcaattccgctcgggatgccgataaaaagaatccgcttcacaatcgttgcgtccactttaaatttttctctggtgagaaagaccagattgtccggattatgcaaaagcgtaaaaagcaccactcctgccacaccgcgggaaaccaacgacggaatggcgactcccgctactcccagtttcagcacatacacgccgattgcatttcccacaacgttgatgacattcatcagcagcgatattttcaatgtgatctgcgcattccccatcgaacggtacagcgccgcacacgagtcatacactgcgagaagcggaaatgagaacacggagataatgagatagatgatcgcattctgcataacatccgcctcaatctgtccgaagaataatccgaggatctgcctgtgaaaaagaagtaccagtacactgataccgatcgtgatcgccgcctctgtaaacacaagctgtctggcagaccgacaggcttcctctctccttcccgcaccgatacactgtgacgttaccaccgcaccgccggtcgcaagcgccgccagcacactgatgattaagttgttaaacatgtctaccagcgacacgccggaaactgccgcttctcccgcagaagaaatcatcatcgtatctgccattcccacggtgatggcaagcgtctgttctaagatcagcggaataatcagtttccgcaaatcttttttactgaataatcgattttctgttactgtctgtctcacgttctttcactccttcggaatgacaataatacgcaaaacggcaactgtcaagctcgtgaaataaaaacataaaaactcccgcatgacagacgccacatctgccacgcgggagttcttttcacctatgtacttttctttgcttatttgccaagttctgcctttaacgcagtggtcagtgccggaacgatcttgttgagatctcctaccagaccataatctgcaacgtcgaagatcggcgcatcctcatccttgttgatagcaacgatgagatcagaatcctccatacctgcaacgtgctggatagctcctgaaataccgattgcgaagtagatctgcggacgtactgtcttacctgtctgtcctacctgtaaatctaccggcagccagccgttctccactacggcacgggagcagcttacggtaccgccaagtacctctgccagatcctcgagaagcttgaagttctccttggaaccaacaccacgtccaccggataccaggatctttgcatccatgatgttcgctgtattcttaacagcctttacaatgtttaagatctctacatatctgtcattcggggtgaatcccggattgtactctaccacatttgccttagcgcctgcgatcggagcgatcttctgcataacacccggacgtacagtagccatctgcggacggttgtacgggcacgcgatcgttgcgatcgtgttaccaccaaatgcaggacgtgtcataagaagctgattgtgctgctgctcctgtccagctgctgcgttcagcgggaaatcgccgatctcaagcatcgtacagtcagcagtaagacctgtcttcacacgagcggaaacagtaggtccgaggtcacggccgattgcagttgcgccaaccagcatgatctccggcttgtactcattgatcacagatgccagtgcatgtgcgtacggctctgttctgtagtcttttaactgcggatcgtctaccacgatgactctgtcagcgccgtactcagcaagctgatctgccagctccttaacgccggagccaatcaatactgcagttacttctgtgtttaaatcctttgccagctcttttccttttccaagtaactcgaaagcaacgccgtctaatacgttgtcaacctgctgtgcaaagacaaatactcctttatattcttctaaacccattttattcaccacttttccttatatttgttagataatgtgcttctctttgaacttgccgatcaggtatgctacggactcatccggatcaaggacaaccttctcgcctgcgcccttacgtaccttgtcagatgcctttgcgatctttgtcggtgatccctttaatccaagatcagaatcatctacatccttaagatctgctcttccccatacggtaacttccttatcatatgcgtcgaagattccgcccggagtcatgtaacgcggctgattcagttcggaaagtgctgtgatcaggcacggcatctttgcctttaactcatggtatctgtcctcgtactgacgctgaacaacaacatagtctccatcgatcttgatgtcctgtgcgtaggaaataaccggaagtcccagatgctctgcgatctgcggtcctacctgagcggtatcaccatcgatcgcctgacgtccggtgatgatcagatcgtaatccagattgcggagtgcgcctgcaattgtggtggaggtagcccatgtatcagctccgcctaacacacgatctgttacaaggattcctttgtctgcgcccattgccattgcctcacgaagcacctcgtctgccttcggaagacccatggtaagaacggttacttctgcgccgtactgctcttttaatctaagtgctgcctcaagacctgctttgtcatccgggttcatgatggtaagcattgcagctctgtctaatgtaccgtccgggttgaacttaacgccgcccttggtatctggtacctgtttaatacatactacgatattcatgtatttttcactccttatatttttatattatgccacggattacgactatttcagtaatgcaccagagataaccattctctgaacctcactggttccctcgtagatctctgtgatctttgcgtcacgcatcatacgctctacatcgtactctctgatgtaaccgtatccaccaaacagctggacaacctctgtggtaacagccatagcagtctctgctgcgaacagttttgcctttgcggcctctacggaatataccttctgtgttgcctttgccatagcagctttgtatacaagaagctgtgcagcctcaattcttgcagccatgtcagccagcttgaactgtgtattctgctgctgggcaatcgtacgaccgaactgctttctctccttggtgtatgcgattgcgcggtctaatgcgccctctgcgataccaagtgcctgagcagcaataccgatacgtccgccatccagtgtgtgcatagcgatcgggaatcccttgccctctacgccaagcaggttctccttcgggattctgcaatcctcgaagatcagctcgtatgtagatgatccgcggatacccatcttcttctccttggttccgaaggagaagcccggagctcccttatctacgataaatgcagagaagttcttcttctttctgcctctcttatcctctgttacgcttgtgattgcgattacgatgtaaacatctgcaaccttaccatttgtgatgaagcacttagagccgtttaatacccactcgtctccgtctaatacagccttggtctgtgcgccctgcgcatcggttcctgcacccggctcagtcagtgcgaatgcaccgagcttctcgcctgttgcaagcggcttaacgtatttctgcttctgatcctctgtaccgtaggtcataatcggatcgatgcagagagaagtatgtgcagaaacaataacacctgttgtagcgcataccttggacagctcctctacgcacattacataggtgagcgggtcacagccctgtccgccgtactccttcggtaccgggatgcccatgaagccgagcttctgcatcttcttcacgttctcaaccgggaattcctctgtctcatctacttcctgagcgagaggctttacctcgttctcagcgaactctctgaacagggagcgcgccatttcatgtttcttgtctaaagtgaaatccatgatatcatttcctccattattaccttatattttactgagcatcaaccggggtctttgtacggtcagcattgtatacatagaatcccttgccgctctttgcgccaagattgccgccgcgaaccatcttgcggattaacgggcatgcgcggtacttgctgtcgcctgtctctttgtagagaacatccatgattgcaaggcagatatccagaccaatgaaatcacctaactcaagcggtcccatcggatggtttgcaccgagtttcattgctgcatcgatgcctgcgatatcagatacaccttccatcttaatgaaagctgcctcattgatcatcgggattaagatacggtttacaacgaagcctgctgcctcatttacctgtaccggagtcttgccgatctctacagagatcttcttgatcgcctcaacggtctcttccggtgtattcacacctgcgataacctcgattaacttcatacggtctgccgggttgaagaaatgcatacctaccattggacgggtcaatccgttgccgatctctgtgatggaaaggctggatgtgttggatgcaaaaatgcactctggctttgcaatcttatccagctcctggaatgtagtcttcttaacgcccatatcctcgaaagccgcctctacgatgaggtcacaatccttgcaaaggtcttcctttaagcctggggtaatctttgcgagaatgccgtctactgcttcctgtgtcatttttcctttctcgacaagtcttgcatagcctttcttgatcttctcttttccgccgtcagcccactcctgcttgatgtcgcagagtgctacttcatatccgtctacctgggcaaatgcttttgcaataccctgtcccattgttcctgcaccaataactccaactttcatgtcagtacctcctgaaatatcatatatatattctaataactgattctatgccttttaataaaataggaacaaagattcctattacgcaaagcaagaacttctccggtgccgcccacaggctggcgccggttcagaagttctcataactgcattagtctctctcaacgatggtagagcatcccataccaccaccgatgcacagagtagcaagacctctctttgcgtctctcttctgcatctcatgtaataaggtaacaaggatacggcatccggaagctcctaccgggtgaccaagtgcgattgcaccgccgtttacgtttaccttggacatatcaaacttcagatctcttgcaactgcaacagactgtgctgcgaatgcctcgtttgcctcgatcagatccatatcatcgatggtaagtcctgttctctcgagtacctttctggtagatgcaacaggtccgacacccatgatctcaggctctactccgccgagtgctccggctacccatgttgccatcggcttaacgccaagctcttttgccttctcctcgctcataacaacgattgcagctgcaccatcgttaataccggaagcgttacctgcggttaccagtccgccctctttgccggagcagcattttaacttggacagtgactcagctgttgtgccaggacgcggtccctcatcttttgcgaacataacggtctctttcttaaccttaaccggaaccggaacgatctcgtcatcgaacttgccctcagcaattgccttctcgcacttctgctggctgtttgcagagaactcatcgagttcttctcttgtaagaccatacttctcacatacgttctcagctgtgatcatcatgtgatagtggttgaatgcatcagtaagtgcatcgtttaccatggtatcaatgatggtcgcattgttcatacgatatccaaaacgagccttcgtcatggcataaggagccatggacatgttctccataccacctgcaacaacgatatctgcctgaccagccagaatcatagtagctgcttcattgacacatttcagtccggaaccacatacaacgttcagagtaactgccggtacttcgatcggaagtcctgccttgatggaagcctgacgtgcaacgttctgtccctgtgctgcctggataacacatcccatcaatacttcatctacctgctccggcttcacgccagctctgttcaatgcctctttgattacgattgatcccagctctgctgccggagtattgctcagtgctccacccatcttgccgatagcggtacggcatgcgcctgctaaaactactttctttgccattttgaattctcctttcagttttacacacaaaaccccgtatgtacggggaatttgttcctctttaaaaataattttgccaaaaaacgctgttaattttttaacaatctttttgctaaaaaaaataaattcaactttgcagttaaaatttatgtttctccctctttttttcacaaggtgcattttaaataatcggcgtttttactagctttttaatactttttcatgctaccatatttcactcttaaatgcaataactttcttcttttttcatctttctaaagttttctttacgctcctttttccccctctatacgtctgttttacagtctttttttgttaaaaatttatcatgcaaattttattttccaaacaaaagcaaagcgattcttgtgtacttttcacaaaaatcgccctgctgccattctgcggttttccgcacttttttcacttctaatagaatacatggtttccaattacggttccctgtatgatgccgttattctgtctgaaatacaggcagcccaccgtaatattgccgtttagcacatcctgcgccgcctgaaggcagcttccgtccacacccgcttccagacgatacgccagtctgccgctcgccaccggcgagaactgaccgctctggtaaatcacacccgagacagagttcggaaaatacgaactcttcacacggtttatcacaacgcttccgaccgcaagcttcccgtcgtaggattctccgcccgcctcgcactggatgattgctccaagcaggtactggtcactgtccgtcggcacatagaccacggtggaggtatcctccttctcctgctccttaatcgccgccagacgcgcagcgtcctccttcgccttctggatctccagctgcttctcgtactcgaccatctggttgatcttatcctccaggtccgcgacgttggactgcgcatccgccagatcttcctgtgtctgcgccagattcgccttggtggtgttgatgagactgctgacgttcgcctgctttttcttcatgtcatcctgcatcgtcaccagctcggtcatatcactctccagatcttccttctgggcggctatctgctcctgcagatcctggtattccacaagcttttttctgtcgtaggcgttgatgtcggtaatatattccgtgcggttcaggaagtcggaaaaagattccgcctccgcaagcatctgccataccggcgtgcttccgttctcatacatgaactgaatccgcagcttcatatcctcatactgtttcgcagactgtgcctccgccgcagccagatcctccttcgcctggtcaatctccccctgtttgtccgaaatctgcccctccaggtcattgatctgtgcgacaatatcggaaagctgaccgtttaacccgctaagatccgactccagtgcgtcctttttgccggagatgtcattgacggtatcctcggcatcctttttctgatctttcagatcctcaatctgattcttcgcatcatttatgttgtcctgtgtcgtctcggcataagatgtatttgccagaagcaggcacatcaccagcgccgctcccgccacgcgtctccacggaatctgtatcataagtacctctttctccggaaaagtaggattttctttcaaaaaccccggttctaagagtatcatatcagattgtatttcagctttcaatatgctatcatagagggaagataaagaggattttggtatgacaataccggaagagggggagataatcatgcaatttgtcaaaactgctgatctaaagcccggtatgcgccttgcaaagccaatctacaacaggatgggggttctgttatacgaacgggatacaaggctcacgatccagggtattaacagtattgagaattttggtctgatcggcatttttattctggagccggctgaaccgctgccgccgctttcgcgggaagatctggagtttgaacagttccagaccatctacatgttcaagttaaaggacaacatggacaagcttgtcgacaatcttgtcccgtccacactgctctcgctggtcgatgatatccagcggcattacggcagtcttgaccacaagctgaattttacgcagacactccgcagttccgcggactttgtatacaaacactcgatcagtgtcggtatcctatccgcaatgatctccaatgagatgcagctcccggcagaagatatccgggcgctgatcacggcttccctgctgtatgatttcggttatctgtatgttccacaggccatcctcgacaagggcgacgacctctcggacagcgaccggaattttatccagatgaatctggaacgcggttatgaatcaatccgcccgcgctatgaggagtgcaatcttccgaagatttccttagagattatccagcagttcatcttccagaagagtcagaccttaaagatcaaggatccttccccggagacacgtctgctctgtgatattttaaaggtggcagatcagtttgaccggcttaccgccatgaatattaacaatccgccggtctcggaggttgccgcgatgtcttttttgcgcagacacagccggacctacaatccgcgcgtcgttgccgcactggcggaatgcatccacattctcccgaccggcgcgtgcgttgatctctccgacggtgagaaggcgctcgtcctcgtggaaaatgccgcggattttacccgcccgatgatcttaaagttctccaacaatatgatctacgatctgagtgatccggtcatcggagattccctgcgtgtgacggacatcatgaaaaccatggacaaccggattgcgatcgacgaggaggcgctcgagcattttgtcgcagaccagtacatccgtgagacggctgaccgtttccggcagaaaaagcttgccatcgcacagcgcaagcagaaagctgcccagaagaagagcatggatgatcttttggacaatgccagagtgctcacacctccgcccattgcaccggtgccggaagaggacgcttccccgatcaggaaagctccccgcaagcgtgtgaaactggtttaatattttatgtgcagggtgggaacggcgtatcgttccccctgcagcccggtgtgaagcattctaaccgccaaatccggcatttctagccgcatcgtgtttgacattctcgatgatccgtgtttttccaagttttgagcactccacgaggtgtgtccgcaggttgcagacaattttaggactttcgtgtgtgtcccttactgtcatcgctgaacaaaacataaccgcgcgaagccgatgtctgagcaggtatctgccgtgtcttcaatagcagatgcctgcgagtttcggttcgcgcggttttatattgtctgtgaagcgctgacattagggacaccaggaagtccgcccattgtctgcaacctgtcggacacatcctgtggattgccaaaacgtggcaaagacacagaataaaatgtcaaacacgacgtggaagaaatgctcgtattttgcttcaaggatgcttcacaccgggctgcatccggaacttatatcctcttcccctgcgcatacacagcgcggttattttgcttccacataaggattgttttccgccatccggcgcgcctggcgcggagtacagtggtaacgctccttaaacatccggtaaaaaagcttctgattaaagaagccatgccgctccatgatctcctgtaccggatcgtccgtgtgcagcagatcctgatagatataattgagccgcacctgatttacatagcgcataaacgagcttccggtgctctgcttaaagaaccggcagaagtattcccggttgagccccagttcatccgccgcttcctgcagcgtcatttcttccctgtagtgatgatccacatacatacagatctgctccagccgctccatcttccccgccctcgtctgcgttgccaccatggagacaggttccgaaaaatgttccaccagacatgccagcaattccagaatccgcgccgtgctttttaaccggtacgtctcattctgattcacataaagcaccgtcagttcttttaaatacccgcagatttcattgtaatattcctgctgccctggacggagacgctgtcccgcgcagcggatcgcaaaaggttccgcctccggcagatagcgccgcagaagctgccttgacacgtggatacagattcccattgtctgcggcagcgcatagatgacttcatgaattctggcatagtccatcacaaccgcgtccaacggattcagttcgtattcctcaccctccatatgcacagtggcatgcccgtttaatatgtagagaatctccatctcccggtgccagtgaaacggagagttatgatccatcgtaacaaaccggatatcaaagccgacgtccggttcgagcgtaacattttcatatgtatttttctgttcttccattttttctcctaaaagtcaatatcacccaactttttgctaatatcttatctataatattaccatatttccgtgtattataatagctgtcaaagggaaaacctttgatgagcaagcaaaaatgtaccaattcaataaaggaggaaattattatgttagcaaaaatcaaagcattcttcatggagaatatcgacggagtcgcaatgggtgttgaagcaatgtacggagttgacattcatccatattacaactaatcccggagcaacgccatgacaacagaaaattttaccaaaaaagagcctgtaacggtgcgatgagttctcatccatccgtatacaggctctttcttatttcataggaaatacattgacacattaatgtatgaaagtaggtccttcctatgaaataaaaatcgctccgcgcggatgcgcagctcgcggtatggaaaatatcgctttgcgaaccgctcgcgcgcggagaatctcgcaagcgagattctttttttgtttataattataaattcttcactttcgcaatatcaaccggagtcagcgtatccatcgctgtctcaaggcttcttgcaagtgcgtttgccgtatccatcgctgtgatacagtacacaccggtctcgatcgcatttcggcgaatcaaaaagccgtcgcgcgtcttgtctccatttccctgtgtcggggtatcgatcacaagatcaatcttatgtccaagaatcagatccatgacattcggggattcctgtgtgatcttattgacacgcagcgcattcaccccatgctcctgcaaatattttgcggtgcttctggtcgcgtagatcttgtagccgagcgcttcaaaacgctttgcaacgccaacggcctccggcttgtccgcatcctttaccgtcataatcatctgcttatatttcggcagtgtcacgccggcgccaaggaacgccttatacaatgcctcattgaatgtctttgcaataccaaggcactcacccgtggacttcatctccggtccaagggaaatctccgctccgcgcagcttctcaaacgagaataccggcatcttgatggcaatgtaatcagccgtcggtgcaagtcccggctcatagcccagtccgcggattgtgtttccgataatgaccttcgttgcgagatcgacaatcggaataccggtcaccttgctaatgtacggcacggttcttgaagatctcgggtttacctcaataacatagacttcttcattcatcgcaataaactggatgttgatcagtccgatgacatgcagtgcctgtgccaggcgcttcgtatattcaacaatcgtctcttttacatggtcgctgatcgtcggtgccggatagacggaaatactgtctcccgaatggacaccggttctctcgatatgctccatgatacccggaatcaggatgtccgttccgtcgcatacggcatcgacctcgatctccttgccctgcagatatttatcaacgagaatcgggtgatcctgtgcaatccggttgatgatgccgatgaattcctcgatctcgtcatcgttaaacgcaatcttcataccctgtccgccgagtacataggacgggcgcacaagcaccggatatcccagacggttcgccactttcttcgcttcctccgcggtaaatactgttccgcccgctgctctcggaatttttgtcttctcaagaatctcatcgaagagctcacgatcctccgcagcgtcgacgtcctccgccttggttccgaggatcttcacgcccatcttcatcaggctctcagtcagcttgatcgcggtctgtccgccaaactgcaccaccgcgccgtccggcttctcaagttttacgatcgcctccacatcctctggcgtcagcggctcaaagtacagcttatccgcaatatcaaagtctgtcgatacggtctccgggttgttgttgacgatgacagtctcccatccttcttttgcgaatgcccaggtacagtgtacggagcagtaatcaaactcgattccctgtccgatacggatcggtccggaaccaagtaccagcaccttcttgttcgggtgcgtctcttccgcctcattctcgctaccgaatacggaatagtagtacggtgtggtcgcctcaaactccgccgcacaggtatctaccatcttgtatgctgccacgataccgttagcgtagcgcatatcgtggatctctgtctcggtcttaccggtcaattctgcgatcaccttatccgggaactcgattcgttttgcctcttttaacagttctaccgtaagagactcgctctttaacttctgctccatctcaaccaggattgccagcttgtcgatgaaccacttatcaatcttggtgatgtcgtgaatcacatcgtaatccataccgcggcgcaatgcctctgcaatcacccagattctacgatcatccacaacgtgaagctgttttaccagttcttctctggaaagtccggtaaaatcataggacatcaggctgtccacatgctgctctaaggaacggatcgccttcatcaaggctccctcgaagttattgcagatactcataacctctccggttgccttcatctgtgtggtcagtgtacgctttgcagtaatgaacttgtcgaacggcagtctcggaatcttgacaacgcagtagtcaagcatcggctcaaagcttgcgtaggtttttccggtaatggcgttcttgatctcgtcaagcgtatagccaagcgcgatctttgccgcaacttttgcaatcggataaccggtcgccttggatgcaagcgcggaggaacgggacacacgcgggtttacctcgatgacgcaatactcaaaactctccggattgagtgcatactgcacattacatccacccgtgatatttaattcagatataatatttaaagcagaggtacggagcatctgatattccttgtcgcccagcgtctgtgacggtgcgactacgatggagtcaccagtgtgcacgccgaccggatcaatgttctccatgttacataccgtgatacagttgccgtttgcatcgcgcattacctcgtactcgatctctttccagcctgcgatgcagcgctccacgagcacctctccgacacggcttaaacggagtccgtttgtcaggatctcgatcagctcggtctcatcgtgtgcaataccgccgccgcttccgccaagcgtgtacgccgggcggagcacaaccggatagccgatggtgtttgtgaacttaataccatcctgcacattgtgcacgacctcggacgccgcacaaggctctccgatcttctccatcgtgtctttgaatgcctggcggtcttccgctttgaaaatggtctccgctgtcgtaccgatcagcttcacgccgtacttatccagaattcctttctcggaaagctccatgccgagatttaatccggcctgtccgccaagggtcgggagaatggaatccggcttttcctttgcaatgatctgctctaacaccggcacagtgagcggctcgatgtagacctgatctgcaatgtctttatccgtcatgatagtcgccgggttggaattgaccagaacgacttctacgccctcttccttcagggaacggcatgcctgtgttcctgcatagtcgaactccgctgcctgtccgatgacgatcggaccggaaccgattacaagtaccttcttaatctcctgatttcttggcattatttcgctcctcccatcatgttgataaatctgtcaaacagatatgcagaatcctgcggtcccggacacgcttccggatggaactgcaccgtgaaaatgttcttgccgacataggaaagtccctcgttcgttccgtcgttgacattgacaaacgccggtgtcgccaccttcgggtccagggtatcggtgtctaccacatagccgtgattctgtgaagaaatgtatacgcggttcgtcgccagatccttgaccggatgattgcctccgcggtgtccgtacttcatcttgtgcgtgtcagcccccgttgcaagcgccatgagctgatgtcccaggcagattgcaaaaatcggcgtatcggattcatacagcttgcggatctctgtaatgatctccttgcactctttcgggtctcccggtccgttgcttaacataatgccgtccgggttcgccgccagaatctcctccgcagaagtatgtgccgggtataccgtcacctcacagcctctctctcgtaaggactgggcaatattgcgctttgctcccaggtcaaggagcgccacctttttcgtttcaggagcattgccctgcttttttaatactcgtttttccgtgcaggtaactttatctaccacgttgcctgtcgtgtatgcttttaatttaggaatgatttcttctatattatagttctcattcgtcgtgatcataccgttcatcgttcccttctcacgaaggatcttggtaagcgcacgcgtatcaattccggcaattcccggaatatcgtattttgcgagaaaatcctgaatcgttccctcgcaccggaaattgctcggcattctggacagttccctcacgatataaccgtccggccacggccgtcctgactccatatccggcgtgattccgtaatttccaatcagcggataggtcatcacgactgcctgtcccgcataggacggatcggtcagaacctccagataaccggtcatcgatgtgttaaacacgatctcactgatgacctctctggtggaaccaatactggttcctgtaaatacattcccatcttcgagtatcaaaaaagctttcattcgtctccctgtcctttcacttttttcccaaaaaaaaaaacgtttccgtttttcttctttttttcagaacgcacatgcacacggtgtgtgatgcatcgtcttcgtgccattatgggcagtgctatgcctttttcctaaattgtaaaaagtttatcatatcacaggatatttttcaacctttttccggaaccaaataatgtataatttttacactgtggtgtataaaaattatacattatggctaaaagcacttactctgcgctatatttctcccacagatcgctgtccgtccggtacgcttccagttcctccatcgtccactgcgtggaatcccagccgtgcataatcagtccttcatcgtaataatgataggtaagattcacataaatatcatttttgcagaggacatagttgctgtaatatctcccgtccagaatctccccgtccatcgtctgtcccgccatctgggcggtaaatgcgggcgcatcgttgaaagaatccgacttctcacagattttttcataataaacctccgcaaatgtatcatccgaacgcagtacgtcctcaacctcatatcgctctgccgtggcaagattgatgactcttgtgcgcaggtcacaaaactctccccacatgcttccattaaaatagtgatcctgaaatgccacgcacagaatctcatcgctcatatacgtgatctcatagtccacatagcatgccagatacgggtagtcttcatccagatacaaatattcttcctgcggctccggatacatggtatccagctgcgcacaggcggcattccgcagaatctcatttactccggtcgcatctcttccatccgcataggtaataaccggatacgaaacatcgtactcctcaaatccgtctttccgctgattcgggacctcgatatgctgtgcggtaaccgtataggaaagctgatctgccacataaatgtcatcctgtgtgacaaaaaagtcctttcccagagaatccgccagttctaatacctcacgttcctccccggtgtcttctacctccgtatcgtcctccgtatagctgccatctgccccgtctctgtacgcctccgcagacgactcattccacgtcaacgtatcctgcacggtacggttgaccgcgtgaaaaagaatgaacgccggcacggtcacaagcagcacggcacaacctatgatcgccagcacaacccacagcagagcacggctctttttgggaggtgctgtctgctgtccgtaactctctccgtacccctgtccatatcctgtgttctgatagggctgctgaccgtaactctgtccgtagcccatattctgattctgctgctggccgtagccctgtccataccctgtgttctgatattgctgctgaccatagtcctgtccgtatcctgtgttctgattccggtacgcctgcggctccggcgtaggctgctgccctgccgcaaacggctgctgccccggcgcggtctgctgtcctgtcacagacgactgctgccccggcgcggtctgctgccctgccgcaaacgactgctgccccggcgcggtctgctgtcctgtcacagacgactgctccggcgcacccgctgtcgctgtatactgcatccacttctctggaatctttatctcttctcttgcaatactgcgcccgacagtcgcaaactcctccatctcgcgcagcacttccgcctccagtccccgatgctggaaattcagccctgcgtagagaagcgtgaccgcacccgccgcatcgatcgcaccgacggcgcacatctggtcattatcatcaaacgctccaaataaaaagagcttatttttacatgattccacccatagatggtcttcatctgcatagcgtttgaaatcctctatctcttttggattcgccacatacggctgctccatcctgctgtatgtctccatcaccagcgctgccgccggtcggagttcatacgcatacaactgtctgattttcatttttaccgccactcctcattttcttctttctcttttatactatcatacctgacagcttcccgccacgacttttctcacctgtttctgacatgcaccagtgcgcccaaacggtatgcaaaaaatcccctctccgccggcaatccggcaaagaagggatctgtcctaacctgacttcttaattgcgttcatgtaagatggattacataatcttgcggaacagctcttttaaatcctccaccgatgcatccttcgggttgcccggtgcgcaggcatccgcatgcgcggactctgcaaggaaatcaagatctgactctttgatagcttccagttttgacggaattcccacatcctcggagagctttctgactgctgcaacagcggctttccggtactcttcctgagacatggcatccacgccttctacgcccatcgcccgtgcaatctcacggtacttctcgcctgtacagtctgcattatactccatcacaatcgggagcatcatcgcacatgccacgccgtgcggcgtatcataaaccgcgcctaaggtatgtgccatggagtgggcaattccaagaccgacattggaaaatcccatacctgcgatatattgtccgagtgccataccctcgcgtccctccggtgtgtttgccacagcgccgcgcagagattttgaaataatctcgatagcctttaaatggaacatatccgtcatctcccaggctgctttcgtcgtgtagccctcgatggcatgtgtcagcgcatccattccggtcgatgccgtcagtcccttcggcatggaggacatcatttccggatctaccactgcaatgatcggcatatcatgcggatctacgcatacaaactttctctttctctccacatccgtgataacatagttgatcgtaacctctgcagcggtacctgcggttgtcggcacagcaatgatcggcacacacggcttcctggtcggcgcaacgccctccaggcttctgacgtcctcaaattccggatttgcgatgataatgccgatcgcttttgccgtatccatagaagatccgccgccgattgcaataatatagtccgctccggattttttgaacgcagccacaccggtctgcacgttctcaatcgtaggatttgccttgatgttggaataaatctcgtaggaaagccctgcctgatccagcagatccgttacctttgtggatacctgaaacttaatcagatccgggtctgagcagacaaatgcttttttgtagtcgtgcgctttcgcctcattcacgatctctgcaatcgctcccgccccatgataggatgtctgattcaacataattctgtttgccattttttgttcccctttcccatacataatgatctttgatcgtattttaacaacacaatgtacaaaagggaagtgacagaatccgggaagtgtaactatttatcacaatttctattttaaaatcctctattatcaatacaatatttctaattgttcaaacaactcgcttattttctcgggcatcgccttcaccataagctctgctaagcgctccggcggcatcttcgtcccctccgtcacccatttcactgtcatatacacggaactctggcagtacatctcgagtaaaaatccaatctcctcatcgggcattttccctgttttctgtcggatcagatcctcgtaaaacgccagaatcagcctgaaatcatgatctttgagattattctggtccgcagacttaaagccggcagaaaaaaagacccgctcttcccggatgtaactaaattttttcacaaggctctcataaatatttttccctctccccatgtgctcaaaagacttgtgaagcaaaatatcaaaataccagttgatcagatcgtacttgtcaataaaattgcgataaaacgtctgccttgtaacaccacacagttccgtcagctgtgtcacggtaatgttatcgaccggcgtcgtcttcatgcattccttcatcgcctccgccagacggtactttgtgcgggttccctttgtcgtcgtatccatcttccgtctccttccgcttcgcgtcctgcgcttttttgtcagattaaaatgactgctctttgctacagctcctgtccatcgtccgtttcggtattctcgtcccacaccggatcagacgtctcatatacgcccgtgattccctcctgtgtgatatgatatacggtaattcccgtcaccactgtcactgcaaaaacaagcgtcactgccgtaagcagaattacctgtctggcgcttaccttctttttcggataagtgatctccggctttgtgcgccgtggctgcaccacctgcgcaccaccgccctgcacggtcctgccgcttcccccgatatttcccatgtatccctgggtcatcggaaccgaccagattcttctctccaacggcacatacattcccgccggtgccacctgaatcaacgtaaatcccgtgtggtaaaaataatttgccaccgccggtgccacctgcaccgtcacacgtccgcactgcaatctggaagctgcaaagttgcacatccggtccaccaggctgctgccgatccgccttccggaatactgcggtcttacatacagcgctgtgatatgtccgacattctgcatggcactaacgccgcacatctgcccgttttcaaatgcgccccataagaacagccttcccgccagcatctcctgtgaaagattgggcagattcatatagtcataatactgctgcacctccgccgcatttcttgtatacggacgcacacactgctcatagacctcatgcgccgtctgcaccgcccactgtatctcatttccgtataataatcgaatctccatctgtatctgctcctctttcacaatgcccgatccatagaactcttccatcacattttaactcattctaccatgaatctgaaaattcaacaatatccgggataccggcagctgcacaggaagcaccgcatcctctggagtgaaaaaccgcgcgagtccgtttccggctctgcgcggtttcgtttcatcctatagtatatggtaagcttgcttctaacgcgccttctattcctcttcttcctccggctcgtcttttgcccatccgtacgcatacttgactgccttattccagcccttgcgttttgccttgcgctcttcctcctccatctccggggtaaagatgcggtcgatcttctggttgttgaccacgtcctccttatccttccagtatccaactgccagacctgccagataagcggctcccatcgcagtcgtctcgacgcactgcggacgcttcaccggcgcattgatcatatccgcctgaaactgcatcaggaagttgttcgcacttgcaccgccgtcgactttcagggactttaaatcaatgccggcatctgcacgcatcgcatcgatgacatcgcacacctgcagcgcaatcgattccagcgtcgcacggatgatatggttcttgttcgttcctctcgtcagacccacgatcgtgcctcgcgcatactgatcccagtgcggcgcgccgagtcccgtaaacgccggaaccacatagcagccgtgtgttccgtgaaccttcttcgccatatattctgaatccatggaagagtcaatcatcttcatgttgtcgcgcagccactgaatcgcagcacccgccacaaagatggaaccctccaatgcgtaattcacctttccgtcgagtccccacgcaatcgtagtgaccaggccgttcttggaaaataccggcttctctccggtattcatcagaaggaaacatccggtaccgtaggtattcttcgcctcgccctcgtggaaacaggtctgtccgaaaagcgccgcctgctggtcgcctgcagctcccgcaatcgggatcgcatctcctaaaaacgaaggatctgtgtagccgtagacttcgctggacggacgcggtgtcggcagcatgcactccggaatctccagctcctccaggatctccttgtcccagcacagatcgttgatgttgaacagcatcgtacgggatgcgttggaataatcggtcacatgcaccgcacccttggtgaacttccagatcagccaggtctccaccgttccgaacagcagcttgccctgctctgcaagctctctcgcaccctcaacattatcgagaatccacttgatcttcgtcgcagaaaaatacgcgtcaatgatcagtcccgtcttctgacggtatgtctcctcgagacccttcgccttcaatgcatccgcaatgtccgaagttctgcggcactgccacacgatcgcattatagaccggttctccagtctccttgttccagacaatcgccgtctcacgctgattggtgataccgatcgccgcaatatccgccgccgtcgcgcggatcatgttcatcgcctcgaccgccacgccaagcattgtagaccagatctcattggcatcgtgctccacccatcccggattcggaaaaaactgccggaactctttctgtgccatcgaacagatctctccctgctcgttaaataaaatacaacggttgctcgtcgttcctgcatccagtgccatcacatactttgccataccatgttcctccttgtttgccccttattgcttatttatgcttccctctattgtgaaatccgttcctgccccgtactccccatgcgcagcgcataaaaaaaggagacatcgttataaaacctgtaagcacccctcatgtgtacaggaattaaaatcatctccactctcagatcccacaatatctaattatattttacaagagctgtgcgtttccactgcttcatgtataggcatattataccataccgcaatgaaaacgcaagctttttttgacacatttactataaatctacaaaattttgctgaatgccagcaccacaaacagggcgccgccgatccaggagtaatctcttttgcaccggtccgccgcatatttcccgacagcgcttccgccaagcaccgcaagtgcactgaataccagattcaggcataccgtgccagcaatcgaaatatccagaaacgccgcccccagaccgccgaaaaatccgtccaccgacatggcgagcgcgaaacatattccttccgtcactgacatggtcgcagagcaatccctatctgccgccgccggattattgtaaatgctgatgataaaattcagctgtgaaaatttcatttttacctgcttgcacaggaattggtgtctcctgatatacgcccggattccgtactccgtcagcttataagcgccgaccagaaacaatcccgcaaaacacagatacgccgcatatttttccctgaccactccatcgatcagttttccgcacactaatgaaaaaaacagcactccgctgcataccgcgccgatgcagagtgctgtcttcttttcgatccggatctgttccgccccgcacgccacggatgccagaaagacgtccatagagagcgctacgatcaataaaactgtctgcacatttttcctcgaaacggctttctcattctatcttattcaaatccgcggctgctgccactttgtattccggatcaccgttccgcggctgctgccactttgtattccggatcaccctttcaccgcgcccgcagccatgccgttcaccatgtccttgaccaggaaaaaataaagcaggacaatcggcaccgcgatgaacacgcttcccgccgcaaatcttgcaaattccgtctcatcgaggctcatcagaccaaccgccaccgtatacaggttcttttccttcagcaaaagcttcggcagaataaagtcgctccacggccaggtaaaagaagagagcgcagtatagacgatgatcggccgggagagcggcagattgattttcataaaaacctgaaaattcgtggctccgtcaattctcgccgcctcgtcgatcgccttgggaatcgtatcgaaaaagcctttctgcgtcagatagcccatcggcgctcccgcactgtagattaagatcagtccccagagatgattgatcagattaaactgcgtcatcagaaggtacaccgcaatcattcccataaaggaaggaaacattccaagcaccatcgtaatcttcatcatcggtttgcgcgccgcaaacgtaaaacgcgacatggtataggcagtcaggatcaccagaaacgtgccgaggatgcagctgcctgccgccacaaaaagtgtattggcaaaccagcgcggatagttgtacagtgccgtatccgtaaacagccgtttgaagctcgccagactgtatccggccgggaaaaaaccgtcaaacgaatagatcgttcccgatttggaaaacgatgcaaggatcagccacaggcacggaaagaagaatacaaacgccactgcaaacaatatgagataggtcattccggtatcgaggattcttcctgcggacatccgccgctttttctctgtttttctgctcattgaaacgtatcctcctccctgtaagacggtgactttatgtaaaccacaagtgatattgccgatgtgataaagaaaataatcagactgatcgccgcgccgatgcagtaataattgttgtcgatggacaggttatagagccagttaatcaaaagatccgtatcactcgcaaggaaatagccgtccatatacagcccgccccgcaggaagtaaaagatcccgaaattattgaaatttccgataaactgtccgatcagcaccggcattgtcgaaaaaagtacgaacggcagcgtcagtttccggaactgctgcatgcgtcccgccccgtcaatgcgcgccgcttcatataaggaagcatcccggtttgacagaattcctgtggcaagcagcatgatctgcggtgtactgatccagcagttgaccaaaagtccgatcaggcgcgccgtccacttggcatccagatccagaaagccgaccgcgccgcccccgtgtgccacgatgatctgattgaccggtccgccgtaggaaaacatgaacttaaacgccagcagggtgataaatcccggaattgcgtatgccagcaccggaaacgcgcgccagatggcttttcccctgacgcagtccttattcaggagcagcgccagcccgagaccggcaaaataattaagtgcagtggagacaagcgcccacacgacattccatcccagaatcttaaaaaaggtcggtgcaaactgcgtcagcgtcagcagttttttaaaatttgcaagtcccacccagtccacgagttccgggggtacaatgtctccgccgtagttcgtaaatgcaatcaggatcatgaacagaaccggcaggatctgaaagataaatacaccgatgaccggcaacgcgagcaccgtgacatagaactttttgtcgagcagttgtgccgcctcctcgcggaaggacaacacgcttcttccctgctcgatccgcttctgcatccggtaagcgtcgcgcacgtttccgcagtagatacacacaaacgccgccaggacgatccacgcaaatattcccatcagcagcatgacaaccgagttatctccctctacgccaagccatgcatcccctctggtcgtacccagtgtaaaaaaaccggcgagatcacgacacccgcgcattgccatatagcagatcatcaggacttccgacaggaaaaagcacacgccttttccctttgcgccatagcggaactgccctgcccccatgatgaccattgataattttacgttcccgctgctgtcaccaaaccaggcagcagcacgctttattttttgcttcataccgttctctccatatctgctactttaacgtatatattgcgtcatggatctgtgtatccacctgttccagcccgctctttagcgcaggcagatcctgatactttttctcactgccgcttcggaacgcgtccttcgctaaatctgtaaaaaaggtctgtgccggcgtccagatctgcgacacctcggagatggacggcatcagcaccacatttccgttctcgagatttgcatagattttctccgatacgtcccccgcactctccgccgcatcgccgcgcgccggtgcaattccgagcatctcgctccgtctggtgaccatctcatagcttgtcgcaaaatcaataaatgccaggcaggcattcggcgccttggtgtacgcgctcactgcgtatccgttgactccgcccatcgctttcatatcgatcagtaccggatcgctctccgacagatcgccgctttccggaagcttcggcagtgtcgtcatgatcagattctgctttgctgtctccctggcttcctcctcgttcatgccctccgcctcgtattctttttccagttcatctgcgaacgtggagtacatatccggtgtcgagagcgtcgcaaaataggtgccatcccccagtttgctgtatgcgttggttgtgatcgtgtcgtcgatacattcctcgttcatcacacccgcaagccgctgcagaacccacgcgcctttttccgcctcgccggcagaaaatccgacgtcctccgggttcgtattctcctcgccgaacacatagccgccgtaggaaaataagaatccgctggaaaaatacacatcgtacagcgacttcatatacccgtactgcgccggattttcttcatggcgttctttggaatatgcatacagatcgttccagttctccaccatatccggcacgccgttctgatcctcatcccagttctcctgccagtcctccggcagcagctccgcccgatagtacagcatcggcgcctgcacattgaccgggacaccgcagcagtaggtcgtgctgtccacggtcgtctcatatgccttccacgcgctctccggaatctgctcatagcaggacagctgctgtaccggaagcggatagatatgttttcccttggcgtactgcatgatgacatcgttcgcctggtataacacatccggtccatagccataaggtccgtcatttgcaagatccaggtactgatccatgttggcatccaccgccgtgattccctgatcggcgtacgcctcattgaatgcggtaatcagctcctcaaaatatcccttggaaatggcggtgtcattttccaatacccggatcgtgacattctcctccaggtcaccgtcaaaaacactgcttccggataccgcggcagcgctgccgctctccgtcgtcttctcccccgtcgtcttctcatccgcacatcctgctgccgcaaggacggctgtcagaagtaacagtgccacctctttttttcgtttcatctgcttcctcttttctgcggaatttccgcccatatcaatccaacgcttccctctgctctctcacaatcagatacccttccggctccacgcagacgccgcaggtcattttcccatcaccagctgccggaagaaccgatgcccggtgagcagaaagcaccttgctgtccgctttcaggcaatgctcctgccgcctctgctcctccgtcatattgatgtacagcgatacgccctcgcccccggccttccgcctgacacagagcatcccgttttccgctgcaagctccacatttccgtcggtgatcgcggtgcagctgcggatatgcgtcagctccgtcagcttctttcgcacgtcggtatcggtgtgcaccttttcccagtcaaagcatctgcgggaatccggatcatagccgcccggcgtgcagatttccgtgccgtaatagatgcacggtgctcccgggaataccatctccagtgcaagcgccgccagcagtctgtcgggattctccccgacttccgagtaaaagcggtgcgtgtcgtgcgaatcgagaagatttaacatcatccggttcaccggctccatgttgcgcatcaggttggacgacagtttttccgccatctgttttgcatcaaacgtttttctcgcaaaataatccaggcaggctttggtgaatgcataattcatgatactgtcgtactggtcgccgcgcagatacggatatgcatcatgccagttctccccgataatgaccgcatctgctttttcctttttgaccgcctcccggaagcgccgccagaacacatgcgacacctcatccgagacgtccagccgccagccgtcaattccgtattcccggatccagtagcacgcaatcccgatcaaatattcctgtacctcgcggtttgccgtgtcaagctttggcatataggtacactccgcaaaacattcataattcgcacggcttggaaccgggtatgccccgtcgattaaaaaccagtcatagtagggtgattccgctcctttttccataacgtcacaaaactgctgcatctgcatgctgcagtgattgaacactgcgtccagcacaatccggattccgtgggcatgcgccatgcgcacgagttccccgaattcttcttttgtaccgaactgtggatcaatctgcatataatccatcgtatcatacttgtgattcgatatcgaccggaagattggcgtcagatagatggccgtaattccaagctccttcagatagtccagtttttcgataattccgcagagatctccgcccgcaaaacttttcggtgtcggcagcgccccccactccatattgatataggagcggtccttttttgtatttccacagaaaaaacggtccacaaaaatctgatagaacaccgcgctcttcatccattttaccgtcggcagtacgtcattgcggttgatgtacggcatctggaagaaattgtaaaatccctccgcgaaatcatattgtaagacgacgccgtcctcgcagaagtaatacgtcgtgccctgctgccggatacaaaatacgtatgccagccttacgtccgtgagcacgagggtcgtctcatagtaatgataaagccggtccgtataacgtatctccatcggaatctgctctctgctttgctgaaactgatacttgcccgcatagattaacgttaccgacgcgtccgcgtcttccttcgccatccggagtcttatcaccagttttttctctccgactgcaaaacagtactgggaatccggtatgtgtaaaattgcactctcattcattgctctttcctctttattctctatcccttcattctcttcttcccgattcccttattgacaaatctgggcaaattctatataaatggaacatagaattgctcattacaggggaggacattatcttgagtcagaaaatcacgatccgggacgttgcccgcgaagccggcgtatcggttgccaccgtttcatacgtgatcaacaaccgcaccgacatgcgtatcagcgacgcaacccgcaaaaaagttcttcaggttatcaaccttttagactacactcccaaccagtccgccaaggcactggcgacaagccgcaaccggatggtcgcactctatcttgacactgatgtcccggctcttaagcgcgcggagcagatgtatctgctggaatgtttctccacctttctgcatgcgcaggattatgatctgatctatctcagccgcacatacacggaaaaatacgatgccgctgacgcaatcgtggcctacgacatttccgaagaatattttcaccagatcggcgacaacaatttcagtccgcttcttgccttggactgccggatcggtgatcccctgttttttgaaatctattccgattacgcacagatggcagccggagcgcgcacgttcttttccggcgagccctattgttttctctctctcgacacgtcaaacgccgggaagaaatcttacgccgcagacatgtttccggaagtacattatgtaaactccccttcggaactggcaccgttttccggccggaacctgctcgtgacggatcacacgctgtacgagctgctggcgtccaccgcaaatgtctgctacctgccatctttctctgcccataagtttcaggtattgtttgactgcatgaacagcgcactgcgccgtgaaccgctgcagcagcacgccattgcagtgtcataaagctgttttattccacgtccaccgtcaatacctgctctgtgggatcatacgtgaatacataggtgccgctctccgctgcgatcagattctccccgccgccttccgtcacatgggaaaggctggtgtcatccccgccgccgatattggtgtagcggatatactctgttcccgcgctgctggtatccccgacggtcaccatggaggtgaacatgaattcatctccctccgtcagatcaatctttaaggtgtatgtgccatcctgctcggcaaacttcgtctcatccgaatacacatcttcccatccggtcacaatcgcacccttgatgtaataatctgtctgaatatctccgccggcattctccgatgctccgttgtatgtccacgtgatcgtatcgtacgggttgatgttgaatgcttccctgttctcctccgtatagtttgcattgtcggtctcgtaggtatcctctcccggatacgtcgtcagtgtaaacgtataatttcccgccaccgcacacttgatattggagcgtttcacgccggtgtcgccaaggcttccggaattttcaaaataatccatgccgtccagttcaatcgtatcgagatacccgtagccgcgctgatctccccaggaggaatccatggcaaactggaactggtctccctcgcttaaatcgagcgtgatcgtatacacattctcgctgtcgctctcctccttcgtcatcttctgcgcatccccgatgactgctccccagtttgattccagaagtaccggcgacgtgccgcttcccacaatcgcaaactctctggtatcctccacatacgtcacaaatccggcaaacaccgaggtgtcttctgttaccgcctgtgaaaaatcaaatttgtggctcatctgcggtgtcgcaaaccagccgacaaaaatgcttccgtccttctctggcgtatactctttggagcatgcccctttttctacctcctccgtctgcagcacggtcttgccatccgagtcgtaataggtcacaacgcaggctgccgcctgcccggtctgcgccgtctcttctgttgccccggtcgcatccgtcttcaccgcatccgcacttccacatgcggataacagcagcatcccgcttaccagcattgcggtcattgccaccgccgccccatcatttcttcttctcatttttccctccaacctttctaatcaattttcttgttgtttctgatgattaaccggttaagttttcgtgtattttttaagcaaaccgctgtattctgcagtttgcttaaccgtttaatctataacaaatgtaacactcttcctgcaggctgtcaatagtattttgtgcatcccgcccggcacgtttttgtgtcatagaaacgaagtttgctatgacacaaaaaaatccaccttcctaccctaaataggaagatggatttttcttacatctgcagcagatattcgatcagtttatgtccttccggaataaagttggttgtctgtgcagcctcgcgctcattgtaatgccagctctcactgcgctctgccgtgctgtcatagagcagatacggcacattgtccgccgtgtgtgtacgcagggaaatcggtgtcggatgatccggaagcaccaccatgcggaaatcctctcctgccgccgcaagtccctcggcgatcggccggataatgcgctcatccaggcgctcgatcgcctttaccttcttctcaacgctgccctggtgtcccatctcatccggtccttccaaatgcacgtagacaaagtcatatccatccctggtcagaacgtccagcgctgcttttgcctttccctcataattcgtatccagaccgccgttcgctccgtccactgtgatgactttcatggaagtgccgaccgcaattcccttcagaagatcaactgcggaaatcatcgcgccctttttgtgggtgcgctccgtaaacggatagagtgccggctttgtgcctgcgccccagaaccagcaggagttcgcaggatttaatccctttttcttacgctcgatgttgatcggatgattcaccagaatgtcataacttttcttcatcatggtgcgaagcgcttcgttctccggaagcttgtctccgatcttctgtcccagcacatcgtgcggctgcaccagatccaccacctcgccgttctcccagatcagacagtggcggtagcttgtgcccacataaaagtgaaaaatgtctgtctccagctccttcttcaccgcctccaagagcactgcacattcctcggtactgatctcacccgaactgtggtcgatgatcgtgcggtcctcgtaattgtcctcctcctcggaaagcgtgacgatgttgcagcgcagagccacatccgtatctttcattggaacaccgatagagagtgcctcaagcggagaacgccccgaataaaattctctcggattgtatcccagcacggagagattggcagtgtcgctgcccggcttcatgccgtccgggatcgtatgtaccatgccgatctcacctttcgctgccagttcatccatcttcggtgtctttgcatactctaacggagtcctgccgcccagactctcgatcgggcggtctgccatgccatctccaagaattaccaaatacttcatctcacacttcactttctgctgttatcagcctgctgtttcacatcggatcccctgttttactgtgccacgcggatcatctgaagtacactgccaagctccgccgcctttttctcataatcagcttcgctcatgcgcgccgtcacaaatccggtctctccggatacgccttccgccgttacataactcacttcaccgaagacttcttctatgcgcttctcatctgcggacgtgcgcacaaaatagcagttctcgacgttgcggtaatccaccagctccagtttcttggagctccactccaccgcgatattggtgtccagatgcttcgccatatccacgatatccgccacaactgcgctcgccgtcgggagcttgccggcgccgcttccgtaaaacatggcatcgccgagcacattgccgtgtacaaagatggcattgaacacatcgttgacattgtagagagggtgtgtcgccggtaaaaggaacggcgctaccatcgccacatatccgtctcccaccttgtggctggatgccaaaagcttgatggctctgcccattgccttcgcgtaccggatgtccgtcgccgtgatcttcgtaataccctctgtgtgaatatcctcaaagtccacctgctgtccgcataccagggatgtcaggatggcgatcttgcggcaggcatcgtatccttcaatgtcagcggtcgggtctttctccgcataacccttcgcctgcgcatcctttaacacatcgtcgaactccgatccctcctcggtcattttcgtcaacatgtagttcgtggttccgttcacaattccggtgatctcctcgatctcatctgccgtcagacaggaattgagcggccggataatcgggataccgccgccgacgctcgcctcaaacatgaaattgacatttttctccttggcgagtgcaatcagctccgcaccctttgccgcaacgagcgccttgttggaggtcgtcacatgttttcccgcttcaagcattgcctttacgaacgtgtacgccggctccacaccgcccatcgtctcaacaacaatctgcacttccggatcatttgcgatcaccttataatcatgtaccaccttttcctgaatcggatcccccggaaaatctcttaagtccagaatatatttcacaccaatctcttctccggcacgctttgcaatgctgttcttattgatgtctaatacttccactacgccggaaccgatggttccatatcccattactgctactctgatcatactgcctccactttcgtcttctatcctattctgttcctactctcttccgaggatcttcacataatgtatccctgtctgctcctcgatgctcgccaccatctgtgtcacatctcccgtctccggcagaacatcgaccgagagtgtcagcgatgcgatcccgttgatcggaatactctggtggatcgtcaggatattggcgtgaaactctgccaccgtcttgagcacaatcgacagcagccccggctcatcgtccagctggatgaccatggtgattgtcttcccctttgctgtctcatgaaacggaaaaatatcatccttgtatttatagaaagaactccggctgatcccgacctgctctgtcgcatcctgcacggagtccgtcttccccgaatccagcagccgctttgcctccacgacacgaagcagtacatccggcaccgccttttcctttaatacataatactgacctttctctttcatgttcctcataatcctctttcttctggtatccctcacgagtgtatgtgtgcagcacgctgacacttgtcctcatgaggaagataataacacaaagaggctgcacaggcaacctcttttgtgaatatccgtaataaaatttagttatggaagctattctccctttaaaacttgcggcttcctccgccgtgtgatctgccactgctgctcgtgtgcgtcgtgcttcttccgctgtgcgaggaggaatgtcctccactgctgccgctgctcgttgagatcctgtgatgcgtcgtcgtctgattcaccagacgatcttccttgacgcgcagattgaccttggaattctgctggtaagcgtaataatatccctttccgcgcaccttgtaactgttgctgatcgtaaaataaatgatgcagccggctccgatggcgaccgccagcacgccgaagatctccccaagcgtcagaacatggtatctggaaatcttccccgtctcggagtcataattgtactgtccctctgaaatccctttttcatagtaattctccacaccggtcagcatggaatgcatacagccattgtaatcgccattgctgatcttcgcgtacgcggcatccaggatattgtcaattctggaatccgtcagataccggatcgcaatgccgcaggtggaaatcgtaatctcacggttatccatatcgatcagtaacgccacaccgtcttcctgttccggcgaatgttcgtcaaagaaatcatccgcgtaggcggtagcacttttcccctgtgcatcatctgtcgtgaccgcatagacattccagccggattcttccataaaggaggcaatctcatcgttcaggtctgaaatctcatctgccgtcagaagtcctgccgcatcgtacacataaccatccgctgcatcctgcgccgcgtccgcctctgccgccagtgccgcaccgctgcacggaacaagacacaccaggcataccagacaccacaggagcgcttttttcatcttctctaccataagaaataccctcctaacagtccgaataccagaatgccaagcgccgtcagtatactggtgagcgcaagcctcgggcggtcaaccggcagatcgccgcagatatttccattctgtccgttcatggaatagtagtatacttttccgtctctgcccttatatgtaatcgtccataccgggagcagcacatacgaccagatttccttcttcggtgcaaaaaacgtattcttgaccgatacgctgttgtaaccgctgatggtatcgcgcatcagcttttcagcgctctcacgcatggtgtgctgcatcttgccctgcacagcattctgctcaatatctctgcgctccgcaaggaatccggagaggtatcccatgtgaaaatctttcatcttgtcataggcgtacggcatcacaccgctggtaagctttacattcgccttcttcaacgcgttctccgtcagattgcgaagcgacacattgccctcgcgctccaccgcataatatttggtctccgtgtactgggtattgcccgtcgtccacatgcgcacacttctcgcgtctccctgcatctttccctccagctccacgtcgtagacccagtatgggaaataaacgcctgtcatgctctcaatctgttttttgttaaaaaatgccttcggcacatatttctttttgctgacaaaatccagaaacttcttctctgcatcctctctgccgatctcaaacggaatgatcttattcggcagatagctgccttccagccgttttccgagcacgaccggattatggcagtaatagcagaaggttgccgcagtcgtcgcatccgtcacaatctctgcgccgcaggacggacagctgtaatacaccgcctcgccctccggttcgctttcccgctctcccactgtctgcccggtctctgccttctcacctgccgctgccccggctgccgcttgtgctgcccgctcctgtgcggcagcttccggctcctcaccctgcatcggcttcatcgcatcgagttcttcctgtgcgaacagcgaattacagtattcacacttatacttctgtgtcgccgggtcaaaaatcagttctccgccacagtttggacacttaaaactgataattgccatcgctagttcctcgctttcccacagttgctgcagaattttccggtgttcgtctgtccgcactcgcacgtccactcaccggataccggctttggttttccacactcgctgcagaactttccggtgttcacatggccgcactcacacgtccattcgtcagataccggcatcggttttccgcactcgctgcagaactttccggtgttcacatgaccgcactcacatgtccagcccgcctgggtacctgcccccggtgtctgtcctgccggcactgcgcctgccgctggcatctgtcctgccggtgccgcgctgccctgctgcattcctgcatttgcctgcatgtctgccggtgtctgcatcgcgccgagtccagacagcgtctggttcatggcattcattcccatgccaactcccataaagcctgccatggcaccgttcgcattgcttccggcgtcacgcacaccctccgtaatattcttgaccgccataccgcgcatgacgttgaaatcgcttccgagcattgcgccctcattgcgcatgttgatcagcttctgggactcttcgtcataggaaatgcccgcgataccgaccttctggatctccataccgcgcatctggttccaatcagcatccagaatgtcctgcatgtacttgcccagttccatcgccttggaagtcacataggaaatacgtgttccgtccgccgacatctggttgatcgccgactgcagtgcctctaaaaactctgacaggtactgctcgccgatctcatcgtaattgacacggtctttgtttctcgggatcacttccgcatagaactgcagcggattcgtgatcttgatggaataattaccgtgtgcgcgcaggaaaagctctgcgttataaaaattatcaaagtaattgatcgggtttctcgttccaaacttgatccctttgatctcctgcagattcaggaaatatactttctgtgccgtcggcgtctgtccaccgtacttgatacggttgaacgtctcttttactgattctcccagttcaccgtttagcatggacggcagggaagaattatctaccttataatatcccggttctgccgtgtaatcgactacttttcctccatccacaagcatcataaactggttgtcatacacgtgaatcacggagccattgctcaccgtattgttcgtccccttggtattctgtcctctccggatcagcacaccactcgtaaagacggtctgttcccccatgtcatccgcctcgaacacctcgagccactgatccgccagtcctccgctgatcgcactaccgattgccttgataattcccataacaattcctcctgttctattctttcgttgtactctgacgagttcttattggaagttcctgcaaaacttcatatgcacagaatcatgcgccaaaaatgtattcacacatggtgataatccacctcagaaaaacgtaccatccgccagactctggtgtctaccggtacaaccgggctaccgcagtattcacagatctgctgtccaagtcccttcatcggcgccccgcagttcgggcagttcagcccgaaggcatttccctccgtctgctgcgccgcatcctgtacatagagcagctccatattgtactttgtctgcagcttccggtctttgtatccccagataattttgcccgctttttccttgtagtggtaatgctctaccgcactctgaaatgtgatcacacaagtgccgttctttttttcgtaattggaaatctctgtctgatgaatgcggatctgctcataggtctcacgcactcctgccgcacggtttccctcaatctgacggctgacctgctccttcagttcatcggaagcgcgcgcgacactttccagattccccgccgacactgcctgaagcgccgccacaagctgctgctgtgcgcgcgcctcaaactgttccagattcattcccggaaaatcacgggaaatctggggtgcaaaaatccgcgtcatggaagcgaccgacttcggtgtctcctccaacatctgttcttgacgcttatattcctcaatcagaccgccttttccaaacacccactttaaggtgcggatcacatcactgctcatcgtctcctccaagtcccttcgggcagccgagggaaagccacttcagatatccattcataaagatatccagcttgccgtccagcacgctgtccacatttccggtctccacaccggtgcggtgatccttcaccatcgtatacggctgcatgacataggagcggatctggttgccccatccgatctctgtcacctcgccgcggattcccgccgccttctcagcattctcctgctgctttaacagatacagctttgcctttaacatctgcatcgccttgtccttgttctggaactgggaacgctcattctggcactgtaccacaataccggtcggaagatgtgtgatacggattgcggaagatgtcttattgatatgctgtccgcccgcaccgctggagcggtacgtatcgatccgaagatcatcgtcattgatctccacatccagatcttcctcgatatccggcatgacatcgcaggacacaaaagaggtctgtctctttcccgccgcattgaacggcgagatacgcaccagacggtgcacgcctttttctgatttcagatagccgtaggcattttctccatttacctggaatgtcacggacttgatgcctgcttcctctccgtccagggagtccagcacttccacactgtatcccttatcgtctgcccaacgtgtatacatgcggtaaagcattgctgcccagtcacaggactccgtaccgcccgcgcccgcatgaagcgacacaatggcattgtccccatcgtactcgccggacagaagcgtctttgcgcggatggcatcgtacgtcgtcgtaaactccgttagcatttcttcgatctccgggatcaacgtggcgtcattctcctcatatcccatctcgatcagtgtctcaatatcttcaaactgtgtcgtcaaagaagcatatgtggcaacatcgtccttcatgctctttaactctttcatttttttctgggagacctccggatcattccagaaatccgcagcttccatctccctctctaactcctggatccgctgttctttgtttaccaggtcaaagtgaatccctcacttcctgcagcggttccctgtatgcgttcagggtcactttaaattgatcaagttctaccacagttatcacctctttcatttttttctattcttattgtactggaagccccgtcttttcgcaatcttttcccacaattttcgcagcgctgtaaaaagcagcagccagatcaccgctcccaacgtatcaatacacacgtccggaaaccgtccggcgcgccccgggacaaacagctggtggatctcatcggtcgccgcgtaaagcgccgcaaccgcaaccgccgaaattccgcacactttccagttaccggaatatccgtgcacaaaagcgcacgccagcagacagagtattccatattctgtcatatgcgccagcttgcgcaccggataatcaatccggtcggcatatgcctccatctcgctctgtgtatattctgttcctgtcagatgactccatgtttccacaatgcagcaggcaaccccaccgctgacctgctccgattctgatgccggctgtgccgaaaaccggaaaatcatcaccatacaaagaagcagaagtcctcctgttatcacacggtatatccgaagcttcatcccgtctcctcactccgatcagtcgttctgtgtcttctcactcagcacttcgattgccttctgcacctgattatcgtattggatctcatactgctctccgtccgggtcgagatactcatattccagttcaatgtccggatcgattccgacaccgtggatatagttgccgttcggcgtaaaatatttcgcggttgtcagcttgatggcgtctccgtcttccaacgggaacaggctctgcacgatgcccttgccgaatgtcgtcgttccgatcagcgttccgtagttgtaatccttgatggctcctgcaaaaatctcggaagcgctggcgctgtcctgattgattaacaccgccatcggatagtcaaaatgcgtgtctccgctggaacggtactcctcgcggtgtccgttcttatcctccgtgtagacgatcagaccttccggcagaatatcgtcaagaatctgtaccacggaatcgacaagtccgccgccgttatagcgaaggtcgaccaccagcgatgtaagcccttccccttccagttccgcaagcgccttctcaaactggtttgccgtatccttctcaaaagattcaatccggatataaccaatcgtatcgtttaacatctgtgaagatacgctcggcagcgtcacatcggcacgctccacgtcaaacgagagattctctccggtagacgggcggtagatctcaagatgtaccgtcgtcccggcttccccgcggatcagcttcacgagatccgtgacatccatcgtatccgcctcggttccgtccaccgacagaattacgtcttcgttgcgaagtcccgcactctcagacggtgttccctcgtaaacctttgtgattgtgacctgcatggtatctttatcctgcgcaagccctgccccgattccgtaatactgacccgtcatgctgacctgcgtctgcgcgtactcatccgccgtgtagtaaaccgaatatctgtcatccagtccctccagcagtcccgcatacagaccgtccttcaaatcctgaacatcggtatcttcataataatacagatcaatgtaagctgacagttcgttgatctttgccgttgtctttgcatccagcagggtcgttccgtccgtatctgccgctgcattggtgatgagtatctgacttccggtaaagcagcaggtcagataaatgccaagcgctccgacgaccagtgttccgcagattccaataaggatgccggttcccattccacggcgtctgcgctcttttccgccgtccggcttctgctctccggttgtctcattttctatcatgccgttttgcatattttctctttgttcgtccatagtttccctcatttctgtatgctatacgtaataagatatgtaaaaattccctgtccaaggacagggaatttcggtcaatgcctacgtgtactttctccatcagccgcccaggtaactccacgggctgacgtaacttccatttaaagagacgccgaaatgcagatggcttccggttgaaatgccggtacttccgacttttgcgatcacatctcccgccgacacggtctgtccgggcgataccagcagggatgatgcgtgcatgtagacggtgtagagtcctccgccgtggtcgatcatcacataattgcccgccgcactgctgtaggatgccgctgttaccgttccatccgccgccgcgataatgtccgctcccgccgatgctccgatatcaattcccttatggttcgacgacgctcccgacatcggggatactctcgttccataatcactggtcacccgcgtgctgctcgggcacggccaccggaacgctcctccagtatacggatgttcctccaccccggctgccgctttctccgcttccgctctcttgatcgccgcaatcagttcttcctgcgcctgaatctccgccgcataatagtcggcgtcgctctgcgcatcttcaatatctcccgagatgtccgcaagctccgactccttctgccgcatcatggcggcaacagtcgctttattgctctcgaccgtcgacttgagtgcctccagatcggtatactcctgctccagctgggcttccagattcacaatcgactccacggtgtcctggtactcggtaagcttttgtctgtcatagctctgtatctgtgcgatataatctgcggaatttaaaaattcagaaatgtttctggaagataaaagcgcctccagataagaggtctgcccgttctcatacatgaactggatccgcactttcatatccgcgtactgctgtgcttccctctctttggctccggcaagctcgtccttcgtctcctggatatcctcgctctttgccgtcagctgattctcaagatccgtgatccgcgcggatatatctatcagctgctggttcaattctgttaccttgctctcgatatcacccttggaatccctgagatcctcaatcgtgctctgcgcctctttgagcgctttttccagctgggctttctcgtcctgcgcctcctgcagggattttgtgggagcggcgtcctccgtcactttctctgtggaagccgacgatgcctggatcggtatgcccgccgccagcaccagaatcagtccgagcgctgttattcttcgtatcattgtaaacttcatgtgtttcctgtatggcatcttatcattataccctcaaatgcttgcgaattgtgatgcggcttccgataaaaccgattcccacacccagaatcaatgccaccgggatcagattatggaaaatctcgttcacgctaaggaacttcatcatattgctgataaagctgaacttatcgctgatgtacattacaatcttcccgtacaatgcgtacagaatgccaagcggaattgccgctccgatcagtccgattacaataccttcgaccacaaacggtgcgcgcacaaaataatccgtcgctccgatcagcttcatgatcgcaatctcttccttgcggacggagataccgaccgtgatcgtattgctgatcaaaaagacggcaacaccgagcagaatcaggatgacgcccgccgagatgtacccgatcagactgttaaagtcggtcagcgtgttggccacctgctgggactgctttacttcacgcactccatcgacggacttcaggtaggtaaccagcgagtcctgcatcgatatatcattcatgtagatggcatagctcgcggaattcgccagcgggttatcgccagcaaaacttgcagccgccgcttcatttccctcaaagtaaacttccttgaagctttcccatgcttcatctgctgagataaagtcataatgtgatacttccggtctctccgaaatcagctccccgatctcctcgatccgctgatccgagattccctcatcaaacagcactgtcactgccacgccggactccgcatcctttaccatggactggaagttcacgacaatcatatagaacagaccgaacaggaaaatgcatgccgtcatcgtggcaatcgacgccagtgagaacagcttgttcttccagatattcacgattccctgcttaattgtataaaaaaacgtactaatccgcatagtcgtcgtcacctccatcatccaagaaatcatcaaacagatcatcgtcctgttcgacagaggtatccttaccgtaatgatccgaagcggtatcgtctatcacaacgcctttttgcatcgtgatgacacgcttattcatcgctttcacaatctccagattgtgtgttactacaaccaccgttgtcccctgctcgttgatctcctccatcagcttcataatctcccatgcattattcgcatcgagattaccggtaggctcgtccgccagcagaatcttcggcttgttaatcagcgcgcgcgcaatcgccacacgctgctgctcccctccggaaagctgtctcgggtatgagcggtattttgccgccagtcccaccatcgacaacagttttggaacatttttcttgatggagcggttggattcgccaatgaccttctgtgcaaaggctacattgtcataaatatttctatcctttaacaatcggaaatcctgaaaaaccaccccaatgttgcggcggaatttcgggatttgtcttcgtctgattttatttaattttctgccattgattgtaatggttccctccgtcggttccagttccttcaacaggagcttgatcaacgtcgacttgcccgaaccgctgtcaccgacaacaaatacaaactctccctcctcaatgttaagactcacgtcattaagtgcaggaattcccgcagagtacgacttgctgacatgctctaactttatcatgaaattacctcatttctgtatgcatctccgatggttccggagaatcaaatgctctgtcccatcccatatagtctactcaatgtatgcagttgttgcaatacccgtatgcaaattttaagaattagtagtccagagactccatatacttcatatattttacgaccatcagtgcgatcttgaacgtgatggcatcctcgaacacacgcagatccagtccggtgctcttctgcagcttatccagacggtacactaacgtgttgcggtggatgtaaagctgtctggaagtctctgatacgttcaggctgttctcaaagaacttgttgatcgtcgtcagcgtctcctcatcgaaatcatccggggacttattgtcaaaaatctccttgatgaacatcttgcacagcggaatcggcagctggtagatcagacgaccgataccgagtgtggagtaagcgattacatccttctcctcgaagaagatcttgccgacatcaagtgccatccgcgcctccttgtaggatctggatacctctttgatctcgccgacaatcgttccgtatgccacatgaacgtcgctgtccgcatccgcacggaacaggttgaccatgctctccgcgatcttgttcagctcctcgtaaccttcgttctcgccgacttccttcacaacgataatattcttctcgtcgactgctgtgacaaaatccttcgtcttcgtgccgaagattccgcggatcttctccagttcattgccgtccttgtcgcggttcgtctccacaatgaataccacgcggcgcacctcggtgtcgatgtgaagcttcttggcacggttataaatatcaaccagcaacaggttgtcgagcagcaggttcttaataaaattatccttatcgaaccgctccttatatgctaccagaagattctggatctggaaactggcaatctttcccaccatgtatacatcatcgctgtctccgcttgccagaagaatatactcaagctggtgctcatcaaataccttgaaaaactgatatccgttcaccacctggctgtctgccggtgactccacgaacgcctgcgccggctcaatgtactgatccgcctccggaaaagtggctgctaacaccttcccctccacatcaataatgcacagatctattctggtgattccctttaatccatcgattgtattctgaagtatttgatttgaaatcataagctccgctccttctcatcctgcttctgctgaaactcttctgtccggtcactgtgtttcttccctatgagcaactttcacaataaaaagccgcctttctacctcggaacaaaaatatctaagctatattttaatgcaaaacagcaaaaaaagaaagaggaaatgcattttttttatgcatttcctctttttcactccgcttccccgaacttttcctgatcctgatacttgttcatactgttcttcaatcttcccagatgcaaccggttcttaacgaaacttccaagtccatgctttttaccatgaacgccgagttctcccatgccgaaccatatggtcgcgctcatcttatccttatgctccgcgaaaaaatgttcctgcagcggagacggcagaatcgaaacgatcacatccggcgtcgtcgcattcatctcattgatgacggcatccagattccccacacaattttccagtgcatattctcccgccagaatcagcttcgggaatgcttcctgcagttccgctttgaccttctgcacgtcctcctccgtctgtcccagcacaaaaatgctccgcttattgcgctcgatcctccgatagaattcatatgaaaaatcattctgctccgtctcctgcacacgctgcatgctgtccgcatccgccgcctttaagatctccttctccccaatgacggaaagatccagctccgagatcacgttgtgtagcaccgggtccgtctctgacgcaatcagcatctgcatggaaatgttttcgattgtatttaaaacatcattactcagatagttctcgacctgccgcatcgattcccgcacggtatagttgtcaagaccgatccccataatatctatttttttaatcattgtgcacctatatcattaccattatttgaaaaaacataccttcgtctgcgaaagatatgtttttagtatagcaaacttgtattcgtatttcaagattcttccattcctgtcaaatttacagacttcttttactgcttttttataattattttatatttgaaatgtcaataacttttccaaactttccacgaaatcggacaactttattatttcttcacaaaacagacattcgattattttactatgtaaaccagatttttttcccacttttctgtggataatgtgaataacttcgtgtataactcaatttttcctgtttttccgtttctgcattgtggataacttttttgcaattcacactcatttagtcagttttcctttttcattttttacaatttgtgcacattgtatagactgtgccttttgtcctattccttcattttttgcaataatcctgcgttttggggtgcaatattgagaaaatcatgtcccttcgttatcaggcagaatgtagctgaaaatcaaaagagcttcctcttctcttcctcttcttatgacgcaaaaatgggactatcacaagtgatagtcccattttatattctcgtttagaaaattcttcttacacagatcgggctgcggtaggtaacactggagtaagtgataccgctggacggtgtgctggcatgcacgatcgttccatttccgatatagattccaacatgtccgctgtaacatacaatgtcacccggctgtgcagatgaaaggcttacttcataaccacagcctctcaacgcactggatgaatgcggaagaccaattccaaatgctgaatacacactcataacaaatccggaacagtccgttccattcgtaaggctgcttccgccatatacatacggattaccgacaaactgacatgcatagcttgcaactgcctgaccgtttgaactggtcggtgcactgtaggatgcactggaatctgaggagctggatgaactggatgaactctcagagttcttctttctggcgctggctgccgctgctgccgccgcctcacgctctgcctcttccttcgcaagacgtgcttcctcttctgctttggactccgcctgcacatactctgtcgtcaatgtgacataatcggtggatacatagccgtctccctcttctgtcgtcacaagtgcccagcccggaatggactcatcggttaccacaaggtcatcctcaatcggaaccatggttaaaaccgctgcatctgtggacggctctgtacgcacataaagcgttgtcgtcgtaacttttgcatagcgggtacttacagactttgcaagttcctcatctccggcaaccacgtactcacacttcacataaccggtaacattgccagatgtgatctcataccagccatcctctgtggtctgtaaaatcgttgccgctgaattattgtaaagcttaccgactacctcgctctctgtgttcggctcggtacgcacgtttacgtagttatctacctgcgcaatggcaatgtctgcatattcggactctaccaccggtgtctcattctcgcttacctgttcctgctgcgctgctgcttcctgcgccacttcctcattgcttgcgaccagacaatctgccactgcaagcgaaacgcctgcgctcgggctgctgcttcccgttccgactgccactgcttctgctgtggtagcaacggacacacccgcaaccggtgctgcatatatcatagatacaggatctcctgccaataacattccagtcaatacaatccctgtagctctcagtgttcttctgttcatgaatgcctccaacggatttattacaaatttgttacatttattacatggttattataacaaagcgtctatatgatgtcaacccgctatattttgtaatactccgcagattttacacaatattttctttttcgacacgtcttttccacaatctgcgccattttccgacaaatccgggttacatctgctcccagattttccctgcctgctgctgccttatgcctttccggttttatagtttgttgcatttttcataattgccattctcctccatctgtggcataataaagccatcataagaaggaaaggtgggattcgtatggatttttccaatgttgatctggcgcttggcacactgacggcctacgactccggttcttctgtcagctccggcagtctcgcctatgcagtcggcacggccgttctcagtcagtcattagacctgacccagcagatgggcacctccatgattcagatgatggaacattcggtgaacccggagctcggcggcaatatcgatatgtacgtatagggatcatgtaacagatgctctctgaaaagaaaagacgcggcacacgatgtaacagtgtgccgcgtctttttatgttccggatctcctccggcagtctcaggtattcctgttcctgtcgcagcaattatttggtagcaatcgcttcgatctcgagcataacgtccttcggaagacgcgccacctcaacgcagcttctcgccgggtacgcgccctcaaaaaatgtcgcatatacttcgttgattgctgcgaaatcattcatttccttaataaatacggttgtttttaccacgttcgccatgctggtgtctgctgcctcaagcagatgggacaggttcgtcagcgcctgctttgcctgcgccacagatccctccgggatctcgcctgttgccggtacaaccggaataataccggaagtgtataccatgccgtttacctcaatcgcctgggaatatggtccgatcgctgccggtgccttgtccgtgctgattacatttttcatgctgtattccttctttcttatagtctgtcggtttcgtctatcatagcacacatggaacatccatgctactataatttgcggattgcacgctccgtaatctcgatgcggcgctccttgtacagtctgccgaccgcacgcttgaatgcatttttgctcagccccgtctcacgcatgatgacttccggtgaagccttgtccgtaaacggaagcacgcccgcaaattcctcaatcacttccatgaccttctcggcgtccgcatccatctgcagatatgccttttcccgcatcgtaatgtcaagcttgccgtccggcttcaccccggtgaccttcgcctcaatcacatcgccgatctgaagatggctgcagtcctcatgtgccgatatcatcgccgagtagcaatcatccactgccacaaacgttccgaaatcatgaccgaactcgtagatccgtccgtttaccgtgtctccttttttataaggagaatccgtgcgcatcaggtcgtacagctttttcatgcttgcacagagtctgcggctcttatcgatgtagagcgtcaccagaacctcatcccccggctgcacctttttcgtcatctctttatatggaagaaacaggtctttttccagtccccagtccaggaacgcaccgatttttccaatctcggcaacctcaagcaccgccagtccgccaagcgtcagtttcggctggttggtcgtcgcaatgatgcggtccttggaatccttgtacaggaatacttcgatctcatccccgagctttgcgtccgccggcacctgcttctgcggcagaagcacacgcgtctcatctccctcatgctccgccagataaattccaaattctacttttttgattacttttaacttctgatattcacctaatttcatctcgatcctcattttccatcaattcttctctaccgccgcaaattccacaatcgcatagatctggtctccgccgtctgtcagaaccaccgttatcttttcctccgatactgtgacaaccggatgcagcacgtcgcccagcattgccgcccgtcggtactctgcccgcacgccgccgattgcaaaatcctccggcacagattcctttgccaccagaatgtatttcccgttgttcatgtggtggttggtgtcaataaaaaatcccgccaccggaaccggcggcatcacagtcccgtcctccggaaccgatagctttctcgcgccccactcgcccggcagttcttctccgatctccggccggtaggcatccgccactttctccgggatgcgcatcgggcgcatccgttccatatccatgtaaacccagacagaattcgccagcaccagttcctctccctgtccgtttgtgatccggaagttgcgatatccatagaatcccttaaatgcgtacggccatgtctccacgcagattttctctcccataaccgggtagcgtctgatcttaatctcccaggaagacaatacccacgcctgcttctgctctgccagatattccacgccgatattcatatcttccgactggaaggtgcagcaatcctgcagataatccatcaccgccggcagtgtcaaatgccgttcgctgtccacttcactgtaacgtacgcgactttcaaactgatacatggagtcccttctttcaatgcctgtgtctgttattatcgtagtaatagtaacacagggggacaggtttttcaatgatgggaaacagatgccggataaagaaaagacctcatgaacatcgttcatgaggtcttagaagcagggctacaaggattcgaaccttgaaatgacggagtcagagtccgttgccttaccatttggcgatagccctaagtgctgtcaacaaaagctattataacaggtcggcagaaaaaatcaagtgtttttttcaaaaatttcaatttttttgtctacgagtgcgtacaacaccttctcgccccaggaaatccgggcgcttccgttcgtcgcctccacgatttctttttcgacttcctgctgctgttctgccggaaccataagctgaagttccactttttctgtatacacagtgtcgatcagcgtgagattctgctgcgcgatcagatactgcagctttccaagcccggtatagtccgtgccgatcgcaagatgtacgccttcctttttatctataatggtactcgccgcaagccccgcctgcacggctccctgatacgcccgcaccagaccgccggtgccgagcagcacgcctccgaaataccgcgtgaccacgaccgccacgttgtgaatctcctcccgcagcagcacatcaagcatcggtctgcccgccgtctgcgccggttcaccgtcatccgaacagcggcttaactcctgccggtctccgatcacaaatgcggaacagttgtgtctggcgtcccagtattttttcttcatctccgcgatgaatgccaccgcctcctcctccgaggcaaccggccggaccgtcgctataaatctggacttcttttctacaatctcaccctcgccgccgatatacactgtcttcatatgatccacaatcccgccacccgggtcctttcccttcgctttccactcttttcaaatagtaacacggcagctttcttttttgcaatacgaatccttaagaaactgtgaagaatgtccgtattttcagttttttctttattctgacacagttctttggtataatacattgatggtgaatcagaaaaggaggcctactatgaattatggaaagaaacgtactcggaagcgcgagcatgaacttgcttccaagggtaccatgattcgcaaaaaattcaacgtaattttttgtaaggcattgcttatatgcttttttgcagtcgtgattgtcggcggatgctccgcgttcggagtgatctccggaattattgcttccgctccatcaatcgaagatattgatgcaaccccgactggataccttacgaccgtgttggacaaccagggcaaccagaccgcaacgctcgttgcatccggttccaaccgtaaatacgtgacgatcaacgagattccgatcaatctgcagcatgcttttgttgcgatcgaggatgagcgtttttacgatcacaacggtatcgatctgcagggtattctgcgtgcaggattaaaaggcgtcgcatccggttttcatttttcggaaggcgcaagtaccatcacacagcagctgctcaaaaataccgtgtttactcagtggacaagcgaacagtccatggcggacaagttcgagcgaaaattccaggaacagtacctggctctccagctggaaaaggttgtggacaaggactggattctggaaaattatttaaacgctatcaatcttggtcagaatacgctgggcgtcggcgtcgcatcggagcgctatttcggaaaagatgtctcggagctgacactctccgagtgcgccgtgctcgctgcaatcacccagagcccgagctactacaacccgatcacacacccggatcacaacaaggagcgccgtcagaaggtcttgaacaacatgcttgaccagggctacatctcacagagtgagtacgacgaggccgttgcggacaatgtgtatgaccggattcaggtcgtcaatgtcgagtcgcaggatgagaatatcaattcttatttcgtagatgagatgacggatcagatcgttcaggatatgatcgaccgtctgggctacacggagacgcaggcttacaaagctctctatcagggcggacttaccatcgagtccacgcaggacccggatatccagaatatctgcgatgaagaggtcaacaatctggagaactacccgaccgatccgaaggtatccttctcctaccgcgtatcgatccagtccccggacggcaccatctcaaattacagccagcagacgatgctttcctattatcagaagtcaaacaagaactacagcatcaactttgccagcgaggatgacgcccgcgcagcgatcgagcagtataagatggatcttatacaggacggagacgtcgttgtggatggcagcgagacgcttacctttaccgtccaaccgcaggctgctttaaccgtcatggatcagtccaccggagaagtgaaggcactcgtcggcggacgcggcgacaagacggccaacaagacgttaaaccgtgcaacggacaccacaagacagccgggttccacctttaagattattgctgcctatgcacctgcactggacgcgggaggtctcacacttgccgatgtccaggatgatgcaccgtacaattacggttccggacagggcggagcggtcaataactacgacaagcgctaccgcggtttcaccacactgcgcgaaggtatcattgattccatcaacgtcgtagcggttaagacgctggcgcagatcggtccttccctgggttacgattacatccgcaactttggttttaccaccgtcggcatcgacgagagcggcaacgagacactggcactcggaggtctcaccaacggtgtcaccaacctggagctgaccgccgcttacgccaccatcgccaacagcggaacctacatcaagccaaaattctatacaagaattctggatcatgacggaaatgtactgcttgacaatacggcaccggaatcgcacaccgtcctgaaggagaccactgcatggcttctgaccgacgccatgaaggacgtcatgacacagggaaccggtacgccggcctacttcggaagcagtatggcgcaggcaggaaaatccggtaccaccaccaagaaccgtgatgccctgtttgccggattcacaccttattacacctgcgtggtatggggcggttacgacgacaatgcggttcagaacagcggacagaccacctatccgaagaagatctggaaagcggtcatgagccggattcacgaggatcttccttatgcggactttgaaaaaccggacggcatcgtcactgctaccgtctgcaaagaatccggaaagcttgccatcgacggcgtatgtacgaacgatccgcgcggcaacatggcatataccgaatattttgcaaccggcacggcaccgaccgattactgtgaccaccatattctggccaacatctgtgcggattccggacagctcgccggcgcaaattgtccgaacacctacgcaaccggcgtatacgtgattggcggctctgcgaacacagaggatgctccttatcttctgaccgaagaagctctcgccaatacctgtacgatgcacaatgcaccgtccacaccgtatgagtcgacgccgtacacacctgttccgggcgtgacggatctcccgtcgcaggataccaataccggaaccacagacaacagcacctccccgggtgacagcggcacatcgacgggtgaggatcggaccaccggtgacaataccggcggctctgctgaaaataccggcggcaacgccgacggcagtcaataaaaagatgcgcccgggttttgaaactctcaaaacccgggcgcatttttttatctgtcatgttttaattctctgtaaaggatcttaccgtctgcagtacctcctccgccttgtccagcgattccgctgcatgttctccctgctcactgcaaaaatcgatggttctcgcctcaatacgctccagatgccctctggcctccgcgctgagtgcctccggcgtgtattctttgatcgtaagtcctgccagccgcttcatataacgattcgtcgtctctctggcctggcgctggctgcgcatgcgctgatccatgatctcaatctcgcgctcctgcttttcctgctcctgtctccgcgcgcctgtatcctcctcatttttgacctgcacggcatgatattcatacgcctcctcaagcgcctcccagaatgctccacggaagtctaccggacgtaaaaatacacggaatacattccgctcgttgatgaagaaatgaagctgcgccgaactgattgtggtcgtatagatgatacaaacggtactgggtgccgtcttgttcagatacgttatgatctgctccccgttgtacccctccagggatagtcccgttatcacgatgtcgtaattctttttcttgatctttgccgccgcctctatgccgtttatcgccgtctcaatctcaatatcccgatccttcatcgcatctgtaaattcatgaatgatctggggatacttgctgatgaacagcagattatgctttgtatagtcctgtcccatatcacattcctcctatgtcgttgcctttacttcttccacaggtctcaaattatttttccaaccctatatctgctgatatttcccacactacttttcgtttattttcttatcttgaattataatggaatgtccccaactattcaatagacttcttctccactttctccctcagatattctatccgcaaaactgccttcgcagattttttcttcgtatttactatacaatcacaatttatggactttacagtcaaaaacgtgaaagcgcccggcaatctgccgggcgttcccgcgttgatgtatatactaactaaggggattagattcaccaatctaatcaaattagattagtgcatattagtgtaactctctggatacgaaatccggatagccggactctaatccatgctctgtcgagtcaagaccctcgatctcctcctccgcggtgactctgagaccgatcgttttctttaatacggtaaacacgattgtcattgtgatgatcgtccatcctgcgatgcagaggattcccaggcactggatggcaaggtgatgtacaccgccgccgtagaacagtccgtccttgtaatcaaagaatcctaccgcgagggtaccccagataccgttgcagccgtgtactgccactgcaccgaccggatcatctactttcagtttatcctcaataaagtatactgccacgcagacaagcacacctgcgactgctccgataataaaagctccgattgcatctacgttcgagcatccggctgtgattgccacaaggcctgccagcgaaccgtttaaggacatggacacatccggttttccgtttctgatccaggtataaagcattgcggttacggttgcaactgccggtgcaatcgttgtggttgcaaaaatctgtgacagctgcatggtgtcggttgctgctgcgccgttgaagccgtaccagccgaaccagagaataaatacgccaagggcaccgatcaacaggttgtgaccgagaataggcttcggcttgccgttcttgtcatattttccaatacgcggtcccaacattgccgcaccgatgaaagcagtgataccgccaaccatatgaatgcaggcagagcccgcgaaatctgtaaatcccatatctgtcagccacggtgtaccgccccatacccagtgagcttcgatcgggtacacacataagctgatgataaaactgtagatacagtaggtaatgaactttgtcctctctgccatggcaccggatacaatcgttgcagcggttgcacaaaataccaggttaaacacaaacgccgaccagtcggtctcgccgaaattcgtaaacgggttcagtccccagccgacaaattttccatcgccgcacaaaaggttgtaaccgagcagataaaacgccacggttccgatacagaaatccatcaggttcttcatcgtgatatttccgacgttctttgctctcgtaaatcctgcctctaccatggcgaatccacattgcataaaaaagactaacgctgctcccataaggaaccatacactcatatccataagcttatcctcctgcaaaaaagaggataacagcgagcacagacattcctgtgttctctattatcccctttgataatatgttacaatatttgattttttcataataatctgtagtgctccttcatcgctcctatagcagactcctcaattcctcctataacagcactccttaaacaggcttacaatgctttcgtgccatgctcacctgtacgaatacggattgcatcttcgacatcatacacgaagatcttaccatctccgaaatgtccggtgttaatctcatctacgatcttatcaatcagcttcggtgcaacttcgtctgccacaaccgtctcgactttgatcttcggaagcagattcacggaatactctgcaccgcggtagttcttaataattcccttctggttaccatagcccatgctgttgacgatattcaaaccgtttacttcctcggtatccagcacgccctttaagtcttccagtttttccggcttaataataatttccagttttttcatgccaagctcctcctttatattcagttttagcgaaagcgctgctcccatccctctgctgttcacagtttattcatttaagattcaaaaatctttcatcctataaacatgaaattttcatttctgctccatatactataaccatacaaatgatagttatcagtatttgttactacccacaaaactttttcataatctgccaggtgacggttgtcacctggcaatcctcccctttcggggagttttttctccctttaggggggattttttatttaggaggttgatggtagcaactatacctcgaaaatcaaatctccataggacggcatcggccacattgacttatcaactaacatctccagcttatctaccggcgctctgagttcatccatcgctgtctttaccgtatctctgtagtatacagcctgctctctgccctcatccattgcagatgctttctctgtcacatcctttaacttgtcgagagcattctgggcgtctgccagaagatcggatacctctgtgaggatctctgtctgcgcgctgatatctgcgccgcatgcactctttacggcattgatggactgtgccagtaccgttgtatatttgataactgccggaatgatctgctttgcagcaatgtcgatcattgcctttgcctcgatattgatctcttttgcgtaggtctcatactcgatctccacacgggaatccagctcagccttggtaaataccttgaacttctcaaacagtgtcactgccttctctgtgttgagtgccgggatcgcatctaccatggagcggatgttcggaagaccgcgcttctctgcctctgctacccactcgtctgaatatccgttgccgttgaatacgattctctgatgctcggttgcatactccttgatcagatcatgtactgccatgtcaaagtcatctgccttctctaagacgtcgcatgcctctgcaaatgcctctgccacgatcgtgttgagtaccacgttcgactgggcgatggaatcctgggaacctaccatacggaactcgaatttattgcctgtgaatgcaaacggcgatgtacggttacggtcggttgcatccttcatgaaatccggaagcgtcttaacaccggtctctaacttcttgccggagatactgtgtgttgcctcaccagtgctgatcagctgtgaaagcacatcctgcagctgctcaccaagatatatggatacgattgctggcggtgcctcgtttgctcctaatctgtgatcgtttccgacatctgctgctgcctctctcaagagatctgcatgcctatctactgcttttaagatgcaggtaaggactaacaggaactggatgttctcatgcggtgtcttgcccggctctaagaggttgatgccatcgtctgtcgtgatcgaccagttgttgtgcttaccggaaccgttcacacctgcgaatggcttctcatgaagcagacactgtaaaccatgacggccggcaactttcttcaatgtctccataacgagctggttgtgatcgactgccacgttcgcctctgcgtagatcggagcaagctcatgctgtgccggggccacctcgttgtgctgtgtctttgccgtaacgccaagcttccagagttcctcgttgacgtccttcatgtacgcaccgatgcgctcacgaatcgatccgaaatagtgatcgtccatctcctgtcccttcggcggcattgctccgaataaggtacgtccggtaaagatgagatcctttctctgtaaatacttctcgcggtctacgataaagtattcctgctccggtccaacggacggtgttactttctttgatgtagtatttccgaataattttaataagcgaagtgactgctcattgattgcttccatagagcggagaagcggtgtcttctggtcaagtgcctcacctgtgtaagaacagaaagcggttggaatacaaagggttgcgcctgctgcatcctgtctcacgaatgccggtgatgtacaatcccatgcggtatagcctctggcttcaaatgttgctctaagacctcctgacgggaaagaagaagcatccggctcgcccttgatcaattccttaccggaaaagctcatcagcactttaccgttctccatcggagctgtgataaatgcatcgtgcttctctgcggtcacgcctgtcagcggctggaaccagtgtgtgtaatgggtagcgcctttttcaatcgcccactctttcatctcatgcgcgacaacatctgctgtctcgagatccagttcttttccctcgttgattacttcctttaacttcttgtagactttcttcggaagacgttcctgcatcactgcatcgttgaatacgttttcgccgaaaatctctgctgcattaaggtatcctgtttcgctcatcttctacatcctttcttctcactaatccaatcccctaagaccagacttgcttattctaatgtacgcgatttcctgttggatttcaaccagaacttcatgtaaagttctgtatacagaaaaaagggcattccaagtctattggaacacccttgttcatcgctcacattgttttgttggtattaagataatactttttaaaacgaaatgcaagcgaaaactttatatatttttaatttttacacttctaacaaaaataataaagttctagtcaaattattgtgaaaaaattctgttgtccgacaaaacaacttcattccataaagaattagtcgtttgccttacctacggaaccgaacagctccatcttctcttttaccgttgccttgattgcctctgcgccaggagcaagaagtttacgcgggtcaaagcccttgccttccagatccttgccagcctcgatatatttacgtgtagcatctgcgaaagataactggcactctgtgtttacgttgatctttgcaacaccgagagagattgctttcttgatcatgtcagccgggatacctgtaccaccgtgaagaactaacggcataacgcctgtcttctgctggattgcatccagagtctcaaagcttaagcccttccagtttgccggatattttccgtgaatgttaccgatacctgctgcaagcatatctacaccgagatcagctacacgcttgcactcgtccggatctgcgcactcgcccatgccgacaacgccgtcttcctcgccgccgatggaaccaacctcagcctcgatagacattcccattgcatgtgcaacctgaaccagctccttggtcttctcaacgttctcgtcgatcggataatgggaaccgtcgaacatgatggatgtgaatccagccttgatgcacttgtagcatccttcgtatgtaccatgatccagatgaagtgcaaccggaactgtgataccaagctcatcatgcattgcctttaccatcgctgcaactgtaccgaaaccggtcatatacttaccagcgccctcggaaacaccaaggattaccggagactgtaactcttctgctgtcaggagaacagactttgtccactcaaggttgttgatgttgaactgacctactgcatagtgaccagcttttgctttttctaacatttcttttgcagatactaacataatgaattcctccataacttaatcaatttgccgcaatgcggcagttgtttttaccctatcgctattatatattacttcctgtaaaaaataaagttaaatttttaacaaaacatacttcccgacaaggtctctcactcgccctgcggcaccataatctcgaccgccctgcacaggttcttcaccacaacctcctcatggtcgccgccgaattccccgtccagcgtccacggaatcgtattcttcgccgtgaaccgcacctcgctggtcttaaacgagtagatcatgtccgtatcgtccacaagattgatcaacgatgcgatgatctcgtttaactcgatcgggttcttcggctttttgatgagtgtgacctcgaagactccatcatccagcaggacgtcctttccggtcatccccttaaatccgcccacagaggtggagttgctgatcatcccgtagatgaactcgtcctgaagacgcacattgtcatactctacctgcatgaggaacgacgggatatcatgcaggcacttcgcgccctctaagatgtaagccgcgtgtccgagcacattcttccactcctggctcgtcttgtaggaaacttccgtaaacagtccgaacgccgccacatatacgaagaagtccccgttaaacgctccgatgtcgcacgggaacacccgtcctgcaacggctgtctctgccgccttgaccatattcttcggaatgccaagcgatgtggcaaaatcatttgtgctgcccgctgcaatatagccgagcggtacctttttctcacggtgcatcatccccgtcaccacttcatccagcgtaccgtccccgccgctgcacacgacgagatcataatcgccggcttccatctcgatcttatgtatcgcgtctccctgtgcctgtgtcggatagatggtgacctcataatccgccttcaccatcacatccacaatatccaacagctgattcttgatctgtgccttgcctgaaaacggattaaacacaaacagtaactttttctttgtacccattatttatacacccttatcttatttctttctatgagacgaggaattcctcaatcgctgcaacggcttccgcttcgtccgctccctctgcatccacaagaatctcctcaccgtttaatagcgccagactcatcatccccataatgctcttcgcattgacacggctgtcaccatgttccagatagattttgctttcataccggtttgccacctgcacgagatttgcgatcggtcttgcctcaaaatcctgctgcatctttactaccacactctttttcattgcatcctcccatcctcgctttttaacttacaccttacactgtctgctgccggaggctgtctgccatctcgctgattctgcgaagcctgtgattcacacctgattttcccacaggaggattcaggtaggttcccagttctgcaagcggcgcatccgggtattccagccgaagcagtgccatctctttgagattctccggcagatatgacaagccggccgtctctcttatatattcaatgtccgcaagctgtttgactgcagcgtttaccgtcttgctgatattcgctgtctcgcagttcaccttacggttcaccgaattacgcatttccttcagaatccgcacgttctccagattcatgagcgcaacatgcgcctccataatgtttagaatatctacaatctgcgagccttccttcaagtacacaacctgatattttttgcgcgccacaatcttggcatccatgtcaaaactgttgattacatcccgaagctgctcggcctgcgggatacttcggcacacaatctcaaaatggtaggatttgttgggatcgctgatcgatcctcccgccagaaacgcccctcttatgtacgccctcttgcagcagctctgctgaatgaggagtcccttgactgtatcttccggctccgcctcccccgtggcatcgttgtacattttaaccgtggaaaaaacgctgcgcgcctcctcctcggtatggatttcttctatatgaaacagttctgctaacagcagctgatatttttgcatcagcagccggttctccgattccgccgcagggattcttccctcaaatgcaatcagcgccgccagctctgcaatctggcaatgtctgctttttcccagatgttttgccagttccgtttttacctcacttgaaaatgacatagcttactccaaccgtccctcgcgtccatcggctcttccttttgtctgcggggtctatttcccgcggagcgcatctttaccgatgtcgcggtgctctattttcagtccgtatcccttttgtccggaaagccgttcatacagcgcattggcgagcgtgaccgaccggtgctttcctccggtgcagccaatggagattacaagctggttcttcccttctgcaatataattcggaatcaggaagttcagcatatcctcgagcttgtccaaaaacgtatgcgcctcctcatactggaacacatagtcctgaatctccttgtcattgcccgtctttgcccgcaatccttccacataatacggattcggcagaaaacgcacgtcaaagaccagatcggagtccgccggaatcccatacttaaatccaaacgacagaatcgtgataaacagattcttatagtcctgattctgcacaaaaatcttatccagctccgctttcagctccctggtcagaagctggctggtatctataatatagtctgcactctctttcaaaaaagccagacgctttctctcttcttcaatgcccttgtccacccggtctccgccggacagcggatggtttcttctggtctccttgtagcgcttgaccaatacagaatcctctgcatccagaaacagaatctcgtagtgaaccttcttttttttgatccgcgcaagcacgtcgcgtatctcttccagtgcctggccgttccggatgtcaataccgaccgccactttctgcagttctgcattttcctgcaggctcgacagctccacgaacttttcaagcaatgcaatcggaagattatccacacagtagtatccgatatcttccatcatcttaattgccgtactctttccggctccggacattccggtcaaaatcacgaacttcatgccagtcactctccattcctgcgtatcctgctgttatctttgtctatcgggctaaaattcgccaagcatcttaatctccggttccagcttcacctgaaactgtctgtccacctctgcgctcacatccgcaatcagcgtcctcacatcctgtgcggtcgcattccctgtgttgaccacaaatccgcagtgtttctgcgatacctgtgctccgccgacccggtatccgcgcaatcccgcatccatgatcagctttccggcaaaatatccctccggccgtttaaatgtgcttcccgcactcggatattcgagcggctgcttttcggcgcgctgcgtggcaagttccttcatccgtgcccggatggtctgctcctctcccgctgcaagcttcaataccgcctgtgtgacaatatagtgcttctttaaaatgcagctcgtgcggtagccaagctccagctcctccacggacagcacatgctgtactcccgtctcatcgagcacggtcacagtctctatgatgtcccgcatctctccgccgtaagctcccgcattcatcacaactgcaccgccaatcgttcccggaatcccggctgcaaattccatcccggtcagcgcatgtgacgcagcaagcgacgccgtgcgtgacaggagtgctcccgctcccgccgtaatccgcacgccgtctgccgaaatctcatccatcccgtctctggtaagaatgaccaccccacggataccaccatctcccaccaggaggttactgccgtttccgacaatgtaatatggctctcccgcctcccggcatgcaccggtaactgctgcaagcttctccgcttccggcgtcaccagcacatccgccggaccgcccacacgaaaggtcgtgtggcggctcatcggctcgttcggatgaatattttcttttcctgcgatctgttctaacgtatccaataactgttgtttcatgcctgttcctttaaaaatgcaatatagccgcgatatgcctcatacagatccaccttgctgatgatctcccacggtgcatgcatgttcagcactgccacaccgctgtcaatcacacgcatgccatagttggcaagaatgtaggcgatcgttccgccgccgccctggtctaccttgccgagttctgccgtctggaatgacacctcgttgcggtccatgatcgcgcggagtgctcccacgtactctgcattcgcatcgttcgatccggatttgcctctggctccggtatatttgttaaacacaagtcctcttccaaaatatgctgcgttgcgcttcgtcatcacggacgggaagttcgggtcaaatgccgccgatacatccgaagagagaacgctcgagttcttcagtgcacgtctgagtgccagttcagaatacgttcctgccgcattcatcacctctgcgaccgtattctcgaagaaacgggactgcataccgctcgcaccgacacttccgatctcttccttgtctaccagaaggcatacacttgtgatctccggcttctccatcgccgcaatcgcctcaaaggaaggatatgcgcacactctgtcatcgtgtccgtagcccataatcatgcttctgtcaaagccgtagtctctcgcttcgccggccggtacgacctcaatctccgcagagaggaaatcctcttcctctatatcatattcctttgcaaggatcttcatgatattggcttttaccttttccttgacgtcgtctttttcatccgcttccgccggaatgctgccgatgatcagatcgaggttttctccctcaatgaccttggctgcctttttctccatctgctctccggaaaggtggatcaaaagatcgctcacgccgaataccggatcacccggcttgtctccgacactcactttgaccacggtgccgtcctttttcgcaatgacgccgtgcagagccagcggcagtgtcacccactggtacttcttgataccgccgtaatagtgggtatccagcatcgcgaaatccgtgtcttcatacagcgggtcctgctttaagtccatgcgcggggaatcaatatgtgcgccgagaatattcatgccgtgctccatgctcttctcaccgattacgaacagggcaagtccttttcccatattgtttgcatatactttatctccggctgcaagctttgtacccttctccagcacggtatccagatttacgaatcccgccttctctgctttctgtgcaaaataggtgacgcactcgcgctccgtcttgcagtctgacaaaaacttacggtactcctctgcaaaatcaaaaacttcgtttctcttttttccttccgggtatttctcccatgcgttcattctttccattgctgttgtttctcctaacctatattgatctattcgtcttcctcatcgtcggacttcttcgtcaggttctcctgtacacggcggtacagctcctgtgcggcattgtaacccatcttcttctgtctgtggttgactgccgccgcctcacagatgactgcaaggttacgtccggcgcggatcggaagcgaatgacatacgactttattgccgaggaactctgtgtactcctcctcaagtcccagacggtcatactcattatccttcttccagtcttccagcttgatgaccagatcgatctgctgcttctccttgacgccctcgacaccgaacagcgtcttcacatcaatgatgccgattccgcgcagctcgataaaataacgtgtgatatccggtgaagtaccaatcaacgtatgctcgttgatcttacggatctccacgacatcatcggttaccagacgatgtcctctgcgcacaagctcgagtgctgcctcgctcttaccgataccgctctctcccataatcagaagtccctcgccgtagacatctacaagcacgccgtgaatggtgatgcacggtgccagctgctcgctcaggcagtagatcagctccgccatgaactcggatgtgcttcgcttggttccgaataccggcaggttgctctcctccgcaattttgaggaacatctcgtccggctttaaatcacggcagaaaatgacgcacggaatatcgtaagccataaactcccggtaaatcgcttcttttttcttctcatccagctgttgcagatacgtgtattccacggtaccaatgatctgcacacgagactgctcaaaatgctcgaaatagccgctcagctgcaatgccggacggttgacatcacggatcatgatccgatgtccttttaattccatctgcggaataaaattgcacagatcgagaatctgcgccacttttgctacaccaacaccactcatcccttacgctcctttgtatgtgatttacttttgtgcaaattataccataggcacatggaatcttcaactaatcggacggctggttttcccgttctttctcccggaaaaaccggtaaaccgagcgcgccgcctgcgggctcatgctgtccgtctgtgcaaggtcttcctccgtcgcctcccggattgcctccagcgactgatattttttcatcagcgccttgcgccttgccggtccgatatccggaatgtcatccagcacggaatgtacctgctccttgctccggagcgaccggtggtactcaatcgcaaaacggtgcgcctcgtcctgaattcgcgtaatcagcttaaatccctcgcttccacggtcgatgggtatctctacattatgatagtatagcccgcgcgtgcggtgattatcatctttgaccattccacagaccggaatattaagatgcagctcctccagcactttgagcgcaatgttcacctgcccgcggccgccgtccatcatgatcagatccggaaatcttgtgaaactgccgtactcctccgacaggtctttttcttccatctcctccatctcacgcatgccatgcgtaaatcttctcgtcagcacctcatacatggaggcatagtcatccggtcccgacaccgtccgcagcttgaacttccggtagtcactccgctttggcttgcctttctcatacacaatcatggaaccgaccgactcaaaaccgctcgtatttgagatatcgtacgcctccacgcggtttaatcctttcatatctaaaagctgttcgatctcctttaacgcgccgatcgtcctgccttcctcgcgcttgatcttctcacgatcctgcgcaagaaccatcttggcattcttctgtgcgagttccaccagcttttctttcatgcccttctgcggtacgcggatataaaccttgctgccccgcttttcgccaagccagtcggcaagcacctcctgctcctcgatctcctgcggcagcataatctctctcggaataaacggcgttcccgaatagaactgctttatgaacgtggtaaggatctgggccttggtgtcctccgtcccgatcttcacataaaaatggtctctgccgatcagcttgccgtcacggataaaaaatacctgcaccaccgcgtcgcggtcatccgccgccagcgcgataatgtccttgtcctcgccgtccgtgtgcgtaatcttctgcttctgtgcgatctgtctgacactgtttaaaagctcccggtactcaatcgccttttcaaattccagattggccgacgccgtattcatcttctcttccagagactttagcaccggcgcataattgccatttaaaaattccaccaccgcatccacgcgctcacggtacgcttcctttgtgatatatccctggcagggcgccgtgcactgatgaatatgataattcagacacgggcggtcctttcccgtgtcgcgcggcaggttccggttgcaggtgcgcagctgatagatcttgttcaccagctcgatcgtatccttgactgctcccgcgctcgtgtaagggccaaagtaccgcgatttgtcttttttctgctggcgggaaaagagaactctcggaaaatcttccccgagagtcactctgatgtacggatatgtcttatcgtcccgcagcatggtgttgtacttcggccgatgttctttgatcagattacattccagtaccagcgcctccagttcggaatccgtcacaatatactcaaaccgcgcaatctgttttaccatctgcgcttttttgataccctcatcatggcttggctgaaaatactggtgcacccgcttgcgcagactgaccgccttgccaatgtagataatggcatcacggctgtcatgcataatataaactcccggctgatccgggagttttttaagttcttcttcaattacaaacattactgttcctcatgatcctgcgtattgcgcagcaatacatcatccatgttctgactctctgcggcagtttttccctcctcgagttcctgacgggcttcctccgcctgctcgaagaacgtcttcttctccgcctcgtcctccggctccgggattcctttcagttcacggaaaatcttcatgaattccttaccggtaatcgtctcatgctcgtagaggtattctgcgatatgatcgagcacctcccggttctccgtgaggagacgtatcgcctcatcatatgcgtgattgataatggcaagtacctccttatcaatctgcgccgccgtgtcctcaccgcagatcagtcctgcgcggttgtccagatactggttctccaccgtcgccaggcacatcataccgaacttatcggacataccgtactgcgttaccattgccctggcaatcgccgtcgcctgctcaatatcgttcgccgcaccgctggttgccgactggaataccagcacctccgctgcacgtcctgccatgtaagtggtaatcttcgctaaaagttcatccttggtctggagatacttctcctcctccggcgtctgcagcgtgtagccgagcgctcccatcgtacgcggaacaatcgtgatcttctgtaccggctcggtgttcttctgaagcgccgtcaccatcgcgtgtccgacctcatggtaggacacgatcttgcgctccttgtcactcatcacgcggtccttcttctccttgccgccgactgccacaagttcaaacgcgtcaagcagatcggactggttgacaaactttctgccgttcttgacggcattgattgctgcctcattgatcatattggcaagatcggaacccaccagacctgccgtcgcaagtgccagtgcatccagatccacggtctcatccatcatgacgtccttggaatgtaccttgagtgtctccagacgccccttcagatccggcttgtcgacaatgatccggcggtcaaaacgtcccggacggagcaacgccttgtccagtacctccggacggttggttgcagcgagaatcagaattcccttggacgtgtcaaagccgtccatctccgcaaggagctggttcaatgtctgctctctctcgtcgttgccgccgtaacgggtgtcacggctcttaccgatcgcatcgatctcatcgataaagatgatacacggtgcctgcttctgtgcttccttaaacagatccctcacacgggaagctccgacaccgacgaacatctccacaaaatccgaacctgccagcgagaaaaacggtaccttcgcctcgcccgccactgccttggcaaggagcgtcttaccggttcccggaggtcccacaagaagtgcacccttcggcagcttcgcaccgatgtcgcggtactttttcgggttgtgcaggaaatcgacaacctcctgcagcgattccttcgcctcatcctgtcccgcaacatccttgaacgtcacgccggtctgcttctccacataaaccttggcgttgctcttgccgacgcccatagcgccgccgcccatccggcgcatcaccacgccgagcacaacccagatcagcaccagcggaatcaggtagcttaaaatactgtaaatccaggtggatgtgttatccggaatcactccgctgatatccacgcccttttccttaagtaacggaatcagctcatcatccgccacacgcccgcagtagtaagtcacctcgtaaggtgttttctcatcggaattcagtgtgatgtcgatctggtacgaaccgatctccactgacttcacgcttctgccttcccatttgccagtgccgttcaccatgtcgagaaactccgagtaagacacctcctgcgtgctcatctggttgaactgattggttacaagactcataataaacagcgcaatcagtgaaatcagtataaatgccatcaaaatctgaccattgtgattccctttgccgccgtctccgttattccctccgtttgaattaccgttattgtaattgttattcgatccctgattgtccattgaagtatttatcctttccaacaggctccgccagttcagagtctggattcttatcgtatatcttctatattatattgaaaatggaatttaaaagcaatacgttcttcgtgaagttttcctgtcatttctaaaataattctaaaatttcccggcatactattttctgtgtttttgaaattgtgctggattttccggacacttagttgtatactgtatgggttatatagatcgtattactattattcacacaactgtacttttatatgaggaggaaaaccctatgcctgtaaaatatgtctttgtcaccggtggtgtcgtttccggccttgggaaaggtatcacggctgcttctctgggaagacttttaaaagcccgtggctacaaagtgaccatgcagaaattcgacccgtacatcaacatcgatcccggaaccatgaacccgatccagcacggcgaggtatttgtgaccgatgacggtgcagaaacagacctggacttaggacattatgagcgtttcatcgacgagagcctgaccaagaattccaacgttacaaccggtaaggtatactggtctgttcttcagaaggagcgccgcggcgatttcggcggaggtaccgtacaggtcatccctcacatcacaaacgagatcaagagccgcttttaccggaactttacttccgaggagacacacattgccatcattgaagtcggcggtaccgtcggcgacatcgagagccagccgttcctcgaggcaatccgtcagttccagcacgaagtagggcacgagaatgccatcctcattcatgtaacattgattccatatatcaaggcatccggcgagcttaagacaaagccgacacaggcgagcgtcaaagagctgcagggaatgggtatccagccggatatcatcgtctgccgttccgagcatccgctcgatcagagtctcaaggacaagatcgcgctgttctgtaacgtgccgaaccgcaatgtacttcagaatcttgacgttgaatatctctatgaggcgccgcttgccatggagaaggagaatctcgccaaggttgcctgcgaagcgcttcatctggactgtccggaaccggatttaaaggactgggaggcaatggtcgacgcactccgtcatccgaacaaggaagtgactgtcgcattagttggaaaatataccgcacttcacgacgcttatatctccgttgtggaggcgttgaagcacggcggcattgcggagcgcgcaaccgtgaatatcaagtgggtggattctgaggacgtcacaacagagaacgtggacgagatcttatccgatgtatccggtattctcgtaccgggtggattcggttcccgcggtgtcgagggaatgatccttgccgcaaaatacgcacgtgagcatcagattccgtaccttggtctgtgcctcggcatgcaggttgcgatcatcgagtacgcaagacatgtctgcggcttcaacgatgcgcacagcatcgagcttgatccaaacaccacgcatccggtcatcgcactcatgccggatcagaacggcatcgaggacatcggcggaaccttacgtcttggctcttatccgtgtattctggacaagacctccaaggcatacgaggtatacggtgctgaggagatccatgagagacacagacaccgttatgaggtcaacaacgacttccgcgcttctctcaccgagagcggcatgaagctctgcggtacctctccggacggcagaatcgtagagatgattgagattccggagcatccgtggttcgttgccacacaggctcatccggagttaaagtccagaccgaaccgtccacatccgctctttaagggctttgtggaagcttcgatccgatgtagcgagaaataaagatatgcgaaaaattaagggactgtagccacagtcccttaattttttcactattcttctacaccattactatctattactgcaaaataccagtagttacatcaaagtaataagttgctccgtcaatcaccgcatttcctttcgccatcgttccatacaccggatcaaaatagtaggttccctgatctgtcgtctgccatccctttaccatgtggccatctgcgtcatagcggacccatttcccagttccgtcttctctatctgcccactgtccggcttccgattcctgatatacatctttgcttactgcttttgctccctgctgtacattatctaaccaataccacgcgtctgaatccggatcatagatttcttttccccgatagtccgcattatttggatcatatccctgacgaacgccattttcataccagtatgtctgtcctccatcgctccaccagccgttttcaaccggagctgtactctgtagaatgcccgtattcgtatcaaaataataggtcgttccgtcaatcattgccgttccctttgccatcgttccatacaccggatcaaaatagtaggttccctgatctgtcgtctgccatccctttaccatgtggccatctgcatcataacggacccatttgcctgttccatccgcgttctccgcccactgtccggcttccgactcctgatatacatccttgcttaccgcttttgctcccttctgtacattgtccaaccaataccacgcgtccgaatccgggtcatagatttcctttccccgatagtccgcattggtaggatcatatccctgtaacacatcattttcgtaccaataagagtttgtcttaatggttacccagccggaaaagactgtacttggccactcatccggtccctgggaattataatgtagcgtagcgttaaaataacaatcattatttgctctacttactctcacatacgaattataattttcctgcgaagatgcatagtaaacctctttcaaattagggcaccagccaaaggctgaataccatatctctcccgtttttgtcggcaacaagattgcctctaggttctggtcatagcaaaatgcaaaaccttgtatagcatcaagtgaaacattgccatctgctatccttacccacgcaagtattggatcatagccaaacgcctcctcatatatcgctcttaccctgttagacagatctgcccatttcaagttggcacagtgtgaaaatgcattactaaaaatctgtatttcatcatttccatcaccgatggtcacgctacggatacctgtttcgtaaaatgcactacacccgatttctgtaacggtagatggaattaccaaatcaccttcaagattataatcccacgcaaatgcataatttggtatcgtctttaagccttgtggcaatgtaacctccttaagggattgattattctcaaaacaccccacacctatagctgtcacacgatttaattgtatttttcttaaatttttacagttgcgaaatgcataaccatctaacttaatgcctattgatccctcatctatcgttaatctcgtaataggtgttgcggcaaacgcatatctccctattctagttactgtggtcggaacatctatctccgatatagatgttccggcaaacgcgtaatcgccaatttctaccaatcccgcattcaaaacaatacttttaatatttacacattcggaaaaggcattgtcaccaattcctgtaaccttacggccatctatttccgcaggaatcacaagttcaacatccgtatcatcatttgcattatccatgccggtaattgtaatggtgttattattgtttatggtgtatttcaaatgattatataccccgtcagtgctgtccttacgcaattcctctgtctcttcctgtatctctgctgcagataccgcatttgctgtaacagccgtcggcatcaccgctataaaagctgctatcattgccactgctgctatcattccttttttcttcattttttctcctccgtgtcattattttaacatctttttgcgcctctttaaaagttcaacagccttcagctttcgcttgtatttctttaaaaagtattatacaatacctgttttttcattgcaatagagctgccgcttcacaaatttctgtttgctaaagcgtcagctccttcaaaacattttcactattctttctatatcgttattatatattactgcaaaataccagtatttacatcaaaataataagtagctccgtcaatcactgcgtttcctttcgccatcgttccatacaccggatcaaaatagtaggttccctgatctgtcgtctgccatccctttaccatgtggccatctgcgtcatagcgaacccattttccagttccgtcttctctgtctgcccactgtccggcttccgattcctgatatacatctttgcttactgcttttgctccctgctgtacattgtccaaccaataccacgcgtccgaatccgggtcatagatttcttttccccgatagtccgcattatttggatcatatccctgacgaacgccattttcataccagtatgcctgtccaccatcgctccaccaaccgttttcaaccggagatgtactctgtagaatgcccgtatttgtatcaaaataataggtcattccgtcaatcgttgccgttccctttgccatcgttccatacaccggatcaaaatagtaggttccctgatctgtcgtctgccatccctttaccatatggccatctgcatcataacggacccatttgcctgttccatccgcgttctccgcccactgtccggcttccgattcctgatatacatctttgcttactgcttttgctccctgctgtacattgtccaaccaataccacgcatccgaatccgggtcatagatttcttttccccgatagtccgcattatttggatcatatccctgtaacacatcgttttcataccaataatcttttccatcaattatcatccatccggtataaactgtacttggccactcatccggtccctgagaattaaaatgtaacgtagcgttaaaataaggatcattatgtccgttcgctactgtcacatatgtattataattttcctgtgaagatgcataataaacatctttcaactcggagcaatcataaaatgtccaattccctatctttgtcaactttgtcggcagtgagattgcttttaaatgctttgctccataaaatgcgcttccacaaatctcaagcggataatttccatctgcaatcctcacccacaccaacttcgaatcaccccaaaatgcatcatagcctatttgttttagccggttagacagattcgcatacttcagattaacacattccctaaatgtgtcatatccaatcgttataccttcatttccctcttcaacagtcagtccttcgatagatgttcccttaaaagcctcatcgccaatagatgtaacagtagatggaacgatcaaattgcccccaagattattagctcctaaaaatgcctgtgtacctattatttgtaatccttgtggcaaagtaacgttcgtaattgccatatcattcttaaaacacatataatccatgactgtcacacggtttaactctaattcacttaaatttgcgcaatcagtaaacgctctaccatctaatttaattcctaatgctccttcttctatctttagcccagtaattgccgttccagaaaatgcatctattcctatttcagttgctgtcgaaggaattacaatatttccagtaagcaagctgcactttgtaaatgcataatttcctattgttttcaatccttcttgaaaagtcacctttgtgagattaaggcaactgctaaatgcatattcgcctattgttgttactgtagcagggatatccaccacagatatggatgttccgtcaaacgcccagttaccaattgtcaccaatccatcatttaaagtaacgcttttgatatttacgcatccagaaaaagcgctacttgctatcgtagtgactttgcatccatttatttctgccggaatcacaagttcaatattggcattttcatttgcattatcaattccttggattgtaattgttccgtcatagctaacgctatagatcaaatgattatacaccttgtcactactgcttttacatatttgatcacttactttctgcacttcttctgctgataaatcctctgcatgaactgctgctgacgatgtagatgataatatcatcaatactgccagtaccgctatcattccttttttcttcatctttctttttcctccattattttttatcttccctttcttgtcacattcctgaatgtaacataaatagggttttgcattcctaccttttcttccccattacaagcataatactacacttattttcataatgcaatattacacgcatgtttatatgtgtttttatatttcatatttttatatctattacacactaaataatttatgtgttattttgttgtgtatattttacattatataagcactaaaatataattgtaaaatatattataggcaggtgatatgatgaaatttgaaatcaaacatccagaatatgtaaatagaacataccgtattcctaaagaattagctgataaattatctcagatagcacaacaggaaaatatatccgtaaacgaactcgtcgttcaatcttgccagtttgcactagaaaatctaaaaaaagagactacgtgacattatggtctgccttttatttttccgaaactgtttcctaatttttatgcatttcctcaaatttgttttttagcaaattattttcttgtatcaacttttgtttcttgctttttctgaatccggcttataacaaacgtattcatttaaaatagaacacatatcatataaacttaaaagttatattttcaagtaataccgttcaaaaagcttcaaagcaaaaacattcaactacgaactgcatatccgccaaaattacccttgtccgccgaacaaatcttttggctatataccaaaaaaggatgtgtatctgtcagtcacattgacaatacacatcctttttctttttacatctggtgtcttaccaccgcatattcatcgtccagctgataatacggacattctctgtaatgtccctgcatcagtctcgccgcatcatcctcatccatatccacttcacagtagtaggtctcgtcatcttcatcgtacacattgtatacacagctgtcacagcttgccttcgccataagacgtcctccttttcgcatttctgttctatttccatgttgaaatcacttcatcgtacagccgcagcagaaaatcatgcagcaactcccgctgtgtatcccagtaaacctccgtgatctcatcgccgtcctcctgcgcttccgtcacatccatcaccgcatccagaatctccgggttcagatcatccatcgcctcctgcacggcagcctcaaaatcacaatagctgtcactggtcagatataaaataaagttctcgcggttcaggtttctcgcctcatagcttcccgtaaacagatcgttcccgatcgatgcgatccgctcaaactcttccttgaccgtctcatattcgacggtgcaataactctctttaaaaaatttatcaaatacttccttgtctatcttctgtcccattcgtttcacctcttgcaatttctcgtgtgccgtgctattttaacataaaattaagaaaagaggaacccataccatgaatacacttcccaaagatcccgtcatgctcttaagctttgtcaacacacagcttcgtgaccactacccatcgctggaagaatttgccgcaacctaccagattgatgccgcagaggttatctctgcattaaaaactatagactacgagtacgatccggcgaccaatcagtttatctgatccgtcagccctgcttcttccggcacgctaatccacagtctcgtcattcaaatattttcgcacgcgcttccagtccgggtaaaacttcgtcatgaatccccagaagcgctgattgtggctcgcctccagaatatgtgtcatctcatgtacgacgacatactcgaggcactccggcggcttggacaagagcgccagattgatgttgatgtgatgtgtctgcacattgcaggacccccatcttgttttcatctgccggatggtgattccggagactttcacccccatcaccggctcccattttgccacaagacgctccacctcacgctttaactgtttctttctgcgcgcgatttctgccgcatccagttcccgtttttccgaacggcgctctccggcttctttgtatttctgctgatatttccgtatccactcgatccgttctctggcaaatgccgcaatccgcgcatcactcatctgatgcggcgctgagatccgcactgtaccgtcctctttactgatgcgcagatacatgtttttcatccgttttttcgtgacaatgatcggcacgccctctatctttatctcataagtgcgctctctcatagttcctgctccccgtatgttttcaaaatagtttccagatactcgcggtattcccgcacgacggattccggcgactcaatccgcactgccgcgccaagtcccgccagccagccgaagaactggcggctgaccgcgacgctcacccgcacccggattcttgtctcatcataccggcgcatcgcaacctccttgccgaaacggtcgatcatgactcccgtgagggcgtcttcgcagattaaggtcacagtctcgtcctcccccgcgaacatgccgaacgtttttcgggaatatgccgccacgtcaaagttcccgaactgctccttcccctctctgctttccaccgtaagttcgatctttagcattttatccacacggtaatggcggatgtcgcggcttctgtcgtcgtaggcgatcagataatagttttcgtcatcccacgagagcagccagggactcacttcatagtaactgccgtcccgccgcagtttcatctctttattgaccgtccattcaaaatactgaaaacggatcttcacattttccgcgatggcattgtaaatcatatctacattataataaatattttcattgaccgccttgctgcggttggtcaccacgacctgcctgtggagctgctttgcctgttccctgccgcaaagcgtctccagcttggcaatcagctctctcgacttcttcgtcgtgatgaacttcgacgcctgcacggcatctacgagaagttttaactccgccagttcaaatttccggctggcaagataatatccgccggggcgctccttcacccgtataatatccagaccgaaatcttccagttcctccatatcggtgtacactgtcttgcgctccgagcggattccgtccgcctccagatagtcgatcacctcctgcgtcgtcacaggatgatcttcgtccgttctctcatataaaagctgcgccatgtaaagcagcttctgtttctgcttctcgcttcttcctcttcccatgacatgttgtcctttccatgcaggtgtccggcattttttcgcagtgccgcgtgaaaacgctccgcttttttcacgctgtcgggcattcgcactatcagacactcgtatattcttcgcactgcatatcacgctccggcaaaagccgggaaaacctccgttttccccggctcgctgtcgcgttcatatggagcaaattcgtccacctcggtttcgcagtgccgcgtgaaaacgcttcgcttttttcacgctgacgtgcattcgcactatcagccactcgcagcggcgcgttctctgtgccagcacagaacgcgccacttctcctgtctgcactgctcattgcttattcacattataccctaattcgtgatgatatggggcactttcttgcaaagccaggtgcaatgtctgtttttttcaatcaggtcttgcatcctgttcatttcgtgttataatatagttaagttcataagaattaccgagagacatgagcaaggtaagagcagagacgatgggatcgtttttgtttgccttgctctttttgcatttcaaagaaaaggagaatgtactatgtatgatgtagcaattatcggtgccggagtcatcggcagtgcaatcgcaagagaattatccagataccaggcgaacgtctgtgtcatcgagcgtgaagaggatgtctgtgacggcacctccaaagccaacagtgcgatcatccatgcaggcttcgacgcagcccctggttccttaaaggcaaagttaaatgtccgcggcaacgagatgatggatgccctctcaaaagacctcgacattccgtttaagagaaacggttccctcgtcgtatgtaccaaagatcaggatcgcagcggtcttgacgcccttttagaaaaaggtgagaaaaacggcgtaccggggctgcgcatcttagaacgcgatgagctgcttcagctggagccgaatttaagcgacgacgtcacctgcggtctgtatgccccgaccggcggcattgtctgcccgttccatatgaccatggcatttgcagaaaacgcatacaccaacggtgtttcctttttcttaaataccaaagtcacctccatccagaaaaaagacggcggttacacgttagagaccatccacaccgatacagacacaccggaaaccttcgaggcgaaggttatcatcaatgctgccggcgttcacgctgacgaattcaacaatatggtaagtgagcacaagcttcatattaccgcccgcaaaggcgaatactgcctgctcgacaaagaggccggaacacacgtatcacacacgattttccagcttccatccaaaatgggaaaaggcgtgcttgtcactcctaccgtacacggcaacctcttagtcggtccgaccgcagtggatgtcacgaataaggaagcagtcaacaccacacaggacggactggattccctcgcaaagactgccgcattgagtgtcaaaaatgttccgatgtgccaggttatcacctcatttgcaggtctgcgcgcacacgaagacggcgacgatttcatcatcggggaagtggaagacgcgaaaggttttatcaacgcggccggcattgagtcccctggtctctcctccgcaccggcaatcggagagatggccgcaggcatcgccgccgatcttctttctcttacggaaaaaacagatttcatctccacacgcaaaggcatcttaagaccggagacgctttccatggaggagcgcaatcagctgatcaaaaagcatccggaatacggcaacattatctgccgctgcgagatgatcagtgagggcgagatcatggacgccattcaccgtccgctcggtgcccgctctctcgacggggtaaaacgccgcaccagagccggcatgggacgctgccaggcaggtttctgctccccgcgtaccatggagatcttagagcgcgaagtaccaatgagtatgtttgacattaccaaaaacggcgtcggcggcaacatcgtcatcggcattaacaaagagatttaaagggggattctactatgaaaaactatgatttagtcatcgtcggcggaggtcctgccggacttgcagccgctgtatccgcaagagaccacggcatcgagagcatcttaatcatcgagagagacaaagagctcggcggtatcttaaaccagtgcatccacaacggtttcggcttacataccttcaaggaggagctgaccggaccggaatacgcttcccgcttcatcgagcaggtggcagagcgcggcatcgagtacaaattaaataccatggtcatggacattgctgccgatgccccgtccggaaacgtaatcacaaaaaaagtaaccgccatgaaccgcgaggacggcatgtttgagatccacgcaaaagcggtcattctcgccatgggctgccgcgagcgttccagaggtgccttaaatattccgggctatcgtccggccggtattttttccgcaggtacggcacagcgtctggtcaacatggaaggctatatgccgggccgcgaagttgtcatcttaggttccggcgacattggtctgatcatggcacgccgcatgacgctggaaggcgcgaaagtcaaggttgttgccgaactgatgccttactccggcggcctgaagcgaaacattgtacagtgtctggatgatttcggcatcccgttgaagctcagtcacactgtcatcgacattgagggcaaaaaccgtgtcgaagctgtcacaattgcagaagtcggtccggaccgcaaaccgattccgggaaccgaggagcgctacacctgcgacaccctgcttctctcctgcggactgatcccggagaacgagcttagccgcagcgcaggcgttgccatcaatcctgtcacctccggtccaatcgtcaatgacagcttagagaccagcatcgacggcgtgttcgcctgtggaaatgtccttcatgtacatgaccttgtggactatgtttcccaggaagcaaccgcagctgggaaaaatgccgccgcttatatccaaaacggctccagcaaagatgccgcatccgtcgagattttcccggtggacggcgtgcgctacaccgttccgaaatatgtccgtccgaccgagatggacgacactttaaccgtccgcttccgtgtgggcgcggtatacaagaactgctcgattgcgacttactttgatgacaccttaatcagcaagcgcaaacgtccggttatggctcccggcgagatggagcaggtaattctcgacaagaaaaaacttgctgaattcccggatctgtccagaatcacaatccgcattgaagaaaattcataaatagaatggaggaatcatcatgagcacaagagaattgacctgtatcggctgcccgctcgggtgcgccatcacagttaccatggacggatctaccgtcaccgccgtcaccggcaatacctgtccgagaggcgatgcctacgccagaaaggaagttacgaatccgacccgtatcgtaacatcgacggtccgggtgaacggaggcatctacccgatggcaaacgtgaaaacagcctccgacattccgaaaggcaggattttcgactgtgtcaacgccttaaaggatatcaccgtcaatgcaccgcttaagatcggcgatgtggtcttatccgacgttgccggaactggtgtcgacatcattgccgccagaaatgttcctgcaaaataagcgctttcaaagaatctcactttattatataataaggtcatcatgcgatcggcatgatgaccttattaattcaccgaatacaggagattgtcatgaagaaattatttaaagaagccctggaggattctcccatcattgcagcggtcaaagacgacgaaggtctttccagatgcctgaccagcgacagccgcattatctttatcttatacggcgacatcgtcaccatcagtgacatcgtggagaccgtcaaatccgccggaaagcttgcgatcgtccatctggatctcatcaatggactgagttccaaagaagtggcagtcgactttcttcaaaaatacacgaatgccgacggcattatcacaacgaagccgacacttatcaaacgcgccaaggagctggggctctttacaatcctccggctgtttctgattgactccatggcatacgagaacatcgaccgccaggtcaaatcctcccgcccggatctgatcgaaatcctgccggcactgatgcccaaggtcatcgccaaagtctgtcagtccacctccacaccggtcattgccggcgggctggtctccgaaaaggaagacatcctcgctcttttggatgcaggcgcgaccagtatctcctccacaaacgagaaaatctggtttttataagcactcctctcctgcatgtattatgatgcagtgccagacattctgtgctggaccatatgcgccaccagcaggattacaaaaatgcaggctgcgtttattcttcatattcgattcccccgcttcctgttttttcttccggaagtgtctttacaaagcaaaaaaagtagatgacatgacatacccacacaacggataaaacaatccgtccgacgggcacatttttcatacagataaatccgatcgccataagaagcgtcacagtggcgacaatactgaccttggttttcatctgcataccttcttttctcatataggattccagattctttttgtaaagatcggtaccggtaaaccagtcatgaaggcgcgttgaactttgtgaaaagcaaaaaagaaccactaccttacggcaatggttctttcaacaattcatgggcagaggtggattcgaaccaccgaagcaatttgcagcagatttacagtctgtcccctttggccactcgggaatctgcccatttgtcaatgtgtcctgacagaggtaaattatatcacagcctaagcagatatgcaagttataaatttaaaaagtgtcacctattttcaataaatgcccggaaaaccaaaggctttccgggcgttgccgttcattcaggaaatcagagttttctacacatcaggattccctataacataccatccttgatcacatcatgatcccggagcagcttctccacgacggttcccttgaccacacgaagcagcggcttcttcaatacattgagcggtcccggcagttcgatctcaagcggagactttccatccatcagcttcacactgctgtcgagcagctctctgacatcatagacacttccccatacctcaggaacgcctctgtctacaccgagcagtccgtataccgcctccattgcggttctgaccgaatattccgtcgtgaagaccgtatcacgcggtgtgtccgcgaactgtccgaggaacgcaaagttcacacagccatccgggatgacgtccgggcggtcgcccttggttctcggcataaagaacgctgtaatgtacggcatcatcgtcggtacacatacggcgctgttctctgccagatccgggatctcctccaccggaacacccagatgatacagccactcctcggtgatctccttaccggtacactccttcatcggcttcttcacataatcgcccggcacatcggtgaacagaccgtatacccacacgcatactttatccttatcctgatccttgaactgtccctggcggttgatcgtccagctgagcagccagctggaatccttacagcttacgatacctccggtcacaacttttccgcttctcggatcacgcttgcagatattcgtgatgtacggaatgatcttgtcgtccaacgtggtcacggttgcagattcccagttcgtcttcgccacatccgagcagaacttctccggatgtccaaaagacggatcctgctttgcaatattcttccacaggctccagcagccgctcgtgcgcacttccgcgtccccgttcggcgcatggttctgatcaccgtaaatcgtaccctcggtacagcttccgtttgtcacgaacacgagatcattctccgtaagcacaatacctttctccacaccgttgaccttgcactcgagcgccttggcaaccttcttgtcatctttgatgtcgaaaatgacattcgttacctcggtgttaaactggaagtcaacaccggcttcctcaaggtatctctgcatcggcagaatcagcgactcatactgattgtacttcgtgaacttcaaagcgctgaaatccggcagtcccgcgatgtgatggatgaaacgctggaaatagagcttcatctccagtgcactgtgccagttctcaaaagcaaacatcgtgcgccagtacagccaaaacgtagaattgaatacctcgtcgtcgaacacatcctcgatcgtcttgtcgtagagatcctcatcctttgtcatgaacagcttcatgatctccatgcagcccttctggctcagattgaacttgccgtctgtgtgcgcatccttgccgcgctcctctgtggcacggcacagggaatagttcgggtcttccttgttcagccagtaatactcgtccagaacggagacgcccggcgtctcaatcgacggaatgctgcggaacagatcccacagacactcaaaatggttctccatctcacgtccgccgcgcatcacatatcctctggtcggatcattgataccgtcgcaggcgcctcccgcgatgtccattgcctcaagaatgtgaatgtgggaaccttccatctgaccgtctctcaccaggaagcaggctgctgccagagaggccagtccgctgccgacaatataggcactcttctcatccacaccctccggctttctcggtctcgcaaaagcctcgtaattaccgttggtatagtagatacccttgctgttcttctcatgcctgccgcgctcggtattgcggtattccgctctcgccttctcctcgaccgctttcttctgcgcacgctcgccgttgttcttatggctgcctgccgccagtgccgccacacctgctccggctgccagcgcagccacgccaagtcctatatgttttccttttcccatcgtaactaccacctttccagttatgctgtaaattctttgtgtccttatcttagtctgcccaggtgaatgacacaatttacaaaaagattaaaatgataaaaaacttatcattccggctcttttgctaaacttgctgattgcttctgttcaaaattccgggcggcatttaagatactgccgtgcagcatcgtactcagccgctgcacaagctctctgtaatccgccttcataccgccgtcgatccagtgcagcatcatacctacaaagccgtatttgtagaactccgcaatcagtgccttgtcctccccgctgacagccgcatcgcggcattcttcctctaccacatctgcgagcagatcataggtcagcttatagagatagctctcgatcttcttctggctgaccgagtgataaacattcaaaataaacggcttgttctccaataccgcctcaaagatctgctccagtccttcactccacgtactgtaagttttcttatccgcaagtgcacgctttccgtcctccaggcacgcccactcaatcaggtcgtaaatatccttgaagtgatagtaaaacgccatgcggctgatcccgcagtcctccgtcagatcgttgatcgtaatcttatccaccggcttcttaagcaaaagctttttaagtgatgcctccagtgcaagttttgtcgtgttcgacatggctgcctccctgttccgttcttgcggcaacggatcttaccgtccgcatctttattgtattcctcctcacaggcaggggcaaataaagaatttctaaattttcttaattcttttttagccgttgatgcacgtttttgaccacctgcacatccaaattactatatacatttatgatctatttgttataatattattatatttgcgcttatggacaaattgggtggttttcacacatatttgaatgcgcaggcggaggaatacatgatcagcaacacggatatccgttacttttttgatacttactatgacaacttcatgcacagtctcgcctgggaggatcaccttctggagcctgccagccgtgaagaatggctggcaacacttcgcgcatgtgcagacgaccagcagcaacgctgtgcggacaatcagatactgcttgaacagtatctctatccgctaagcagcaatcctgctcttctgtccgatgagggatatgatcttttactttctttttgccgtgatttttactacagcaactataccgaaccggctctgctgatccgcattattgatattctgcttccacattatgaagaccgcagcgatacggaaagcctgctttttctctatatctgcgccggcttttcatacatggagctctcacgaaccggagagcccacctctcgcgataagactatatatttctacaccaaagtgctctcttaccgcgatcagattgaattctttgaatcggctacaagccgcgactatatttttattgcctattacaatctgatccgggtggctccgggtcttggcatcttagacattgaggccgcttaccggctctgggaggagctctgtcagatccgtaccatgcccaaattctgtcagtacgataccaccaatccacggattccgcagctctgtgaccgtgcaatcaacgatttccgcgcgtacggcgctgttctcaacgttgaacgtgttattgcaccatccgcgatcctgtcctctctggagaatatgacgcagatctattactccgagatattgcacgagcatggttccatctatgagtgccctgtattcacagtatttaattaccactatgtgcaggcacgcaatggtacaatcacctgggaagccgcctggcagatcctggacgattattatgtccacaagatgcagaccatcggtcaggtttcctcgcctgacctgcttgctttttataccaatctgccgctcaacctgatcgacgtgctggggcatacgcatttcaaggaagagtttaagcaggcaacttaccggcgctaccgcaatctgattaccagctatctgatgaatcagcctgccagtctcaattcctacacgttaaacaacggtgtccagctggtggcgtttcacccgctgatccttgggactttccagaaccgtatggaaaaaatgaactttatcgtagatctggtcgtaaccagacatctcacgacattcacacactccgttatggtttcctatctcgcagaagcgatcggaaaacatattttagccgcacgaccggagtttttgcggattccttcctcctatctggagggaaatgtctatgcctcccccgcggaagtactggactatatcgttcccgcagctttattccacgatattgggaaaaacggcatgatcccgatcatcaacacgcagcaccgcaagttaaacgactacgaattcaacattattcagacacatccgcagaagggctccgactatctgtcgtccgatccggactttttaatctaccagccggttgcgctcggacatcaccgctcctacgacggtacccgcggttatccgctcagttttgacaataccgcctcgccgtaccgggacgccatcgacctgatccacatctgtgactgtctggatgcagcgaccgattacttaagccgcaattaccaccgcgcgaaaccgttcgatgtggtattgaacgaactgaaggcagggcgcggcaccgagtacaatcctgatatggtggatgtgattctaagcgaccgggaattatataacgatttaaagatgcttacggagcagaaccgcgaaaatatctactatgatatctatctcacgtttgtgaatctccgcaagaaaagacaataaatgggatacgttttattataagaatatcggagaaaatgaagttccagaatgcaaccggggcggcaattctttgaagcaaaatccgaggatttcttccgtgccgcgtcggacatcgggttctgtgtctttccacgtttggacagtccccggggtgtgtccggcaaaaccgcagacaatgagcggactttctggtgcccctagtggcaccgcttcgcagacaatataaaaccgcgcgaaccgaactcgttatcatctgctattgaaaacagggcagatgacaactcagacagcggcttcgcgcggttatgttttactcagtggtgccaacaaggggcacacacaaaagtccttaaattgtctgcggtttgcggacacaccacgtggaatgttccaaacttggaaaaacacagatgatcagggatgtccgacgcggcatggttagaaataccggattttgtgattagaattgccgccccggttgcatctggaacgtgatagtctctggttcttataataaaacatatcccatttcaaatatttttagttagaaggtaaaaaaaagacagcctgtcgaactgctgtctttttaggagaaggtatttttactatggggtatagcaaaaactatatataatgtattggggggtttttacggttattataatagcatgccccgccagataagtgtgcacaaacttcacaattttgtgcacacgtttttattcattttgtatagtaccttctgcccggtttttcttttttcattgccgttatgcacaattactgctcaaacaatgcctcaaactcctgctggctgattttttccttctccagcagaagattcgcgcaggcatccagcacgtcgcggtgctccgcaatcatctgcttcgctttttcataacattcgtcaatgatccgcttcacttccaggtcaatggtggtcgcaacgccctctccatagcctctcgtgtgcgccaggtctctgccgataaatacctcatcgtcgtcattgtcgtagcagatcagaccaatgttctctgacattccgtattttgtgaccatatccttcgccatccgggtcgcctgcttgatgtcctgagatgcccctgtcgtgatgtcatcaaatacaagttcctccgccacacgtcctcccagagatacgataatatcctgcagcatcttgcctttcgtgttgaacatgtcgtcacgctccggcagcggcatcgtgtaaccggcagctcccgctcccgtcggaatgatcgatacggaatagaccggaccgacatccggaagcagatggaacagaatcgcatgaccggattcgtggaatgcggtgatacgcttttccttctcagagatcacgcggctctttttctccgcgccgattcccaccttcacaaacgccttcttgatgtccgtctgtgtaatatacgcacggtcttccttcgctgcgataatagccgcctcattcagaagattctcaagatccgcgccggtaaagcccgcagtcgtctgtgcgatctgttttaagtcgacatcatccccgagcggcttgttcttcgcatgaacagaaagaatctcctctcttccgccgacatccggacgtcccacatgcaccttccggtcgaaacgtcccggacgcatgatcgccgggtccaaaatatccacacggttcgtcgccgccataacgataattccctcattgacaccgaaaccgtccatctcaacgagcatctggttcaatgtctgctcgcgctcatcgtgaccgccgcccataccggtaccacgccgtcttgcgacagcatcgatctcatcgataaacacgatacacggcgcatttttcttggcttcctcaaacagatcacggacacgcgaagcgccgacgccaacaaacatctccacaaaatccgaaccggaaatactaaagaacggcacgcctgcctcaccggcaatcgcctttgccagaagtgtcttaccggttcccggaggtcccacgagaagaacaccctttggaatacgcgcgccaagcctggtatacttcttcggggcacgcaggaaatccacgatctcctcaagctcttccttttcctctttcagacctgccacattggcaaatgtcacccgctttgccgggtcatctgtcatgagctttgcgcggctcttgccgaagttcatcatcttaccgccgccgccggaattggcagccgcctgattggtcataatcatgaagaaaatgaacatcgccgcaaaaataatcagatacggaagtatcgtcacgatccagctctgctccggcggattctccacggtgtaagacgtaaactgccgatcgcgcagatagtcttctatatcatttacatcgtttaccgccagaacctgtgtcgaggagtccttaaatgtaatgtatacattaccggtcggcacctcgccgcggttcggtacaatcttcagctgtgcaacatttccatctgcaaccgcagtctcaaactgtgcccgcgtgtaactgttggttgacgtgtttccgtccatccaataccagatacctatgatggcaagtatcaggagcagatagatgccaaatcctctgtaactgcttctcttactattcaatcgatttctcctttattcctctatctcaacaaatccgatatacggcagattgcggtacttctggtcgtagtcgagaccgtatcctaccacaaattcatccggaatgacaaatcccacataatccacattgacatccaccactctccggtccggcttatccagaagcgtacacagtctgagggtcttcggatttcttgtcttcaaattctccaacaaatagcttaaagttctgccggaatcgatgatgtcctcaattaccagcacattcttgccttcaatactggttccaagatcatttacgatacgcaccacgccgctggaacttgtgcctgatccatagctggataccgacataaactctatctcaaccggtgaagtaatacgctttgccagttcgcaggtaaaaaataccgatcccttcaaaatacagatcagacataccggctcatctccgtacaccttgctgatctcggctcccaactctcttactctctgctcaatctgttcctctgtgagatgaacgttaattttcttgatcttcacaatcgtttcctccacttaaccgtacttctaatatcttttctgtattctctccgactttgcagccggcgccgatgcgcccgcctgccacccacaggatctcggaccccgttgccagaagccatatagcgtctctcttcgccgccggaatcttctcattgacaaaatgttccttcagcttcttggtatgtccggcagcatctatcttcaggtaatcgccgctctctcttctgcgcagccgcagaccagattttattttaccataatcgaaccatttcgtatatgtttttttcgggatttcctgcatattccccgaaaaatcacgtatccgcaggtgcagcctgccatccggcagcgcaagcaccacctcttccttttctgcgcgcgaaagcatctccccagtaatctcaatgctctcccgttccatatcagccgccggcgcttccctgtacagccggattccctcatacacgcgctccgcacgcacgccgtagggcaggcagatcacacggccgacctgtcttgtatacagtgtgcacagttcttccacatgcacgcttccgatgtcacggctgctgcccgccactttttgcagcgccccaagcagcacttcccggattaaaagcacgggatattccgaaaaaagaaccgcatcaatcacacaggcatccggattgtcacggcacacgcgctctgccgcccggcgcgtctcttcctccaggtaatccgacagctcccttaacatctgtgcgctctgcatcatatgatgcaccgcccccgtattcaccgcttttaattccggcatcaccttatggcgaatccggtttctgctgtagccggtatcctcattggtcgcatcccggcagtaaggctgtccctgtgccttaagatacgcctcgatctccgctctctccattccaagcagcggccggattaccgtgacgccctccgcaagcctgcgcgccgggcgcataccgtagagtccgtggagtccgctcccccggatcagccgaaacagcatggtctccgcattatcatccgcatgatgcgcgagcgcgatcttcaccggtctgccgtcatagtcctctgctgcctccctgaagcactcatagcggagtttcctcgccgcctcctcaacgccgaggccgtgtccctttgcatacgccgggacatccaccggataaatcctgcagcaaacgccccgcttttcgcaaagccttttaacaaacgcggcgtctctcctgctggcatctccccggatcccgtgttccacgtgcaccgcctccaggaaaaaatcgcagtgcttccggtactcaagcagcataagcagcagacataccgagtccgctcccccggagacgcccgcaagcaccacatccccggatttaacaagcccctccagttccattcctttcttctgcatcgcatttcctctatcgttccacattctattctatgcctttttccagatgcacgccgcaagtaccgtcatatcgtcctgtgcgcgtccgccggtaaaaagcatcactctgtccataatcttttttgccagaattcccggattgttggttttgatactgagaatcatttccctcatcgtctcctctggcttcggaacatgtaagtattctaacacaccatccgtcaccatgacaataaaatcaccgtcacttagctggatctcccgcggttttgcatccagctgcgcacgcgcccccaccggcagattttccgatgcaatgcactccacctcgtcctccctcctgataaaggttgccgccgctcccaccttgtacaggcgtgccataccgctgtacagattcaccatgcagagatctaccgtggagtagatatcgttttcccctttcatcaccatcgccgaattcatcatgcgtatcgccgtctccagggaaaatccggcttccagaaaacgttccacaagatccagcaccatctcactctccttgcaggcgctgctcccggagcccatgccgtccgacagtccgagcagcatttccccgcgctcgagttccagaaaggaaaagttgtcaccggagatttttgcctcatccttttttacccgcgcaattccctgcacgctccggtatgcggtgtcctcgtagatcaggaaccggaacggctccttcgcaataaacgtccgcgcatccgcggttgtccggagcttttttccaagcacggcgccggagagcgtcagaaatgtcttcaccgcgacacagcctcccagccggctttttagcactgcgtcaatccggatccttccgtccaccgcctcgatcaggtgcagttcttccaccacaatcccctgctccttcgcacggtattgaatctccgagaggacatggcgttcccccacgtccagaattttttcctccctggcgcagtcctgcatgatatacgccatcgcatccagctgttccgctatcacctcccggttctccaccagtctctggtaccatgcccggtttaagctgacgcgctcaaagacgcgcaccgcctcctccaccatatcgctgctgtgcctgcaatactgtgcaagctcctgctttttctcctccccgggagtctctccgttccagatcgcggaaaggatccccgacagcgcgccgtataagggtgcaggatctctctcccagcagactgcacacgcgtcacacgacgcgcagatctttccagtcagctcgttctgtatctgtcccagttcctccgccgcaccgttctgatgtgcggcactcatactgtgaaaaacctgggacaagccctgaaacgattccgcataccccagcagccgctcctctcttcctccatccggccgctccggcacccccgcctttcttccccagtgtaatatcatatgcagggcacggttaaaaagaatcacggctcccaatataaacgcgccctccagcgccgccgccagaattccgggctgatccttccattcaagaagtccccccgccaccgacaggatcatggtaataatcgctgccatactgcccgccatataggaggggcatccctcgttggcccattccacgagccggattgctcccatcaccacgacaagcgccaccgcatactttactgctgccgccgtcggcataaacacaaacattcctatgtacatcataccgagcagcaccgacccgctgacccgctccagatacagcgccgcaaaatacgccggcaccagagggtaacaccccatcacgcccacactgcacattacacttcccgccatacagagcatcatttgtcttgcattcatttttttcatcgcctacctccattcccgcctccggtctgtcccggtgtttttcgcgggtgacatcgattatagggttgttcccggaaaatctttgtcaaaggaaggaccccttttgaaaaacttttcgccaaaatatcggttccattgtctgtttcatggactttgaagcgcttcgtgccttttaggaagttcatccagaaatattcctctaccacattttttcatgccggtgttataatgtacgcaaaagcatagccaccatgatatgaaaggagattttcttatgggttatatggcaaaagaaagccgctatgataccatgcagtacaatcgctgcggcgccagcggtttaaagcttccaatggtttctctcggtttctggcacaattttggggacaccggacattatgacaacatgaaggcaatgtgccgcaccgcttttgataacggtatcacgcattttgatcttgcgaacaattacggtcccgcttacggcagcgcagagcgcaacctgggacaaatcctgcgggacgacttttctgcgtaccgggacgagcttctaatcagcaccaaagccggctacgatatgtggccgggaccttacggcaactggggcagccgcaagtacctcatcgcaagcctggacgccagcttaaagcgcctggggctggattatgtggatattttttatcatcaccgcatggatcctgagacaccgctcgaagagacgatgggcgctctcgattccattgtcaaaagcggaaaggcgctctatgtcggtctgtccaactatgacggtccgacactggaacgtgcatgtgcgattctaaacgacttgaagtgcccgtttatcatcaaccagaaccgctactccatctttgaccgcacgatcgagaaaaacggtttgaaagatactgccagaaggctgcagagaggcattatcgccttttcaccgctggcacagggcatgctcaccgaccgctatttaaacggtattccggctgacagccgcatcgcgaccgacggacgtttcctcaaggagaccgcacttacgccggagcgtctctcacagatccgcgctctcaatgagcttgccaaaaagcgtggacagacgctcgcggagatggcattaagctggatcttaaaggacggtgacgtgaccagcgtgctgattggtgcttcccgcccggaacagattctcgacaatatcgccattgtcggacatacttcctttacgccagaagaactcgacgcgatcgatcagattacactttaacagccaaaaaagaagccttatccgggatgatctctccgggtaaggctccttttattctgtcattcttatgttcttaaggttcttccttaaatataatctcattgtcataggctagtcccagtttgctcttcgcaatatcctccacatactcctgggactgtgtataggactggtaattctgaagttcctcctgccttgccgtctcatcctgaagctgcacctccagctgttcctgctttctggcgtactcctgatctttctgataagcttttacaatctggacagacattgccgctgcaaatacaaccagaatcatgctgatacagatcttgcccgccctgttattccgatttgattttctcttctttgctgccattcctgtccctcatttcctgcatctgtgtagcaatttacattttacataaacctattttaaccgctctcacaaactttttcaatcgttttccacaaaatgccccaactttttttaaggttttccacaccggacgcacgaaaaatcccagcacttttccaataattcccagtatttttttccagatccacacctgacagtgcacgatcaggcggctgagcagcagataataacacgccattccgaccagcagaccgccaaacgcaaacccgcgcaccatgccgtcattttcccggtataaaaggacaaagaccacgcctgtaaaaatgatccagtacagaaaatcctccacgccgatccagatatttccgtgcggaagaatccggcggaaaatgcgcaggatatcatagagaaagaaaagtcccattcctaccagcacagagctcccgagaaacagcagttcctgatagattgatgtgcttaccgccatctaccggaacagccttcccagaagagattccgcctgttttcccgccgttttgacatccgaataggtcagggaatcaatccgtccctcaatatccacttcccctttttccaggctcagtcggttcacgtgcagatcctgtcccttgatgagcagcatccccagttccgtctcgagcagaatctccgccacatcaaaagacagcacatccacaacaccggaaaacgcgccgtttccccggtttaccagcaggaccttatgtgattttgccgtattattataattcttttcctccataaaaaaacctcccgctttccttttctattagaaagtatatgggaggtttttcatattatgatacatattcaaacaaatccttggcttcttcctttttcgtcgtatcctgcagatccagcacgcggactttcacggtcttcgttccaaaaccgatctcaataatgtcgccgacttttacattcacggaagccttcgccggtttgccgttgaccatcacacggccggcgtcacaagcttcattcgccactgtgcgtctcttgatcagccgggacacttttaaaaatttatccagtctcatcttcttctccttatgcctgcggagcgttcctgcttccaaaggctccttttccctgaaagcaaaaaagtggattctgcaaccgcaaaatccactctgctatctctatatcacttaggcgttgatcatatcctttaaagccttaccagccttgaacttcggagccttggaagctgcgattgtcatctctttaccagtctgcggatttcttcctgttctctctgctctctcagatacctcaaatgtaccgaatcctactaactggatcttctcgcccttctttaattcctcagcaacaacatctgtaaatgcctttaatgctgcctctgcgtccttcttgcttaactcagtcttctcagccattgctgcaactaactctgctttgttcatgttaaaaattcctcctctggattttcaatataaataatattcgaggttctcaaaatacctacttcatatttatacttgttttttctttctttgtcaagaaaaatccccaaaatatggggattttccgagcttttttacgtttgggaagcgtttacatcatggtgtcgatcaatgcgtgaaccgcttttgagagcgcttctgattttgcgtccgcatccgcgagcgatgtcccctttacgccgagataaaatttgactttcggttcggttccggacggtctgacgcacacccatgccccgtcggtcatctcgtaataaagaacattcgacttcggcagacctgtcggccgcactgcacccgctgccgtatccgtgatggtgtccagcttataatcccgcaccgccgtcactttgtatccaccgatctctgccggagcattttcacggagcgtattcataatctcctggatcttcgccagtccttcgattccctttaatgtgatggaagtcacatcatccttgtagtagccataacgctcatacatggcaagcattgcatcccagagtgtcatgttcttcgtcttatagtaagccgccgcctcgcacagcatcatcgatgctgcaacggcatccttatctctcgcgtaagttcccggcaggcagccatagctctcctccataccaaagaggtatgtgccctttcctgtctcctcaaactctaagatcttctgtccgataaacttaaatccggtcagcacctcgatcagatctattccgtagtatgccgcaatcgcatctgccatattcgtggatacgatcgaacggataaatgcgccgtcctccggcagtccgaagagctccttgcgctgtccgatcacatagtcgccaatcaggcatccggacatatttccggtcaggctgtggtattctccggtctgtgcatccttcacataaacacccagacgatccgcgtccggatctgtcgcaagaatcaggtcggcatctacttttttacccagtgcaagtcctaatgcaaatgcctctgccgcctccggattcggatagcttaccgtcgggaaatcgccgtccggcagttcctgctccggcacaacgtagacattcgtgaatccaagctctttgagcacacggcgtaccggaaggttgccggttccgtgaagcggtgtgtatacaatctttaactcggatgcaactttgtcaatgcagtcctgatgaagcaccagttttttcagctccgcaatatacggatcgtcaatatccgcgccgatcgtctgatacagaccatctgcctttgccttttcaagcggcatcgtcttcacagaagcataatccgtcacgtttctcacttcatccataattcccgtgtcatgcggaggtgtgatctgcgcgccgtcctcccagtatactttgtatccattgtattccggcggattatggcttgccgtgatgttgatgcccgctgtacacccaagcttgcgcaccgcataggaaagctccggcgtcggtcttaacgattcaaatacatatgccttaatgccgttcgctgcaagacaaagcgccgcctcgtcggcgaactccggggacatatgtctggaatcatacgcgatggcaacaccttttgcctgtgctcccactttgcagatataattcgccagtccctgtgtcgctttgcgcaccgtgtagatattcatgcggttggttcccgctccgatcacgccgcgcagtccggcagtaccgaactccagatccatgtagaagcgctcttcaatctccttctcattcccggcgatcgcctgaagctccgctctggtcgcctcgtcaaaatatggattgttcagccatgactcatatgtttctctatatcccatctcagattcctcctgcttttttctaaatctatcttatcttccctgtatcactttttcaagtactattcccctaaaaaagtgatacaattctttcagcttcccttaatagccttaagaagttccgtcagcgttgaaagataatctgatgaagaactgttgctgctctttgtactctccccatcatcatccagaatctcgtttacgatggcatccagcgcagcgtcactcgtcgtgtccgatgttcccgtcgatgtggacgacgaacctgaagatgaactggaagacgaacccgtggaactgctgtccgagtggcttcctgccaggcttcccgcgagacttcccgcctgtccgtctgcgctctctcctgtggatgtactgctgtctgcctccgatgactgcgtctcacttccggtcgtagtcgacgagcttcccgattctcctgtcattccgatggcgatcgttgcctccggtgaattcacaaacagctttttgctatatgtatcataaccgtccgccgtcacggtgagcgtatgcactccatactgtagttccaccggctggctgtaatccaccagctgcccgtctacctgaagccatgcgccctcaacattgactgcgaagagaatgcttccgtacttcggtccctcgcccttcaacgtctcaagatccagaaccgtctcctgccctctcgtgatcgtaatctccgtacttccgccgtatccgttattcgcgacagctgccgtgtatgttccctcaggaatctcaatcgtcatctctccggtaatctgtgcaaacaccttgcttcccacctgaatgtaacttccatcaaagacactggtattgaccagctttaacgaaccgtgcccggtggtcaccgagatggaatagattttcttgtcaattccgaccacccgaagcgtatccagtgccgtcagatctgaaagctggaggggacttccgtccgaaaccacaaacagatcctcatcatacgaataatttgtatccgcaatcttaaatgcaccgtgctcctcatctacactgtatctggtcacatccgggtattcccacgccagatcggagatctgcgcttccacaagcctgccctgcttatctttttccccgacacggataatgcgacccgcgtcaaatccagacaccggcatccggctgccatatttgtcaaggaaccgggtagcaatcgtgtaattatacatatactgcttgccggagttcaactgtgttaaaatcagacactccgcctgcatatcattgttggtgattaaaaacaggtctgctccgatcgacgtgccttcctgctccgtcccctgttccatcgcatccagcacgtcgttcgcatccgcctccgtcccgacggtctgtgctgtgttttccgcatcctttgacggattatagtaagttcctgtcacaactgtattgctgctttttccgcatcctgccagtaacagcatcatacagaccggcaggatccatcgaactattttcttcttcaagtatatccgctcctttatcgtgtacacaatctacggcaaaagtgccgtcagattgattatatcatcttttttgcgctgctttctgcgcatccgaagttccaccggaacttctaatatgaatctgtcaagattcattatatcatattaaacaactcagcggaacttttatctcaggacgcgggcggctgcaaggtgaaatggcgcatcatttccaggaatcgttcccgctcatcctcctgccgtatgaatttttccagcttttcaatattgcgtccggacacccatgccttgtgtgtgttatagtagcggttcgcaattttccagaatttttccggatatgccatatacagatacagatggttcagttccacggcagtcagccggcgcacacggtcatacgcacagatgagatccatgccaagtccggtgttccagttgtttttttccagcattttccgcatgtaattcgccagatcgctgacctgtatctgataggaaaagcactcaaaatggacaatgccgattccgtttttggaaaacagaatattgtgctggttatagtcaccgtgacaaaacccggcgctctgcccgccctgtcctatcgctgaaagttcctgtgccacctgccttgctttttccataaagcgctcatactgcccgtaaaagagcacttcaaaatcattctttttctttttggaccgtatgtaattccggactttgaccagttcccggttatgcttctcatacagttcctgcagttcattcgggtcgttgcagacaaactccggaaccgtctccgaataagtttccgccgcattgtgcagcattgccagtttctccgcccccgcgatcatgtccgcccggtttctggtgtcacactcgctcccggaaacagccgtcaataccatatactttgtctcatcctccgcgacggcaatcggggcgtcctccttcgtccgcacgacctgctccgttaagagtccctgtccacccagatgcccgagtatggcagagagaaactctgcccgctccgccgagcctttgtattcttttaaaagtaactgcccctgtgttgtatcacaaatataactttcacgccctttggaaaccgctctcacttccaggtcgtactgctccaatacctgctccggtcgattatacacaaaaacccctccatatgattgatctgcggctgctctgccgtgtctcttcatcatatgtgaggggtttttatttcatgacctgttttgatcagaaatctttcctgtcacaatttttaataattgttccttcgtattcagcccgggatcttccaatacccggtccagcagttcattcagcatctccccgatctgctttcccggctgcattccggctgcaatcagatcctgaccggaaaccgccagttcccggatcgtaagacactcttttttctccatgcactcccgatacatctgttcatatgcgtccacatacgccagcttttccgcgcgccggtacccgctctgcgccagaatatccgcgcgcttgaccgcaaacaatgccggatactgttccacgccgatcctgtgcatcgccctgcggaccgccttcccggaaagctccggattatcgtcgtgccagtgcaccagccggcacacccggtcggtggtatcgttatcgaatttcagtcggcgcagaattccacgggccatctcgcttccgcgcgccggatgtccgtaaaaatgatccacgccttttttgtccgccgtcctgcaggcaggctttgcaatgtcatgcagcagcatcgtaagccggagcaccttatccgccggcaccgcttcgattgcctttagcgtatgctctcccacactgcagcagtgatgcggattgttctgcggtgtctccatcatcacgtcaaactccggcagaaaaacagccgtaagccccgtgcgatacgccactttcagctctcccggattcggcgaagtcaaaagctttaccagttcgacctgaatccgttccgcactgaccttttttatattgcccgccagtccggcaatggcttcctgtgtctcctgttcaatcgaaaaaccaagctgcgccgcaaaacggaccgcccggagcatgcgaagggcgtcctccgaaaaccgctccatggcatttcccacacagcggatcacgcctctctccagatcgccgattccatcaaaagcatccaccagtccggtcacttcattgtaagccatcgcattgatcgtaaaatcgcggcgtttcagatcctccagaagattcgcggtaaacgctacttcctttggatgcctcgcatcctcgtattctccgtcaatccggtaggttgtgacctcgaatccctcatgctccagcatgaccgtcaccgtcccatgctggatcccggtatcaatcgtgtgccggaaaagagccttgacctgctccggtctcgccgaggtcgtaatgtcccagtcctgcggcgttctcccgagcagggaatcgcgcacgcagcctccgaccgcatacgcttcatatccgtgctcgcctaaggtattcaaaatcctcgcaaccttcgcaggcaggctgatctttgcatttttatccacgcacttctccttaatatgccttgccccagtataccagcttgtgcgccggtctgccgcagcatacgcaggttccggaaatctgctcctgatcatggaacgggatacagcgggatgtcacggcaagctcctctttgatcttgtcctcgcacgcctgatcctcgcaccacataccgcggataaatcccggtttgtttgccgcgatgtcctttaattcttcataattgtgggcatcccagatatgcgcgtcgcggtgtgcctttgcacgctcgaacatctctttctggatagtctctaaaatctccggaatcttctgctccagatcctccagtgcgacctcgatcttctctctggtatctctgcgcactaccacgcacttgcctgcctcgatgtcttttggtccaagttcgatacgaaccggaattccgcgcatctcctgctcggagaacttccagcccgggctcttgtccgagtcatccagcttcgcgcggcatacttttccaaggcgctcgcagacgctctttgcagcatccatgacgccgtctttgtactgctggatcggaatcaccatcgcctgtaccggtgcaattctcggcggcagaaccagacccgaatcatcgccgtgtaccatgatgatcgcaccgatgagacgtgtggtcataccccaggaagtctgatgtacatactgaagcttattatctttatcggtatactggacaccgaacgcctttgcgaatccgtcgccaaagttgtggctggtaccggactgcagtgcctttccgtcatgcatcagcgcctcaatcgtataggtagcctccgcgcccgcaaacttctccttctcggtcttgcgtccgcggatgaccggcattgccagtacctcctcgcagaagtccgcgtacagattcaacatctggatcgtgcgctgctcggcttcctctgcggtcgcatgcgcggtgtgtccctcctgccacaggaattccctggaacggaggaacggtctcgtctccttctcccagcgtaccaccgagcaccactgattgtataccttcggaaggtcacggtaggagtgaataatatttttataaaaatcgcagaacagcgtctcagatgtaggtctgacacagagacgctccggcaacgggttcaatccgccgtaggttacccatgcaacctccggtgcaaatccctccacgtgatccttctctttttcgagcaggctctccggaataaaaagcggcatgtatacattctccacgccggtctctttgaatctgcggtcaagctctttctggatattctcccagatcgcatagcctgccggacggatgatcatacatccctttaccgcggaataatcgatcagctccgccttttttaccacgtccgtgtaccattgtgcgaaatcaacatccatcgatgtgatcgcttctactaatttcttgttgtcctttgccatcatctatctccttttcatagctcttactgccgttgcaagcagcttcaaggttgtctgtgtgcagctcctgcacaactaatgattttatgataaatggaaagggttgtcaatttcaaacgcaagatttctgcgtgttttcgggtgtctgaacccgattttgtacgaacagaggcagagcggttcccccgacggcttcatattctctttaaaattgtacttccggtctcccacaatcggcatccctgcatgtgccagctgcacgcggatctgatgatgtctgccggttcccagctgaatccgaagaacggcgcgcccgtttttctgctctaaaacctcgtaggaaagctctgccctctttgctcccggcgtactactttctacaaccgcagacgtattggttctgccgtcacgcagaagataatctgtaaactgcccctttccggcttccggcaccccatctgtcacggcatagtaaaacttgtccgccagccccgacgcaatctgccggctgagtgcggctgccgcctccttcgtctttgcaaacaccatcactccggataccggctgatccagccggtgcaccactccgatatacggcagttcgcccttccccgcccgcctgtttttaagcaggctctccatatccgcctgtccgagtcttttcgtctgtaccgccacacctgccggcttttcgcagacaataatctgctcatcttcaaataaaattctgatctccatattctaaaccgcatccaccatagtctgtgcccactggcgtgcatccgcaaaatctttctcatccggatgtgaaagcgcctcgtcaaaattttttacgctcgcattcagcttctgatcttccgggtgctcccgcagcatcgccacatagcggtttctcactccgatcggcattttcccctggcagtaaaagcttccgagcacctcactggtatccggaacgcactccgttacccggcacgccagcttctgatagtattctctggagccaccataaccggcagtgccgaaaaccgccagtttttttccttccagctgcttcaaatactcaccaaccgttccatcacagcttcccttgtccgtccaggatcctacaaaataaagatccgccacaatgtccggcttcggctcaccgaagtatacaatctcttcaccgccaagcgcatcccgtattgcttctgccacctgcctggtattccctgtcagacttttgtatatgattgcaatttttttcccactcatctgtgctctccttcgcccgctctgtcatcctactgcctatgatctctttaccggtctgccgtcgatacatccggtaaaatctgcttcgcgcgcagactcctcgcccggaagcggcgtatttctctgcccgccgctcttagagcactcctggcaggtgtccgaacccgcgtttgcttcctttctgccaaatcgacaggcagtttcttccggtcccgacgaattatctgtcgaaccgccgctcgccagatacacgccctccgcatattcttttgtctccacaacttctggttttacatactttttcatttttctgcactccttccaaattataaattacagcttaaatctgtaccctactccccagattgttgctgcttcgcagcgcaggcgctcattccggtacagcttcgctgtggagcgcctgccttgcacacctttacacatccttacgatttaagctctacagcttaaatctgtaccctactccccagatcgttgctgcttcgcagcgcaggcgctcatttcagtacagcttcgctgtggagcgcctgccttgcacacctttacacatccttacgatttaagctctacagcttaaatctgtaccctactccccagattgttgctgcttcgcagcgcaggcgctcatttcagtacagcttcgctgtggagcgcctgccttgcacacctttacacatccttacgatttaagctctacagcttaaatctgtaccctactccccagattgttgctgcttcgcagcgcaggcgctcatttcagtacagcttcgctgtggagcgcctgccttgcacacctttacacatccttacgatttaagctctacagcttaaatctgtaccctactccccagattgtttctatgtactgcggtttgttggtgttcatctcgatcttttcgcggatctttttgatgtgtaccgtcaccgtcgcaatgtccccgatggattccatatcccagatctggcggaacagttcttccttcgtaaatacatgattcggattctccgcaagaaatgtcaggaggtcaaactcctttgttgtgaactgcttctcctcgccgttgacccagacacgtctcgccgtcttatcgatgcggattccacggatctcgatcgtatcattctcaggcgtattgctgccgatcagccgctcatagcgcgccagatgtgccttcacgcgcgccaccagctcgctcggcgaaaatggcttggtaatatagtcatccgctcccagtcccaggccgcggattttatcgatgtcatccttcttcgccgacaccatcagaatcggcgtgtttttctcctcccggatctgcttacagatctcaaaaccgtcaatgcccgggagcatcagatccaggatgtacatatcaaaatcttccgtcaacgcccgtttcaggccgacggttccgtcattctctatctccacctcgaatccgctgagttccagataatccttctcaaggtctgcaatctccacctcatcctcaatgatcaatactctgctcatatggcacctcctgatattttcgtaatacaaaatacatcacggttccgatggactccttgcttgtcgcccagatcttaccgccgtggtcttcaataatcttcttcacaatcgataatccgataccgctgcctcccgtcgcagaattgcgcgacgcatccgcacggtaaaaccggtcaaaaatgtaaggcagatcgcgcgcggcaattcctctgccgttatcttcaatctcgacctggataaaatcaccaacatccttgatccggatattgataaatcccttctgcttgtccagatatttgaccgaattacccacgatattgttaaccacgcgctttagctgctccgggtctgcaataatctggacatcctcgtccgcataattaaaatatgccagtccgatgtttttcgcctcgagatcgagtccgatctcctcaatgcagtcattgaaatactccgccacattcagctttgcaaaattgtacggaatgcggttggtatcgatcttcgcatacaaggtcagctcattgatgagcgtatccatctcattcgccttattataaatcgtccggatgtacttgtcacgcttttccggcgtatccgccacaccgtcgatgagaccctccgcataccccttcacggctgtgatcggcgtctttaaatcatgggcgatattactgatcagcgccttgttctcacgctcacctgaaagcttttcctctgcgttatccttcagccgctgccgcatctcctcgaaattgcggcagagctccccgatctcgtcattcgtctctacatccaccgtaaaatccagattaccgtccttaatgttctgcgccgccacctgcagcttcttgatcggattgataaaactcgtataaatccataccgtcagcatgcatgccgtcaggattaagatcaggacaatcgagatcaccacatccgccatcaggctcttcaactccggcacggtctcctcgaggatcgtgataataaaaacgcttccctggcttccgtccgtatacacaaaatcaatctgcttgatcagcgcctgcttgtctccgtcgacatagatgccggtgtctgccccggactcttcccctccgtaggccggcagatccgtcagcagcgacgcctccttatcatctcccacatagatcagctcgtctcccctgcgcacgacaagatacgaatacttctcgcgcagagtgtcattcatctgctccagaaacgccttatcctccagcttatccggatcctgctttgaaagatccagaagcgtctcaaaggactcgcgcgtaaaacggctgagcagctgcatggaattagaaaaataactgtaatcgtcactctccacgccgtatgtctgttcaatcgacttcagctggatcttctggaatccgaaaagcaccgccaccgcaagaagaatggggataaatatgataatacaaaatgaaatgataattttatttttgaacttcatgtctgctttgtccaccccgcaaattcccgcaaaaaaacgggtcatagaactgtaattctatgacccattataacacgaaacatccaaaaacctatttattttatgtaaaattgtctaaacttttcataaaactctacaaatatttctttaatgtctccaccttatcgactgcctcccacggaaggttcagatcggcgcgtccgaaatgtccgtatgccgctgtctgacgataaatcggtcttcttaaatccagcattttgatgattccggccggacggagatcgaagttttcacgaatgatttccaccagtttctcgtcagaaagctttccggttccgaaggtatctaccataaccgatgtcggctgtgcaacaccgatcgcataggaaagctgaatctcgcatttttctgcaagacctgcggcaacgatgttctttgccacataacgtgccgcgtaagctgcggagcggtctaccttggtgcagtccttaccggaaaaagcgccgccgccgtgacgtgcatatccgccgtaggtgtctacgataatcttacgcccagtcagacctgcatctccgtgcggtccgccgataacaaaacgtccggtcgggttgatgaagaactttgtctgtgcatctaccagttccttcggcaggatcggatcaaacacgtatttcttgatatcctcatggatctgctcctgtgtaacatcatcatcatgctgtgtggacagtacgacagcttccagacgaagcggctttccattctcatcatactcaacggaaacctgtgtctttccgtccggtctcagataggaaagtgtgccgtccttgcgcaccctggtcagctgtaatgccagcttgtgtgcgagagaaatcggatacggcataagctccggtgtctcgtttgtcgcataaccgaacatcataccctgatctcctgcaccggtatccagttcatcctttaacccgccctcttttgcctcgagtgccttgtctacacccatggcaatatccggtgactgctgatcgagcgctaccataactgcacatgtatttccgtcaaatccggtcttcgcatcgttgtaaccgatctcgttgactgtctgtctcacgatcgccggaatatccagctttgcctttgtggtaatctctccggttaccagtacaaatccggtacagcttgccgtctcacaagccacacggctcattggatcctctgccatgcacgcatccagaatcgcgtcggaaattgcatcgcagactttgtccgggtgtccttctgtgacggactcagatgtaaataatctcttttccattccttattactccctttctcatcatgtaaaatgacacaaaaaaaccacttgcgaaaaacaagtggaagtgacgtatagataatcaaatcctcttattgttcgaactatcgcggatatcgcttctgacagcgctcatccataacagtatttgctcgctcaggttggcaccttccgtagaggggttgccgtgacttcacagatcctatgtatctccatcactctgaataagaaaatttacacacaatattgaattttcaaatctacgtctgatacgttacacccctttctccgctatgtcaagctttttattgactttcttttttcaaacttctatactgaaagtagttgtagtaaatataggtagaaggggtaagcaaatgaaagaattggcactgtacaatttaaaagagggcatggttcttgcaaaagacatcactacccccagcggacaggtggttcttgaaaaaggaaaagaacttacgaagcagtcgatcctgcgcctttccttttataatatcaagtcggcctgcattgtggacggggaagaaaagcaggcggctcccaagtcctattcgcagaaaatcaagacttcgcagaagtttcagtctttccaggtggatcacacgatcgtgctcagtcagatccgtgtcagctttgagggctacgtgaacgagggcaagccgttagacacatcagcgctcctgtcgaaggtcgtcgaattgttccagtcctgcaagacttctctggaattgtttaatatgttacataacatgcattcctcagacgacagcgtctatgtacattccctgaatgtctcgctgatctgccggcagatcggaaaatggatcaaggcagacgacgccactttagacatgctgacgctcgccggactgcttcacgacatcggcaagctcaagattccaacagagcttctcaacaaaccgggcaaatacaccgacgaagagttcgcgcaggtcaggctgcacacccagtacggttacgaactgttaaagccgcttccgctggatgcacacatcaagctcgccgcactctctcatcatgagcgctgtgacggcaccggttatccaaacggtcttacgacgaacgatattgatccttatgcacgcgttgttgcgatcgcggatgtttatgatgccatgacgaccgcccgctcttaccgtgctcccctgtgcgcttttcaggttatcgccaactttgagcgtgacggtctgcagaaatacgataccaaatgtgttctcgcattcctcaaccggatcgccggcacctaccagaaccaccgcatcctcttaagtgatggtcgtagtgccaacattgtcatgctcaacgacaagcagctttccagaccgatcgtgcagttggacgacggttcctgtattgatctgtcaactgcgggcgatctgcatattcaggcggttctctaaaccgtcaatgtcgtgtccaaaagcatccggcgcctgcgatagccggcagaagataagctgtagactgggaagttagagaaacgcaacgttccaaatgcaaccggcagcgacgattctgatcgtaaaatccggtatttctaaccatgccgcgtccggcatcctggatgagctgtgtctttccaagtttggaacattccacgcggcgtgtccgcaacctgcagacaattttaggacttacgtgcagcacggctagtgctgcttgtactataagcatgtagatacattatgtatgtatccgcatgcttatttttattataataaaaggcggataaggctagtgcggtgggacatagctcccgttttttagagtttattccgcctcttattataagcattcgtttaaacaggttggattaaatacatccgtgtaacgaacaagtctgaatggtaataagtctgacggagaaaaggaggatttgcatgaaacaaatagtaagtgtaggaatcgatgtatcaaaagggaaaagcactgtctgtgccatgatacatcctaatacgattattaaggaatcgtttgaagttttgcataccgtagaagaaatgtcaatgttagctgattacatcggatcacttgatggagaaattcgtattgtaatggaatcaacagggcattatcatcttccggttgcacaatttctgtatcaaaaaggcttttttatatgtgttgaaaatgcatatattatacgacaattttcacgcattatgctgcatggcgcaaaaacagatccgcttgatgcaaaaaaattagcaaagtacggtttggcatactggagtgaactgaaaccatataaatttcatccaagctgctacacagaattaagtctattatccaagcagtatcagacatacataaagcttttgattgctgctaaacagaatgtaatacatttgatggatgaga

SEQ ID NO: 16 - DNA, 98973 bp, Roseburia hominis
ttgatttgattgatttctatgttcttccgcattatcttacagcaccatttaagaaagttaccgagaaaataatgactgagttttcggatttgaatctatgcccaattaacaaccgtcagggaattgtaattgatggtgaagattcaaaggttatttgcaaagactaatttgaaaattccagtttgtcaactacaagtgacattgaaagagtcagcccattcaaggtgctggctctttcaaaaattccattctaataaattgcatgataacttagagtaaaaatgaatacccattagccggaaatgaatagaaaatgaataaaagtgtggtgtttcgtataattatgagtcagtatgcatcagacacacttttgtaaaaagggagttattaaaaaacgattacggggtggaactgtcgtaataagcataccgtgcttttgagtgataagtaatattatcagaacatcacaccgtgggatttcagatgaaaatgcaatccccaagtatgttttttccaagtattacttatcacccttctgctttcaactcctatttgataaatcccacctgtttgctgatcttctcgatctgctcgtccttgcgcttgttgaactcaatcttgtttttctcaaaaagattattgccctttgtatcgatggacacgatcagcggaccgaactctttgacacggcagttccaaagtgtttccggcattccgagatctctccactcggccgccacaatctcctcgacctccgttgcagccacgactgcatttcctgccgggaaaacacagtggatggcaccgaattccttgcaggcacgctccgtattttccttcattccgcccttgccgatgatgacacgcacgccggtctcttttacaaactcatactcaaatttttccatgcgcatgctcgtggtcggtccgacagagaccatctcaaacttgtcgttctccagcggacggatgatcggtcctgcatggaaaatcgcgttgtttctgacatctaccggaagttctcttccctcctcaaccagacggcggtgtgcaacatcgcggcaggttgtcatgcttccgttcagataaataatatctccggccttaatatctgcaagatcctccgcagaaatcggagttgttaaaattttctttccatctttcatctctaccattataattccacccccgaatgtgttgtgatcgtatagttcagatccttatcaaagataatgtgtcctcttctgtggctccaacagccgacattgactgccacaccgatcgtggacggatgacgcgccgtgttctcgatgttaacgcccataacggaatatttgccacccatgccctgcggtccaagtccgattgcattgattccatcttcaagcagacgctccatttttgccgcgcgctcattgtcattgtgggaaccgatcggacgcatcagcgctttcttggaaagcagtgccgctgtctccacggaggttgctacgccaacgcccacaagaagcggaggacatgcattgattccataggaagtcatgacatcgagtacgaacttggtaacaccctcataaccttcgcccggcattaagaccattgccttgcccggaagcgtacatccgccgcctgccatgtaggtgtaaatctcacactgatcactgtccggaacaatatcccagaagaccgtcggtgttccttttccgacatttttgcctgtgttgtactcatcgaatgtctcaacactgttgtggcggagcggagcctcaaacgttgcttttacaacggcttcttttaagagtgcctccagttctccgatcagcggaaagtttgtgccgcattttacccagaattgcagcacgccggtatcctggcagctcggacgattcagctttaccgcaagttcctgattctggaacatggtatcgtagatcgtcttggacagcgggctgtcctcctgtgctctcagctctgttaattttgcaatgacatcatccggcagcttctttgccacatgtgcaataaattttgccatgtaatcggtaagctgctcaacctgtgcttcttttgacatttttttgtcctccttttatctataactatccagtacaccgcagctgtgcggcaaaaactgattttacgggaaaaacggatacaataccggaagcaggatcatgctgacaacggttgccaccagaatcagcggaattcccgcttttgcgtaatctttaaaggtataacctccggcagtaacgaccatggtgttcgccggcataccgatcggtgtcgcataggcacatgaaccgccgatcacacaagccatcagaacagcacttggatcagctcccatacggttcgcaatggatacacagatcggaaccataagtgcagtcgttgccgtgttcgacataaagttggtcagtacacagcagagcatgaataccacgaaggtcagaagatacggtgacgggttcgctcccagaagaccaatgaccttgtccgcaatcatctcacctgcacctgtctcctcaagcgctgacgccagggaaagcgtacctccgaagaggaagattgtctttaagtcgatggactttaaggcatctttctcactgatgacaccggttaagatcaatgccagtgcgccgaccgcaccaatcacacagagcttgatgccgatctgtttttcaaaaatcattccgatcagtgtcaataccagtatgatgagggaaagattctgcttccacttcggtacatgaccgaaatcctttgtctcatcgtagattccatcctctccgcccttgtgctccggcaaaagcttgtagccaaacagtgcaaagaaaatagttcctgcaatcagaatcggcagacccactttggcatactcgaaaaatccaaatgctttccccatgtcttccatcgccgactgggcgatgaggttgcccggcgctccgatgagagaaaggtttcctcccatagccgccgcaaatacaagcggcatcagaagtcttgatctggaataaccggattttgcggcgattccgatgactaccgggatcagcactgctgcggtaccggtatttgaaagtacgccgctcatcacaccggtgatgatcataatggcgataatcagctgtttctctgatttggcgaagtgtgtgaccacgcctccgattttatttgccatccctgtctcaaacagcgcacccccgacaatgaacatcgccacaaacaggatgacattgctgtccacaaatcctgcaaacgccgtcttccagtcaagcacgccggtgacgacgagaccgatacagacgatcatggatgttacgccgagcggaatcttctcccagacaaacatcacgacggcaaacaacaaaaataatagtgttattactgatgcttccataaaaccctcctttgttttgcgaagcaaaatgcaaccgccatgtaaaaacccttcccatcatggctcattgaatttttcccttgttgcttgtttgatatttgatattgtatccaatttctgagtttagaatataaaaaaaggccgaaaatgtcaatacccttttgacactttcggcacttatgttcaatttatctttttatttttgtgcaatacctacaattacacttccacataaggattctctttgaaatattccagaatgagttccaccatctccgtattgatttcacggacaagttcacattccgtatatacttcatatccgcccgctccgctgtaacggtaattgttaaggcacagcgtaaaagaatctgtctccgttaccgtctttccctggtaagtcagatttttaatcctgtttccgaccggtgcagccgggtcaatctcatatgctgcccccatatagtagtcatagttatagtgctccaccttcggcacaaggaagctttccgcaacctgcaccgttccatccgtggcgacggcaaaatactccgcgctccgctccatcacctgctttaactgttttccgctgatcctgcatacgatgagcgtattcggatacggataggttgctataatgtcgcggacactcacctcgctgcgaaatccggcgatctcattggcaagaccgaccgctgacagctgtgtgccggaaaaatgtaactgtatccggtttaaaaaatcggcaatcggcgaaccgtgcagcgccatttccgctttttctccgggaagaagcgcccggcttaaatgcccgatcggctgatccagccagctctgtacccgttcttcctctgcggcatacttttcgcataatgcaccaaccgcatttgctccgtcggcgacacgcttctcggagcggacaacaagtccgtcttttgtccgctccgcttccagatagtgatactctttggcattctcaagcggctgtaccacgtaagttccatgcacatactgcccgtcgacggacatatgctggtgcccggtcagcagaatgtcaaaatccagttccttacagatgcggtatccgacattctccgttgtcttctgcaggcgctctccggtctttaaatcgcactcaaatccgccgtggtagatgcaaagcgtaatgtccacctcttttttcagatgcaaaagcgcctcttttgccgcctcaaatgggtctgtaatgcaaattcccgcgagattttccttccgctcccacacattcacatagtctgtcacaataccgacaatcccgacccgaagtccgtttccaagcgtgtggatcacatacggatggcatgctcttcctgcctcatctacaacattctggcagacacacgcgccgtgatgagcctctatgtaagcgttctgatagtccatcccataattaaaatcatggttgccgagcgtataataatcgtagccgcagtcgttcatgatatccgcaatgacctgcggcgatcctgacttctgcctgcaatagtaggcaaaggcggagccctgcaatatatctccgccatcaattaccagtgtattctcatcttttttgaaatcccgggcaaacgagaacagccccagatcttttcgtttcaaatccccgtaagtcgttgggtaaaaatacccgtgaacatccgaggtaaaatatatctttaacgtttgttccatcttatccctcagtcgtattatagttatccccgcgtcagcttcacacggatctttgtggagattacctccacaatcagaatcagcacgatcagtcctgcaaggattgcacccacctgattccatttgtacgcgctcattgcaaaaataagcggcgcaccaataccgccggcacctaccagaccaagcacagtcgcatcacgaagattcatgtcaaaacgatagattaacgttgacataaagtccgggaataactgtgacagaatgccataacggatcttctggaacatcgtacatcccgctgcatcaagcgattccagtatcttggtgtcaaggtcttcgatactctcgataaacatcttgctgatcataccgatcgagcacagggacatcgtcagaagtcccgcaaacggtcccggtcccgtcacacggatgaacatcagtccatacacaaatgccggaattgtgcggatcgccataataaacacacggaaaaccagcgcgatcggtctcggaacgagattggccgccgccagaaaagacagcgggatcgagagcacggctccgacgatcgttcccagaaacgcaatacacattgtctccaacagcagatatgccacaccggatgttgtaaaattaaacaaaagagtggtgtccggatgaaaaataccgctgataatttttcctgctaccgtaagcccgtcgccacccgttgttccgctttgcaccgtggacatcgaccatgccagaagagctgcaacgatgagtgccaccagaattttcgcataccacgtccttggctcctgctcatacattttatctatttcttttttcattctgccttgtcccctcctaggtaagcttcttacgaatataatggctgagtgcctcgatcacgagcaccgttccgaataataccacgaggatcatgcccacgctgtcgtactctctccagccgatcttctcgtttaagatcagaccgagtcctccggcgcctacatatcccagaattgccgcatagcggacatttccctcaaaacagaacaggcagacggaaagatatgccggaagcacctgtggctggatcgctgccagaaatgcctgcgccctgccggcgcccatcgcctccatcgcctcgtaagctcccatgtcgaccgtctcaatgagctcgtaaagctgcttgccgacataggcaaacgtaaagactgcaatcgccacggttcccgccattgtgccgagtccccagatataggttgcaatcagcgccgccaccagcgtcggaatcgtgcgcacgatacttaagaaaatgcgcaccacacccagaacgactttatttttgaccaggttgctggatgctaaaatcgcaaacggaattgcgagaacaccgccggcaaaagaaccgagcagcgacatcttgatcgtatctaaaagcggtccccagatactgcttaaatatcccgtctttggcggaaacatctgtcctaatatgacaaagaactgatttccgcgtgtgagaatcgtattgagcgaaaaaccggtaatccggacggaaatgacggtcgcaatcagaagcagaagaagtacaagcggtgtgcgcgtgcgtttttcctccactacttttccgtcggataacaccagtttcttcggcttgaaaattttatcatatattcccatcaggcttcctccacctcatccggtatctttccggcatagatcatgtttaacacatcctctgtcacatccgcggaaggtccgtcatagacgatctttccggcgcggataccgatgatccggtccgcataggcaagcgccagttctacatggtgaatattgatcaaaatggtaatgttcatctcctgattgatcttcttaaaatcgctcattacctgctttgccgttaccggatcaagcgccgccaccggctcatccgcaagaataatcttcggattctgtgcgagcgtgcgggcgagcgccacgcgctgctgctgtccgccggagagctgatccgcacggatatatgccttatctaaaatgcccactttgtcgagtgcctccaaagcgttcaacttgtcttcttttttaaatataccgagtaatacacgccagaacggcatctccggcacttttgccatcaatacgttacggataaccgtggtgcgtgtcacaagattaaaggactgaaaaatcattccgatattgcggcagaatttccgcagttgttttcctttgaggttcttaacctcctgtccgtccactgtaagcgtaccggaagtaatgtcatgcatacggttgatcgtgcgaagcagtgtcgattttcctgctcccgaaagaccgatgattcccacaaactcgccctgctcaatcgtaagattgacatcgtcgagtccaaccacgccgttgggatataccttggatacgtttgaaaactctatcataaatgctccttccacattgccctaaaaaatatgcagcacagcggagtgatgtctcttttccaagatcactccgctgacactgcaccctttatctgcccgtttctgattagttggctgcgttcagttcctgaatcagcttctgtgcttctctttccttatcgtagtcagaagactgtgccggctcatatccgttgtggctgtagattgcgataaccgccttgccctcttcggtattgccgatgttgatcagtgctgtctgaatggctgtctttaagttctcatccatgtacggagaggtcttgctcacacagacggtatcgttgtagatcggatctgtcacaccgatgacgttcgtctcctcccagatggaagcagagcgtccatactcgctggtccagttttcctcgtagtcacgtcttgcgtctgcgtaggttaccaatacatctacctgtccggatgcaagtcttgcgaatgcacttgcataggaatcagactgtactgcattggaaagatctgtgatgcccttgccgtaacgatcctgcatccataatgccgggtaaatgtagcctgccggtgaagaagaagacatcacgctccagtttgcgctatccagatcatcccaggtaagctcctctccggaatttaccttgtctgcaagctcctgtcctttctcagaaggacctgcgatgaacagagcacggtaagatactgcctgcttgtcagatgcctctgtcggctgtccgtcattccagtccgccggattgtcggagtccttgttcagaccatctctggttgcggtcaggatcacatcacatccgtcatcatagagcacgtaagtaccgcccggaataaatccaacatccgctgttccggcggaaagtgcctcgcctactgcctcgtatgtcgtacctacggaaatgtttacactgtctacatcatagcccagtcccgcaagctcgttctttaacagatcactcaacggctctgttgcagttacgatctcttccggatctctggacggtacaaaatatacgtttaacgcatccagatgcacattctcagcggaagctgtctggctctccgtagtagcagctgctgtctcgcctgctgctgcacctgcattgctgttatctgttgtctcttctgtgttacttccacagcctgcgaatgtacccatgcacattgctgctgccagtaaagtagctgtcaatctcttcataattgcaaatttctcctctctgcagtgaaacaattttttcatgcgctgtcgcccagctccaattttgtcggcagatagaccttcatactgtccacacgtttgtcaatcattcgttccagcaaaagcttgatcgctgttgaccacacgatatccggcagcatccgaagactggtgtacgtcgggtattttgtctgcagcgtctcaatatcgcggtagatcacaaccgcaacgtccttcggaatccggtattttaattcctttaccgcttccagggcaccttccgccacctcatcatttccaagtaccagcacttccggcacatccttcgtctccagaagttctctggtcagacggtaaccactctccctgctgatctcccccacacagaaatagtgctccttatagcatcctctctgctgaagaatctctgtcagaccttttaagcggtgcgtaccaatccggacaccgtccttttcatagataccgccgatataaccgatgctccggtattctttgatatccagaagatagtgtaccatgtcctttaagccctgctcatagtccatgatgatccggtcaaattcataatctttctggtccgaattgacaaaaaggatcgcatcgctctgtttccgcaggaaatccatctcctcctccgaaaaagatccgaatgcaagaatcccgtcgacctctgcatcttccctgcaggtgatccgcaaaaagctgacgtccaccttctgcggcatcgtcgctgcgatgtggtctaacgatgcgagtcgtatatcatgccggtcccctcttaccagatgccagtctgccacaccgatcgtaacatgggtcttattctgcgcatgacgcatcttaggcggaatatagtttaattcgtgggcaatctttaaaatctggttcctgacttctgctgtgacggtcaatgtttcatcctgattcagtaccctcgatacagtcgccggtgatacctttgctaactctgcaatttctttgattgttgccatataatcacgcctttcttctgcattatatttcacgattttttaaatttcaatagcatcggtaaacttttactaaatttttaccggattttacacgacctatacattaggcttataaagcgacggtttttgacttataaaaaagaccggaaatgccatattctgacatctccggtccgtccgcctgtttcttctcaacggtaatttgtcagcatatcgtccctgcttcgcatgatatgacgatacatttcttcctttgcagccgctccgtttctctcacgaatcgccttcatgatgcgctcatgctcctcgatcgacacctttgcataatccgcttccgtaatcatgctgcccatcgacaacccgttccacaattcagcaatcatattttccatacggctgttacccgccgcactccagatctcactgtggaattcacggttctgatccgcgtacgccgcgaagtcgttgttctgaatggactctgcggcacactcgtaggactcctcaatccgggtaatatccacctccggcgcacagcacatctctgccgcagcactctctaagatcgcgcgcagctggtaatgctctctgatatatgtctcgttaatccctaaaacgaccgctcccttgttgcgctgaagcttaatcagtccgtcacgcgcaagaatctggaacgcctcacgcaccggcatgaccgacacctccagctgattcgccacactctctaacgtgacagcctccccttcctgcagctggcgggagagaatcgccttccgaagttccgctgccaccttttcttttgccgacggcatcttaatcggatgtaatccattcattgatgttttcctctctctgttaccactcgtgcggcaagttcctcataatacggctccatctgcgctgccgccccgcgcagttcgtctgcactgagctgtctgctttttacttcccgtttctgccagaagccgtcctgccattccgttcctttgcggtactctgcatctgcgcttcccgtttcctgccgcggcaggctgatcgcaaaacgcacatagcactccaccgcattcttcaggatattccgcacataagcattgtctgtcatcccatagattctgcggtgaaattccagttccgtcagcgtctcctccacaaaaataccgggattctctccctgctgctccgatgctgcaagatcgcagagcacacggcgttcaatatcgccgatgataccgtaaatctcccggatatgtgcatctgaaaaatctgccgtcaccacatgtctggtcgcaagacgcaccgcgagtccctgatgttcaatgatctgcaacgcctcgcgcacagggattctcgatgcgccgagaagccccgagagttcctcctgcttcaatggcgtaccgccccggatcgctcccgacaagatctgatcggtcagctgatctgcgatataatctgctgttctcttgttcatctgtatctccatactgcagccgtactcctctatcctcttaacagaagttctttctccacaactttgccatttctgatatagatgcgcggcacacgtttgctcaccgcacaggtaagctcgtatggaatcgtcccggcaagtgccgcaagatcattgatggagttctgttttccgaacacctcaacctcacttccaacatccacacccattttccctgtcagatcgatcatacacatgtccatgcagatcttcccgcgctgcggagccggtccctcttttgtcatcagcgcgcagcggttggaaagacagcggaaaaagccatcggcatagccgtagggaaccacgccgatccgcgtggtatgctctgtcttaaaaatgccgccgtagctgatcgccgtccctgccggatagatcttgatggtgctgaccgtcgtctttaatgtcatgaccggcaaaagccccagctcgtccgcaaattctccatagccgtacagaagcagtcccgggcgcaccatatcaagaaaggtctccggatatcttgcaaccgcgccggtgttcgcgcagtgacggagcgcgaactttcttcccaggcgcttttccacttcctcaatcacacgcataaacaggtcgaactgatgctccgtgtattttttgcagtcctcgccgggctcgtccgataccgcaaaatgcgtaaagatgccctccgcatccagtccgggcagagagcagccgtggcagattcccgcaacgcccgtctcaaaataatctccgtcgcacagataccccagacgcgacattccggtatccaccttgatgtgaatctttaggatgccgccgcatttgaccgcctcttcgctgtactcaagcgctttcgcctcgcagctgaccgcctgtgtaatgtgatactcgatcagcctcgacacctgctccttcggtgtgtggccgagaattaaaatcggcatcgtaacatcgtttaaacgcagctcgaccgcctcatcaatactgctgaccgccagataatccgcaccaagttcctgcagcagatgcgatacctgtacagaaccgtgtccgtaggcatccgccttcacaacccccagaaactttacatctgcaccgattctctctcttaatttatgataattgtgtgccagggcatccagatcaatctccgcccaggtacgtctcaatgtcgactccatgccgcactgcctcccgcttcatttcttctatatttatacgaatactataatccacgcgccacatttatgcaaacaaaaagttcccttccatgctttgccttgataagtaatattataagaaacacaccgtgtggatttcagatggaaatgcagatggaatattcgttggagaaaaatgtgagcatttcttccgatcgaatggttgcatcagattccgtgtctcttccacgtttggacaatccgacgggtgcatgtccgacacaccggagacaatgggcggactttctggtgtccctaatggcacctcttcacagacaatataaaaccgcgcgaaccgaactcgccggcatctgctattgaaaatagggcagatgccgactcagacagcggcttcgcgcggttatgttttgttcagaggtgccataagggacacacacaaaagtcctacaaattgtcttccggagtgcggacatgacccgtggagtgctccaaacttggaaagacacggatcatcgaagatgcaaccattcggttggttagaaatgccatattttttgaaccgaatattccatctgtatttccacatgaaatccccaagtgtgtttcttataatattacttatcccccaaaagagatctatgcttcctccacttcaaagtagctgctccagttcgcggacaacttctcatgcagggtgcttaccgcagaatccagatcttcaatggttggcaatcccatatttgccgctccttcgttcattgcggtggcaagtgatgcaagattatcctcgtcacccagatcctccagcgataatcccaattcatccagcttcatcaggatgctgtccggatttgtgcggaatgtctctgacaactcctcaagcaatgcctctgttcctgtcgctgcggttccctgcgtctctgtcgttcccgtgacctgtgtgctctccgtcgtctcgtctgtctcgtccgtctcctgcggcggcatcggcggcattggcgggcgttctccgctcatcatcccctgtgcattgtaagtgctgctcggcatcggaatgtccatgtccatctggctgatgcccggcacataactgtccgtggcgctgttctcttccttctgctgtgcggcctgggtctcctgcatcttctgcttccactcttccagtgcttcaagatatgcctcgtaacttgaactctcgaccttcataaccaattcctttctgaggtggttccttcccgaaattgtgccatcctttgcattttcctcgaaatagctatcggatctgccgcagaaaaaataacagacttcacataacattcagataaccgtcacattactccccggactgatagacaatctctccgtttatgatggtatataatatccgcgcatcaatcgaaaacggggtgccttttagcagaacaaaatctgcgtccttcccttcttcaatgcttccgacacgatcttcggcgccgatatgccttgccgcctgaatggtaattgcccgcagcgcatcaaactcacgcatgccattgtagattgcccgccctgcgcagagcggcaaatagcgctcctcgatgaccggcgaatcggtgatgatcgacacctcgcagccggcatccgccagaattgcaggcgtctcaaatcccttgttcttcaactcgtacttcgtcgcatgaccgaaggacggaccgaccgccaccggaaaatgctccgcacccaattcctttgcgatcagcgcgccgtccgtcacgtgatcgagccttaaccccagatggaactcctttgcaatgcggattgccgtgcagatatcatccgcccggtgtgcatgcgctttcagcggtatctccccgcggatgaccggcagcattgcttccagttttgcatcgtaggctggcattttgctgatgtccacctgcccctccccgctgccgcggttgatctcattccagcttgtctcacagcctgcctcccgcagctttttatcgtagatgatcgtcttctgcagcacttcccgcagttttgccgccacagacatgcgcgaatagacgcctttttccttataacagttcttcggattctctccgaatgcaattttcatggctgatttttcccggacaatcatgtcgtccacgcggtttccatacgttttgatgatgcagaaggttcctccgatcacattggagcttcccggtcctgtcgacacgcaggtaacgcctccctcccttgccatgcggaaagtctcatcctgcgggttgatcgcatctatcgccgagagctgcggtgtcatcggatcgccaagctcattgaagtcctgccccgcaaaaccgaccgcataaccgtcgagccccagatggcagtgtgcatccacaaacccgggatagacatcgatccccatcgcatcaatgacagccgcttcattgatgactttgccctccagcacaggcgcaatcttttttatttttccgtcctcaatcaaaatatccgccacaaatgcctcctcgtcgacggcattgtggatcgttccctgttttaacaataaatactgactcatcgcaatcctcctgtgttattctttccctgctctgtccttaattttttcttgcattttatagttatcctgttataatacaactaagaaatgagtttttcgaccgtacagctattgctcaagcggctcgctcgtttctttttttattctcagaatatcgtataaatacatttttccatcttcatcatggcgtattaaaatccttgcgccaaagatattatatctgcacaaatttccctcatcgttgtatacaggtattgcaaaacgtgtatcataacgataccatccatattttgcatctgccacatgtttttcctcgtaattaggcgcaaatgttttaccggcggcaatttttatcattggttctacaatctgagatgcatttgcatttgcctttgcatgccgatttgcaccttttaggcttttcgtatctttggaatgcgtatattcatccggaaaatctttcccgatataaatctcatcggatgtttctaaaatctgcacgcagcttccaacatattcctttaaacactgttccactgtattccagtcaatattccttctgcttttaaatcgtaaatcattgataatgacaactttatttccttccgcatcttccacaatgtcatagtgatttcttatctcattcctcgcattgtctgtatctatacttctcgtatagtatgccagcatccttggaatatattctggcgggatccttctacctgtctcccactcctccatcgtcctgagcggaataccaaatttttgacaaaactcttttctgtttaaccctgtccggctgcgtatttcttttactgtctcacttgtttccataccagcatccccttctgccaagtcctcattgcgtggttttcttttaatttagcacaaccgctctttcctgtctatatttatatatacaaaaaccaccggggcggcacgctattgcatgccgccccggggatttttgtatatgggtatatcatcaaataatattaagaagaaaccttatttatgccacgttcttcttcagaacgcctaacagtaccgcagataccacagatccgatcgccagtgccaccagatacatgaatggattaccgacggtcgggaatacgaagattccgccgtgcggtgccatcagagtacagttaaatgccatggaaagtgctcctgcgactgccgatcctaccacacaggatggaagtacatgtaacgggtcagaagctgcaaacgggatagcaccctctgtgataaaggaaagtcccattataaagtttgtcggtcctgcctttctctcctctgcggtgaacttgttcttgaatactaatgttgcaatagcgattgcgattggcggaaccataccgccgaccataactgctgccatgatgttatagtttccggctgcgatggatgctgtaccgaatacataagctgccttgttgactggaccgcccatatccacagacatcataccgccgagcagtgcacccagcagaattgcacttgcgccgtttaatccattgagtccgttgttgatcagagtgtttaatgctccgattggcggctcaaccacgtaagtcataatcacacctgtaataaaaataccaagcaccggatagatcagcatcggcttcatgccttccaggctttccggcatctttgagcagatcttcttgagcagaagcactacatagcctgccaggaaaccggctaccagagctccgaggaaaccggaagttccgtttgccgcgatcgctccgccgacaaaaccaacagcaagaccaggtcggtctgcaatactcattgcgataaacccggcaagaatcggaagcataaatccgaatgccgcgccacctattgacttaaacattgctgccactggtgtaatcgtaccgaagttacttctctgatccatcggaagagaattcagatctacggaaaatccatcgatcaggaatgccagtgcgatcaggataccaccgccgacaacgaatgggagcatatgggatacaccgttcatcagatgcttataaatctgatgtccgacgctgtccttctcattatcgtttctatttgccgcttctttattggatgcgtggtatgtagccgcatctccattgattgctctcttaatcagttcctcagccttgctgataccgtctgcaaccttgcactcaatgacaggtttgccatcaaaacgctccatcggaacctgtgtatcggcagccacgataatgcaatccgcctcggcaatctccgctctggtcagcacattcttggcgccgccggaacctctggtctcaaccttgatgcggtatcctaactctgctgctttcttctcaaggctctctgctgccatatacgtatgcgcgataccggtcgggcatcctgttactgcaaggatcagcctgccgccctttgtctctgtctttgccggtgcctctttggcttcttccacatcctttgcactctcagccacatcaatgacatgtaaaaactcttccacgctctttgcattccgaagatcatttgtgaacttctcatccatcagcagtacagaaagtttgcttaatacgtccagatgcacattgtctttggtgttcggcgcagcgatcaaaaagatcaggtctgccttctcaccgtccagcgactggaaatccacaccgcctgcaacacgcattgccgcaagtcccggtgcctttacaacatctgatttgcagtgaggaatcgcaatcccttcaccaataccggttgtgccctcttcctctcttgcgtataccccttttcgataagtctcgacgtcgccaatcttaccacttctcgccatcagatccactgcgtgatcgagggcttcttttttgcttgcagcttttgcattcaggtcaatgctctctactgctaacaattccctgattctcatgattcttcctcctccataatgttaaatggtttctatttaatctgcgcacattttataattctcatttgccgcaaaattaaaacaagttttggttcttctccagcagatcaagtacctctgcctttgttgcaagctcttcagaaaaagcggatgcacttcctgtacatacccccatctgaaatgccttgtcataggttccatgctccaaatatcctgcaagaaatcctgccaccatggaatcgccagctccgacggaattgatcagctttcctttcggcgcctctgcctgatacaccgatccgtcctcggcaacaagtaccgccccgtctcctgccatcgaaataagcacgtttctggcccccctctcctgcagcttcttcgcgtaagtcacagcatcctctttcccgcggatctccacgccaaaaatctctcccagttcgtgattgttcggtttaattaaaaacgggtggaagggaagtacatttaccagaagatctctcgtggcatccaccacaatttttaaattcctgccctgcagatgcttcatgatatccatgtacatcgtctgcggcatcacatccggaatacttcccgccatgacaagtatgtcgccatccttcagtgcatccagcttttcatataatttatcaatatcagaagcagcgatcgccggcccctgtccgttaatctcgctctcctgctctgaccggagcttgacattgatccgcgtcattcccttatctaccgggataaattcagcatgaattcccttatcagccaccagccgcttcagctccatgccggtaaatcccgcataaaagccaagtgctgtattctcaaagccaaggttcttcaacaccatggatacgttgattccttttccaccggggaaaataatctcttccgtggtgcggttaaccaccccgcaggtaaacttcggaacagtcacaatgtaatctaaagatggattaaatgttaacgtataaatcattacccaagatctcctctcactcgactttaatgatattggaacaatccttgtatatttcctgttttaactctgtcgtaatcacagtcgctttctcaaacggtgcgaacgtcacgctcgatatctgggaaaacttgctctcatccgccagaatgtaacagtctctgcaattctccatggatttccgttttaccatcgcctcttttaactccggtgtggaaaatcccctctgcaggctgacaccattggctccccagaagcctttcgtaaaattgtatttatccagtgtaaaaacggcttcctcaccgacaatagcctctgtcaccgccttgaactcaccgcccaggatatagaccttgcatccatgctctgccagttttttcgcatggccgatggcgttcgtcacaaacaccgcctgacggtttgcaatgtaatcaatcatccgctccgtcgtcgtacctgcatcgatataaacaaaatcttcggcagtaatcagtcctgccgcatagcgtgcgatcttatcctttgcctcccggttctgctccttgcggtgaaccacttcatcatcgatggtgctgtataccgtattctttaaaatcgctccgccgtgtaccttgacaagctggccgtttgcatccagcgtattcaggtctcttcgcacggtagactcggaagcatcaagttccgtcatcagctgctgaaccgtcacactccccatacgttccagtatggacaaaatctttgcaaatctttcttctgtcagcatgattcattctccgttttccgtcatattcgttcaaaatcgttcatctctatacctgcattatatttccgtttccagtcatagtcaatcattttccgtcaaaatcgttcacaaaaatcgtcatcgaaatttgtataaaacacacaaataaaaagaaggctgacttctcgacgaaatcatccttcctcacaaaattagtatctcatattgccctcccgtagcggcggatcgcctcccggatctcctcctccgtcacccgcacaagctcggtgttgcgtgtccggtactcgcgcatcacgtcaaacggccggtccgccagatagcaccgcagtgccatcagcaccgcactgtgcgtcacgacaagcacatcgtccttctcgcgcgccagaatctgttccagcgcagccagcgtgcgccgcagcacctcgttatagcactctccgcccggcgtacggcagaatctcctgtgggtatcccagatataatgccgttctgcttccgtttcccttatctcatcccagttcctgccttcccagtctcccagatccatctctcgcagatcccagagccggatgcagtcaatgcccagcgcctccgcggaaaaacgggctgtctctgccgcccgaagctgcggcgacgtgtagactctgtccagatgaagctccccgtttcgctgcttctctaagagtgtctctgcgagccgcttcgcctgctgtattcccttctcatccagcggaatgtccgtcgttccctgtatcttcttttttacattccattccgtctcgccatggcgtgtaaagtaaaaattcatatgcctctccattcatggtgcctgcatggtttttaccgtttccaccctaagtatataccaggaccgatatcttttccaagagcaaatacacacaaaaaacggaaagtccggtttccctgactttccgtttttattatctggcaatatcgatacgcaccagcgccttgcgcagcgcaaactcggcacgcttgacatcaatcgcctctgtccgattggcaagacgctcctcggcgcgtgcttttgccgcctccgctctcgccttgtcgatctcgttcggccactcagcaatctctgcaagaagtgttaccttttccggcaggatctctgcaaacccggaatgaaccgcagcaatgatatcctcctcgccctgcttgtggatcgttacaacccccggcgcaagaaccgttgtgagaggaatatgccgcgcatacactccaagctctccggcagccgtattaaattcgatcatcgtcgccgttcccgtgaaaaagacacgatccggcgtaatgatctccacgtcaaatactttgttctcgtctgccatagcttatcctcatttccgctactgtgcgttgttatacttttcgcgcacttcatcaatggttcctgcatttaagaagtaactctccggaatgtcatcatgctttccttccagaatctccttgaatccgcgaaccgtctccgtgatcggaacgtattttccttccagaccggtgaactgtgttgcaacagagaacggctgggataaaaatctctgaatctttctggcacggtttacgacaagcttatcgtcctcagacaactcgtccatacccaggattgcgataatgtcctgcaattccttgtacttctgtaaaatctcctgcacaccgcgcgccacctcaaaatgctcctgacccacgatacgcggatccagaatacgcgacgtagatccaagcggatccactgcagggtaaataccaagctctacgatcgaacgatccagaaccgtcgttgcatccagatgtgcgaatgtcgtcgccggtgccggatccgtaagatcatccgccggtacatagactgcctgtacggatgtgatggaaccgttcttcgtggatgtaatacgctcctggagcgcacccatctccgtctgtaacgtcggctgataaccaacggcagaaggcatacgtcctaagagtgcggacacctcggaacctgcctgtgtaaaacggaaaatgttgtcgatgaaaaggaggacatcctttccacctttgtcacggaaatactctgccatggtaagtcccgtaagtgccacccgcatacgcgctcccggcggctcgttcatctgtccgaacaccatggtcgtcttatcgataacgccggattccttcatctcgtagtagagatcgttaccctcacgggtacgctcacctacaccggtgaatacggaatatccgccatgctctgtcgctatgttgtggatcagctcctggatcaataccgtcttgcctactcctgcaccgccgaaaagtccgatcttaccacccttctgatacgggcagagaagatctacgaccttgataccggtctcaagcatttcctgcgacgttgcctgatcctcgaatgccggtgccggtctgtggatcggccagtgctcgacatccttcggcgcgtcgatctcatcgatcggattacccagaacgttgaacatgcgtccgagcgtattctctccgaccggcacgctgatcggtccgcccgtggcgattgcctccataccgcgcacaagtccgtccgtcggtcccatggcgatacatctgaccgtatcatcacccagatgctgggaagcctcaacgacaagctcaccaccgttctttaacggaacgcggattgcatcgttgatctccggcagcgcgccttccggaaacttgatatccagaacggcaccaataatctgggtaatcttacccgggcaatcctgactgcctctattatttgccatcgctatttctccttgtctgttattttctatcaccaaatcctgctatgcagcttcgcgcttccaccgccatccggcgccggaactttttgcactgctgcctcctaggatatcgcagaagctcccgcaataatctccgtgagttcctgcgtaatagagccctgacgtgctctattgaatttgagtgtcagatcactgatcatatcttccgcattgctggtcgcagaatccatcgcctgcattctggctccgttctcactcgcaaccgcctccaccagcgccccgtaaaacaggctggtgacatacttcggaatgatcatatccagcgcttcttcctcgttcggctcgtaattcatgagcaccttctcatccgccgcttcccgcatctcgtcctcgtcgaactccaccggaagaagcttgatgagcttcggctcatggctcaccgtattcttaaaatgcgtatacgcaagatagatctctccgatctctccgtccgtataggcttttaaaatctgtttacagagctccgccgcatcctcataggacggggactccataatcgaagatccatctgctgcaatctcatagccctttcgctccagagcttctcttcccttattaccgatggcgtagactttcgcattctctgtcgtgatgtcctcgcttccggtcaccagctttacaatgttggagttgtaacctccggcaagtccacggttggaagtaatgaccacaaccgcttttttgtcactctcacccttcttgagatacgggtgattgatcgtgccggacttcgccagcatggaagtcactgtccggtacatatactggaaatacgggttcgtctgctctgcacggttcttggctttctgcagcttcacggtagacaccagcttcatggcttttgtgatctgctgtgtactctgtatactgctcttacgtctctttatgtctctcatcgaggccataatacgcacaccgcctttctgccgtctactttgtgaactctgccttgcactctgtgattgcctttatgagcttcgcttctgtctcttcgctgattaccttctcagtgcggattgcttccggaacctccggatatttcgtatccacatactcgaacagtgccttctcaaacggaaggatgtccgcaaccggaatatccatcagatatttgttggttgccgcgtagataatcataacctgcttctcaaccggcatcggctgatactgcggctgctttaagatctccttgatgcgctcgccctgcgtcagcttctccgtcgtatccgcatccagctcggaaccgaactgtgcgaaagctgcaagctctctgtactgtgccagctcggtacggatcggcgccgcgatcttcttcattgccttaatctgcgcagaaccgcctactcgtgaaacggaaagacctgcgttgatagccggccggaaacctgcgttaaacatctctgtctcaagataaatctgaccgtccgtgatggagatcacgttggtcgggatataggcagatacatcgcccgcctgcgtctcgataatcggaagcgcggtcagggaaccgccgcccagcttatcggaaagtcttgctgcacgctcaagcagtcttgagtgtaagtagaagacatctcccggatatgcctcacgtcctggtggtctcttgaggagcaaggagagtgtacggtatgccgctgcgtgcttacttaaatcatcgtacacaacgagaacatcctgtccgttctccatccattcctcaccgatcgcacatccggcgtacggtgcaatatactgtaacggtgcaagctcactcgccgtcgatgcaacgatggtcgtgtaagacatagcgccgaactcttcgagggtcttaacgattgatgcaactgtcgatgccttctgtccgatggcaacatagatacactttacgttctgtcccttctgattgatgatggtatccagcgcgatcgctgtctttccggtctgacggtctccgatgattagctctcgctgtcctcttccgatcggaaccatggaatcaattgccttgataccggtctgtaacggtgtgtctacggattttctggagataactcccgatgccacacgttcgatctgacgatatttcgatgtctgaatcggtcctttgccatcaatcggctgtcccaatgcatttacgacacggcctaacatggcatcgccaaccgggacctcaaccacacgccccgttgtctttaccgtatctccctcgttgatgttcttctgggaaccgagaagtacggcacccacattgtcctcctcgaggttcaataccattccgtatacttcgcccgggaactccaaaagttctccctgcattgcattgtcaagaccgtgaatacgtgcgattccatcagccacctgaattacggtgccaacgtcagctacttccaactgcgctgcataccgtttgatctgttctttgatgacggaacttatttcttctggttttaaattcatggagcgcattcacctgctttcaactgtattttggataattcgcgcgtcagatcgtacaactttgtcctgaccgttgagtcaacgacacgatcgccaatgcgaatcatcattccgcctatgatcgcggaatccacttcataatgcatttcaaatgttacatactttgtggtctctaataagcgtttcaccactgctgccttctgcgcatccgataattccattgcagtcgtcacatatgcagtcccgatactcttatattctttgacctgatcatcaaaatacgccaaaaccttcccgatctgtgcaaaatgatccttttccacaatcatgcgcaaaagtcccaccagttctgcacacacctcaccggtaaaaatcgattcgatgatctttactttttcttcttttacgatcttcgggtgacgcatcagcgcgaaaagctccggattttcctccagtgcggtctgcatggctctggtctgctcccagatctcatccagcctgccgctctccactgcgacctcgaacagtgcatcaccgtatacctttgatactagctttgccatgtcgaatcacccatttcctttaatgtctcttccacaagcgcatcctgtaccgacgcatcgatatttgctgcaaccacttttgcagccatcatggatgcaaccgtgatcatctcctgtttgacatcatccatcgcgcgcttcttggaaagctctgcttcctcgttcgctctctggataatgcgggcagcctcttccttcgcttcggactcgatacgcgctgcattcttctgcgccttctgtctggcctcacttaaaatctgttcagcttctttgtcgatgttcttcaatctggcttcataatccgccttcaacgccgctgcatcttttttgtcattcgcggcatccgacaactctccggcaatcttttcccgtctgtcggcgagcatctttctgacaggattaaacagcagcttcgacatcatcatgaacaggaaaaatactgcaatcgccatgagcacgacatcgtggagcagctggaaatccagattaaagagtctggtcatctcttccaaggtccggcctcctttccgttatattcgttctctccgtctcttcctataccaacggttttacgaaaagcaggagcattgcgatcaaaagaccatagagacctgtcgtctccgcaaccgcctggccaagtaacatggtagacatgatgtcaccctttgcgcccgggtttcttcctactgctgcagctgcatgtcctgctgctataccctgtccaataccaggtccgataccggcgataaccgccagacctgcaccgattgctgagcatgctaaaattaaatcttctcctgtgatattcatactgataccctcctaaaataatctttttggtttcgacgtctattccgtctcatagttctgactgatgtaagtcatcgtcaacatacagaatacgtatgtctgaattgctcccgagaacaaatcaaagtatacatgaagcgccgccggccagataatcgctatcttgccaagcagtccgtatacaagcgccatcatgaccgttcctgacagtacgttcgcaaacatacgtaaggaaagagagatcggtactgcgatctcgctgatcaggttgattgggaaccagatcggcagccacggcggcagtggagaacacatatctttccagatctgcttaggcggcagattcttgaactgcgtgatatggatgagagcaaatgtgatgagacctaacgccagcgttgtgccgtagtcggcagtcggcggtctcaacccgaacaaaccggaaatattgctcataagtataaacacaaaaatcgtgctgatgtagttcacgaatttcggcgccgcaacttttcccattgttccatataccatcgcatccagtttctctaccatgatctccagaacattttgaaagccctccggaatttcctttgcatgtttcatcgtccgatttgccgcgatcgccagccccaacatcagcagcagcacaatcaggatgcagacatgcgatgttgtaatccagaccgtatgaccaaagatctcataggaaaaaatcccatgtatcatgaagtcaatattatcggcaccagaagacatcaaaattgcgttattcacaatttcacctccttatagagcttcattttctctgctgtccgaaggcacatcacctcttcctccaagctttgaaatgaatctatgtgcaaggggctgcagatacgctgatatcttcaatcccaaaacaccaataaatgctgccggcagactgccaagctcccacttcatcatcacgaaaaacacaatgacgaccaccagatacctggtaatggaccgggcgataatcttcgaccgggctttcgcctccccgtagatctcaaccgcatcccgcagaaccaccgccatattgaccgccatcccgcaggcaagggcaatgcctatggcaagtccggtagtaaatcgcagcttgtccggcacgaaccagattcccgccagaaaaaccgccgccccatatacaataattcccagaacaagaccgggcaatgcatcatttagtcttctcaacatgatcccgcttcccctcatctccctgtccgtagatcttcttagccatcttaaatatattattaaatccggcaagtgcgcccatgataaacaacggcactgttatgatgggcattccgtatttttcccccagccacgcaccgagcagcgtgcacatcacgatcggcacgatcatgttcagtccaaactgcagaatcagtgtcaaagactggaaaacctttcgctgatttttcatataaatcctcaccgtaccgcagtctctgctgcaaccattgcctattatttttcccataacaaattcttttataagtataaaagatttgtaaagaaaaatcaaccgacgcaaagaaactgttttaaaaataaatggatattctggaatttactgacacaaaaaggagccgccatctctggcggctccaaaagccctttttctacagctgaatcgtgacggttctgccggtatgttcgtatttctgtatatccacccctgcggcagagagcatcttccgcgacgcgatggttgacggcgtcccgttatacttgtcgctgtcgtaaaccagccgcttgatgcctgcctggatgattgccttggcacattcgttgcatggaaacagcgtgacatacatggtcgcgccctcaaggctccccccgcggtaatttaaaatcgcgttcagctcgctgtgcgtcgtgtaaaaatacttgttctccagcggttcgccctcgcgcgcccacgggaagtcgtcatccgaacagcccgtcggaaagccattgtatcccatggaaagaatcttgtgctcctcactgacaatgcaggctcccacctgtgtattcggatctttggagcgcatccccgacaaggtcgcaacgcccataaagtattcatcccagctgatataatctgtacgttttccgctcatgttcctatcactcccacctgcgtccgccgcatcaaacagattctatttcgtgccgaaaatacggtctcccgcatctccgagtcccggtacaatgtagccgtgctcgttcagatgatcgtcgagcgcgccgatgtagatatccacatccggatgtgcctcctgcatctttttcacaccttccggtgctgcgataatgcacatcaggcggatattttttacgcctttatcctttaacatctgaatcgccgcaaccgaagatcctcctgtcgcaagcatcgggtctaccacaaacacctctctgtttgcgcagtctgccggaagcttgcagtaatattctaccggctctaatgtctcaggatcacggtataatccaatatgtccgaccttggctgccggaatcatgttgagcataccgtccaccatgccgagtccggcgcgtaagatcgggacaacggcaagctttttgccctttaattctttgaccgtggtcttgcagatcggcgtgttaatctccacatctgtaagctttaagtctctggttgcctcgtagcacatcagcattgcaatctcgctgaccagtgtacggaaatccttagaaccggtctcctccctgcggataattccaatcttgtgctgaatcagcgggtgatccataactactacttttgacattttttgtaccttccctttctgatacacagagcctagtctgtgccgttatcttcactttcattcaataggttcacaagctttaagatcgtcttgcgcatcgtctcataacagagtccgtatgcctgaagcgtccccccgtagggatcgatgatctcaagttcgtctcctaccagttccgtaagaacatagacattctccggatcggcgtgcccgtacttttccagaatcttctctctctggctgtgttccatgactaaaacgagcgcatcctccgaaaaatcctcctccgtcaactgggtggacatgaatccatccatattgataccattgcttatcataacagtttccgccttctgattcaatggttccggaaataaaaccaccagtcccctggcaagtatttccaccggatgttttaaattgcattcctgcagaattcctgcagccataggtgctctgcaggtgccgctttctgcaacaaatatgattcgattatattgtctcatagaaatgtctgccctctccctgatgtagctataccggaatcacctgatgccccgccgccttcagcagtcggttcataattgcctgaccgatgcgcggtgtggcaaaactctccgagtagatcgcatccacattccagtcatcaaactcacgcaggatcttgtacaagtgtctggcaatggcatcctcatcttccctggcgccgatgctgacaacgtgatccgcctcatagcgtaaaaacgtctcatccgtagcgatcactccgactttctgtccgagctgctgcttttctctgaccagctcattgattctggcaacgaccttgtccgtctcgccctccaccagcacaagatccgccttgggcgcataatgcttgtacttcatgccgggcgctttcggctttctggtggaatccgacgcaataattcccggatccatgcggacttcctcgccgagaacctcctgcagcatctcctgtgtgatatatcccgggcgcagaatcatcggtgtctcctcactcagatcaacgatcgtcgactcgatcccgatgccgaccggacctccgtccagaatcatcgggattctgccatccatgtcaagcgccacatgggatgcctcggtagggctcggcttgccggatgtgttagcgcttggcgctgcaatcaggcatccgctcccctcgatcagccggagcgctaccggatgcttcggcatacggattgccacggtatccatcccgcccgtggtctcataaggaactctgtcatttttccatacgatcatggtaagcggtcccggccagaacgcgtccgcaagcttcttcgcctgcggcggtacctccctcgcgatcgataccagatcttcaaactttgaaatatgtacaatcagcggattgtccgaaggtcttcccttcgccgcataaatctttttcgatgcctccgggtgcagcgcatccgcccccagtccgtataccgtctccgtcggaaatgccaccagctctcccgcgcggatcagatcacacgcctctttcatggctgcatcgtctatattcgcagaatctatcttaacaacctttgtctgcatattattcgcctctcaattgttgtgcctttgcggccgtcatatgcactgtctcctgacctgctttacagtgcgtgcatgaccgcttcgctttcgtgaacattattgcataatttcacgatttaggcaagtttgacatttcgcccgctatgggcattcttccgaaaatagggcaattcacttgccatgtttttgcaaatgtggcataattatctgcgttaggtttgtcctgatataaatggaaaggagtttcctatgaagattacaaaatcagattttggcacattaaacacaggagaaaatatttatatataccatatggagaacgcaaacggcgcttatgtggaagtcatcaatttcggctgccgtctcgtaaagatcgtggttccagaccgcgacggaaaaatgacggacgtctgcctcggtttcgattccatggaagattacgcgcgcgacaacgccagcctcggcgcagttgtcggccgtgttgccaatcgtatcaaggacggtcatttctgtctggatggcaaggaataccagcttgccatcaacaacggctccaaccatctgcacggcggactgatcggctacgcttctaagccctgggacgcaaagatcaaggatgacaaactcattttaaccatgaattcctacgacggcgaggaaggttatccgggcaatctcacactttccgtaacctacggctggtcggaggacaatgagctgtcccttctctacgaagcttccacggatgcggatacgctgttaaacgttaccagccacggctatttcaatctgaacagtgaaggctccagtgaggttttatcccacgagcttttcattgacgccgatcagatcacagagctcgatgactcacaggcaccgaccggcagattccttccggtagagggaacgccgtttgatttccgctccatgcacaccatcggaaaactgatggattccgactacgagcagtatcacaagttcggcacctacgatcacaatttcgtcatcaatggcaccggattccgtgaggcagcggttctccagtcaaaggagagcggtatccgcatgacatgctttaccgatcagccgggtatgcagctgtatgtggcaaaccagccgatcgaggtcaccggcaagaacggtacgcaatatgcctgccatacgagcgtgtgtctcgagacacagcattttccggacgcgatcaaccatgacaatttcccgagcatcgtgctgacaccggatgagccgttccgttccaagacactgtatcatttttcaacattctagcagaagctccagcatggaatatatttcgtaacagcattatgtgctaatttaagtacacggcttttttgacttgaaagccgtgtatttttgtattagaatgtcttaaaggttatctataagggtagccgggttttgattacaaattaaggagggaatttaaaatggcatacgttatttctgattcttgtgtaagctgtggaacatgcgagccggaatgtccagtaggagctatttctcagggagacagccagttcgtaatcgatgcaggttcctgcgttagctgcggaacatgtgcaggagtttgtcctacaggagctatcagcgagggttaatctttcgtacatagccaaaagccgtcacgcttgtgacggctttttctttttccagagtttcttttctttctgttcgtcctttttgcggatatttccacggatcgcagcatccagcctgcggaagcggtcctcctctgcttcctcccgctcccgcatgaggtaattcatctccttgatcacctgttttcctacctcctcgctgatgctctgccccagttcttcattgttggcggcaagcgcttttcccacaatctcggtcatcagttctgtgaactgtgccatcttatccgtattgtttagaatactctgcgggctctcggcggtcgtttttaccggaagctgctggggtgcagcggactgcaccggctgcacggattgctgcaccggctgtgccactgctgccggctgtgccgcgaccggttgtaccggctgcacggattgctgcaccggctgtgccactgctgccggctgtgccgcgaccggttgtaccggctgcgggattgcagcggccgctcccgcaaaaagcggtgcctgtcccacgggaatcggtgcttctgccgtcagcccctcgatcggtccgttatgtacaatcatgcgtatcgccttcaactgatagccctgttcctttagttccttgattctctgaaattccgcaatgttttccttcgtataataccggtgtcccatctcattgcgcgggatattcagttccagttcatcttcccagtaacgtaacacatgtgattcgacgtggacgatatttgccgcatcggaaatcatataacgtaccttttccatacaccctcctatattgtaattccttaacttatattataggtgtatcgattcttccgtacaacaaaaaccgctcgtcttattgcgacacaaatcgccggtctttcttatttttcacagaactaggcgagtgttctgacccacgcctccatctgcgctctgtcatatccgttcaacatcttaccgctcttccagttcacgctgtccgggcagagtgcatgcagcactgcttctgtttttcccataccgcttccgccggatgttgcaaacgggatcaccgtctttccggaaaaatcatagctctccaggaacgtattgataatcgtcggcgcaacataccaccagatcgggaatcccacatagacggtgtcgtactgctccatatgctctaccttgtccgcaatcgccggacgcgaggacggatcgttcatctccaccgtgctgcggctctttttgtccatccagtccaggtctgccttggtataaggcacctcgggacgaatctcaaacagatccgctcctgccacatccgaaagcagctctgccgtcttctttgtgacgccgctgcatgaaaaataaactacaagactcttctgactcatcataatcctccattcttaactcttttttctataagttaaaatgtttaaaacaaccttctctagcggtaagacttctcataaatcgccgcgcactcttcgtctgtcatcggcaccggatcacaggcaaacagtccacccatcgtcgcctttgcattcctggcgagaaccatgctctcctctttttcgatgccgtaatcggacatctttaagtctgatacgccgcagtcctcctgcagtttctttaacgctgtgataaaatcctccggcgccttggcatctttcatgccgagtgcctgcgccatgcggacaaaccgctcatcacagcagtgtttttcgataaagtgtctgtaatactccaccgaaatcataatcagtcccgcaccgtgcggcagcgccggatgaaatgcgctcatcgcatgttccatcgaatgttcgcttgtgcaggaaccgaccaccatcgaatagccggacatcgtattggcaaatgccacatgctccctggcctccagatcgctgccatcctttaccgcgcgcggcaggtaggttccgatattctcgatcgccgcaagctggaccatctcagacatcgggctgttcacaaccgagaggtatccttccacgctgtggaacagcgcatcaaacccctggtatgccgtgaattttgacggtacggtcagcatcagctccggatctaccaccgcaatcaccggaaacagctcatccatgccgccgcagccgatcttctcattcgttgccggattggtcacaacgccccactgatccacctcggatccggttcctgccgttgtcgtgatcgcgatgaccggaagtaccggattcactaacggctgctgctttccggttgctcctgccacataatcccagagatctcccggctgctgcgcatacattgccatgactttcgccgcgtccataacggagccgcctcccagtgcgacaatgaaatcgcagccttccttcttggcaaaatgtcctccttcctcgacgatctccttgaccggattcgctccgaccttatcatacagcacaacctccacacctgcgagggaaagctctttcatcgtacggtcaagtgcgccgctcgctctggtcgatttcccgtttgagatgacaagcattgccttttttccaagcatcttctgctcgtgtaagtgatttaactgtcctgctccgaacaggactcttgttgggttataaaattcgtatgacatccttcgttctcctcccatgtcagttttcctgttttcattgcctcttcgtagcgtgagatcttgtaattcagacgtttcctggtctcctcgatctgccgctgctgttcctccagaagttcccgctgctccaccagaagctgcaatctcgcagggatcgtcttatcgccctgctgaaaaagctttacatattcaatcattgcctccaccggcagacctgccctgcgcatgcagatggcaagcgaaacccagctctcatccttcggaccgtaatcccgtattcccgatgccgtccgtgtgaccggcggaatcattcccactcgctcgtagtagcggagcgtatccgcggtaatatgatatttctcactgatttctttaattgtcatgtcctctgctcctttccggtgccctggaactctctgttcgttaggcattgtaagccctggagttcactccaagtcaagaggtttttgtaaaatgtaaacgtaaattcttcctataaccctttataacgtgtgatgacattctccggcttctccccgcagataaaatagtagtcgagctgtctctcgccttccgcgtagagatattgcccgtacgtcttaatatcgcagagcagcaccgtattttttgccgccgcagcgatgccatagccgcggttcgacagcacaagcggcattctatgctttttccctccgaaggatatataacgcgcatttaatgtcacatccagaaaatccgtatcgagcatgccctttgccttgatgcgctctttcttgtcccagtcgaaaaatacccagcttccctcctcgccgatcactctcggctccgcggcattttccgcaagcagaagctgattctccctgttccagaaagagaccgctccgctccgtttatctacccgcaccgtaatctcacccgcggcaatctcaacaacgcttttggattccctggcgctccatgaaaacgcttcctccgctttggtcatccagcccgtagctgcaattttttccgtcactccttttacaaagctgacccggatgatgtccggagcgaccggcgtaatccgcatcagcccgtacatgctcgccatctctacataggatctgctcttttttacccaccggaccgcatgatttccctttgcgtgcccccgaacgcgcagactggtattctccgggatcgtcccgaatgcatacggggacggattggttccctccggtcccggacgcttccctgccggcgccggagacgtcgccatatcctgctgcccgcgcactgtctctgcctgtggacggtgcattgccccggtctgcggacggtgcactgtctttgcctgctgcccgcgcactgtctctgtctgcggacggaccgccggggatgccgccggtcttatgaccggtttctcctccgccgcaggcgcttttgccgcaatgcgtctggggccgaaatattcccgctccgccatatccatggcgccttccaccctgcgctgctgcatctgttccttttttgtccggacaggcttctcatactccctggcttttgtgagcggttccgccgcaaattcctttatatgcttatcctgcggcgccctgcccgcaagaattccggacaactccccccgatggagaatcgtcagctcatgcagcgcgcgcgttgccgcaacatacaacagctttacatgaccgttgtccgacggatattttttctccgacgggtcaaacagaagtaccgcgtcaaactccagccctttcgtgtaggataccggaagcaccatgacgccgtccccgaactcctccgtctctccttttgcgccgttctttaccggaacgtcctctgccagccgggccacaacccgctctgcctcctcttcatcccgacagatcaccgcgatggtctcgtatccttttctctgccagccctgtatcgtctccgccgcccggttaagcagcgcccgctctccctgcaccggttccacacagaccccggcgccatggcggatgatcggttccaccggatagatggaaaaatccccgtggcgcagaatctcgttcgcatatgtagagatctccaccgtgttgcggtagcttttccgcagaagcccaaaggcgtcatagtcgccggtcaggatgagtctgcgcagttcatcccagtcattcaagccgtactgaaaatggatattctgcgaggtatcgcccatgatcgtgtaggtgcagcccgacaggcacgcatccatacaccggtatgccatcatcccgaagtcctgcgcctcatcgatcaccacatggcttgcctccctgaccgggtctgtctccttgatccgcttgtagatataggccagcgccgccagatcatagacgtcaaaggaattccccggcggggttacttccctgccacgggctgcctgcgccgccaggaaatcctgatagaacgcatagaccgatccctcccattttccctttccaaaatacatcgtgtatttccggtcgagccgctttttctcttctgccggaaacgtgatgtctcttcccaggatctcattctcatatctggagtggacaatctcccccagcatcagcattttgctctccatggaatccgccggatgctcctttagatagcggcggatctcatccgcaccgatcagaagctttcccgtcttttccagataaatgtcctccgccggcacgctctctttttcatattcttcacagtatgctttcaaatcgagaaaccactccgtatcacacttgacgctgttttccggatcgtctctctccatactgtggtacgagtagcgtgcatcgtcccagtcttcatataaaagccggacgaacagctgctccatcgtcagctgacggattccatacacatccagttccgggagaacgctcgtgatatagttcagaaggatccggttgcttcccacaatgtaaaaatcctccggccggaaatcatccttatagttatacaaaatgtaggatatgtggtgcattgccacggtcgtttttccggaacccgccacgccctgaatgatgacgttcgtccgcggcgagcggcggatgatgacattctgctccttctggattgtcgcaatgatctctcccaataccgcctttttattctttgcaaggtattttgtcagaagttcatcattggcaacgacatccgagtcgaagaaatccttcagcacatcctgttcgatctcgtacgtccgcttgcgcaccagatccatctcataggttccctcggagcttaccgtataagtgcagggtcccatgctgctctcgtaatataccgatgcaatgggcgctctccagtccagcaccaccggctctgagccgtttttcgcaattccggctcttccgatataacaggtctcctcctcctgggagatgccgtccttaaaatcaattctcccgaagtagggcttttttctcgccttctcatagcggatcagatcgtattcattttcctttaatcttgccgtcgcattattccagagtgcaaggccttctttgtctttcacgtcgtatgtctcgagaagatccgccagatcttcgttaaccttgcgtatgtccgccccggcgcgttccagattctgctgtgcaaccgagatcacgtccgccaaatgccgctcctcgtctgccctggtcagccccaggtatccgcttttctgttcttccgatgtgctgcgcttatccatcctccgcttcaccccctgtctttttactataccaaaaaagcagagataccgcattaccaaatgcatcaaaggtatctctgcttttctttttctattaaaatataacggaaaaccggttctctaccgcaccgcctctgcctctgacaatctctttctgccgagaactccgcgtgttccaagcaaaagcagcagacagacgacagataagcttccccccgcaagaaggtattttcccatcccggcggtaatcgcgctgatctcaaacagcgacggcaggatggcgagaccgccaaaggttcctatcaccatcgtgatgcagatgaaggtacgcaggccgttaaacggaatacagctcttcaccacggctgccatggaaataaagatcagcagaaaatacatgactgtctgccgctgctccaccgtaaacggagcaatgatactggtgactgcgaccatcgccgtgactgtgagggcaaacggcagcgcattggataacgccgtctttaagaatctgccgcgtatcttgcgcgtgtcggattcccagatggtaaggaacgacggatacccctcgattgccgcatccagcacagtaatctgaatcgggataaacgggaacggaatgtttgccagcaggcagatcaccgaaaccagcaccgagtagatggtcttgataaagaagacgctcgccgttcttgtgacattgttcacgactttccgcccttccatcacaacctgcggaagattggtaaaatcggaatccagcagtaccacctgcgcgacctggcggctggcatcgcttccgtccgccacggcgatggagcagtccgcctcccgcagcgccagaagatcattgactccgtctcccgtcatggctacctggtgtccctgtcgtttcagcgcacacaccagttcctttttctgtcccggcgtcactctcgcaaacaccgcgtactgctggcagatctgctcatagtcaatgtcctctccgagcgtcgataaatccacggcatccttccaccggtgcagtcctgcccgctttgcaatcatggagaccgtcttgacatgatctccggaaattaccttgacgtccacgccttcccggtggaagaagtcaagcgtctccctggtgttctcacggatggtatcctccaggacaaccccgtagagcggctgtatctcttccggcagcgccgcttcgtcctcccactgcatcgggacatagcccacaatgataacccggcatccctcttccagcttctgttccagttcccccggcagctttcgcatcagcttttccggagcgccgacaaaaacgctgaccgctcccgcaaaactgatacatccccatttgcgctttgatgaaaacgaaatcttatgtgccggtgtataaaatgcctgaccgccaaacgcctctttcagcgcctgaaatgtcgcattgttgtcgtcggaggccgccagatacgactgcacgagtttttccggttcgccctgcggcagcgcctttcccaagagccccgcaccgatctccatgacagtgtccaccgtaagctttccgtttgtaatcgttcccgtcttatccagacacagggtatctacatgcgccagtgtttccagcgaataaatattctgaacgaggatcttcatttttgccagccggatgactccggtcgccagtgaaatcgagattaaaagtaccagtcccttcggcagcataccaagaagcgccgcggcggacgacaccaccgcttcccgcatgggcgcctgccgcagcaggaaggcctcgaaaaacagaatcacacccaacggaacaatcagcatactggtaaaccgcgttaccttattcatagagccaagcagttccgatgccacacgtttttccttttttacttcgttggcaagctttgtagcataattttcatttccgacatgcgtaaccttcgcatatgccttaccggaaatgacagagcttccggaatataactcacttccagcctccttgaccactgcatcactctctcctgtgagcagcgattcattcacttccagcatgccttccacgaccaccgcatcgttgcagatctgattgccgctctctaacaccatcacatcatcccgcacaatctcatccaactccacagccatattctgtgaatcacgccggacgcacacgctcggacggttcaggatcgacaggtcgtccaccagctttttcgccttcagttcctgcgcaatcccgaccgcaatatttaagagaatcactgcaagaaacagcatattggtgtaagcgcccaccgcaaacaaaagcgctgcaatgataaagttcagcaaattaaataacgtaattacattttcacgaataatctgcgccctgctttttgtaatacgctctgcggcagcgccgccttccccgcgctcgcggcgctcctgcacttcctgcgcggacagtcctgtcatatctgtatccatgatctgctcctcctgttttcctctggatcgtagtgcgaaacattttccaatcatagcatgcacaatagccgctttcaacaactgccaatgtttccatacgcaccagcctgatttctgtaccttttcttgatacctgtgtaaggtactccccataagaatggaactgccgcaataagcatatcgcgctttggggtgataagtaatattacaggaaaaccagagacaaaaaagttccagaataaacagacggcggcaaaatctttgaagcaaaattcgtgtatttcttccataccgcggctggcatcccattccgtgtctttgccacgtttggacactctaggagtgtgtccgacaagccgcagacaatgagcggactttctggtgtccctaatggcacctcttcacagacaatataaaaccgcgcgaaccgaaactcgtcggcatctgctattgaaaataaggcagatgccgactcagacatcggcttcgcgcggttatgttttgttcagaggtggccataagggacacacacaaaagtcctaaaattgtctgccggcttgcggacacaatccgtagagtgctccaaacttggaaagacatggatcatcacggatgccagctgcggcatggttagaaataccagattttgcggtcagatttgccgccgcatgtttatctggaacttttaagtatctatttctaataatattacttatcacccaaaagatgtctatgcttattgcggcagttccatcctattatttttccatattcgcaaactttgtgtactgcggcagccataccagattgacggttccgatcggaccatttctctgcttggctatgatgatctctgagattcccttcatatcggaatcatgattgtaataatcatcgcggtaaatgaacattaccacatcggcatcctgctcgatggctccggactcacgcagatcggagagcatcgggcggtgatccggccgctgctccacggctcgcgagagctgggagagtgcaatcaccggcacggaaagctccctcgcgagtgccttgagggatcgggaaatatccgaaatctcctgctgacgggagtctgttgacttcccggaaccggacatgagctgcaggtagtcgatgatgaccagcttcagatcatgctctaatttatattttctgcacttgcttcgcatctcggagatcgagatacccggcgtatcatcgatgatcagctcggaattaccgatggttccggctccctcgatcagcttctcccagtctgcatccgagagattaccagtacggagcgcctgcgcatccactctggactccagagaaaacagacggttgacaagctgctccttggacatctcgagcgaaaagatggcggtacacatattttcgtgaaatgccacatactgtgcaatgtttagtacaaacgccgtcttacccatagacggacgcgctgcaatcaggatcagatcggacggctgcagaccagcggtgcgataatccagatcaataaatccggtcggtattccggtaaccgttcctgaagtctttgccgcgttctcgatcttctcgagggcattcataacgacctgccggatcggcacgtagtcgccgcctccgccgcgggtggagagaaggtcgaataccttcttctcggtgatatccatgactgtctcgacgctttccttgccgacataacactcattctcgatctcttcattcagcttgatgagctttctgcgcatcgagttgtccttgacgatctgtgcataatacttcacattcgccgaagtcggtactgccgtcaccagatcccgcacaaactccagactcgcaatctccggcggaacatctttttccttaagcttgttctgcagtgtcaccagatccacagggagacctttgttgtacagttcaatcatcgtatcaaacaaaatcccgtactgcgtgtggtagaagtcctcgctgatgagcatctccatcgctgtcacgatggcatccttatccataatcatggaaccgatcacggactgctctgcctcaagactgttgggcataatccgctttaccagtgcctcttccatgaaataaacctcctgctactcttctacaacatgaacggtaaatgttcccgttaccttcggatgaagcctgatggcaacctctgtcatgccgaagcttctgatcggctccggaagctgcatctttttcttgtcgagctccatgccgagctgctcctttgccgctgccgcaatctccttcgtggaaacagatccgaaggtgcgtccaccctcgccggctttcatcttgaccgtaattttcttatcctttaattcctccgcaagcgcgagcgccgcctcgtaattctcctgtgcaaccttgtctgcatgctgattctgcaatttcagatcattgaggttcttcggtgtcgcctcaagtcccagctttttcggaaaaatcgcatttcttgcataaccgtcactgacattcaccacgtcgcctttttttcctaatgcctttacatcctgcaataaaattactttcatatgatcctcatttccgcgcattctgctgcgcttatcttgtatttcccaaatcgtattattcctcgatgtcgccttcttttaacatctcgtcgatcgtatcctgaatgatgtgctttgcctgcagcaccgagcagtctgtcaactgcgcgcccgccacattcagatgaccgccgccgccgagccgctccatgatgagctgcacattgatctcgtcaatcgaccgtgagctgacataaatcttgccctgatattcggtcagcacaaacgatgccttgataccgacgatatttaacagctcgtttgccgcctgtgcgcccacaatcgtcgggctctccacattatccgccgggcacacggagatcgcaaatgcaccgcggtaaacctccgcgtggcgtaccgcctccgctcttgccttgtaggccgccatgtcgttgcgcagcatcttgcgcacgcgcgtcacttcggctccggctcttctcagatatgccgccgcctcgaaggtgcgcacacctgtcttggtcataaagttgttcgtgtcgatcagaataccagcgtagatacagtctgcctcatgcggctccagcttgatattctcggaaaaatactgcagcacctccgcgatcatctcgcaggcgctcgacgcatacggctctacataggaaagcaccggattctcgatgacctcgctgctctgtctgtgatggtcaaacacgcacaccgtatccgtgcgttttaacagctccggacactctgtataactcggccggttcacatccacaaccatcacgagcgtatcgcggttcgtcagaagaattgcttcctcgctcttgataaagagatccgccggatagcctttttcctcggaaaatccttccacaagcggacgcagggaagatgtcacctcatttaaaacaatctgcgcctttttgccgagcactctggctgcgcagtacacgccgatcgcagcaccgagggaatccacatcgctgatgctgtgtcccatgataatcacatgctcgcggctctcaatcacctcccgcagcgcatgtgccttgactctcgccttcacgcggttgttgcgctccacctgcttgttggtcttgccgccgtaataagtcacatcctcgttgtcgcggacaaccacctggtcgccgccgcgtccgagtgcaagatcaatcgccattctggcgtactcgtaattcttggtgtaggaatcgccgccgacgccgataccgatgctgagcgtcactgccatctcattgccgacttttaccgtcttgacgtcctcaatgatgctgaaacgatcctcccggagctttccgagatattgattcttaaagacaacaaaatacttgtcattctcaatctttctgacgagtgcatctatctctgtaaagtatttgttcaccttccggtcaattaacgctacgagcagtgaccgcttgacgtcctcgatactgtcgagcgcctcgtcataattgtcgatgtatacaagccccgccaccagacgctgttcctcgttctcgcggatataacggttcaactctgtctcgtcaaacaggtacatcgccgtcagatattcattgctctcatcgagcgatacaatcgtactgtcgtgtgtcatggcatcgaaataaatccgctttaacgccacacggtaataccggtcattgtatgtcagattgatcgactccaccggctcgctccgctgcaacagctccttggtcagcgtcgggaataccgtcatgaccgacttatgatacttcttgtcttttcctgtgacctccgtaaactgctcattcacccacagaaactttgcattataatcaaccagtgcatacgggatttcaaactcatttaagagctgtttctgcacgagaccgtactgcgtcgcaaaattgatcaactcatcgatcagaagcggcttattgcgcagataagcgatcagcataatcacaaaatagagcagtacaaatccagaaaaaagcactcctgaagaagtgtcttccatatacacaaacacattgatgataatcagaagcattgtaagcagcagcggcagatacaaatatgtacgaagctttcctttaatctttacgttactttttctcacaagcaagcctccatcattctatacaaaaacactatcataccgtgcattataccattttgaccgtgcaatataaagccttttttgcccgaaaaaagactgcccacaacaagttggacagtccaaaatttcagccgctatatctagttggtttgcgctttatctagttgccttgcgcttcgcttccgccatcttcctccggtgcgagtgtcatataattccccttatccatatcgtcgataaagttgttggagatgatctgcgtaccgtcctgcggctccacctcatccacaacctcactcagatctgtctggtatcctccattcggattataatggcagatacggtatccatcttccgctccacgaccatattcctggtaaataatatcatgccagccgttcgtcatgcgctcactgactgtcaccggcgtgtggattccctcaaacgactcgatcacctggaacgttccgtccgcctgttccgataagatcagcgccggatcaccaaacgatacctttgtatactcaccgaccacgacaacgaaaatctcatccgtcccatcctcattcagatcgatgtgattatagtaataccgggttttgctctgctcttcgttcggaatctgataataagagatcagaaactccgccagtgccggatccggcgtctcctccgcgtactgcgagaccactgtcgccacatcctccgcatcctccgccgcaaggaaatgctcttccagcacctgctcaagcgtctgctccgtctgttccacctgctcggtctgcgccgcctgctctgcctctgcgccattcccgccgcatcctgccagcatcagaaccattgtcagcgtgactatcgttttgtaccagtgtcctctcattcgcgttcccactcctctgcacctcttgcacttacacatacccataatattatatgattcttgtctcatttccaagcccatttttctattcttaaggaaagttttagaatcagtggcattacgaaaatgcaatcacataaaaaagaccagcaatcggaaggattgttggtcttttacttatcagcttaatcgctgcgattatgcgaagcttattcgctgcgattaagtaaaacttattcgcatacgtacggcatcaatgccacgtgacgtgctctcttgatcgctacagtgagcgctctctgatgctttgcacagttgcctgtgatacggcgaggaaggatctttcctctctcagagatgtatctctttaacttgttggtatccttgtaatcgatcacattgtccttaccacagaatacacaaactttttttcttctatgcatcgggcgtctcttcattggagcgccttctttgtctgctgccttattgaaagccatgataattacctcctgttattatcgtccattagttaaatggtaactcttcatcaattccgtccggaatattcatgaagccatcacctgctgcactgctcggtgatggtctgtcggaaggggtaaaaccggaattatctccgccgccggaagcattcttgctctctgcgaactctacattctcagcaacaacgtccgtcgtgtatacacgctgtccgtccttgttggtgtagcttccggtctgaatacgtccttccagaacgaatttagttcccttacgtccgaatctctccagaaactctgcagttctgccaaatgcaacgcagttgataaaatctgctgtctgctcgtccccgtcacgacggaaacggcggtctaccgcaagcgaaaatcttgcgatggcggtggagttctcaccctgtgagtaacgcacctctgcatctctggtcagtcttcccataagaatcactttgttcatatacgattcctctcttccctcaaacaaacgttatcagttcaaagaatctcttatttctcgtcttttctcacaactaagaaacgaagtacgttgtccatgatacgaacatcctgctcaacttctgctggaacagtcggctctgcatcgaactgaatgaagtagtaataagcttcgctcatcttctgaacttcgtaagctaacttcttcttaccccagtcctctacttctgttacagtaccgccggcacgagtgatgtactcttttgccttctctactgtagctgttctcgcatcgtcttcgatctttgcactgacaacgagtgctaactcatacttattcatgcgaatttcctccttttggtctctggcccacgttttcattacatgagcaaggaataattattatatcacgagtatctactataacacgttttccctgtaattacaagtgctttcttgaaaaaagcgcaaaaaactgcgcagcgagcctattccgtctcccccgccttgcgcagccctttggtatttttctccacaagctttctcgcaatcatgatctgatgcccgcaacccgtacatttcaggcggaaatccgcgccgacgcgcagaatctcccactcactgctgccacacggatgctgctttttcagctttacgatgtctcccacttcataatggtactggttcatggtcttcctcactttcctaatgtagtgatagtgtagcatgtttcgctccgctgcggtagaaaaaaatttcattcgcctggcgcccgtctacacctcaatctgcccgaacacatcgccgagtcccgcctgaatcagcagatctgccctcgcgtccatcggcgtcgtcgatttgttgattaacaccagtttatttccccggtaataatcgatcagaccggctgccggatataccgcaagcgatgttccaccgataatcagcatatccgcatggctgatataaaataccgcatcctccagcgtctgctggtccagtccttcctcatagagtaccacatccggcttgatcgtaccgccgcaggcatcgcacagaggtacttttcccggataatccctcacatactccgcatcaaatcccttgccgcacttcctgcagtaattacggtgcacgctgccgtgcagttcaagcacgcgcttacttcccgccagctgatgcagaccgtcaatattctgcgtcacgacggcttttacttttccggccgcctcaagctccgccagctttttatgcgtgatgttcggttccgcgtcaaggcagagcattttgtcccggtaaaaacggtaaaactcctccgggtattttatataaaaggaatggcttaaaatcgtctccggcggatagtcatatttctggttgtaaagaccatccacactgcggaaatcaggaattccgctctccgtagatacaccggctcccccgaagaatacaatattgtccgactccttcaccatctgcaaaaattgttcgatattcgtcattgactggcgcctcccatcccactgcgattttctctatcatacaccaaccgcacgccaaaatctattggtattccgtccgcagatccggaaaacgttctctaaaacgcaaacatcagctacagcagaacccaggtcttttagataaagcaaaaaaacagcagtcatgcgactgctgcctaaaaagttgcgggaataggatttgaacctatgaccttcgggttatgagcccgacgagcttccagactgctccatcccgcgctatatgcaaccaccattgcttcctgtatcacaatgtccgttgcttgttaacataatgtattataactctttcgtacccacttgtcaaatccgcttccgcaccctgctttttcctgccttactctatcattatatgcagagctgacatcctatagaaccgattttttcatttttctgttttcacagacatttttgcagaaaaaatccttcccgggcgcagccacagccgccggctgctcacatatatcccgccagaataatgcttgcgacggttcccgcagtggttgcgatcagcgcgcccaccagcgtgtaacggctttttttgatccccgccgccataaaatagaccgacatcgtataaaagatcgtctccgtgctgctcatcatgatggatgccatctttcccaacatcgaatccgcgccgtactccttatatatatccaaaagaagaccggtcgccgcagaggacgagaacattttgaccaccgtgaccggtatcagctccggcggaaaacccagccagccgatcccccgtcctagcagcccggaaaaacactccagaaaaccggaagcccgcagaatcccgaccgccaccataagcccgatcagtgtgggcatgattccgatgaccgtctgaaagccgtcctttgccccgtctatgaattcttcatagatattctgtctgttcagaattccataaccgacaataccgaaaatgagaagcggtatcattatgtccgatagaaaaatcattacgcccatgatacatccagaatcttccgttattctactatatggaatccgaacggtaaatattcatattcacgaactttcgggctgcggcatgtcatgctgctcttcctcatcgtgattcgtcagcttctcatactgatcctgcgacatcggcctgccaaaataataaccctgaatatagtcgcatccgaggtcatttaaaaaatccacctgatgcttttcctccacaccttccgcaatcaccatcatgtccagagattccgccatccggatgaccgcctcgatgatctttgcacccttttccgcggtattccccttagagaagaacttcatgtcgatctttaacacatcaagatccacgtcctttaaaatgtttaaggaggagtaaccgctcccaaagtcatccatcagaatcgtaaatccggcgtcatgcagataattcaccgctctctggatcagttccgcatcctcggaaaagacgctctccgtcagttccaggttcagataatgcggaggaatatgatagcggtggatgaggtcaatcagggaatccataaaatccgggttatagaggttgactctggatacgttgaccgaaattggcgccggattccttccctgggaaagctcactgtctatgaactggcagactttctcccacacgtaatagtccaacttcgtgataaagccgttgcgctcaaagatcggtataaattcgttcggaagcacgatctcaccgctcggcttcttccagcgcaccagtgcctccgctccgtacggagccatctttttcagctggtacttcggctggaaatagacgataaactgctgctctgccagcgcggcatccatctcgtcaatgatatgctgttcgcggagcactttctgtccgatctcctccgtatataaaacatcgtgaaccatgtactgacccttgcactgtgccgccgcaatctcagcgttgtcgtgcatcgccgccacttccatatccggatcgtccaccagataaatgcccgcgcaggtctccagataataatgtacggaatgtttccggatctctgcccggattccttccagtatgtgatagatcgccgcaccatcttcgtaggggacacacattccgaacacatcgccgccaaggcgtccgtatgtgcctctgccgtaagctgtcatgaccttgcggatggctcccgccacaaaatggatcagccggtctccctctttggagccgtagagggtattgataatccggaaacggtcaatgtcaaaatggataaaagcaaaattcgctcccgcgcgctggtctaaaagttcgcgggtcgcctggtagaacttctgctgtccgtaaataccggtaagaaaatcatattccagaaaccgcaccttgcttttctcgatggcgtttcctgcgcgcagtctcatgatcccggggctggatttcttcaaaacaaaatcccatgcaccgagctccagactcttctgctctctctccgggtcgtcttctgtcgtacacaccacaaccggaagatagctgtactccttccgcttccgatgcatctccaaaaattcataaccgtccatcacaggcatcatcagatccagcataatcagcgaaatctgcgctctttttctggaaagaatctccaacgcctgctttccgttacatgcttctaggatgtcgtaatccgatctcaaaacatccgctactgccatccggtcctgctgacagtcatctacgatcagtacatattttcttctacccatacaagcccccgtaccttgaaacacgatctgcgtttctcctatgtactattatagttttttcgtttcctttcagcaacgtttttttaacttacaaaagataattgccgccgcggtactacatatagtcgcaataagtcccggacccactactgctgcgggattgacgctcccgtactggctccggtacgcgatgatattgaccggaatcagctgcagggacgagatgttgacgatcagaaacgtgcacatctcatccgtggcaatatccggtccgcgtttccgcgaggttcctttttgtccgcagagttccaggttacgctcctgcaatgcctccatcgcttttaatcccgccggcgttgccgcccagccaagtccgaagacatttgcaatcatattcgtcgcaatgtattcgttggcggggtgctcctgcgggagatccggaaacaggaaatgcagcaccgggcgcattctccgtgaaagtccctcaatgatccccgccttttccgcaatccgcatcagtcccacccagaaagacatcactcccatcatggtaatacaaagcgtaaccgcctcttttgccgaatcgagcgccgccgtcgtaatctgcggcagggttccgtggaacgccccgtagatgatgcccgtcagaatcataaatgcccagagataattcatatcccctcacccgtttttatcgtttctccatatatatgcatcccggaataaatcttgacagcacccccttgatgcgcaaaaatagcgcagaacttttgaataattgcacattttcccacatagaatatgttaattttccgacacaggagttttctcctctgccgcgtttccgaggtgtttgtttgcattcttcgtttatccacacattttccaggcaattcgtcctttttccactgatgacgtccgtttttctgctcaacggatgctcccgcttctccatgcagacggatttcgtcgccggttccacgtcctccttcgatacgtttcttgatgattttttccgggcggaggtctcctccaacacgatcaatcttcatttttcactgtcccatccggaaaactacggcattacagagactccgatcacgctcggcagtctctcggaagaagcacttgccgcatcccatgcatctctggagaacacgctcgcggctctggcaaaatacgaccgcgatgcccttccgccctccggtcagctcacctatgacgtcttgcagaattatcttaagacggagctctccgcatccgatctgactctctacgacgagccgctgcgccctacgaccggcattcagtcgcagcttcccgtactatatgaggaataccgtttccggcagccagccgacgtggaggactatctcgcgctcctcgccctgaccggcgattatttcaaccagatcatccgcttcgagcagcagaaagcacaggccggactttttatgtccgactatgcctgcaacacactgatttcacagtgcagcgccttcacagcagacccggatcaacactatctcatccagaccttcgatcacaaaatcgatgccatgtcagaattgatggaggaacaaaagacactctacaaggaaaaaaatgccgctctggtgcgggaacatgtgcttcccgcctacacccatcttgccgcggcgctcacagagcttctcggcagcggcaaaaacgatatggggctctgttactttgcagacggaaaagattactaccgctacctggtctgccacaacaccgggagcgcttccgatcttccggcgctgcaggatcggatcttagaaaaacggcaaagcgacctgcagcaggcggcagcactcctctccgaaaacccgcagttaaaagcatcccagacgaccgtccggcttcctgccgccgatcccattgcaacgctaaacgggctgcaggaggcgatgcgcgcaaattttcctgcaccacccgagaccacatttactgtaagttctattgacgagtgcatggaagactatatggcgcctgcgttttacatcacctcgcccattgacgattatgcgcagaactccatatttatcaatgcctccaccgacacctcctccctgcggtatttcacaacgctggcgcacgagggcttccccggccacctttatcagacggtgatgtcctatgaagccggactacatcccgtgcggtttctgctgaattatccgggctatgtcgagggctgggcaacctacgtggagatgatctcgtaccattatgccgggctggatgatgacctcgcctcgctgctctccctgaatcagtccgccctcctaagtctctatgcctcaacggatctgggaatccactacgacggctggagcttttccgacacaaccgctttctggaaagacttcggcatcacggatcagaccgcactgcgcgaaatctatgagctgatcgtggaagaacccgcccattatctgaaatactatgtgggatatatggaatttgtggatttaaaagaaaaggcacaggaaacctacggaagcgcctacagcgatatcgcttttcataaggctctgctctccatcggtcctgcacctttttcgatcattgaaacgtatctggataattattatctgccggatgcggctccccaatagccccggcgcagcttatgcgtcacatgtatcgtttccaacataaaccaaaatgtttttgcgaattgtaatatgatattggtaaaaaacgccgcaacacggtcatccccgtttgcagcgttttctaatataacacagtattttcatttatgtaagtattttttaagacaacagcgcctggtagacatcgcgcttgctgatgccgcggtcctttgccaccagcttcatcgcttccttccggctgatcccctgcttctcatagacttccatatgctcctcaagcgacaggttctcccagttcttctgctcttcctgcttcaattcctcaaatgtctttccggcgattaccaggacatactctccgcggggttcattgtctttataatatttaagtatctcagagaatgtcgttaatgtcttttcctcgtaccgctttgtcagttccctgcacacggttaatttgcggtctccgagcgtctcatacagctcttccagcgtgcggatcagatgatgcggcgcctcgtagatgatgatcgtgcgcgtctcattgaccagctgcgagagcactgctgcccgctcttttttctctctcggcagaaacgcctcaaacgcaaaccgtctggtcggctgccccgacatcgtgagtgctgtgatacatgccgccggtcccggcagagatgtcacctcaatcccttcctcatagcagatgcgcacgaggtcttcccccggatccgagatccccggcgtccccgcatccgtaatcagtgcgatgttgagtccttcgcgcatcttatccaccagctgatacgctttctcgatcttattgtactcgtgatagctcgtcatcggcgtccggatctcaaaatgattcaacagcttgatggaatttctggtatcctccgccgcaatcagatcgacttcctttaaggttctcaccacccggtaggtgatgtcctccagatttccgatcggagtggcacacaaatataactttcccgccataacttttcctttcgtcgtgcataaagcgcgcacatcctgtatacttcccgcgtgcattcctgcctgctatccgacagacttctcctctgccacattccccactcctgcaagcttcggtgcagcgaaatacagtacgattcctccgatcaccgcgccgatggagatcaactgcgacgtggacagcacacccacactgcctctgtaatcgttgcgcaaaaactccacggcgaatcttccgattccgtacagcacaagataagccgccgcaacgcgtccggccttcggtctcttcgatgcaaaccataacagcagcgcgcagatgataaaatctcccgccgctgagatcagctgcgtcggtatcagcttcacaccgttcggtgcgaacgaggagttatgaaacgtgattccgtaccacgcatccgtctccctgccgtagcagcagcccgcaaaaaagcagccaaagcgaccgaagccttgtgcaaacgaaaccgccggcatcaccagatcaaaatacggcataaacgcctgctttttcgtgcggcagtagatataacttgccagaattcctccgatgattcctccatagaccacatagccgttcttgaaatcccagaggatagacggatccttcatgatctccggaatctctacaatataatataaaatcctggttccgagcattccgccgatgatggcgcagaagaaaatgccccagatgatatcctcatcatagcctctttttttgccccggcgcagcgtcatcagcaatgccgccagaaaacccgctgcaatcatcactccatacatatgaatggtaatcggtcctatcacaatatcattaaacatattcttttcctttctgccacagcgtcctgtccgctgctttctgtgctgtcacaccggtcgttcgttaatatccgtagatatcatagatttcatccgtatatacaccctgttccttataaacgatcagcggcttttccaccgtcagtctcgatctgccgccgcggcttccctccagcagaaccatgttcggctccttgtccacatatggatagaccagctgcatccgcttgggttcgatgccgcaggcaaccatcttgctcataatctccgcaagccggaacggacggtgtaccatgtaaaatctcccgcccggcacaagcagcttcgccgactcccgcagaatgtcgtccagggtacacagaacctcatggcgtgcaatcgcttttgcctccgagccggaactgattccgtgctgtccgatcatatacggcggattggtggtgacaatatcaaaagaagatgccccgaatattcccgaggcatctttgatatcgcctgtcacaacccggatcttttcttccaggtgattatataatacgcttcttctcgccatatccgcgctctcttcctgaatctccagcgcggtaaaatcttctgcctccgtctttgcctccattaagatcgggataatcccggtgcccgtccccagatcaagcacacgctctccccgtctggcacgcgcgaatcccgacaacagcacggcatccataccgaaacagaatctcgccggatcctgaatgatatagtaaccgttccggtgcagttcatccagacgctcgttttcatggacaagattatttggtgtcatcaatcttggattttcctcccttatcctcaagcgcggacaattccttcagctcctttgcagaaagctttatattttcctttctgcggcgcggacggaacttcagctcgtccaccggatagtcccggagttctttttcatcgtccacctctaccagtaccttcaccatctggcggagcacattgaccgaagacacttctcctttcagtccgtccaccgtcgtcacgcggtcgccgatacccggaagtctgctgttgagatactcgtaggtctcttcctcattcttcaggcagcacatcagtcttccgcacacacccgaaatcttggtcggattcaaagaaagattctgctcttttgccatcttgatggaaaccggcgcaaattccgagagataggtgttgcagcacagcgcacgtccgcagatgccgattccgcccatgatctttgtctcatcgcgcacaccgatctggcgaagctcgattctggtgcggaataccgctgcgaggtcttttaccagctcacggaaatcgattcttccgtccgccgtgaagtaaaacaacagcttattattgtcaaacgtgtattccgcctcgacaagcttcatatcgagcttgtgcttggcaatcttctcaagacagatgcggaaggcatccttctctttttcccggttcttcgcaaccgtcttctcgtccgcctccgtcgcaatgcggatgaccggcttcaacggctggatgacttcctcctccgaaacccctttcggctccgtcatgaccgttcccatctcgacaccgcgggcggtctccacgattacgtgcattcccgcatggatgtccagcttgcccggttcaaaataatatatcttgcccgcattccgaaagcggactcctactacttttaccatatttctagttctcctttattgtcagcaacagcagttccattgtaaggtcaaagttgacgttggcattcagccggatctgtgctttgcgcagcgcctccaagatcgtctcgatgccgctgtaagaactcttctctgcctgccgcttgatgtcgtacacttcatccttgaagatcagaccgttcacgtcgccggttgccttaaacagcagcacgtcccgataccataccatcatcagatcaaagtaatcattgatcgaaagcttgtatgtagcaatctgttttaccgcctctgtcatctcatacaaatcgatgtcccgaagccgcttgatcagctggagcaccgcgtcctttaactcgttgaactcctccgaggacgcaagctgaatggcttttccgacgttaccctgagcgaatgccacacatacgtccgcctggtagtccggaatctgatacttgcgcatcagatagccgcggatcttctcatccggcactgccttgatgttcaatgtgacacagcgggataagatcgtcggcagaaaagcggcagcgtttgtggtaagaagaatcagaatcgcgtaggcaggcggctcctcaatcgtcttaagcagcgcattctgtgcctgctcgttcatcttctcggcttcatcgatcatatagatcttatatctgctgctgtaaggtttgattactatatcgttgttgacctgggtacggatatcatcgaccgagattgtattcggcttctcatgccgcacatagatgatgtccggctggttcttcgtcatcgcctgcttacaggaatgacattccatacacggctccacatcggacggctgcgcggcatttttcaccacatcctccagcttctcacactcgagtgtctgggcaaacgcctccgcgagcatcattttgccggacttatccggtccgtttatgatgtatgcatgtgataccttatccattgtgactgcattctgcagatgctctatgatctgctcatgccctaaaatagctttaaatcctgccatagcttccctcgttttatgttaagtcagaatatccaacagaagtccctggatctccccgatcttgctcaagatcgtgatgtgatccttctcatccttgaccagttcctgtgcaagttcgtccaggttggcatcaatcagccggatcagtccgtagactctgtggcgtcccttgcggtccaggaaattctctcttgaaaacttatgagagcggtagaccacttcattcataaaatcacggatcagtccgcggtactttttcatatcgcggatgtccatatgttccgcaatccggttcccctgaaacgtaatgtcagataacagactgtccaccttcgcctgaagctctgcatccgtgatcgcgctcgccagcgtaaacttgaacgttccgtcgccggtctccgtcgtcaccgtgtccggcacctgcgttaccatctgtgcctgattcaccttaatatccaatctgccaccctctttccctgatccgtcaatcgttctgagacaatatataatcgcggatattttcttccgtctgctttaaatcatcatttgcaaaccgcaccgtaatctgtgcgtccaaaagcttttcttcggaaaaatctgccgcgtccgccagaaatctccgacacatctcttcatagtgcggttcccgctgctgccgctctcttccgatcgcacgctccagccggattccgtcctccacttcaatatatatcggaacaacacgttcctttccgaagtagtcccggagcttcccgtatgcttccagcgtaccgatcaacagataattctgccgcagatcctgtatctgatggtcatccaccgtaaaatacttccatactccctgcaccgtatcgtatgcccgaagttcaatgactttgccacactttagaagatcggccagttccttctctccgcagaaataatattccacgccgtccgtctctccccggcgcatcggccgcgtcgtgtagggaatgatcttcttcagcgaaagcgccccgtcttccagaagcatcttatataatgtatcttttcctgttgaactcttgcccatcatgcaatagatttttcccattcgctgcaccttctagtataatatagtctttaaaaatatacaatctttatccgaccgggggcaagatttccctgcccttccacgttcagctttctctcccggcactctctgatgtgccggataaactcttccgtgataacttctcccggcacgatgagcgggattccgggcggatacaggtaaacgtaatccgccgccattttcccgactgcctcatcaagcggcacctcccggtacggcagatccagcgcctgataaatctgcatccggcgcggattcttccggtacatgcgcgccgtaaatccggcttccggcacttctccgtctaattccgtcttccggttctcttcagcggtctcgtggggctccgccatacgccggttcttttcatcaatctcatggagcgccgtcacaagccgccgcatgccctcgtccgtatccataaggcttgtcatgccgagcacatagtccgccgacaccatctccatctgaagatgataatgtccgagcagttcctgatgcagcgcctcgccgcccatggtgcccgcataaataatcagcttggaatcgtcccagtcatacgcttcttccttgcagaggtcttcccgccgcatgacatgcagctgcgtaaggtccgccgtatcacggtaaaatgcatccagacgtctccggtattccgcaaaaagttctgccccctgctcacggatcaggtcgatgcatgcatccattcccgccataaacagatacgacggcgaactcgtctcatagacgcccagataccgtgccacgcgcccgggatcaatccgcgtgccgttacaatgcaaaagcgccgtctgtgtaaacgacggcagcgtcttgtgcagactcataatcacggcgtccgccccaaggcgcaccgcattttccgagaatccggctccgaatccgaagtgggccccgtgcgcttcatcgacaatcagcgccgccccgtgtgcatgacagcatgccgcaatcgccgcgacgtccgacacgatcccctcgtaggtcggggatgtgaggatcacaaccgcaagatccggatgctttgtcagcgcctcctccacctgcgccgcggtaatctgtccctgcagatctccccgcgtgattgccggatagaggaactccgccgcgagtccctgcatggaaatcgcgtgatagaccgctttgtggcagttccttgccgccagtaccttatctccccgccgtgcggcagcgcagatggcggcaagcagtccgcaggtgctcccgtttaccaggtaatacgaccggtccgcaccgtagagcttcgccgcgcgctcctcggcctccctgataagcccttcggcatgatgcaggttgtcaaatccgtcaatctccgtaatatcgatggtatacggatttggaaacggaagtgcccggcgcttgtgccccggcatatgaaaagggtagacatccgattccccgtatgaaattagctgttgatacaaatgttctctctccattattcctgtcactttcccctgtcaatccgtcttgttttgtcccgtcgatccgcgcagcagaatttttgtcacttgaacaatccgccgttttccattatgatatgggatatatttatttaatagaaatggcggaaatttttatgaaacacgcactcattatcctgtgcggcggcggaagcacgcgcatgggaaccgataaagccctgctgccttttggcgaagtaagtctgctggaataccttgtgaacaagtacaaaccgcatttttcgcatatttacttatccgtgaaaaagccgggcgaatatacacacctgtcactccccatcacagaaattgccgatctgtacatgaacgccggcccgatgtccggcgtattttccggtctctccatgatggatgaagaccaggcgtttattctgccgatcgacaccccttttctggaaccggaagtcggactgcagttgctggaacatctggacggttttgacatcgccgcggtatccggcaccgaaatggatcaaaaggtaccggcgtccgcctactccaaaagctgcctgccgtccatcggaaagtgtctgcttttgcaccagttcactttcgatacgctgcgcgagaaatgcagcgtgtcctatctgaagcgcgaagaagcgaccaaagactccgatattccggcagatcttcagttttcccatctggataccagggatgactactatctggcgctccggctccttcactgcatttaactaatctaagaaccgctgcagatccggcatccagtctccgaaaaaaatctcgtcccggcacagggtgctccacatctgcggaaggaattgttccagaacctgcatgacctctgtccatgcgggttcttttcttttccggtgtcttaaatatttctcccaacgctttctcatgtagctgtaatcgcggtaggaaagaatctctttcatccgcgactcctcgggaagtaactgccgctttttgcaatgttcgccgagcagttcctgaatatgcctgccgtccaccggctccgtctttaatatcccgtaaaccttatcgtagacgctcatatccggaagcagttccatatcccggatcagataaaaaagattctccgcgagaatactctccaccggatattccagatacggaatctgctttccgccttccataaacggcataaaagtccgcttgaccggaaccagtccttcctcggtcagttccgtgacgcggatatggatcggaaccgtcatctcctcgaactcccccgcaatctccagatccacgcggtgatcccccgcgctcgctcttcccttccaggaaatgtccggcaccttttccacttttaggatgtacgcgagcatgacatatcccatcttaagagacagctcctgccccggaacgatcccctcccgcttcatcgcgcggggatctgtcacataggcaaaatccagcgtcagcagatttttcttccggtactgttccactccgagtgcgctgctgtttttcagccagagaaacagggaaaacggcgaatcctcgatcagatacatcagttcttccagtacatagcctgccagcagattggaaaacggaataccggtctcttcactttttgctttcagtgcagctttttctatgatcgtatgtttcatctacagccatactcctatcatcgtctgtactttctttaccactctgcgttcccttgcgtatttcatcagctttgcgacatccttcttcggatcgcggatatacgctaaaagcccttctttgaaaagctcacgctccatcttatcttcatatttcagacactcgcacatcaggcgctcccggtcaaaaattttcatcttcgcgccgccgtagtcaatctccgtcacaccgagtgtcagggtctccggctccgcatacagcggcaccaccggcggaaaatccagcttaaaccgcgacttggatgtgttcttgtccaccgacaatttgtatccgtaaggcttgcggtccagatagccgtacgcgtacaatgcggtctccaggtttaagacgcagtccggaaacagccgcgcaatcagctcctcctccgagaaatcactcagccgcaccgcatagtacccgttcttgatccggatcagatctcccttttccacaaaatccagaatcctccggtaatcgattcccagttcattcagctggctctttttcaccacgccgccattctgatagatgaactctttgacacgatccagaatgagttcccgcttttcgttaatcacataagattctgacatatcgttccccgtacctttcctgttgagccatcccctcctgcagcgcattttggggaaagttctgtataacttctccgctctatgtatatgtttgtggtatttattgcttatttttactataaaggatccactgctgtttgtcaatttatcgtttctgtcgtttttccggctgttcacagcccctgttttgtcctataatgtcataaaagacaatttttttgtcgtttacagaaaggagttctctatggaagcaaaatcaccctccctgcgcaagaatccatcccgggaaacctgcgagggaatcatccgccggatcctgatgaccgaggtcttagaaaagggaaaaaacgagcatttccgcacggctgccgatttcatgaaatattttgagtctctttacccggcgtccgacgctctgaccaaacaggtgcagcgcgccatccgctctctgaatatgccgaaggatgaactcggctatttcattccgaacaagactgccgaacagttagcgcaggagcaggagcttacctatattttcaaaaaagcaaatgccgacgtctgccggatggatgattaccagcctctgtttttaaaagcggacgatgctgtctcctcctacctgctttcccgcatcacggactcccctctgtttcagggaaaatatctgaccgcgcacactgtgtcaggcggcattcttttttacacaaagaacccgaatcaacttgaaatcctgctgaaaagcttaattgtcagataatttattatcatttttttcgtgtccataacgcaaaaaacgacaatattcaacatggaatattgtcgttttttgtttctctatactatcttctatgtcttctacggcgtcttgacttgctttttatctgtcgaaactgctctttgcggttcctgcgcacttcccggttgtgccggataatataatagttatcgtagaacttctttccggcaaagatcaaccctactgcaagcaggattccggctacgataagcaaaattgtgcgcggtctgatccgcaccgtagagaccgtctcctcctcggtgtctgtctcctgctctacctcgctctggttgtcaaaaatatatccgtccacaaccgcaccggttgtcactatgtctgcttttccgacctgacgtcccgcataggtgtaggcaagcgttcccaccacgttctcgctgacgtcgtcatacgtgatctccgatgccgcatcgttaaagtcggtcgtcttcggaagaacgatattggcattcgcgtcgatgtccacaaacgccttgttgttatttaaggctccaacttccaccgcctcggaatccatgtatctggtctcattgtccgcaatattgaacaactggaaattatcaaatgcatagtcgaaaaggttccggctgtcggtccactgattcggcgattccgtatgcatcacgacgcataccagactcatgccgtccttctcggcgtaagtgaccagcgtgctacgcgcgatatccgtatatcccgtctttcctccggtacaatactcataccggtacttgagcgtcttgaacgggtagagcatctcattgtgattctgcagatccgtcggctcatcatgcttgttcgtcggcggaatagtgtagcgtgccgtccccgtaataatccggaaggtctcgttctggtatgccgctttggcaatcagcgccatatcgtgcgccgtcgtgtaatggttctcgtcaaacagaccgtgcggattggcaaaatgcgtgttggtacatcccagctccgccgctttttcgttcatcatgtccacaaaatgctccaccgtaccgccgacatgctccgccactgcgtaggcacattcatttgccgaattcagcataaccgcgtacaggcattgctccatcgtcatctgctccccgtaatcgcggtagattccggaaccctcagtattgttgatcgcatcatcagaaaatgtgacgacctcattcagatcggaattctccagcgcgagaagcgtcgtcatgattttcgtgatacttgccggataattccgctcatcgctgtttttttcgtacagaaccgtccccgtcgacatctccatcagtatcacggacggtgactgtacttccggtccttccggccagtaatctgccgcctgcaccacctgcggctttatctgtaaaaagtatagtaaacttaaggcgacacatgccgcctttttccacacattcgctcttcgcattgcttataactccattctatccagaaatcctgtccatttcttccatatatatccggaacataactagtatcagtataatcgcagaaaaaaatacatgcaacaatttttctggcaaaagctctttttttatccacagatttattgtagaatatcttgtatgtccacaattataggacttcccgacatttattaagattttcttatgagaggcaggaacaatatgagacttagaaatataccgggtgcagacgccgccatcacagagagcgtctactgcatcaaaagccccgagacgcacaaaggccattggcaggagatttttccgtcacagcagccgcttcacattgagatcggtatgggaaagggccgcttcatgatggatcttgccgcagcgcatcccgacatcaattatctgggaatcgagcgctactccagcgtcctgctgcgcgccctgcaaaaaatggaagagaatccgctcccgaacctgtttttcatctgcatggacgccgccgatgtcgctgaggtattcgatcacggagaggtagaccggatctacttaaacttttccgatccgtggccgaaggacagacacgccaagcgccgtctcacctcccgtcagttcttcgcgcgctacgatgaagttctcgcaccggagggacgtctggagttcaagaccgacaatcaggatctttttaccttttccctggaggagatcccggaagccggctggcatctggacgcctccaccagagatctgcatcacgatccggtgctcaatgaaggcaatatcatgacggagtacgaggagaagttctcctccctcggcaatccgatctgtaagctgatcgcttccagataaaaaacacccgcagtctggatttttctcgatccgcctgcgggtgttttttgtgttctgttttcttttattctttgatccggaactggttgacattgtcgcttaaattttctgcaatatccacgaggtttttcgtctgcgcattgcagtccgtgacgatgccgcttaactccgtcatggaagctgaagtctcctcggtacttgccgcattctcctgtgcaatcgctgccagactctccatgctgctcataacatcattcttcgccgtgttgactgtctcgatctcacgccggatattgtcaatcgcaactaccacattgccgacctccgtattcagtccgtcgaatgcctctctggtggtcgaaagcttctcgttctgctcgttgatctcatccagcacaccgttcatcgtctcgacgctcctgttggagttcttaatcagttcttccacaatatcaccgatcttcttcgcggagtcgctggactgatccgcaagctgacggatctcatccgccaccacagcaaatccttttccatgctctcccgcacgcgcagcctcgatgctcgcattcagggacaacagattggtctggcttgcaatatctgtgatcatctggatcgcgctgccgatctccatgacagactggttcgtcctgtctgtctgacggttgacctcattcaccgattctctggtgcggtcgctgatctccaccagatctttgatcgtgccgtcgagcttatgattctgctctttcatctcctccgtgctgcccgtgagattttccacgttctttgtcgtctcggcaatggcttcgttcatgtcgctgatctgctcattgaccttctgcatctcgcccgcctgattcgtcgctccgttcgcaatgtcctccatcgctgtattcacattatgaatggactcattgatcgtcgtaaagctgttctggaacctggcgctgaaatcatccagcgactttgcggatgtccggatgttttttacaatcatggccagtccgccaataagtgaatatagcgcacgcgcaatatttccgatctcgtccgagcggctcgtcatgcggtcgctgatcctgctgtccagatttccctccgcaacatcgtccagatgatcgatcatcgacatcattgccttcacaatcttcatcatcacaattgccagaaagatacatgcaaagattgcaagcactaccataaatattatattttttttcaatcggtcattgtagatttcgtgaacggaagcagacgtcataccggtaaacaccagacctgccatggaaccgtcactgttgtacaatccctcataatatccgtaatatttctgaccgtcaatcacagtatcggacacaaaataactacccttttctttcacagcctgatacacatctgctgctatctccgtcccgatctcgcggctgccgtcctgactcacaatgctggtcgccatccgggtcgtattccagctgagcgtaacatcctgtccggtattttccttaaaagcatccagcacatcctgatgttccgagaaattgtaatctcccttgtacagctggtctccatccgtattccagtcaccactgctcaaaatggacattgtctggttcacggcatagaccgatgtcttcaattcatgctgcatcagtttatcagacacagtaacgccaaccgcccggattgccagccctgcaaaagccacaagaatgatcagcggtatgatcgcggtgatcagaatcttcatcatcagattcagaccttttttcctttgcacctcaatattcttttgttccatctgactctctccccttcatatagtatctgctttttatatcgtcaggtttttccttctgttaaagtaggatacactctttttttaaattttaataatatgcgttgtaagcacaaaaaaagcaccaaccccacagtcaatgctgtaaaatcggtacctttcaatgcgccaccaggggttcgaaccctggacaccctgattaagagtcaggtgctctgccagctgagctagtggcgcttattttgtatctcgtgttctgtatcactcgagcacgaaaattattatataacagaaattttagaaatgcaacattttttttaaaaaacttcaaattttttttcaattgtgttattttatagatagaatggcatagatcaaggaggtttattatgcaagttgaacagcgattattgaaatatgtgtcctattggacgacatcggatgagaataacatggcagacggcaagatacagattccgtctaccgagcgtcagtttgatctcggaaaggtactggagcaggaattacgggatctcggtcttaaaaatgtggttctgaccgaccactgctatgtgtacggtctgcttccggcaactgccggctgtgagggacacaaggccgttggttttatctcacatatggataccgcaccggactactccggcaaagacatcaaaccgcagatcattccggattatgacggcggggacgtccgtttaaacggtaccggggcaatgttaaaggtttccgattttccaacgctgaaggatttgaagggaagaaccctgattaccaccgacggcacgacactgctcggcgcggatgacaaggccggtgtggcagaaatcgtcacagcgctcgaagagatcatttcttccggaatgcctcacggagatatctgggttggatttaccccggacgaagaaatcggctgcggtgcagatttatttgacctggattattttaaggctgcttttgcctacacggtagacggcgattacgagggcgaagtcgcctatgagaatttcaacgccgcgagcgcaaaattttccattaaaggcgtcaatgtgcatccgggcgaggcaaaggatattatggtaaatgccgctcttgtggcgtgcgatatccagtcgcagcttccgccggaggagacaccagcgcacaccgagggcagacagggcttctatcatctgaccgacatgaagggtgatgtcgcttttgcagaactttcctatatcgtgcgtgaccacgacagggcttcttttgaatcacgcctgaacagactccgcacactggaagtggagatcaaccagaaatacggcaccggaaccgtctctcttaccatcacggattcctactccaatatgcttgagatcatcgaacagcatccttatgtcgtggacattgcaaaaaaggcaatctcgatgaccggtctcacaccgctctcacgtccggtccgcggcggtacagacggcgccagattaagttttatgggtcttccgtgcccgaatcttggcaccggcggctacggcttccacggtccgtatgagcatatcagcgtggagggcatgcagacagcagtctccatcatcaagaatatcgtgacgatcgtcgcggagtctgatctgtaagattacggaaagaattgccgcatagattcccgtaataggaagttccgggatatataaataagtattatcgtttcagataaaaaatgagcgtggaagaaattctcacattttacttcaaagaatcttccacgctcattttttattctgaaactgctaataacttcatttcttatcccggaacctgctcttacatttttgcaatcaatgcggcaatttcttccggagtcataagcttgtgtggatcggaaaaatccatcggtgcagcttcctctgcctttgtctcaggctctttctgcggttccgccaccttcggctcgtccggtatttcgttctccggcgcggctactggctctggctcgtccggtgcttcattctccggcgcggcttcctctttcagatctgctccaagatcgaggctttctcctccgagatcagagccatctgctcctaaatctaagctatccactccgagatcaaggttctccgttccaaggtcaaggttctctgctccaagatcgagactatctgctcctaaatctaagctatccactccgagatcaaggttctctgttccaaggtcaaggttctctgctccaagatcgagactatctgctcctaaatcaaggctgtctcctccgaggtctaagctgtctgccccaagatcaagtccttctgatccaagatcaagtccgcctgctccggcatctaagttatctgctcctaggtcaaggttctctgtcccgagatcaagaccgtccactccaaggtctaagctgtctcctccgaaatcaagaccgcctgctcctaaatcgaaactgtctatctccccgctctctgcctcagcctcattctgatcgtctgtggcagctgccgcatcttcctcttccacaatcgcgtcggaatctacgatcggttcctcatactcttccatcaccggggtgtcatccgtcaccgtctctgcatctacaaccggcagttcctcctccggtgtatccggcatgctaaaatccgcttccggctccatgacctcttccggctgtggttccatgaccagctccggctccgcttccatatccggctctgattctgtcagcacttccggctgcggctccatgacctcttccggctgtggttccatgaccagctccggctccgcttccatatccggcttctgcgctgctgcagctgccgtgctttctgcaattctgctctccaacgccgcattctggcttaccagttcgtccatccggctctcaatagcggcaagcgtctgtgccttttcctcggcaaccgtctccttcactgcctgaagtccctcagtaatctccttaagccctgcggtaatctcctttaatttctcagcaaattcctgctgctttaagacgagttccttaacggaatcatccatcatgttctgctgctttccggcaaactgctcgaatccagcatccatgctctcctttaactgtaagagattgtccactacgcggtcgttggaattcataagtgcatctgcattttccctgcttctggtaatggtcaccttggcgatcgccttctgcgctgtgatgatctcttcgcccggctccctggtattgcggtcaaccgcctccagctgctccgagattttcttgagcatcagatatgacgccttttccccgcgaagcatcctctcatattcgtcttttacctgctccccggtcttatgtatctcctttaataaggcagcgatgaatacataagtacaggcgagaattgctgctcccagaatgatctgcaccagatatacccggggcaggttgacgataaaatacatttcaatcaacagcagcaccgttgctcccagcaaaaagaccggcgcaagcggcataccctttttctcacgtggctgattctctttcttatccatagtgtgtcctccgtggctttcctgtccatccctggcaacaggcattttatagtgttatattatcacagaacgcaaaaaacataaacggattttcttgttattttatgctgcagattttataatatatttcggacttattttcacattttttatacctttacaacagatatggagattatagcatgaacgaaacctcttccaagaacgaaatcacatccggtatcatctggaaacaacttcttttatttttctttcctattttactgggttctttttttcaacagctttacaacacgatcgacgccgtcattgtgggacgctttgtcgggaaaaatgcacttgccgcggtcgccggttcctccggaatggtcatcaacctgctggtcaacttttttaccgggctgactgccggtgcttccgtcatcgtctcccagttcttcggatccggggaccgcaaaaaggtggacgacagtattcatacgatctatgccttctccatcatcggcagcgtcatcatgacactgatcggcatcactgctgccccggcgcttcttcgactgatgaatacgccggaagaactgatgagtgattccattctctatctgcgcatctattttgccggtatcttcttcgtgtttatttacaataccggagcagggctgctccgcgcacttggagattccagacgtcccctgtactgtctgatgatctgctgcgtcatcaatattgttctcgacctgctcctgatcgtcgggctgggactcggtgttgccggtgcggcgatcgccacgcttctctcgcaggggatcagcgccgtgatcgttaccgtttttctgatgcgccagaaagatctctgcgatttttccttaaaagacatccgtatccacccgagacttctcaaatcagagctgcttttgggactgccgggtggatttcagtatgccatgtacagcatttccaacatgattatccagtccgcgctcaacaaattcggaaccgacacggttgccgcatgggcggcttacggaaaactggacgcgatcgtctggatggtcagcggtgctttcggtattgccatcacaactttcgtcggtcagaactacggcgccgggaagtatgaccgcgtcagaaaaagtatccgcgtgtgtatcggcatggactttgccgccgccatccttctgatgctggtgctcgtatgcttccgcattccgctcttccacatttttgtgaccgatgaaaatgtcgtggagatcggactgaaaatgatggcgaccatggctccattttactggctgttcgtctttaccgaggtcttctccggtgcgctgcgcggcatgggtgatgtcgtcgttccaatgctcatcacaaccggcggtatctgcctgttccgtgtggtatggattttcggagtggttgccctcttcccgacgctcaccgtaacgctcctcaattatccggtgtcctgggttttaacatccgttctgtttctgttttactatcatttccggatgaaaaagctgaccgcgcactgattgctccggcatctcttacttctctctgctttttgcgaagctgaccgggcggcatgccataggtttccttaaagctgcgcagaaacaccttatagttggtaattccatttttattcattaaataagtaatactctcgtccgtctgcagcagatcactgtgaaaatactgcaggcggatttggtttacataagtcaaaaatgtctggccggtgtactttttaaacagacggcaaaaatattccggcgtaagcgacagttcatctgccgtctcttttagtgtaatcgggttcgtgtaatttcttttcacatactgcatgctctgctcgatccgctcaaaatctctcctggagcggtggcgcagcacatgatcgaccgtggccgcatcctttgtatacagcagatacagcagcttataaaccgctgcaagaaatagcagatgcgtaccgtccgccgcctgctcctgcaggcacttcatttcttccagcttctgtgacatccggcaattcacggatgcggtctcctccgaatacggaacatattccccgaaatgcagtccccgccagtcctcactgacgcgctttaaatgctccggcggaatctgcagcagatagtaatgcccgtccccatggacatgcgtgtagtgaatgtctctcggattgacaacgagaatatctccctgctgcagttcatacgacgtctcattgatgtacgctgtcattgccccgtgctgcatacagatcatttccagatgctcatgccaatgtgccggcagcaattcattggacgcgtcgacctgcgtaaaatagagctgcatcagcccgtcatcggatataatctcatgttccccctgctgcactcccgctccctctctttcctgctctccccgtgtttttcacatgcacggtttctctttctaccatcataccttcagaaggaaaaaatatcaatatcgacccatgtttctgccaaaattcgatctataacaaacggaattatctgcttataatacgaacatagacaatgttccatactgaaaaatatcaaaataatatcaggcgtatgccggaaaagaggtcaaaatgaagaaatggaccagagtgatgtatcagccaaaccgtccattaaaagagggctgttacgtgactgcttccaaagaacacatcgcactttccagggaagctgcaacagagggtatggttctcttaaagaacgagcacaatctgctgccgttaaaagcaggcagccggattgcactctttggaaaaggcagttttgattatgtcaagggaggcggcggcagcggcgatgtgaccgtatcgtatgtgcacaatctctacgatggctttcagatgctccacgatgccgtctccctctacgagccgctgtgcgatttctaccgcgccaatgtgaacgaacagtacgatcagggttccgttcccggcatgacgacagagccggcgctctccgcagaacttctcgccggcgccagctcctacaccgacacggctgtgatcgtattgagccgtttttccggagaaggctgggaccgctccagcatcgaatacaacggagaatataatccgtgggagacagagaccagcatgccgaaaatctccggagagatcttcccggacggcgacttctatctcacaaaggaagaatccgccatgatcgcgcaggtaaagcagcatttttccagaattgcagtcgtcctgaatatcggcggcatcatcgatacctcctggatcaaaaatgacgatcagatctcctctgcacttatcgcatggcagggcggcatggagggcggacttgccacggcggaactgctatgcggaaagatatctccgtccggcaagcttccggacaccttcgccgcttccgtggacgactatccttccaccgcggatttccacgaatcggttgactatgtggactatactgaggatatctatgtgggctaccgctattttgagacttttggggatgcggcaaaacgcgtatgctatccgttcggattcggactttcctacacacagttttcccttacggtgcagagtgtgaccgaaaccgcgcaggccatccgcgcttttgtccttgtcacaaacaccggagattacaatggaaaagaagtcgtgcagatgtattacagtgcgccgcagggacttttgcagaaaccggcgcgcgaactttccgctttttgtaaaacaagaatgcttctcccgggcgaaagccagcttctgacgctcgagacagcgaaggactccatggcttcctacgatgatctgggaaaaatttttaaatcctcctacatactggaaaagggcgactatcatttttacatcggaacttccgtccgggatgtcattgcgctggattatgtcatgacgcttaacgccaacctgctggtagaacagctttcctccaaagccgcatctgcaaacttgaagaagcgcctgctcgcagacggaagctacgaagaacttccgcagggaactgccaacgatccgaatgcctgtgtttttgaaaaaatggtaccgggcaccgaggaagctctcgctccggcaacacgcggacgcgcatcctatcttctgctgaattcctataaggaaaacgcacatccgctgatcgacgtttacgagggaaagatttccctggatgaatttaccgcccagctggacgacgatgatctgattcatctgcttggcggccagccgaatacctctgtcgcgaatacctacggctacggcaatcttccggaatacggcgttccaaacatcatgaccgccgacggtcctgccggtctgcgcatcaccccgcagtgtgaggtctgcacaacggcatggccatgcgccacactgctcgcctccacctggaaccctgccctgattgagcaggtcggaaccgcaggcgccgaggaagtaaaagagaacaatatcgccgtatggctgacaccggcggtcaacattcaccgcaatcctctctgcggaagaaattttgaatactattcggaagatccgctgctcaccggcaaaatgggcgcagccatggtgcgcggcattcagtcgcagcacatcggcgcagccgtgaagcattttgcatgcaacaacaaggagaccaaccgcaaacacagcgactcccgcgtctccgagcgcgcgctccgcgagatctacttaaaggcgtttgagatcatcgtgaaggaagccgatccgtgggttatcatgtccgcttacaatatgatcaacggccaccgcgcttcggaaaatcacgatctgctcgaaggcatcctgcgtgacgagtggcattttcacggaatggtaacctccgactggtggacgagaggagaacattacaaagagatcaaagccggaaatgacgtgaagatggcgtgcggtttcccggaacgcgtaaaaaaagcgatggaactgggtgaactggatcgaagtgatctggagcgctgcgcaaagcgcgtacttgatctgatcttaaagatcgattagaaaactcattcttcctgctgtagatcaaaagacggaagcctctcacagagacttccgcctttttgcttttcgactatagatattttccgatatggattcaaccgcagcggctcctgcttcctccccgcctctctggaagtttttgttgcagtcaatttgtgcggtttcattgacagctgcagttacatcttcgtttctgcagaatccatacagccgttgcaggatgcagcggttctatcatccggccacgattttctaagcgccgcataggaaatcaggaagtttgccaaccagcccgccggtacggcaagccagacaaatgcaataccaaagcgcggtgcaaaaatcaaagcaaccgacagacggatcgcaaggtttaccatattagctataagaaatggacgcatgattccaagtccacgcaaaactccatccgttgccattttaatacccatgaaaataaagaaatagccaagccatctcatgtaatccccggatacctgatatgcgaaagcagttccgtcttttcccagaaataaggaagaaatctgggtgtgcagtgtttcaataattataaaagccagaactgcaaagcacagatctaacaccagtgcagcgtgataaccttttttaatacgcccgattttctgagcaccaagattctgggacacatacggcgaaactgcattgccaatggacacaaatatcagtgagaaaacattctctactctcattgttgccgaataacctgcgagtgcctgtgtaccaaatgggtttacaactgcctgtacgatcatcatgcctattgatactgtggactgctggagaactgacggtatggcaatccggagcatatactgtaactcctgtccgtcaaaccagtgaaagggactcttatattggcgcatccggtaaaaaaagatcaggaatgaaaatactgcagaaatgccctgtgcgatcagagttgcaagggctgcaccaaatacaccaagaccaagccctgccaccatccaaagatccataataatattcaaaacagaagaaaatatcagcagacccaacggaatctttgattccccgattgaggtgaacatcgttgaaaggatattgtacataaataaaaacggaaatcccacaaaatatacccgcagatacagtacagcttcctccagtatgtcagtgggtgtttgtaaaaggctcatcatcggatgcgaaaaatgaaagccgaatacaccaagaagcacgcttaggatcagaaagctgatcaaagatgtcgacacaatcgttttcattttgccgtaatctctggcgccaaaatagcggctcaccagtacgcctgcaccgacaccggcaccaagtgccacacaaataaacacattcgtaagtgccgcgcatgcaccgacagccgcaagtgcagaggaaccaacatactggccgacaataatggaatccgccatattataaacctgttgaaaaaagctgccaagaatcataggcattgcaaaaacagtcaacgctttgagtggggcatctgtgatcagatattcatcttttgacattattttattccccctaaattcctgcttttatctgggatttctgccacaatttattccagtgccaatacatcggccggcatcaggcattctaaaatggcatggaatatcgatgcttactgttccgccagctcctcataaaaccggtaattgttcttgccattctgtttgacataatacaatgccttgtccgctcttatatagtattcttcaaagctttctccctgtctgcacatgcacagaccgcaggataaggatgccggtgaagtctccgtcgtggcattttttgccgcttcaaagctgtcaaacagctttctcatctgcgtgttcatctcaacttctgatacctcagacagatagaagaggaactcatctcctcccagccggcagaccaccgcattctccatgcactctgtgagcattgctcctaccagcctgagagcatgatcccctgccttatgtccatagacatcattgatcttcttgagattatccatatccacaaatcccagacagccatcatgctcctgcattttttcaataatcagtgtctcacctttatgacgcatgggaagtcctgtcaggtaatccaggctttcccgggcctctttctgtcgttccagctccagctcgcggatgcggtccattgtctggatcagggtaacgaccagcaggaccaccagtccgattgcgataaagattccggacagagacacaacacgatacaccgctgtcatctccagcatgactgcgatcatggcagctaccagtccgatcagcggaagcttgtaatgtttcgctgttcccttgatgagatcccggcagatggtgataaatatcgtcagaaacgttcctgcgatcactatgtgggacaagaacattgtcgaaataaaatctgcgatattcagtacctgtaagaccgtgcatatcacaaaattcacacaaatgatacattctgccacatgatagaccttccggtatcttccctgctgcacactatcaatatagaacatgattgggaccgggcagatcatcacaacaaagaagcacatattcgacagaatagaagcattgggaacaaacagctgacgcagcttcgattctcccagcatccacactgctcccaggatcatgcaccatcccagatattccagatcaaatcttgtcttgtatacaatatcgagcaccagactgatgatcagcacgaccagtccggaaaacagcatagtgcaggcgatcagagttaccataaaatagcagtgaaatatatagccccagatatctgatttatccccgcaatataccgtgttgacgacaccggaatacttttcagtaaaagactgcagttcgatccgcacttcctgccccgcatcctcaccggacgtctcgcagaacacatacccgctggcagaatttttcccgaagggtctgctattcttcgtatcatacaccgtcctcagttcccctccaatgtaaatgcgcacattttccatagaggatctgatggcgatcgtattttcattatagtcctgtgggagcactgaccggatgactaaaagctcaccggcaggcacatcataccggtccggaacccggatctcctcttctgttccgtctggcagctcccgataaaaggttccggtataagtaatgctttcctccgtgaccggttccctctcactggggtaaatgctctgccctaaaaaaatgctgcaagcagcacaagtatcactacataaaataaaattcttttatacttatgaatcgtatatttctcttctgtcatttttattacctatattaaataattccggggtatttcccctgcttttatgacgatattggggtgcagtccaatatctttctcccgctcatgaacaagtttatcacagactgcaggaaaagtaactatctattttactctgtagcggagatatttcgccctgcttattcttgtagcagccaatcagctatatcatgaatttcgattccttcatagctatattggggatgtctggttctggcaataatcattttcggataagcatctcggatctgaagcagaggagagcattctctctcaaatgtttcctgcccggaaatgttgtcgctgacctgaatataaaacttctcgctgcctctctgagcaacaaagtcgatctccttttgatagagcttgccgacatagacatcgtatccacggcgaagaagttcgatgcaaacgatgttttcatatactctgccgtaatccatatttctgcttcccagtattgcatatcgaataccgctgtcacacaaatagaacttttcagagctttcaaggtatttcttgcctcggatgtcgtatctcttaatatcataaaatacaaaagcattgcacaaatacttaatgtacttgccgacggttacatgattggtcggagtctcatttgctgtcagcagctgactgaccttattaggagaagtcaggttgctgatattatccataaggaactcgctcagacgctgtaaaaccaaagtgtccgggagcgcatatttctgcaccaaatcccttgtaacaatcgtttcgtagacctctttgatatagtttgttctgtctttttcgattctgtaagcgtaagaacctgctaaaccgcccttgatagcgtaatcatcaaagagcttatctttatcattaacatcatcataatattggcaatattcctggaagctgaaaggaaacacatgaatttcaatatagcgtccggtaaacagagttgccagatccgcactcaacaggaaagcattggagccggttacatagatgtcgtattttcccttagagtacaggctgttgattgacaactcaaacttggggcacatctgcacctcgtctacaaacaggtagttcgttttaccttcctgataatgttcttccacataggcgtgtaaggcatggtattccttgatttcttcatacgccaaatccatgaagtcaatgaagatgatattgatattttcaaaatggcttttcagatactcaatatacgcctgcatcagcttggacttaccagatcgacgaatgcccgtgatgatcttgatgtcaggagtatcattcagttcaatgattctgttgagatactttgctcttgtaattgttttcatatcgtcacccactttcaaaagtcgaaaatttttcatttcttgaaactgcttcgatgtacttattatactgtctgctaatagtatatgcaagaggtcgctttcaaaaacacaaaatattttattttttgaaagtggagactatgtaaaggcaacctgaaggttgccccaggcattaagcctatactgtttacacaggttcattatcatcttcatcgacggagctatctgcatcatagtcctcaacctctggatcgtacccatagtcctcgtcatcgtccacataatcagcatccatccctgctgacaaaatcagtattttcaaacctgtttcgctgacaaacctgtcactgaaattgcaattctgcacgaaaaaagcggcaatgaaactatcttcattaccgcttaaaatagagcgttccctataggaatcgaacctacaatagagtcttaggaggaccccaacctattgtcactctctgtcaatctgaggtaaggtaaacccaagtgggacactatataaaactgtttccgattcaatttgagttattctgaataccccctctgtcaagctctgtaaagctctgaaagttagctgattgtttgctccagctaataatcggggaatgccttgatattaccatcgacatctgttatatgaccaccatgcttcgtacgttcgatcatggtaaacagtattcaattaaactttcctatcgtaagtacaagatattttcttgtctataaataatataacgcatacgagacggtttgtccatgcgtttttgactagcaaatttataagctgctttcatatttttaaacacggacataaccagtagatggacctgcaccaacttttgcgatatacccactcttaaccagattcgtcaaagtcctttccacggtaattttgcttatatcaggacaaagctccatgatttctttctttgtaattttgccaaccttgttatcaataaccgctttaattctatcaggcttagaaagactccgatgcttcaaatgctctacacggctttcgaattcattgtatgctttcaacatgatacccagataatatttaacaaaaggctcatagctgttttctccctcatgccagccagtagaacttgcttgaagggcttcataatatgtttcttttgtcttttcaatcagcatttccatactgacatatttcccaacgatgtatcccgccttataaaaaagcagtaaagtgagcaaacggctcatcctaccatttccgtcattgaaaggatggatgcacagaaagtccagaatgaacatgggaatcaaaaccagtttatcaatgcggtcagcttcccatgcttcaaggaagcgggcgcaaagttcttccatcgcttcagcagtctgaaatgcgggaactggaataaaacgtgccttctgatgaccctcggcatctgtttctgcaattacattatcggaattcttataacttccaccagcacccccctgtgaataggagtacagatctcgatgtaactgcaaaataatgttcggtcttgggttgatatattcatagccttcgtaaattgtggaaagtacttcacgataaccagcaatttcctgctcagatcggttgcggggttctgctttttgacttaccaattcttccaaacgcttatcgcttgtaaatataccttcgattcggttggatgctcccgtactctgaatcaatgcaacttctaaaagtgttttcaattcatctacattggcttcgagaaataattcctgtttgcctttatgttcatggatgctgctaaccatctgaacaatttcaggtgttaacaacttcgcaggacttacaataaaatcaaagtctctcatatgaatctccttcatttcagatttatctccatcattctatcatcaaatgatggagatctcaatagatttgatggagatagaatatccatatacacaataaatatcctcatttcatccatatattatatcgttttatggattgttttttcattaaaattacactattttttcactatttttcattacttcatcgttttcgccaacgaattgagcaacgcccgcctctctggattcagattctttttctcataaaatgcttctttaaaaagctctgcatttttcctttggtcatcatccgaaatatgagagtacgcatccgtaaccatattgacctgtgcatggccggaatcaccctgtactgctttgatatcagataatggtacacacaagcacggaaaacactttatgcaaaatcttccacaataaaatctataaatgatccgcaaaggcaaaggaaaccgacagtttaccatgtttggaattatggcagttcttttaggaagtggagatgcattccatctggttccccgtgcagtagcgctttgtacaactggacttgagaactttactgtacagatggggttaggaaagtggattacctctatcactatgactatcctaaaatcatcccctcctcagaatttgcaacaagttgttgcaaattttctatatccttttattttacagaagtacttatttttaacttttttccttcagatttttatattgcaaaaatcatatcaccatctgcagtatatcctctatatgttctgcataataatcagccccattcagttcccctttctcaccatatccatacaggcatcctataaaagggcttttgcaggacctggcacattccagatcctgtctcctgtctccgactaccagataagggccactatattcccggatgatttcctgcacaatttctgtctttggacggaatctgtatgattcacagtcataaaaacggtcaaaccatcgttccatcccaaattccttccagtgtgcctcacgatatgaagctttacagttacttaagatcacaaggtgatatccccggttcttcaaagctgttagcatctcctctgctcccggataccacactgccttatgtttcctgatctgtcttatcatcagatctcctaccatcgtgcttgcctgctctttatagctctgatccagttccggcaaaaatgtattccacatctccttactgttaagtcccagccagccggcaatttccaccgagcctatctcccgttcttcggtaaccttctgttctgtcagccactgataggtttcacgaaatgccggttcatagattccaagggtatgatggatcgttccatcataatcgaatatgattgtttttgtcatcatttattttcctgtcttttagagctgcttcatcagattgaccatctcaatcgcagataatgcacaatcatagcctttatttcccgctttgcttcctgcacgcgcaatagcctgctcgatattttcagtcgtgatcactccgaataaaaccgggattcctgttgcaagttcaacctgtgcgattcccttggcagattcattacacaccagatcataatgtgaagtatctccacggatgacagctccaacgcagataattgcatcatattttcctgactgtgccatcttctgtgctgtaatcggaatctcaaatgctcccggtacccatgctgcagtaatgttctcttcttctactccatgtcttaccagtccgtcgactgcccctcccaataatttattcacaataatttcattgaatctcgctgccacgataccaaccttcattccctccggtgctactacttttccttctactaaattgatctgtctcattttttcttcctcctgatatttgctgttttttataaatttatttctttaaaaatatgacccatcttttcctgcttcgtcttcatatacttccggtcatacttttgtgccggaatctccagaggtactctctcattgatcttcagtccgaattcgccaagtccatagactttatccggattatttgtcagtaatcttaatgatttcacaccaaggtctgacagtatctgtgccccgacccagtactctctgagatccggtgcaaaccctaacttcacattagcctccacagtatcgtatccctgctcctgaagcgcatatgctttgatcttattgatcagtccgattcctcggccttcttgtctcatatacagaatgattcctcggccttctgcttctacctggcgcatcgctgtctgcagctgcaggccacagtcacatctgagcgatccgaatgcatcccctgtcagacactccgaatgtacccggcaaagcacatcctcaccatctcccagatcaccttttaccagtgccagatgatgctctcctgtaatatcattgatataaccatacattttaaaatcaccgtactgcgttgggaggtttgcaacggcttccttctttacatgcttttcatgtattcttatataatcctgcagatcacggatcgtaataaatgtaaggttatgctcttttgccatttcccatagctgtgatgtacgcatcatagttccatcttctttcataacttcacagcacacgccgcattctttcagtccagcaagtctcataagatctgttgttgcctctgtatggccatttcgtaccaaaaccccgccttttctggaaataagcggaaacacatgtcccggtcttctgaaatcctccggttttgactgatcatccacacacttcatgatagtataggagcgctcttccgcagagatacctgtggttgtatctgcgtgatctactgccacggtaaatgctgtactgtgattgtccgtgttctccgcaaccatcggcggaaagttcaatctcgccgcaatttctgcactcatcggtgtacagataagaccctttgcataggtcgccatgaaattaatattttccctggtcgcaaactctgccgcacatatcagatctccctcattttctctgtccggatcatctgtgaccagaactatttttccttccttaagatccctaagtgcttcttcaattgtgttgtactgataattttgtgacatagtgtatatcctcctgttctaaaacccgaattcttcaagaaactccatcgtaattccggattcttttttctcttcttcgttttttctgatgccaagcagtttttctacgtattttccgatcacatcattttccagattaaccagatcccccggcaccttttccaaaagagtggtttcttcgcctgtatgtggaatgaccgacacctgaaaaccagcttcatcaacccttgcaactgtcaggctgatcccatcaatacagacggatcctttttccacgatcagatgcaaaatctgtggcgatgtctcgattgatacccagatggcattttcttcctggagcatggaacgtatcacgccagtcccatcaatatggccgcttactatgtgtcccccgaacctgccgtctgcagccattgcacgttccaggtttacctggcttccggccttgcagctgccaagactgcttcttctgatcgtctctgccatcacatcggcagtaaatccgtccggctgaatcgacgtaactgtcagacacacaccattcacagcgatactgtcaccgatccttgtcccttccaggactttccgggctttcactgccaggatccctgattcccctgtcagctgtatataacggacttttcctttctcttctacgattcctgtaaacatgattcctcctgttttttatcacacacctgacattttatccggatatcctcaccgatctggcagatatctgtatatttcagttccactgcttcagacggcagttcaactccaataccctctaccggtgtcttcccagccacaccgccaaacagctttggtgccacaaaagcctgtacttcctttacaattccagctcgcagtgcactgtcatttaacgtacctcctccctccaggaggatgctgtcaatgcctctgtttccaagatctgccatcagcttcttaaggtctatctgattcttttcgtcgggacagtaaatggtttcaactcccatggtatgtaatatttttattttctcttctgcatttttctgttctgcataagccacgatcgtccggtacttttccgcactttttacaatctgactgcccggcgggatcctgagcttactgtcacacacaatcctgacaggacttttccagccttctacccggacgtttaacatcggatcatctgcaagcacagttccaataccagccatgattcccatgtactgatgccgcatatgctgtacttcttttcgtgcagattctccggtgatccattttgatgctcctgttttcgttgcgatcttcccatccagtgtcatggcatacttcattaccacataaggagtcttcgtagtaatataatggaaaaacaccgggttcagctgatcacattcttctctcataaaatcttcaactactgttacaccggcttcccttaacatctgtacaccttttcctgccactttcggattcggatctctggaaccgatcaccacttttctgatcttctgttcaatgatcgcttccgtacatggaggtgttttaccatgatgacagcaaggctccaacgtgacataaatcaccgcaccttctgctgattctgtaagagaagcaattgcattacgttccgcgtgaagttctccatactttttatgatagccttccccgatgatctttccgtcttttacgatcactgcccctaccataggattgggattcgtccagccttctccttttttggccagttgaatagcccgaagcatatattcctgatccgtcatttctattccttctttcttattcctgttctttgcctgggctacgccgaggcttttaaacatgtgcaatcggattcacagacaagtgaatggtatagttatttcgaaaacgatgtaccagatacaaaaaaagcctgcagaaatatctgcagggtggaattgatctgttacatatgattgataaatgaatgtctgattttcctatataaaaagctctgaaatggatcaccatctcagagctctgatactacattcattcatacaaaaaatcaactgtactatcatcttcttccatccagactgtactgtcggccccggaatctcaccggatcatgcctctcggctcgcgggctttaccgccggtagggaatctcaccctgccctgaagatatctttttgtttattttaatactttatctgttatttgtaaagcagaatttttattttacttagtttactggtttggaaatgaaagttcccggatgagcaattttcatataatttctcagttccaatgccaatactcttaaccgttcaatcgctatctcaacgattttttcatctggatccatctgatccactttttctgccataggcatcctccttcttcctgaaataaaaaaatccgcccagattagaacctaatctaatctgaacggaatactcattcaggcttgatattttccaagcagaaatagttttaatcattacccttttgttagctacaagaatttacaaccttttacaccagttgcattatagcttttcattcctgttagcaaatctactataattttactgttagcaatttgtattttctgttagcaaaaatgctcattttttgatttgctgttagcagaaaaacaacaaaaaaacggcaatgatttttctctcattaccgcttaaaatagagcgttccctataggaatcgaacctacaatagagtcttaggagtatggcttaccatgtgatacacggttcggatgtaacttccaatatcatcccttacgcagaatgacttgtagtaaacgaactttatggtgcaaaacacctattctgacgcagttttatgtgtccgttgggtggtcctattagcaaattcttagcaagaggacaccccgccaaagccgattgctactgccattcttcactcccttagtcaaaatgacaaggcaaatacatggaggttactatgaacaagaaagagaaaaagtcactgccggaaccgcgcacatacaccgtggaacaaattgcggccatgctcaacattggtcgcacaaccgcatatcagctcgtcaagcaggaggagttcaggatcgtccgcataggaaatgcaatccgcgtttcaaagaaatcttttgacgagtggctggaaagtttggaattgtgaatattgcaagaaacgccgtaggctcaaaaaacctatggcgtttttttatacccattttagaaggaggctggcaatgaaactgacagaagcagaaatgaggatggtgtttcagattgaaagtaccaatcagaacgctgccctgaatgagatttacatgacatggcgctatgcgccgaacccggcaacgaaagaaacggcggaaggccttttggacaagcttcgcccactgtcggatcaggagtgcatggatttgatccgcaaggtgcaggccgaataccgtctgccggagaaagcccgcaccatcggggaaatgctggcagaggccagacagcaatccggggcgcagaagttatccggccatgacattatggctttggagcgtttcgacccggcgaccagacacatgatcgtctttgatgttcttacccatgactcgcctgttggctggaagggtgagaaaatgcgcctgttcctgaccgacaccggatacagcaaggctttggaaaatcaggaaaagggacatatcaaaatccgtaaccatgcgaaggtgctttccggcgacctccactatgaccataaagaccgtgagaggtagccgcccccaaaatgtatcaaaatcagtgggatatcttctgtttcttcctcagtggcttgcgttctgaacagggcgtggatgttttcccatgcggaaggctatggaggcatacagacagataaaccgctcaaaatcaacactttttattttcacaggaaggaggtgcgaagatggctgtttttcgtattgaaaagacccgtgattatacggtcatgtcgaaccatcacttgaaagatcggacgctgaccctgaaatccaaggggctgctgtccatgatgttgtcgctccctgacgagtggaattacaccaccagaggtcttgcggcgatctgccgggaaggtgtggacagcatcggtgcggcattgaaggagctggaaacccacgggtatatccggcgcacccagcttcgggatgaaaaaggcaagattacggataccgagtatgtcatttacgaaatgcctcagtgcgaaccgccgtcaagcccaggtacgcttttaccgggtacggcaaagccatatacggaaaacccggatatgggtatcccggatacggcggaaccgtgtacggaaaaccccgcacaattaaatactaatcaaacaaagactgatttatcaagtacagagatatcaaatcctatccaatcaaatccccctacccccgcggggacaaggatgggaacggatcggatgggagccagagaatgttatcgtgaagtgattttggataacatcgagtacagctatctggtgcaggacagccatatcgaccgtgagcagcttgacgagatcgttgacctgatcgtggataccgtgtgttctgcccgcaaagtcatccgcattgccggagatgattatccggcggaggtggtaaagtcccggtttatgaagctggacagctcccatgttcagtatgttatggactgcatgaaggacaacaccacctatgtccgcaatatcaagaaatatcttctggcggcgctgtataacgccccgaccaccatcaacagctattattcttccctggtgcagcatgatatgtacggggacgggcaaagggggcgaggctaaatgcaggaggaagtaacgcggggcgccgtgacgctcattgttgacggagccaagctaagcgaacaagtctttgaaaaggccgtcaaaaagttcctggaggaaatccagaaaagccagaagcccaaaatctaccgcggcaggcagagccttaaacagcttgccagccagaacgccggtcttgccaatatcgagatcagtgacaagaatatcaaggccttctcccgtgtggcgaagaaataccatgtggattttgccttgaagaaagacaccgccgcagagcagccccgttacctggtctttttcaaaagccggggcgcggatgccatcacagcggcatttcaggagtttgccagccgcaaaatgagccatgagaaaaagccctccatccgggatcgactgacccaggcgaaggaacaggcggcagagaaaacggaacaccgtaccattgaccgggagaaagtaaaggtcaaagatcggagcgtgcagagatgaatatgaaaaaattgtttttgctgaaccttccgtatcttctgttcgtgtatcccctcgataagctggcacaggctttccggcttgcgcccggtgctgacctctccggcaagctgctctccattggggacggcttcacgacagccctttcctccccgtggctcagtttccatcccacggacctgctgatcggcatagccggtgcggtgatccttcgcatggcggtctacctgaaaggcaagaacgctaagaagtaccgtcacgggatcgagtatggttctgcccgctgggggactgcggcggatatcgctccctacatggacaaggactttttccagaacatccctatgacgcagacggagcggatcacgatggcgagccgcccaaagcagccgaagtatgccagaaataaaaacattctggtgatcggcggttccggcagcggcaagacgcggttcttctgtaagccgtcgctgctgcaagcccattcgtcctatgtctgcaccgatccgaaaggaaccttgctgccggagatcggcactttcctggagcgaaagaaataccgtatcaagtgcctcaatctgataaacttccgaaaatccatgagatacaacccactggcctacattcggtcagagaaggatatcttaaaactggtgaacgccctgattatgaacacgaagggcgaaggcgaaaaatcttcggaagatttctgggtcaaagcggaacgcctctattattccgcgctgcttggctacatctggtacgaggccacggaggaagaaaagaacttcatcacacttctggaccttatcaatgccagtgaagccagagaggacgacgaaacctatcaaagcccggtggacttgctcttttctcagttggaggaacgggagccggaccacttcgccgtcaagcagtaccgcaaattcaagatggcggcgggtgttgtatgctctaaaagacttcttaatcaagcggttaggaagtctcttagaacacataacctaaaaccgaagaaaggagcgcaagttatgagaaaaaacgagaaaatcacagctctgtacgaacgactgagccgtgatgactttggcaaagatgatgaccaacagcgtgagagcaactccatatccaatcaaaaggcaatgttggaggagttcgccgcacggcaggggtttacgaacattgtccatttcacggacgatggcattagtggtacttgctttgaccgtcccggatttttggcaatgatgaaagaggttgaagccgggaatgtggagtatctgtgtatcaaggacatgagccgcatgggtcgtgactatctgaaagtcggtcagattatggaaatcctgcgtcagcgtggcgttcgccttatcgccatcaatgacggcgtggacagtgccagaggggacgatgattttacccctttccgcaacattatgaacgagtattacgccagagacaccagccgtaaaatccgttccactttccagtccaaaggcaagtccggcaagcacctcacaggcacggttatttacggctatctctggaacgaagcaagagaccaatggttggttgaccccgaagccgccgaggtggtcaagcgcatctttgccatgacgattgagggctacggtccgtatcagatcgccagcaagctgaaagaagaaaaagtcctcattccgtccgcttaccttgcccagcacggcgagggcgtgaacaaaaacaagactttcaaagatgtgtacggctggggttcttccaccatctgcaacattcttgaaaagcgtgagtatctgggacacaccatcaatttcaagacccgaaagcacttcaaggacaagaaaagccattatgtcccggaggacgaatggacaattttcgagaatacccatgaagctatcattgaccagcagacctttgaccttgtgcagaaaatccgtgggaatgtcagacgctacccagacggctggggcgaagcagctcccctcacgggcttgctctattgcgccgattgcggtggcaagatgtatgtccaccgcaccaacaacggcaagcgtatttctcaatatacctgttcccaatacagcaaagtcccagttggaaagctctgcacgacacagcaccgtatcaatgaagatgtggtactgtcccttgtctctgaaatgctgaaagccattgccgagtatgcgaagcatgacagagccgagtttgtccgtgtggtgcaggaagcgcagtccagccagcagaccacagaggtcaggaaacagcggacacgccttgccacagcaaagcagagagtttccgagctggaagtcctgctctgcaaaatctacgaggacaacattttaggaaagctgtccgacagcagatacgccactctggacgctcaatatgaaaaggagcagaccgagcttaccgccgaaatctctgttctggaaaaggctgtcaagagctatgagaagcacgaaaaggacgctgaccgttttatcgctctgattgacaagtatgagaacttcgacaagctgacgattgccatgctcaatgagtttattgagaaaatccttgtgcatgagcgtgaccgcaagggcagtattcagaccacacaggaggtcgagatttacttcaatttcgtgggtcgtttcgttccccctgcgtttggcgaagtggagcttaccccggaggaattagaggaaatccgcaagcgtgaggaacgcaaggacaggcttcatcagaactacttgaagcggaaagccagcggagcgcagaagcgatacgaggacaaaatcaaggggagaaaaaaggcagaaatcgaagccaagaaagccgctattcgtgcggaggatattgcaaagggagtgttcgtccctgtcagcagtttaccgcagagagagccgatgaaaggagtacaaacagcatgaatatcacttatacacagaacggcgattatcttatcccgaacatcgttatccgcaagaccaagcccctcggacactacggcagacttcgcaaggcgtatctggaaatgcaccgtccgatactgttcaatgaactggtgctatccgacaagctctttgagcattgcgccgagattgacgaagcggcacgaaaccgcatggagctgatcgtgcggtcactggcagagcaaaacggcgtgaccgagcaactaaaagccaaaaaccaaatggaatgggtgcggcagatgaacgcttgcaaggcacaggcagaggagattgtgaaagcggaattgatttatgattgagcgaggaagtccgggcagaaaactgttcggacttttctcatgtagtccaaagttgcggtagaattgttcacgagttttatggtacaatttatgcgaataaaaaaaacggaaaattagaatctaacaagagaatgtggttgtatgaaaaaatccatattagtattttgggcaatcgtgtgtctgttacctattcaaaggaggtttaagaatttcaaatgaaacatataagaaatatattgctgttgattacgattatttttgcttttgttatgcaagctgaagtatatcaaaatatgctctggaactttaatggtgcttattatttatcgtccagatacacaactactaatgacgatatggattcatttttagccaatgcagaagatacagctgagaagcatggtgttcatattttttcgacttttaatcagagagtttctaattatcagacaagactttatatttatggtgatgataccgttgttcgggatagtcttaaaagcacaatggatattgaggaaaaaacatatacggctttgataggcggaatcaccgtaatagaatttgaagattttagagaagcaaaaaacacaggcaatggacaggaaataatggtcagctatatcggtgacgatgatgacattattgccacatatcaagatttggcaaaagaatattctatatcgcagccagagttttggcaatcaaccgaaactgatatgatgttcattgtttggggcctggttgccatattgatgattgtacttaatatgattgaggtgatacgcagacaaaaggaagtagttgtacgagcttctctgggcgaaaatgctgctgtgattgctctaaaagctgtagtggctgatatgatttcatatgctgcattattcgtcttagcaaagttgcttgtttctcaatttatatcgggagcgtatgaagatcatctcattttggcagtgtattgtgccggagcagttctttccgtaattccttatgctgcttttgtccgctttgatgtaaaaaaagcctttgccaatgcttcagataaaaaaggtatgttttatcttctgaacggtcttaaagtatttgctactgctatgacaatttttacaataactacaaatctcagtagcattcaaggtaatttacttacaaacactactcttttagaaaatcattataatgattattattttggagttatgcagattgaacctccttttgaagaaaatgaggaggaatccaaagagagcaaattttggaatgacctttacgaaaatgaatacaacactataaatccggtggtctgcataggcagccggataagcgatacggataattatatttttgtaaatcataatgccagagatatgctacaagggttttctgatatgcttactgaagatgatgaaaaagaggatatcgtggtcttcgtgccaaagggaagaaatgcggaatcatacaaagatatcgcaaaagaggaaattgactctcttacccaaaatgcagaagaactgcgtgttgtttataaagaatattctggcagagagcaattttattatctcaattcgaacagagaagaggctattgacggattgtcaagagcaacaaatccgattgttatttatcaggcaaatgaggctgttgctttgaatggaagttatatcgaaacaggaacatataatggtgaggtaatctacggatgcgatgaaagcacaattcgtaatgctgcgaaaaaatatgcagaacagcttggttcacactattttatgctgacgaatgtcggagaggattacatttatagtcatagtttccttgtaaaattgattagctttataagctctctttgcgtattagtattgctgttagatatagctatcatcgtatctgaagcgaaaatggaatttagacttagctctatggaaatctccctcaaaaaggttttaggttatagcttttatgaaaggcacaaaagatttatttccgttaatctcatagaaaatatagccgttgtgatattgatttgcattgtttcgatttttatatctaacgcaagtgtcgggattgctttactaattggatcattgctcaccattattgaaatggcaatcattttcacaaatattatgtgggttgaaaaaacaaatatctcaaagtcattgaagggaggatgtttatgattataattcgtggcttaaataaagcatttggagagaaaataattttctccaactttaatttggaaattccggatggaagttttgtagtaatcagcggggatagcggcagtggaaaaagcactttgctcaatatgattggtggtatcgaaaagccggatagcggcagtatcataatcgaagggctgaatattacccggcttaaaaataaaaacagtttttttgcggatacagtggggtttctttttcagaattttgcactgcttgaaaataagacagttaaagaaaatttaagtttgattaaaaaatcaagccgaactaaagtatcacttaaagaagctcttaatcgtgtggggttatcaaaggaagttaacaaaaaagtttatcagctttccggtggtgaacaacagagagttgctttagctcgtcttatgatgaaaaaatgttctgttgttttggcagatgaacctactggctcacttgacaagaaaaatagagatattgttatgaggttgttgcacgaactcaatgaagaaggtaaaacggttatcattgttacccacgatcagggtattattgaagatgaaccttatgttgtgaaaatctgagagtacctcttagaaatgtcttgatctacattttatataatttgggtcagaagaaaatccctttaggaactaaagggcgcacttctatactctctgtcgagagtagtgcgccctgcggagcttcattctccgtcagcagaagaaaactgcatgaccgagaatgttgcgtcacttcgttccgtcaaggtggctacacccccttgcgccgctaaagcggctatcccctgtggacttgccgtccgcaaacggttttgacaaaccgttcgccgccagcaagtttgaaaatcaagaatcttaatttgataaagactaactattaaaagtcaagtctgaaaatgaaatattttgaatgaattgcagaaatgcatttcagatatatttgtaccttgaaaactgcatgacaaaaagagtgtcattagcggcactcagct

SEQ ID NO: 17 - DNA, 70918 bp, Roseburia hominis
cgtgcatgagcgcattgacgaaaataaaacaagacacatttctatcgaaattcattttaatctcaaacccatcccggaggtggaacaggtcactgcctgacctgtcccgccgggacggttctcttaaaaacaccatatagattttttgtacgccgccgcccgccatcgagcagagttttacacctaattggggataaaacagttgatggccggcggcggtgtcgccctcatcggcatcacccttgtacctctgctctccggcctgttcggttgatcgtctggcggtgatcgcttatgggtggcatactcgacaaactcgatgaatggctccgagggctactcatcgagggaatcacgggaaacctgtcgggcatgttcgatacggtcaataccaaagtaggcgagatcgccggtgaagtgggacagacgccgctggcatggaacagcggcgtcttttctatgatccgaaacctctctgaaacggtgatcgttccaatcgccggggttatcctgacattcgtaatgtgttatgagctgatccagcttgtgacagagaaaaacaatctgcacgatgtagatacctggatgttcttcaagtggattttcaagaccttctgtgccgttctcattgtgacgaacacatggaatatcgtcatgggtatctttgatgtggggcaaagcgttgtgaacagcagcgcaggcgtcatcatcgggaatacctccattgatatcagcagcgttatcacggatatggaggcacagcttgaagccctgggcacgggagaattgttcgggctgtggttccagtcccttttcgtggggcttaccatgaacgccctttccatctgtatcatgcttgtcatttacggccgcatgattgaggtgtatttgacaacttccgttggaccgatcccgcttgccactatgacaaaccgggattggagccatacaggacagaactacttgaaatccctgtttgcattggcgttccaggcatttctaatcatggtgtgcgtgggaatttactctgttttggtacagagtatcgccacggacggaaatatctcaggcgcgatatgggcctgcatgggctacacggtcctgctgtgcttcgccctgttcaagaccggcagcctctctaagagcctgttcggagcgcattaaggaggcttgataaattggcgtatgtaaccattccaaaggatttgacgaaagtaaaatccaaagtgctgtttggacttaccaaacggcagcttatatgtttcggagcggcggcactcatcggagtaccgcttttctttttgctcagacgcacggccagcaacagtgccgccgcgttctgcatgattatcgtcatgctcccgttctttctgcttgccatgtatgagcggcatggtcaacccctggaggtggtggccggacaggtcatccgctgtatgttcctgcggacgaaagagcggccttaccagacaaacaatttctacgcagccctggagcggcaggcccaggcggaaaaggaggtgaaagccattgttcagaaagcgaaagccagagccgcaggcacggcaggcggcaaaacccacggtaaagctaaccgctgcggaaaagcgtgagatcagccgtattctggaaaccgccagaggcgacggcaaggtacattccgcacaggacactttaccgttccgccagatgtacccggacggcctgtgcaagctggacgaccacacctggtcgaagtgtatcgagttcgaggatgtgaattatcagcttgcgaaacctgacgatcagacggcgatctttgaagccctctgcgatatgtataacgcccatgacgcttctatcgggatgcagctttcccttgtgagccgccgcatgaaccgggaggattttgtaaagcgtatcgagatcgcggcgcagggagatcatttcgaccatatccgtgagctttacacacaaatgctccgcaagcagcttgaacggggcaacaacggtcttatcaaaacaaagtacctgaccctcaccatcgaggcacgggacagcaaaaccgcacgggcacgattttcccggatcgtcatggatgccctcaaccatttcaaggtcatgggtgctctggcaaaggagcttggcggcaaggagtggctggaaacgctccacggcatcctgcacccggacggggaacggtttgcctttgaatggagctggcttgccccttccggcctgtcggttcaggattttatcgcaccatcttccttccgcttcggtgaagcacggaagttcacgatggcggataaattctgtgccgtgtcctttctgcagatcagcgcaccggaaatggatgaccgtatgctcaccgagctgctggatacggacagcgggctgcttgtcagcctccatatccgcagcatggaccagaacgaggcaatcaaaacggtcaagcggaagatcactgacattgacagtatgaagatcgacgcacagaaaaaggcagtgcgggaaggtttcgatatggatatcatccccaccgaccttgccacctacgcaggcgaggcaaagaacatcctccgtgatctgcaaagcagaaatgaacgaatgttcctaatgaccttcctggtggtgaactttgcggacagcaagcaaaagctggagaatgaccttctccgtgcggcaagcgtggcgcagaaatataactgctctctggtacggctggactttcagcaggaggacggcttcgtgtcggctctgcccctgggtgtcaaccgcattaagatacagcgcggacttaccacttcggcggtggcggtgttcgttcctttcaccacgcaggagattttccacggcggtgaagccctctactacgggctcaatgccacttccggcaacatgatccttgctgaccgcaaaaagctgaaaacacccaacggcatgatcttaggtacgcccggcagcggtaagagcttttccgcaaagcgttccatcgtgggtgtgttcctgaacacaaaggacgatatcctgatctgcgacccagaggcggaatattttccgctggtgaaccggctggaaggccaggtcatcaaaatctcgcctaccagcacgcagtatgtgaaccctatggatatcaacctcaattacagcgaagatgataacccactggcgctgaaatcagactttatcttgtcgttctgtgaactggcggcaggcggccggaacggtctggagccggtggaaaagacagtcatcgaccgtgccgtgcggatcgtataccgctcctatatcgcagacccccgcccggagaatatgccgctgctggaagatttgtatgacgagatcaaacggcagccggagccggaggcacagcggatcgcggcggcactggaactgtatgtgcatggcagcctgaatgtttttaaccaccgtaccaacgtggatatcaacaaccgcattgtctgcttcgatatcaaggagctgggaaagcagctcaaaagcctgggtatgctggtgatccaggaccaggtatggaaccgtgtttcccaaaaccgggatcagggtaaatccacctggtatttcgtggacgagttccaccttctgctgcggggcgaggttggttcctggagcgtagagatttggaaacgctttcgcaaatggggcggtatccccacgggaatcacgcagaacatcaaggacctgctttcctccccggagatcgagaatatctttgaaaacagcgattttgtgtaccttctgaaccaggccagcggagacaggaaaatcctctgcgagcgcctgaatatctccaaccagcaggcggcgcatatcagcaacgcaggccccggcgaggggctgatcttcttcggcaatgtgatcctgccttttgtggatgacttcccgaaggacaatgaactttacagcattatgacaacaaaacttggtgaaaccgggaaaggagaaaacgaacatgaatgatccccgctatttgcatacggaagaaaaacaggagggtgaaaccttctttgatgtgatgaaccggctgattgccagaagcaaggcggtcacggcggatatggaggcggttcttgcggagctggaaagtgagatcgaaccgttccgtgcgccgaaggaccatgagtaaactgacccatgtgagcctgttttccggcattggcggtctggacctggcggcggaggctgccgggtttgaaaccgtctgccagtgtgagtgggcggatttcccgcactccgtcctctccgcacgatggccggatgttcccaggttccgggatatcactactttcacgaaggaggcgttttttgaaaaaacaggacttgaaacagttaccgttatctcaggcggctttccctgtcagcccttctccaccgccggaaaacggaagggctttgcggatgaacgctacctgtggccggaaatgtgccgcgttattaccgagctgcggccccgttgggtgcttggggaaaatgttgctggcttcatcaatatggggctcgacaaaacgatctttgacctggcaaaagcgggatacgctgttctcccattcgtatttccggcttgcggtgtcggcgcatggcatgagcgccagcgaacttttatcgtcgcggctgatgtttcccacaccccttgcctccgacaacaacaccgccagggacgcggcaagcctggatgtgttcctgtcggacaatgggatattccgcaagaggaaccgaaacggggcgatctggagcctgagcctgtcggcggcggtattctatctgaccccggtggcgtcggacggtttccgctcgaccttgaagccgtcggccttcgatccagcgaagaaggacgggaacctgtcggcgcaaatcatctcccaggaacagccggtgtccgaaacggcagcactgaacccggattgggtggaatggctcatgggcttcccgaaaggatggacggacgtatcctctgggccgccgaaccggaaggaatcccccgcatgaccgagcgcatggaggaccgggcactgcggctgaaaacattgggaaatgcggtctgcccgccccaggcctatcccattttccgctatatcgccatgatcgagaatggcacctgcggcgacttttgcccttatggaaaggaaggtgactgcctatgagggaactgaaagcgaccgataagatcgcgcagaaaatgacccgtgacggtgcggtatcggaaaaccttgccacgggagaggtggaacatatcagcagccgggagccggaaacggaactgtccgcttcttcggaagaatccgctggcgctgcggctgaccttgccctgcgtgcggcggaacaccatgagaagaaaagcgcacgaaaggcggaaaaggctgatatccaggcggtgcgggatggttctgctgcaaggcagcgcccgtcctcccgtctgcaattcaccgaggaagaacgtgccgatcccgcacttgggaaatacattgaccgttccgaccgtgcggcggatcggctggatgcggcaacggccgctatccccacaaagaaagttctccgtaccgagcgtgtttttgacgagacagccggaaaaggcaaaacgcagcttcactttgaagaagtggagaaacgccccaacggacggctgcggcacaatccgctttctcggccggtccatgagattgtccacgctgcccatgcgaaggtgcatgaggtggaacaggaaaatgtgggtgtagaggctggacacaagggcgaggtgctgacggaacgcgggcttgcctacggaaaaggcaaagtccgtgccgccgtccaccatcaccgcacaaagccctggcgtgacgcggcgaaggcagagcaggcttcttttaaggcaaacgccgactacctttaccaaaaggcactgcatgatgatcctgcattggcagcttctaacccgatatcccgctttctgcagaaacagcggatcaagcggaactatgcaaaggagctgcgacaggcagagaaaaccgcaaagaacacagcggccacggcgaaaagtgcggcgcagaaagcaaaggacgccttcaaggaaacattcctctacatcaagcaccatagccgggcggtgctgttggtgatcggtattggtgcctgtattgccctgctgtttggtggggtatcttcctgttccatgatggcaggctccggcgtgggcggtgtattcacttcctcttatctctccgaggatgcggatatgctggctgcggaggcggcctactgcgaactggagcaggagcttcaatatgagctggaccactatgaggctctgcaccccggatatgacgaataccgttttgacctggacgagatcgaacatgacccttatgtgctgatctccattctcacggcgtcccatgaaggggtgttcaccatcgacgaggttcaggaggaactgcaaatgctctttgaaaagcagtacatcctgacgcagaccgtggaagtggaggtgcgctatcggacggagacacggacagacagcgaaggaaacgactatgacgtagaagtaccgtacaactactatatctgcaaggtgaagctggaaaacttcgacctttcccatgtgccggtctacatcatggacgaagaaacgctttccctgtatgcggtctatatggcaacgctgggaaaccgggaagatttgttccccggctccggctatgtagataagtacaccaaaccgcccaccacctatgatatcccgccttccgcactggaagatgaaacctttgcggcgctcattaccgaggcggagaagtacatcggctatccttatgtctggggcggcagcaatcccaacacttcttttgattgctccggcttcgtgtcctgggtgctgacgcaaagcggcgtctgcaatacgggcaggctgggagcccaggggctctacaatatttccaccccggtatcctctgccaacgcaagacccggcgacctgatctttttcgtcggcacttacgatacaccgggcgtttcccatgtgggtatctatgtgggcggcggaaaaatgctgcactgcggcgaccccatccagtatgcagatatcaacacaagctactggcaatcccacttttacgctttcgggcgaccgccctacaactaaaaaacgatatggaggtaatttgatttatggcaacgacacagaagatccgcaatgacattgcgaaaaccaaagaaaagatcgcggagcagcagaaacgccttcgtgcgctggaagcccagcttgcggaggaagaaaatctggaaatcgtccgcatggtaaaagccgtgaagatggacaacaaggagttgaccgctttcctgaaagcctatgccagcggtatgatctccctgccggaaggtatgctgcaggagggcaacaccgagaatgaggaaacggagggatacgaggatgaagcataactttatgacaaaaatggtatcggctcttttggcggtggtgctcagcactgccgctttttctgtcaccgcctttgccagcagcggcgaggaaagcacggagtccgtggctgaacaggaaacggctggggatgtctctgatctgctttccgcgctggcaggcagccaggtcacggtatccgtcaccgaggatggtatccagttcagttccggcgaaaatgactctgagcagaccggcaccgtcaccacgggcggcggcaatctgaatgtccgcacgggcgctggaatggattataccgccttcactcagcttcccaacggaacgaccgtgaaggtgatcggcacggacggcgactggctgaaggtcatcctgccggagaaagtcggctatgtctattccggctacatgacggtaagtgacggcgaggctggctccggggaaggtcctttctctctggacgcggaaacgctggaaaatctgctggggatgctgggcggcggtctgaatggcggtgccgccctgacgccggacgggaacctttcgctgatcgacgatatcggcagccctgtcaccagtggcaagcagtttattacagtagaaacgaagaacggcaatgtgttctatctcattatcgaccgtgacgacgagggcgaggaaaccgtgcattttctgaaccaggtggatgaagccgatctcatggcactcacggaggacggagaaaaggcggaaacgcctattgtctgcacctgtacggagaagtgccaggccggagcggtcaataccgcttgcccggtctgcgtaaagaacctcagtgaatgtgttggcacagaacagaaagctgcggaacccaccgagtcggagaatccgaagcctgaaaagaaaagcaataccggggcgatcctggcggtgctgctgatccttgcagccggaggcggcgcggcggtctatttcctggtgctgaaaccgaagcagggcaagaaagttcccgctgatctggatgatttcgacctggaggatgaagaagaatatctgactgaggacgaggaaacggaggaaaagaatgagtaaactgattattgcggaaaaaccgagcgtggcaaaatctatcgcgtcggccctgggtgcttcatccagggccgatggcttttatgaaggcaacggacttctcgtatcctggtgcgtgggacacctggtatccccgatggatgctggcggctatgacgagcatttcaagaaatggcgctatgacgatcttcccattctgccggagccgttccgttatgtgcttgcaccgggcaaggaggacgcttttgaaaatctccgtgccctgatggaccgccccgatgtggataccgttgtcaatgcctgtgacgccggacgtgaaggggagctgattttccgactggtgtatgaaatggctggatgccgcaagccggtccttcgcctctggatttcctcgatggaggacagcgctatccgagagggcttttctgacctgcgccccggcgccgattatgaagcattgtatcaatcagccctgtgccgccagaaagcggattggctggtggggatcaatgccacgcgccttttctccgtcctctatcaccgcaccctgaatgtaggccgtgttcagacgcccacgctggcaatgctggcggagcgtgacgcaaagatcacgctgtttcacaaggaaaaatatcatttgctgcgcctgacgctggatggagccgaagcggtgtcagagaagttcaccaatccggaagaggcggaacaggcagcggctatgtgcaagggtgtgaccgtcacctgtacttctgtcacgaaggagcaaaagaaggaacagccgccgaagctctatgatcttaccaccttgcagcgtgaggcaaaccgcctgtttggatacacggcgaagcagaccctcgactacgcccagagcctctacgaaaagaaactgctgacctatccccgaacggacagccggtatctgacctccaatatggcggaaacggcgtcctgcgtgatccatctggcggcaaagctgccgccctttgatggctgcacaaacttcttcccgctggtagaggctatgatctccgacaaggatgtatccgaccaccacgctattattcccacgatggagattgaaaaagcggatatcaaggttctgcccctgggcgagcgcaatttgttcctgatggtctgctgcaagctgctgtgtgcatcggcggagccgtatatgtacgaggcggtcacggccacctttgactgctgcggccattcctttaccgcaaagggcaagcgcatcctctccgaaggctggagggagattgatcgcattttccgtgcctccctgaaggaaaagcctgcggatggggacggcgatacgctcccggacttcaccaaagggcagacttttggcggtgcggaggttgctgttaccgagcattttacccagccgccgaagccctactccgaagataccctcctgtccgctatggagaacgcaggcaaggatgatattcccgatgaggcggagcgaaaaggtcttggcacgcctgcgaccagggcggctatcatcgaaaagctggtagcagccggatttgtggagcgtaagggcaagagcctgatccccacaaaagccggtatcaaccttgtcacggtcctgccggagtcgctgacctctcccatgctgacagcggaatgggaacagaaattgacggagatcgcaaagggcggcgctgacccggatgccttcatggacggtatccgcacgatggttcaggagatcgtgtccacctattcctgtatttccgaggatggcaaaaagctgtttgccccggagaaggaagtgatcggcacctgcccccgctgcggccagccggtctatgagggaaagaaaaactttgcgtgttcggatcggtcctgcggttttgtcctctggaaaaatgaccgcttctggacgagccgcaagaaggagctgacaaagaagatggcaacggaccttctgaaaaagggccgcgccaatgtcaagggaatgtagtctgaaaagaaacaggctacttatgacgccgcggtgatcctggacgacacgggcggcaagtacatcaatttcaagctggaatttccgaaaagaaaggttggtgctgatggcagaaaataagattttggaacatttacccgaagtgagggcggcggtggctgccctctccccggaggaccgggaggtgctggcggcggtgcagacctcgcccttcaagctgacaacaccagagcagttcaaggagtttgcggacaacatcgactatttcgtatttgagcccaacatccacaatctgaatgatctgggctggcggtatctggcgcagcacatggatatgctgctgcccccggaacttctgaaagcaatcgaccctgttccttttggcaagtatgccatgcaggaggaacagggtcattttacggaacacggatatatttctctctccggcgacgagtggaaccatgagcgccctgcggagccggagaaaaagccctccatccgggaacggctgaaacagggcaagaaggaatgtgcggagaaaagcaaggcgcagccccataaagaaaaatctgcgccggaactgtaaggaggtgctgatatgccatattacgatcacgacaaagattatccctttgccgcctttatcaccaatcttgggaagtacaatgagggcgagcttgtgggcgagtgggtgaagtttcccaccaccgccgaggaattgaaggaagtgtttaagcggatcgggatcggccagaaggatgacttcggccagccctatgaggaatggttcatcacggactatgactgctatgtggacggtctttacagtaagctgggtgaatatgaaaatctggacgagctgaattatctggcatcgaagctggatgaaataagcgaaagcgaatacgcacagtttcaggccggtatggaaatgggcgaccattgcggcagcctgcaggagatcatcaacctcaccgagaatctggattgctatgaggtttaccccgatatccatgactatgacgatctgggccgctattacatcgaagaactggacgttatgcaggtgccagagcatttgcagaattacatcgactatgaggcctacggccgggacgttgcgttggaggaaaacggcaccttcacggatcagggctatgtgcgtgatacgggtgacagtttccatgagtattacgacggtgagcgcggcagtatccccgacgagtaccgggtgatgaccttccaggacgatcttccagaagaagaaaaatccgagtgggctatggatatcgcctttgacatggacgagtttttccgtcagaacgatccgcagtatgcggcggagcacccggaggcgcacgccgcaaaggaagaactttacgaaaatctgatggccggacgcatttccgcactggatgaaaagctggcggcactggggcagacgcaggaggactatcttccttcggagattgaaaagttcaaggatgccacgggctatgaggaatttcttgattttgacccggcggaggtcaaggcagctttggaggacccggagaagtcccatgcggatgaaatgctgtccgctgcggaaagggctgcctcggaaaagatgactgtgcttgtagtggaacctatgaaggaaccctatgtgaaggagatcgaccccgatcttcattccctacaggcggaggtcggcggagacattggcgcaacttatccctattctgacccggtggcgctggtctgcaatgatgaaggaaagctcatagggcttgatctgaaccgtggactgcgggatgaagatggagaaatttatgatatcgtagcaggaacattcctggtggttggacttggtgaggaagattttgcgtccctgtccccggaactgattcagaaatacacggaacagttcaaaacgccggaacgatttatgcagatcaatggcaatatcgttgttctccctgtcccggcagagaagcaagacctcgcttatctgccagaccgttttgaaactggcgagcgtgtgcagacaccgaggggcagctttcaggtgacggctatgagccgggaacagatggaggcggccggttacggtgtccaccatatttccgatgatggaaagtatcttatcatgggaaatggtacacgggcctttgccgtggcagcggagcagccggagaaggacaatcccctccgcaccgctgaaatgacgctggaggatgactacggcatgatcgacggcgttatcaacaacggcagacgcggcgaggaattggaaaaggcccaggagtacgcagaacggataacgccggagaagccttccatccgtgagcggttggaggacgccaaacgggagtgtgctgagcacaaacccccggagggaaagaagcccggtcgtgatgtgccggagcacgactgcctatgagccgaagcaagaagtggaagctggaatgggcgttcttcctgggcgagaacggcagacggcagtataaccatatctgtaaaaaatgtgttcacggctgcaagcagagtttccgggcgtgtctggtcgcttgtccgcattacaattccaaacggtctaaaatatgtgaagataagggggcgaaaaacgcagaataattccctgtattcgtattttcaaagggagcctttatgatttctcatgtgtcggtctgcttgctggcacatagagaaaatggctcgattccaaacactttctgatacacaaaacgggagtacagcttttcggttcgtccgattggctgtactcccgctttttctttttgctatcatcaaattactttaacacggttctgttgtttgaacaggggtacaaattgtacctccgtggaaaaggaatttccatagtattttctcattaggattggataggaaaggatggatagccgccgcagtaggcgttgtgggaatgtgtgtaaactgccaggattgtgaggctgtgggaaagctgtttgcagacttgtgggaaaaggcttgtctttttccatcaggttgtgaatggcttttccatcggcacgagcggcagttttccatatttccatgacgcaaaaatcagcctacaatcagccggtacaccgtcagcggcacataccacaccgccacgatcagccgccatgccagaacaaaaccaccgattacgccgccgataatgaagttcaacacaaacagggcaatccctccacccagggagccgccgcccggcacgatccagaggcacatccgatggaggccaaacggcagcccgcagagtatccagagccatacatagtcaagctctccgttcttcatgcaggcggatttgaagatacaatacagaatcagcgccacgatcacgggcaggacacttttgaagaaaaatgctttgattgcttcgcttcttgtcatcggtaaaacctccttccgcagttccattatacaggatgccgggagctgtgcccagcgtctttcagagaaaattattcaagttcatgtcgccgctgttgttcctgttcctttggaacggtcagtagtgcatctacattctgtttaacagtatcgtattcctgggcttcggttcttgcggctttgtattcagcaaggagccgttccttttctgcgttgagattggcaagctccgttttcatgctttccgttgtcggtagcggcacagcccccagccgtttcaattctctggcggccgcttcaaaaaggatgatctcgccctcatgcccccgcaggaacttttctttatcattcgatttacggtatcggtcataaagcggctttagctgacggtaagttccggcgtgcttcatcacaagggcaagctcggcacttctgctttctatccgcttgatctctgcatgagcagtatctctccatgcggataatgcggttagcttgctttccagttctccatagctgcttatcccgtgttcggttaggaaatttatggtcttggcggcctgtttcagattgttcagcttcgcccaatgggtgaagcctgcgctctgctgtgccttgatattgctctgaatgtcaatgagcaggttgaccttcccgctgcgctgtttgggctgtctggagggcctgggacctccggcgatgcgggaggcaacggcttcttccgtgtaatcggcacctagggttttgagccgggtgaaccgctcctggtccggcgccctggcggagatatatttgccccgcttgatctcatagccttctctctgcaggcggcgaagcagttcttccaaatcggaacaggctggcagaagccggtcaatggcagctttcaactttgccttatagctggtgccattctgcgcggcctgatgttcaatatagctcttacccttgtcctgtccggggatgatgacggacagaccgtgttccttgcaaagctggtctgaggtgcggcggatatagtgatagctccgcttgttggaatgatagtgcttgtgatccgcaaagctgaccgcattgaaaatcagatggttatgaacatgatctttgtctatatgggtggtaagcacaaactcatacttgccgcccagaatttcttttgcaagctccataccgatctcatgggcctgttccggcgtgacctccccaggctgaaaggcttggatcagatggcggcccaggtttgttcctttgtcgatggcgtggcggcgggtccaggaaaattcgatatccgcagtttcggcggcgcatccataggaggatacaagcagctttccatccgtcttttccgggttgcagatatagtcaatggctgctttcagcgttgacttgataggatgtgtctttgtaactgccatatctcgtccagcctttcccgtatctcgtccatgtcagcctgatacgcagggcctccggcgttgatccgcttggcgatctgattgatgttccgaccgatagcggaaagctctttgatgaacgccttgatatctgcggtgtccgtatagatgatatatccgtcaatcgccattttgcggagatatgcaccatatctgcgtgtgggtagctggctcattttctcatctatgagccgtttttcgtcctccgtgacatagaatttcatttggatattccgctttcggtttgccatgcgccgcctccgttcttcataagggtttgggattatcccaacaagcaattttggattttcgggcaagggacctgaaaatttcaaaattcgcaagcgggtactcgcttgctgtgcttgctaccgtatcttatccctacttataaagcgtttcggaagcctcaaaatgcccgcaaaataagaaaaacagaggatgttcagacaccctccgtttcttcattcggcttttcaatttttaaggccccgtcaatggcaccttccacgataggcaaatactgttccgggcagagctttaacttctgtccgacccgctggcgcagctcgctttcctctcgcatgacctctggattgaaatatctctccatcggcaggccgcagatttttacaagctgtataatgaccggcaagcttgggatcgtgccctcgttttcgatgttggcaagatacctggtatcaatattcaccttttcggctaaatcttttcgtgcaaggttcttcgccttccgtgcttcttttacatctgcaccgaaggtttcaaagccagggcagtctttaacttttgccattcaacatcacccacatacattctatatttcatagtttgtgcatggaatgatgtgatatccattctgtctacattttataattcatatctttaaccttgtattcttcgagcagacgaaatataatattttaggaggtgcaaaatggactatataacattaaaagaggcaagccaaaaatggaatgttacgccgcgccagataaattatttgtgtacatctgggcgcatccccggtgctgtaaaaatggcgacgatttggcttattcctaaaaatgcagagaagccagtagacaggcggagaaaagaaaacaaatctcagtgaggtttctgtgacatttgggtgatacactgaaaatgaaggagtgtgataccatgcgaattttagtagtcgaggatgatcgacttttgaataatactttatgctataacttgaatactgcgggctatgcggttgattctgcactgacaaaatcagcggccggtaatttcttgacgaagcaggactatgacctgattgtgctggatgtaaatttgccggacgggaacggttttgacttctgccgggaggtaaaagagcgccgccccgataccgctattatctttctgaccgcaaatgatatggaaagcgatatgctcaaagggtatgagctgggtgcagaagattatgtgacaaaacctttccctatgagtgtctttcaaaagaaactggcggtagtgctagggaggctgacaaaacaatatggtggtgatacttatgaggatgacatactgaccatcaatttttcagaaatgagtgctactctatcaggaaagccacttacattcacaccactggaatatcgacttttgaaaattctgatgaaaaatccacagattgttttgacccggcaagtcttgttggaaaaattgtgggacgcagacggaaatttcgtggatgaacacgctctgactgcggctatcagccgggtacgaaacaaaattgaaacacccgaccgtcagtacatcaaaacggtatatggtatgggttatatgtggattggaggggtgctgaaatgaatgggcgaaaactctctgtcaacaaagcctgtctctttttagctgttctcctgctggtggcaatggggacggtttcagcagctttgtatgggctaactcagaatataaccgctgtctggtatgtagtattgttcggcatctttgtgctgctttgcgctgtttgttttatggtgctggttcggcgtaaactggcaatgttctccgatagcttttgtagtctgatagataatatgttgtccgggaatatgcagccgaaacagattattgaagaagaaagtcttttctataaaattgaatatcggctgaaccgtttatatgaagtcatgcaggaaaacaagaacagcattgcacaagaacgggctgacctgcaagaactgatttccgacatttctcatcaggtcaagaccccgattgcgaacttgaaaatgattaacagcaccctgcttgaaaatgaagtccctgtgcaaaagcaaaaagagtttcttacagcacaggccagccagcttgataaactggattttctcatgcaggctatgattaaaacctctcgtttggaaacaggtgttatttctctggaaaagaaaagccagccgctttatgacacgcttgccgccgcattgggaggtattcttctgaacgccgagaaaaaacagatcaatgttcaagtggactgcccggagaacttggtcgtttcccatgacagaaaatggacaagcgaagcactgttcaatattttggacaatgcagtgaaatatacgccggagggcggtcaaatccgtgtttcggttgaaagttgggaaatgtatgtgaaaatcgacattgcagatacaggcattggcatttcagaacagcatcagggagcaattttcaagcgtttctatcgagaggacatcgtacatgatgtagatggaattggtattggtctatatctggctcgtgagatcgtaaccttgcaaggcggttatatccgggtaacatccgaggttgggaggggttcaactttttccgtctttctgcctcgacaataaaataagtacgctaaaaaacaaaatgtcacaggcctatgacatttgagatttaattaaacagaggtattttgtttcccgtgacatttctgtgaggtttaccttttatgatagagccatcaaaaagaaagggtggtgttctatatgaacatattacaaacgacagatttgaagaaatattacggcaccgaaccgaacattacaaaagcattggatggcgtgaccctatccattgaggaaggtgaatttgttgccattgttggtacttccggcagcggtaagtctactttgctgaacatgatgggcgggttagatacgccaacttccggcagtattaaagtaaaagggaaagaattatcgaaactcaaggatgaacagcttaccatcttccgcagacgtaacatcgggtttatctttcagaattacaatcttgttcctgtgctgaatgtctatgaaaatattgtcctgccggtggagctggatggtgataccgtggacaagcggtttatggatgaagtcgtgaaaatgttggctctcgatgggaagctgaacagtatgcctaacaatctgtccggcggccagcagcagcgtgtagcgattgcccgcgcccttgtttccaaaccagctattatacttgcagatgaaccgacaggcaatttggatagccggacaagtagtgatgttcttggtttgctgaaagttacaagtcagaagttccatcaaacgcttgtaatgattacccataacaatgaaattgcccagcttgccgaccgaattatccgtattgaggacggaaaaatcgcacagtgacagggggtgacattgatggatgatattttatttgggaacaataatcaggcaacaatcaatcgtcttgccaaaagaagctaccgcgctaataagcagagaaatgttttcgttaccatcgcattattcttgaccgcctttatgattacatctgtatttagtttggggtgcagttattttgaaacctatcaaatgcagcaaattcgtgcgatgggcacgactgcggatgtggcaattacaagcctctcagaagaacaatatgaagaattgagccgatccagcttggtatccgtagttggtgtcagtcagagattgggcagcattgatacatctggaatggacgatgccctgctgagtattacttggatagacgaaacagaatggcaagaacaccgtgtaccaacaatttcggatatacacggagattatccgcaagcaaaaaatgaaattatgctccctacatgggctttgcgtgcaatggggattgatgatccacagatagggatgaatatttccctttcctatcaactcggaacagattatcaatatatctccgatgaatttgttttgtcgggctattacacagattattcggcttcacgtgcaggcaaccgtggtgccgcttatgtttcggagctttttgcaacacaaacagggcttccctttgatagtgtgtctaccgcaatgatttctttttctgatgacagtaatgccctgcgatcctgtgaaaaactaaaacggaagatttcgtttacagaaagtcagtcctttgaaattgtacctattgctcagagcaattccaccaccgttgttcttccactggctgctattatcgtctttatcattatcagcggctatttgctgatttataacattctgtatatctcaatttcaagagatacacaattctatggacagcttaaaacgataggcacgacaaaaagacaaatcaagcggatcgtgcgttctcaaatattcagaacggcggtgatcggtattcacagcggcctgattgtcggtggtattgtttcgcttggatttgttccgtttgccatgaatatgatgtactcaggcgatacagaccttggggagatagtgtccttttcccccattatttttgcgggtgccgcaatcttcacattttttactgcaatcatcggcagcatgaaaccagcgaaaatagctgcaagtatttctcctgttgcggcttcacgctatacagaggcaaatacaaggagttaccgagatcataagagccatagaacaaaattatcccggatggcacgagataatatttttagaaaccctaaaagcgctttccttacttttgcgtccttatttttaggcttaatattgtttttggtttctgctggtctactatcaagcctaagtcccaacaattttgtaaatcaatggggagaaagtgatttcgcattgacttacagcatttccgaagaaggaaacctgctctctgatgaaatgttgcagcaaattgcaacaatgcagggaattgaaaatctgcgcgtcacttattccgcttcaccgtggcccactatggatgtcatttacgacgaaaatgtattcgggaaatatattgattccttggatggcgtatcaggtcttgatttttcaaatgcggaaacacgaaaaaactatacagataatttttggagcggcgtttacggaatagattccagatatatcgaagaacttaataaaacgcttgataagcctattgacttaaccgcctttgaaaagggagagttggtggttttgtccgctatgacggatgatgagggaaacccattgattcagccagggcaagcaatcaccgttgtcggtgagtccggggaacaggtctttacagtggcaactggctttctggacgctgattttcagagtggtcgaggaaatgagagaggtactgcccctgatttgtatatcagtgagcaggcattagagaagttgtctggagaaaccaaaatccttcggattgcttttgatactattgatagcagttatgacaaagggattatggagcagcttcaatccattactgcttcgtcaccgggcattacgattctgtcacgatatgaaaagcagcaagaaatggccgggtatttgctgacctcaaggattatagccgcagggttgtccgctgtatttttgctgataggaattatgaatttcattaacacaatggttgttagtgtaaatactcggaaacatgaatttgcaacacttgaaagtataggaatgacgaaaaagcaaattagaaatgtattgctttgggaaggcgtgtattattggagtatttctttcctactgcttgccacactgggaacagcgatatatattccaatatactcagcctttagaagaatggttccttatgcagcttttcactatcctgtaatttctctgttggttgtcgcagctattgttttgctggtctgcttggcaacccccgtcataactttcatgcaaaatgttaagcaaagcgttgtagagagactgcggcagaattaaatatttgcgatgaaaaccgggagattattctcccggtttttcaaatctcacaggttcgtgagatttcagcccattattctgtcgaaacagcgtgtgtcagtgacatttctgtgaggattgcttgttaagataagcgcaaaaggaacaagctgccgcacgacggcaaaagaaaaaaagccgtcgtacagcagcctatcaacacgcccatttgaaacggcggctttgattttcagagccgccgtttctttgcgattgcacaaaccaatgacgacttgcagggacacggtagccgatgggaggttattttgccgtgttcattttattatttcattgttcgcgtgatctgcaccagctaaaaaaagcgtagcccctccatcggagtcgtccgactttggatatgaactataccatgtaagtaatcttctttataaaacatttctgcgcccagcaggtccgttgcgacttgctgggcgctttttgctgttttccgaggacaagcccgcctcgaaaaatttttttgagaaattttcaaaaaggaggcttttagcgggtagcgaacggctttgcgttcgccttgttagcggaaagggagaaacccacctcattcccccaagaaagggggtgaaaagatggatatgattccccgcaataactatggcgagcggtgccagttcgatgcttactgcaagctggtactgtaccatgaggcaatcgactacctccgggaaatgccgaggcgccgtgacagggaactgtcattcagcgaccttccgcagatggagatggacaagctctgcgttgtagatcattaccccagtgacagatttacattctcgtcccatgggtatgacctgcatattgaaaacgagcttgtggctgatgccttcgccggtttgtctgttcaggagcagagtattttgatcctgcattttgttctggacctgccggatcaggaggttggccgccttgttggaatgtctcgcagtgccgttcaacggcgaagggcaaaatcattgaccgagctgcggatcaagttggccgcactcatgccgaagggaggttgaaggtatgaagaaacccacttacaagggcaaggagcttcttcctctttcggtgattgacgccgcccgtgacggggactctcaggctgtggatcaggtactccggtattatgagggctatatcaataagctctgcacccggacgctttacgatcctgacggccagccccatgttcgggtggacgagtacatgaagcgccgattggagatcaagctcattcattccattgtcagcatgagctgacaagcccggtctgaaagcggagacagcttaccctttccctgtttctctctttcgtggccgaaggcagcaccttgacaaagaaagcccgttgggaggccaacgccgcagtataaggcaaacggatacattcctgtttgtgccgagccatacggtcggtgcgccatgacctcgtttcaagtccgcaggacgggaccactgtaacgggcgagcgaacagcaccagatcgtaaaacaagcgtggcggcttgcaggcgatgacacacggacagggttaaagatactcgcgcattgaacgcccacaaagcattgtgcgccgcacccatcagcatgggccggggttagactcccgtggagctgtgccagcagccgtccgtaagcctacttttcttttttgaaagtttatggatagatcgtaaacttttcaattagcagcagacaaacacggagcagcacggtaaaataatggtggaagttatattacccacacatattcgtgctgttccttttcataactgaaagggggttctcatgtctcaaacatggaacggcacgaagaaagaaacccctgaaagaaggacatatacggttgacgatattgctcaaattctgggcatcggaagaacttccgcatatatccttgtaaaagaagggcacttcaaaatcgtgcgaattggtaacgccatacgcatttccaagcggtcatttgacgagtggcttgactccctcgacctgtgatccaagaaaggaagaacgatatggcatctataatcaagcgaaagaaaaactattccgttgtttacaactatgtggatgaaaacggagaaaccaaacagaagtgggaaacctggcatacccacaaagaggccttgaagcgcaaggcagaaatcgaaaatcagcagcacacgggaacttttctcccgccaagcaatcagacgatcaccgagttcctttatgacttcgtatctctttacggagaaaagaaatggggcgtgtctatgtatgacagccaaacggcgctgattgcgaactatatcaatccaatcatcggtgatatggaggtacaggcggttactccccgtgcggttgacggttatatccagaccttgcagaaaaccaagtcggtgtctaccaagacccgaaaggccgttaccacctatgtcagcgacaagaccattgaaaagatcatcaagctcctgcggtgtgcgtttaagcaggcggtacgatgggaaatcattgcaagaaatccctttgacaatgtgatcctcccgaaaacggagtatgcgaaacgggatatctggacggcggatatgatccgtcttgccctggacaaatgcacggacagcaaactctatgtggcaatgaatctttcctttgcctgttctctgcgtatgggtgaaattctgggactgacctgggagaacgtccatatttccgatgaagatattgcggcggataacgcctatgtctacatcgacaaggaactgacacgggcatccaaacgggcgattgaaacgctgggtgagaaggatatctactacatcttcactccgcttatgccgaacaccagcacaagaattgttctgaaaaagccgaaaaccgattccagtatccgtaaggtgtggcttccaaaaacactggcttacattctgcgggaatggaagaagtcccaggacgagctgaaaggcttccttggcgacgagtatcaggacttcgatctggtcgtggcacttcccaatggacggccctgcgaggatcggatcatcctcaaagagtttgcaaagctccgtgaggacgcagggctgccgaaggtggtctttcattctctccgccattccagtaccacctacaaactgaaactgaaccacggcgatctgaaagccactcagggcgatacaggccatgccgagatcgacatgataaccggtatctatgctcacattctggacgaggatagaaaggtcaatgctcagaaatttgagacagccttctatgccaagcctgatctccgcaatgtccgtccgccggaggaaccggcaaaatcggagcctgcgaccctggaccttgaaagccttgtggagcagcttcagaagtcgccggagctggcaagtgcgcttgcagccttgatagcagcgcaagccccggcaaagtgatccgaaaaatcgaattagcaaaacgcagaattttcttagcaaatttctgaaaagcgttcgagtccaattagcaaatatacatcatgcggcgtataaaaatctcccggtaacggaagtgaaattaccgggagaaggaggaacaaaaaaacgctgcaaaccctgaaaaaaggcttgcagcggtgctttctggcgtcccagagaggatttgaacctccgaccccacgcttaggaggcgtgtgctctatccagctgagctactgagacatttttaagatttatgcaattttcattgctcgaaggaatcgaacaatctgccgcttaggaggaccccgttatatccatttaactaagggaacaaatgccgtattttcgggcttttcagcctttttggctccggctgccatgtttatgaatccaatcacttgtgtgatgaattgcctcagttattatatattgattttagcctttttgcaaactctaaaatcccgttgtgtctcactaaatggtctgcacttagttgccccttaggaggcgtgtgctctatccagctgagctactgagacatttttaagatttatgcaattttcattgctcgaaggaatcgaaccatctgccgcttaggaggcgcttgttatatccatttaactatgggaacaaatgccgtattttcgggcttttcaggctcctttggttacggtaaaccatatttatgaaatcaatcacttacgtgatgaatcatctgttttttattttgactttagtgtcttctctgtgagaatcgaactctgaattggttcttttttcattcctccggcttcaaccattgctgactctcaggagggggctgttatatccatttaactaaggaaacatatatccgctgtatacaggcttctctgtatacagcttattcattttatcatattatccgccaaaagaccataggaaaatcacaaactaatcccgatattttacgctgccctgcatccagatatttcccttaaaacgtctgcccacttccggttcgccgagcagatctttttgattgatacagacgctgaaaagaatatcattgcacatgatttccatggaatatacattttcctccgtgaaacggttctggagcagtgtcacatccatgatctcgccgagcaccgaatactgatcgctctcgataccgtacggcataaagtaggtatccacaatgctaagcacatcttcatgtgtgatcctttttgacaacagcgagtaggtatcaatgtcctccagcgtcagattctcgatcgcatcctcatccccgtctcttgccgcggcaatcagatgattccggtctgttccctcctttggcgcatgaggcacttttttctccgccttattgatcgggaataaaatctttccctccgtagacagcgcagctaaaatgacgccgtctgccagattcatatatcctttgctcttgctgaccgcaagataatccaccacattctgaagataaaaaatgagtgtcactccaatgcggacttcatcacatatccccgcataggattctttttccgcatgtttttccacttctgcgggttctattgtggatatgttctttccacacaaatacggatagtaatattccatctcaaaggtatcatcttcgttatacacgccccggacagagattccgaaaaaatctccgtactcctttgacagttctgcaaattcattgccctccgaatcaagtgcagccttctgaaccgtcggtgcgcttataatatctgcaaaaatatgctgcagctgttcttttgtaatatgactgaacccgatggctcttagaaatttgtgcattttctatcctcacctctttctgtttctagttttcgacctgaagaatagatacattcttgttcttatttaactggtatatcttttccgtcaaccggttctcttcatccaaaattctaattacaggacggatggaattttctgtctgttttaaaacgattcccgattcgcctgtattaagccgaaccctcgtcccaaccggataacgtgcgacgagccgctcgatcgcacgcacgattctcctgtcataaaaaatatccgtaccttccaccagatactcgagtgcctgctggatgctcatacgtctgcattccatcccgctgataaaacagtcaaatgcatcacatgcctgtaatattccacattccgtatcccgtgttttctgcttcagaggaaatccggagccgtctcttctctcatgatgtacaagtaccattttttttacaaaaggatccatccatttttcttcctccagaacagagtacgcaaggatcggatgcttccggtattcaaaagcctctgcttctgacaattcgttgatgtcgcagttgatatacggcaccgtaatgtagcggagtcccagatcatgcagcaatgctcccagtgcaagtctgtaaatctgctccgcagtgagcttcattttttttgcgactataatacataattttgttactacaagtgtatgttcgtacaaattaccttcgcgttccaaaagatcaattaccatattttcatccgcctgcatgacatcctgaataatgtcctctgcgacgtattcaatttcccgaagggaactgcccctgtgataaatatgcttttccagaatagattttattttttcaatatattcttcccgtttttcgttactgataatatcatgtggtgtttcatcttcctcatagggatcttcgatacacacggtctcgattcccagaaaggagatcagatccagatattccgttttcagcgttgttccctcagaaatgagaatttcattttccttcgttatgaccggccctgcaagtttctcccccccttgcagtgttcttaccagttgtattctcatacattatcctcattcgttgttttctgtttttcccatagctctgtcgagagctttctgctcctcatccgataacacgataatggaattaccatctacgatctctttgatatatgtatagcagccttcgcgtgtgtgcatggcattgatgataaatccgttatttcttacatccagcatggcaagagaaaaactgagttttcctcccatctcgttgaacgcatcatactttatcagtcccatcttctgataggtcagctgcatggcctcaaacaatgatttgattgttttttcattctcattgtttgcctcaagaagtgtatctacctgatccagacgcttgatcagggtatcctccagattcttaccgttttttccgctcataaatactttgtatgcttttttcagcttccgcatctgcgcaatatttacaatgataagaatcaatagaatcagaaccactgcgctaagtccgataataatataatcggaatcaaaacctaaatactgtgaaatcatatgcttcctctctctttattctgatatggcttttatcagaatcttactctgtctattttcggatggatccaaacagatccatgatacggtcaagttcatccatagaataatattcaatttcgatcctgcccttctggttatccttctgattgatggcaacctttgttccaagaatgactttcatcttctcttcgagatcacggcagattgcttccatcttcggatcgatctttacctcttcctttgcttccggctgatctttttcctgctggatcttctttaccagtttttccgtctcacgcacactcagtttttcgtcgaaaattttctgtgctgtcgtatactgtttttcctgatcgtcaataccaagaagtgctctcgcatgtccggtcgagatcatgtcatcaattaccatctgctgtactctctcgtcgagttttaacaatcgcatggaattggtgacagcggttctgctcttcgatacacgctcggcaacttcatcctgtttcagattgaactctgtcagtaaccgcttgtatgcgattgcttcctcaatcggatttaagttttctctctggatattttcgatcagggagatttctacgacttcctggttggaaagattcttgataattacaggaacctcttttaatccggcaagttttgctgcacgccatctgcgctcgccggcaataatctcataatatccttttctgtcctgtacaagcagaggctgtaacacaccaaactgtttgattgactcggacaattccaacagggcatcctcatcaaaattctttcttggctgttcccggttcggttctaccttattgatatttaccagaacaccctcgatgactttatcgtttttcacattttcattctttgcttccgtttttgtggcacttactttgtttggaattaaagaatcaattccctttcccagtccacctttttttgcagcagccatagttttcctccttatctctccatcacttcttttgccaacatacgataactttctgttcccgctgattttgaatcatacatattgatcggaagtccgtgagatggagcctctgctaatcggatatttctcggaatcagtgtctcatagatcttggtatcaagattttcttttacattttctactacctgattggacagattggttcgcacatcatacattgtgaagacaactccgtcgatgatgagatccggattcaatctctgctgtaccagatcaatcgtgtggatcagctggctcaatccctcaagtgcgtaatactcacactgaattggaaccagcaccgaatccgcggttgtcatcgcattgattgtcaacatatttaaggacggcggacagtcaatgataataaaatcataatcatccctgatataatctacggcattttttaaaatatattccttttcattgataccaagtaactcgatctctgctccggcaagattcacattggacggaataatcttcattccttctactacggtatctgccatactctctttgatggaacactcatccagcattaattcatatacagtattttccagttcgtttttatcaacgcctaatccgcttgtcatatttccctgcgggtcaagatcaatggtcaacactttctttcctgcttctgcaagacaggatgataaattgatagctgtggttgtcttaccaacaccacctttttggtttgcgattgcaattattctgctcatatagtacctcttttaaatttttattaccctgttcatttggtgcgttttgtttgccagagttcattattttagcaaacttctaatatgaactcgacagagtttattataacacttttacatattcttttctataggaaagttcgtatgaaatgtttcacgtgaaacattttcacgctaattgcaaactgttgtatttctgtttttttgtaaatacaaaatcttgtagaaaacatgtgtgaaacattttatttatataatgtttcacgtgaaacattgcaatgatttttccaataatacgcgttttaaaacaatttcatatagtaataaacattatttcttctataaaataattgagtgtatcggatgattccgaaacactcaatctttatactctctaatactaatgaatagaaatcaaattattccgaatagcaaatacagctgcctgcgtacgatcagaaacatcaatctttttaaagatactcgatacatgatttttcacagtacgttcgctgatgtgcaattcatcagccactcccttattgtacattccaactgcaagaagcttcaacacttcaagttctctcttcgtcagtttttcaatcttctcgctgtccatatcccggtcaatcatttttgcatttaatacaggaatcagactcggctgtatgtaatcttctccatcgacaacagataagattgcttttttcaattcagaagactcagagtctttcaacagataaccattgattccgatgtccactgctttcaataaatactccacttcattatgtacggtaagaacaagaatcttgacatctattttttcatctttaatcttctgcaaaacttcaagtccattcatgcgcggcatattgatatccagcaacaaaacatccggtatctgctcttttaatttttccatgcaatcaataccatcacacgcctctgcaattacctgaaagtctccttccagttccaacagttgctttaatccttcacgaatcaatgaatgatcatctgtaatcattacttttactgccatttaaaactcctccttgttactaataggtactttcactataatttttgttccaacaccgatcttagagtcaatctgtatcgaaccggataataaatatactcgttctttcatcatagacattccaaacccagaattatcatcccttggacgctcatccagaatatgaacatcaaatcctgttccatcatcctcgactattaccgtgatacctccttgctcgtatcttaacagaacatgtatcagagtcgggtttgcatgacagatcgcattgctgcatgcctcctgaataattctaagtaacgttatcccgataattggttttaattgataaggagttccttccactacaaaatgaatcttcttcgtgccggttgcttccagcttgtccaaagttctctcaattgtaatatccagaccaatatcatcaaaagacatagggcgcaggttataaatcatctttctggtatcatcgatgatctccctaagattcttgatcatcttattgagttccagtttacaccggataggatccatatccaccagtttactgcacagttctgccatgtgaaccattgccgtaagattctgtacggtactatcatgaagttcacgcgaaatacgctgtctctcattctcctgcgtttcaaggagagacgtatggtacctttcttcctcaagtgtatttctgttacacttgcatgcagcatctgtctttgcctgctgtaatacccctgctgcttcttccactcttttcatctgctgcgtatggtagtccgtctccaggtgaattgcctcctcgacttctttcatctctgcatgcaattcatcaattttctgcttgttcctcgaatttacttttcttggagtaaacgactcaaagttaggatcgttcgtctcctcaagcaaatggatcattgcctgcgtctctttcaaatgaatctgtaaatcagaaatccgcttcgcgctgttctgctcctcttttaaaagttcctcataaattttctgaatatattcttctaccattttgtcaccgaacatatgtttgatattaaaaaccaaattaccagtattattttataccaaacgtaattcaatgaaaagcaaaaatttatattttcagaatttttaatttgtataagttatggaaagcggctataatataagtaataggaaacattttgcaaagattacgggaggttctatgaacaatagcatgaaaaagaacatcagacatttctttctgctgactgctcttgctgcaggcacgattcatcttgtgaaccgcttcatcgatatgacagcagagatgaaaaatattttaaagacggaaagcggcagctactatcactggaaaaacggcagcattttttataccaagcgcggctccggttctccgctccttctcattcacgaattaaatccgatcgcttcttcctatgagtggtgcagacttgtgaaaaagcttgagaagcactatacggtatataccatagatctgttgggatgcggccgctcggacaagccttatctgacttataccaattacctgtatgtacagcttctcacagattttattcatgatgtgatcggggaacgcccggatgtcgtgacaacaggcaattctatttcgtttgcggtacttgcccagaatatgaatccgaatcttctcgcaagcatcactgcgatcaatccgcctgcgatgaacagttttgaccgcacaccggacaagtattcctctgtcaaaaaggcactgctggagctgccgatcctcggaacattcctctacaatgtccggacacacgaatccaatatccggcggacactgcagaaaacatattttagcagaccgcagcttgtatccagcaagatgcttgatgcctactatgaggcatcgcacatgggaaagagccacggaaaatatctgatggcaagcatcgagggacattacaccgacaatgcaatcggacatgccgtgaaaaagcttaccattccgctatatattattgaaagccgttccatgacagatgcggttgccattgcagattcttatgcgcacaaaaacgcaactgtagaaaccgcctatatttcaaatgcaggtctaaccccgcagcttgaagtaccggataagcttctgaacatcatgcggatgttcttacatgaagatcactaatgtaacgtcataccttatacaatcaaatacttcataaaatcaaagagagatgacacgaccggatcaaggatccatcgcatcatctctcttttctgttactgcagcggttcttttgtcggtgtgccggcttttcttggataagctttcggcgtcttcctctctttctcaatcacaacaaacgaacgcttctgatcaaacaaatcgaatttgtaaatgtccttcacttcaccacccaaaagataaatggctctctttgcctgtgtggcttcctcatccacctctcctgatttataggaaataaatgctccgccggtcttcacaaatggaatacaatactcgctgagggaggataaatttgccacggcacgggacacacataggtcaaattgttcccgatataatatatttctgcccatttcctctgctcttccatgaacagcagtcacatcttccaatccgagtgtatcaatgacctcctgtaagaaacggattctcttattcagtgaatccgccagcacgatctgaagtttcggaaaagcaatctttaaaggaattcccggaaatcccgctcccgttccaagatccagaatccgatatgcctccggtcgatcttcgagacttcttaaatccttcacacgacacagggaaaggctgtcaagaaaatgcttctcaatgacctcatcaaactctgtgatagcggtcaggttcataactttattcgtttctaccagaagttcataataggttagaaattgtcccatctgtttttcgtccagatggatctgcaaatcatccagaccttttttgaacttttcaagattatacgccataaaccacctctccattcctgcactctttttctttttatgaatgatactcctatgaatgatgctccccatgatgattcatctgttccatgtacaccagcaatacggaaacatccgccggcgatacaccggagatacgcgacgcctgaccgatcgatgtcgggctgtacagctttaacttctgccgcgcctcaatgcgcagactcggaacctcatcataatcgaatccttccggtatttttttcttctccagcttcttaaagctttccacctgcttgatctgtctggaaatatacccatcatacttaatcagaatattgacctgctctctcacttcttccggaagttccggtctctcatgatcgatcggcgccagcttatcataatcaagctccggtctgcggatcagctccgttaacgtcacaccggtatttaacggtatactaccgtaactctccagaagagcctgcacttctttgttcgcacctacatgaaccttcgcaacacggtcaatctcctctttgatcatctgctcttttttacagacccagtcgtaccgctcttttgagatcagaccgatctcatatccctttttcgtgagacgcagatccgcattatcctggcgaagcaacagacggtattccgcacgcgacgtcatcatacgatatggttcatgattctccttcgtcaccagatcatcaatcagaactccgatataagcctccgaccggtccagcaccagcggctctcttccgagaatctccatcgccgcattgataccggcaatgagtccctgacaggctgcctcctcataaccgctgctgccgttgaactgccctccggaaaaaagtccccggatcttcttaaattcaagggacgcatacagctggttcggattaatacaatcatattcgatcgcataggcattccggacaattttcacatgctccagtcccggcagagtgcggtacatctcatgctgcacatcctccggaagtgatgaggacattcctccgacatacatctcattcgtgtgaagtccttccggctcaatgaaaatctgatgcctgtccttatccgcaaacttaaccaccttatcctcaatggatggacagtaacgcggcccggttccctctatgattcccgcatagatcggagaccggtccagattgttgcggataatctcatgcgttttctcattcgtgtaagtcagccagcaggacacctggtcgatctgcacatctttgggatttgtcgtgaaagaaaacggaacgactttttcgtctcccctctgctcttccatcttggaaaaatcaatcgaccgtttgtcaattcttgccggtgtaccggtcttgaagcggaacatttctactccatgtgccagtaatgagttggtcagatgatttgcagccatcaaaccgttcggtccggtataggtaatcatctcgccagtcagacaacgtgcgcgaagatacgttcccgtacacaacacaaccgccttacagtgatacattgcacccgaaaccgtctttacaccggtaatctgctcacgatcgccctcttttgtgagaatctcggcaacctccgcctggcggatcgtcagatgctccgtattctgtaatgtattccgcatctccatgctgtaatttgccttatccgcctgtgcacgcagcgaatgaactgccggacccttggatttgttcagcatttttgactgaataaatgtcttatcaatattgattcccatctggccgccaagcgcatcgatctcacgaaccagatgccccttggaacttccgccgatattcggattacacggcatcagggcaatactgtccacactcacagtaaaaataattgtctcgagccccagtctcgcacaggcaagcgccgcctcacatcctgcatgtcccgctcccacaactgccacatcatacgtttcttccaaaagattcttagaattcataatcaatacaagccctgctctctctgattgctgtaataaacttaccaaactccacatgcatcggatgcttctgatatgcattcagatcatccatattcttaaaatcaaaaataagtgaaagatcataattgctgtccggagcagcagccgcattcgtcacaacctcaaacgttgcaatcagggaaatctctctcatctcctccaaacggcgcagtgcctccttcaaatttgcttccttattctcatccttcagcttaaacatacagatatgtcgaatcatcgctgcttcctccttatcctatggttgcatacttccaataatagccgtccaatggtttcttaaatatttaggccaactattttcccatacaaaacttactgaatatctcattgacgagatcatcttccaccgcttccccgatgatggttcccagcacctcatacgcattcatcaggtcaatcgagtaaaagtcctccggcattccatccgcgatactctgctctactaaatgtaaactagaaagtgcctcctgtaaagcggttttatgacgaatattcgtaatatagacttcatcattaaaggtaacttctccccggaaaaacattttccggatctgctcggtaaagacatcgattcccttctgctctctcgccgaaatagaaataaccggacagtctttatccacatgtacacgaatatcctccgctgttgtcaacggcgttaagtccgatttgttcaaaagtacgatcgtgcgtcttccatgaagcagctccatgatctccccgtcgttctcatccagattcgtggaggcatccactacatacagaatcagatctgcatccttcacatattttcgtgccttgtcgactccgattttttccacaatgtcatccgtatcacgaatccctgcagtgtctatgatattgagtatgattccattcaggttaatctgctcttcaagcacatcccttgtagtaccggcaatttctgtaacgattgcccgctcctcgcccaatagagtgttaagaagtgacgattttccggcatttggttttcccacaataacggtagaaattccctcttttaagatgcggccgttatcactagaagccaacagcttctcaattctgtccactgcaccctctatggtaagctccagtctctccccgtaaccatccagactgatatgctccggatcatcaagcgccgattcaataaatgcgatctcgtggagaatctctccgcgaatctctttgactgcatctgagacagcgccggacaactgcttcatggaactctttaaggcaaattcatttttcgccgaaatcacatcaatcacagactccgcctgggacagatcaatacgtccgttcaaaaatgcacgctttgtgaattctcccggctctgcaggacgtgctccatatttgataactgtctccaaaatgcgcttcatcacataaacaccgccgtgacagtcaatctcaactgtatcttccctagtgtaactccggggtccgcgcatcagtaaaaccattacctcatcaatgacttcctctccatcccggatgtgtccgtaatgaatcgtgtgtgtctccatatccgaaagcttcttaccgcccggcatatgaaaaatctgatctgtaatggaaaccgcttcttccccgctgattctgacaattccgattccagatcctgccatggcagtcgcaatcgcagcaatagtatctgttttcataaatctcctttaatgaaagaatggggatgtcggatgacacccccattttgtactctatttcttcagggtaacaaccacatgtctgtaaggctcctcgccttcactgtgcgttgtcacaaacttatcattctgtaaagtcgaatgaatgactcttctctcaaacggattcatcggctctaaagaaaccgggcgcttcgttctcttcaccttgtaagcaatgttcttagcaagattctcaagcgtctctcttcttcgcttccggtaatcctccgtatcgatcttgaccttcacatactcttcggaattcttattcactgcaaggttggtcaggtactgaagtgcatccagcgtctgtcctctcttaccaatcagaacacccatatcgtctccctttaagtcaacgttcacgacattgctgtcctcttccttctcgatctggatcgtgacggtaagtcccattgccttaaatacactctcaagaaaatcacggatattatcattcgtatcattcttcctgcgggcgcggatcacagcatcctttctgttgattccaaggaaacctgcgcttcccttttcaattacttcatattcgatcttgtcatgggttgtccccagcttgatgatggcttctgtgattgcgtcatcgactgtctttgctgaaatctcaatataatccattttcatcaccataccctttctaacttactccaccccgaaacttactttctgttgttgcgctcgttaaactcacgtaccatatttgcttttgcgctcatgcttccggcttttgccttcgacttcgctgcgttcgccttctcgatctcaagctctttctccgcactgctcaactgcttcttattcgcatctaccatctgtctggtattcatttttgcagcattggaaatctgattctcggcgattcccatcttctcgcgctttttcttcgccttttcctgattcttcttgataatatcttcaagattcatcttctcgaaatgcttgttcaggaaatactgctgtacaacacggacaacagcaccggcaatccagtagataccaagaccgaccggaacggtaaaacacataaccagtgagaataacggcatcatgcggttcatcatcttcatctgctgtgccatcgcatcgctctggtcattgccacttgcagtcgcctgcggcattaacttgatgttcaatacctgcgtcagataagaaataatcggaaccagcaaggctgcaatgaccataaggtaagcacctgcagaaaaacttgatgtaatcacatgaagcggtgtatctgaaatattcattccaaagaaattatttacatgggacaccgtctcataggtggatgaaatctcactggagagagccgggaatgcatcctttaacgcatcccatccgctggagttcatcttataagtaacatccacgatcgagttggcaatcgcggtcggatccgaaacagtaaaattagctaccggctgtgtcgtgatcttaagtgtagacaccagattggtcatggtatcctgatatccctctgtcgccatgatgccgtctaccagggatgttgcattgccgccgagcggctgtgtgaacagattcttaataccgctgacataggcaggaacgttcatgaatacacgatacaaagcaaacagaagcggcatctgaatcagcatctgcacgcagcttcccatcatggaaacaccgtacttctcatagacagcctgtgtctcctgctgcattgccatcatggatgcctgatcctttttcccctgatacttcttattgatcgcattcagctccggctgcatcttctgtgacagctttgagaacttctgctgcttataagtaagcgggaacagaagaagataaataataatcgtaaatataatgatggaaagacctacattaccgattccaatctgatccatcagatagtagactccattcattacccatccaagtaattttgcgattggtccgagaatcgcaccgtcatacgctgttaataacatttctgacacttaaaatacctccactatggaaccggatcatatccaccttttgaaaaaggattgcatcttataattctccataaagccagcgtgccgcccttgatggctccgtatttttcgacagcttccagcccatacaacgaacaggttggacaatacggacacttggtcgttttcatcggagaaagatattttctataaaattttatcaaagcgatcaaaatttttttcaaaatgattccatcttcttttctttactaatgatcttgtgaagacccccaagatgcagcagcgcactctccacttcatgatacgagatgtccttcgctgtgctccttgcgacgactacaatgtccaaaccactattgaacatgtcttcatgcagtctgtagctttcccggatcagccgggtcagatgatgtctgataacactgtttccaacttttttactcacggaaatccctaaacgatttccttctgtctgatttgaaagaacgtacatcacaaggtaccggttcgcatatgactttcccctgcggtatacgttctggaaatctttggttttcttcaatgactcggaatatttcattctgtatgcatgtcctttatagaagaaaagaccacataagatgtggcctaagctgacaatttctttctaccttttaatcttcttgcagccaatacttttcttccgcctgctgtgctcattctgcttctgaaaccgtgaactttcgctctctgtctcttttttggttggaatgtcatcttcatatcgcattcacctcctctacgttacaaaacatcattctcaattatatcagaaaaagtctccaagtcaagcataaaataataatcccggccggcaggattcatctacatttccacaatttgccctttgtggaaaaaaataaccactatatatataaggaagaaactcatgccaactatatcttgtaaaattactttccacaacccttccacaaaaaaatgcaaaattgagggtcccttaaatcccgtaaatacgccgttgacataagttatccccgaaatgttgataacttgtggataaaatatggataatacacggacaagttgtgaataagcatcacaaacgctgatttttggcggtctataacatggaacccctttttttccctcatagacaccgtattttgcccaaatagcgattttttttcttttacagtgtcccctacgccatagcgctccaaagcaaattaaacattgattaaagcactaaaatggtgtaggatagagggtgtaggatttttttagtatgataagaaattggagcgtttacatggatcagattttagaaaaatgggacgagatcctgatgaccgtgaagacagaacacgacatcagcgacattgcttttaacacattcttacgtccccttgaattttatggtgtcactgggaacaccgcatatatccttgtcccgtccgagcagttgggactcagctatatttccaagaagtactatctgccgctcaaagtagcaatcacagagatcaccggaacagaatacgagataaagttcattcttccggaacaggcgaagtcgatcgcttcttctcctaataaacagaaaaagcctttttactcagaagcggcatccaaatcgaatctgaattccaattatacgtttgatacattcgttgtcggaagcaataaccgttttgcccactccgcttctctcgcagttgcggaatctccgggcgaggcatacaatcctctctatatttatggaggaccgggactcggcaagacgcacctgatgcattccatcggacatttcatcctggagcgcaatccggatgcgaagattatctgcgtgacttccgaggaattcaccaacgaggtcatcgagtccatccgaagcggtaatgcagccgcgatgaacaagtttcgggaaaaataccgcaccatcgatgttctgatgatcgatgatgtacagtttattataggtaaggaaagtacgcaggaagaatttttccatacgttcaatgccctccactccgccggcaaacagattattcttacctccgataagccgccaaaagagatggagacactggaagaacgtatccgttcccgtttcgagtggggtctgatggctgacatcggaacaccggactacgagacacgaatggcgattctccgcaaaaagatcgaagcggatgagatgaacttaagcgacgagatccttaattacattgcaaccaacatcaagtccaacatccgtgagctggaaggtgcgctcaacaaacttctcgcctactccaaccttgagaaaactgagatcacgatggagattgcccagaaggagcttcagaatatcatcactccggacaagccgaaggagattacgcctcagcttatcatcgaggtcgtatcggagcatttccagatctccttagatcagatgatctccaagaaccggagcaaagacatcgcaaggccgcgccagattgccatgtatttatgtaagaatatgaccgacacaccgttagattccatcggtgcgctgctcggcggcagagatcactctaccatcatccacggcgtccagaagatttcggatgagtacgagtcggacgagacgacacgcagtctcatcgacaccatcaagaaaaagatcaacccgaactagatattcacattcggttgttgaaatattgtgtaaggtttgttcatgaaactggataaacatcattatgtaaaccacttaagacttctttcacatttttctttcaagtttacataattttttattcacaggttgtccagatttcatccgcacgtaattcacagactttcacccttcattttttacctgaaagtcttatagatcaagggctgtgtgacttattcacatataaacaccccctaagaatattactttgaatctctttttataacaatcatgtatggcgtgcgcaccatatattccacgaaccacaggaaggagttattaacaactatgaaactgatctgttccaaatcaaatttattacacggtgtcaatatcgtatcgaaagcggttccaaccagaaccacgatggccattctggagtgtatcctgattgatgcttcagccaatgagatcaaattaactgcaaatgatatggaattgggaatcgagacgaagatcgaaggcgagatcgcagaacgcggagtgattgctctggatgccaagatattttccgagatcgtgagaaagcttcctgacagtgatgttgtgattgagacagacgcttcctttaagacgaccattacctgtgaaaaagcaaagttcaatatcgtaggaaaatccggagatgatttttcctatattccttatatcgagagaaatgaagccatcacgttatcgcagttcaccttaaaagaagtcattcgccagacgatcttctcgatcgcggacaacgacaataacaagttaatgacgggagagctttttgagatcgaggagaatcatttgaaagtggtatctctcgacggccaccgtatttccatccgcaacatcgagttaaagaataactatgagcacaagaaggttgtcgttcctggaaagacgctgcaggaagtgagcaagattcttccgggaagcgcggaggaagatgtcaatatgttcctgaccgacaatcacattgtatttgagttcgacgatacaactgtcgtttccagactgatcgagggtgaatactttaagatcgagcagatgctttcctccgattacgagacaaaggtcaagatcaacaagcgcgagctgttagactgtatcgaccgtgcgacgctcctcgtcaaagagggtgacaaaaagccgatcatcatgaatgtgacagacggaaacatggagttaaagatcaattccttcatcggttccatgaatgaggatattgatattgtaaaagagggcaaggatattttaatcggattcaacccgaagttcttcatcgatgcgcttcgcgtaattgatgaggaggaggtaagcctttacatggtgaatccaaaggcaccgtgttttatcaaggatgatgaaggaaagttcatttatctgatactgccggtgaactttaatgccagcaccgtttagaaacgaggcgtaggagagatatgatagaaatagagattcgcaaagaggatgaattcatcaaactgggacaggcactgaaaaaagccggacttgtggagtccggagtggatgccaagttcgtgatccaggatggacttgtaactgtgaacggggaagtagagacccagagaggaaagaagctgcacggcggtgaacttgtttcctataatggcgagacagtaaagatagtcagatgaacattcggtcaatcgagcttaagaatttcagaaattacgaaaatttagagatttcttttgatgaaggaaccaatattttattcggggataatgcgcagggcaagactaatatcttagaggcggcatatatgagcgggacgaccaagtcccacaaaggtagccgtgacaaggagatgatccgcttcggtgaggaagaggctcatttaaaaacggttgtcgcgcgcggtgggagagaatatcagatcgatatgcatctgaagaagaaccgcgccaaggggattgccatcgacaagattccgatcaaaaaagccagtgagcttttcggaattttaaatattgtgtttttttcaccggaagatctgaatattatcaagagtggtccggcggagcggcgcagatttttggattccgaattgtgccagctggatcggatctatctggcagacctcacaaattacaataaaatcttagcgcagcgcaacaagctattaaaagatatgatctaccggccgggtctttccgatacgctgcccgtctgggacatgcagctcattgagacggggaagaaaatcatccggcgcagaaaacagttcgtggatgaacttcgggagattgtaagtgacattcactaccgcatttccggcgggaaggaagagcttttcttaaaatatgatccgaatatcgacgacatcttttttgaagatgagttgagcagggcgaaggaaaaggacaaaaagctttgtcagacatcggtgggaccgcacagggacgatctgctgttctcgatcggtgacgtcgatatccgaaagtacggttcacagggacagcagagaacatcggcgttgtcgctgaagctgtccgagattgaacttgtgaggaagtccatttccgatacgccggtgttgctgctggatgatgtgttatctgagcttgacagcagccgtcagaattatctgctgaacaatatttccgatacgcagaccattattacctgtacgggactggatgaatttgtgagaaatcgttttacggtaaaccgggtatttgaagtcatagccggtcatgtatatgagcgatcaatatagtaagcgtgagccgttttcctggctgatgcagaaatggagaataaaatgggtacagaaaatgaatacggagcagatcaaatccagatattagagggacttgaggcagtcagaaaaagacccggaatgtacattggaagtacatctgcgagaggacttcatcatctggtatatgagattgtagataatgcagtagatgaggcgcttgcgggatattgtaagaatattgaagtgacgatcaatccggataattcgattacggtggaagatgacgggcgtggtatcccggtcgggatgaatcacaaagccggaaagtctgcactggaggttgtatacacggtgcttcatgccggtggaaagtttggcggcggcggatataaggtatccggcggtctccacggagtgggagcatcggttgtaaatgccctatccacgaagctttctgttgaggtatacaaggatggacagatttacagtcagagttataagattggcaagccggatgaaccggtcaaggttatcggtaagtgttctgccgaaaaacacggaacgaaggttaccttccatccggatccaacgatctttgaggaaaccgtctatgattacgatacgttaaaacagagactgcgcgagaccgcctttttaacaaaaggcttaagaattgtgctctccgacgccagagtggatccggtgcatacacacgaattccactatgcaggcggtatcaaggaatttgtgacctacttgaacaagagcaaggaagcgctctatccggaagtcatctactgcgagggaaccagggacggagtctatgtggaagttgccatgcagcacaacgattcctacaatgatgcgacttacagctttgtcaataatatcatcacaccggaaggcggtacacatcttgccggttttcgtaatgcattgacgaagactttcaatacctatgcgcgtgcgaataagattttaaaggatacggagccggcgctcaccggagacgatatccgcgagggactcacggcgatcatcagcatcaagatcgaggagccacagttcgagggacagacgaagcagaagctcggcaacagcgaggcgcgaggcgccgttgactcggttgtcagcgagcagctcacctacttcctggagcagaatcctacggtggcgaagaacatctgtgaaaaatcactgctcgcgcagcgcgcgagggaagcggcgagaaaagcgcgtgatctcaccagaagaaagaccgccctcgagggaatgtctcttccgggcaagcttgctgactgttccgacaaagacccgaagaactgcgagatctttattgtagagggagattccgccggcggttccgcaaagacggcgagaagccgtgcaacgcaggcgatcctgccgctccgcggtaagattttgaatgtggagaaggcaagattagacaagatttatggcaatgctgagatcaaagcgatgattactgcgttcggtaccggtattcatgaagattttgatatcagcaagctccgctacaacaagatcatcatcatgaccgatgccgatgtcgacggtgcacatattgcgacgctgatgctgacctttttgtaccgctttatgccggagctgattaagcagggacatgtctatctggctactccgccgctctataagatcgagaagaacaagaacgtgtggtatgcgtacgacgataatgaattaaacagtattctgacagagatcggccgcgacggcaacaacaagatccagcgatacaaaggacttggtgagatggatgctgagcagctctgggagacgaccatggatccggaaaagcgtatcttaaagcgtgtcatgattgatgaagagaattcttctgagattgatgtgacatttacgacgctcatgggagacaaggtagagccgcgccgtgaatttatcgaggaaaatgcaaagtatgtacagaatcttgatatctgacagacggactgtacagagtatgatgtaattgatagaaatggagaaaaatcctatggatgacaagatttttgaccagatacatgatgtggatctgaagaaaacaatggaaagttcctacatcgactatgccatgagtgtcattgcacagcgtgcgctgccggatgtaagagatggtttgaagccggtacagaggcgtgtcctctattccatgattgagctgaacaacggaccggacaagccgcaccgtaaatgtgcgcgtatcgtcggtgatacgatgggtaaataccatccgcacggcgacagctcaatctacggagcactcgtcaatatggcacaggactggtcattccgttatccgcttgtcgacggacatggaaattttggttccgtcgatggtgacggcgctgctgctatgcgatacactgaggcaagactttccaagatttccatggaaatgcttgcggacatcggaaaagatacggttgattttgttccgaacttcgatgagacggaaaaagagcctacagtgcttccgtcccgttttccgaatctgttagtcaacggtacgaccggtatcgctgtcggaatggcgaccaatattccgccgcacaatctgcgcgaggtcattaacggtgtggtaaagatcattgataatcaggtgttggaagaccggggtaccgatatcgaggaacttttgacgatcgtcaagggaccggattttcctaccggaggtacgattctcggaaccgccggaatcaacgaagcgtaccgtaccggacgcggaaaagtcagagtccgtgcggtgaccagcattgagccgatgcagaacggcaagaaccgtattgttgtgacagagcttccgtacatggtaaacaaggcgcgtctgatcgagaagatcgcggagcttgtcagagataagaaaatcgacggcatcaccgatctgcgggatgagtccgaccgtcaaggtatgagaatctgcatcgaactccgccgtgatgtgaacccgaatgtcgtgctgaaccttctgtacaagcatacacagcttcaggatacgttcggtgttattatgctggcactcgttgacaaccagccgaaggtcttaaacctttacgagatgctcaactattacctgatccatcaggaagaagttgtcaccagaagaacgaaatatgatctgaacaaggcggaagaacgtgcccatatcttacagggattattaacagcacttgataatatcgatgaagttatcaacattatccgcagcagcaagaacacccaggaagcaaaagaccgcttaatggagcgtttttcgctgacggacgtacaggcacaggcgatcgtggatatgcgtctgcgtgcgctgacaggtctggaacgcgagaagctggagaacgaatacgcggaattgatggagcgcatcacagagttgaaggcaattcttgccgacaagaaaaagctgctcggcgtcatccgtgaggagattcttctgatcgccgacaagtacggggatgacagaagaacatccatcggttttgacgaatatgatatttccatggaggatttgattccggttaccaataccgtcattaccatgacgaagcttggatatatcaagcgcatgagccttgataatttccgtgcgcagaatcgcggaggaaagggaatcaagggaatggagaccatcgatgacgattacatcgaggaacttctgatgacgacatcgcaccattacctgatgttcttcacgaataccggccgtgtataccgcatgaaggcttatgagattccggaggcaagcagaaccgcgcgcggtaccgcaatcatcaacctgcttcagctgcagccgggcgagaagattactgcggtcattccgatacgggagtacaccgagggacatttccttttcatggcgacaaagaaaggtatcgtgaagaagacaccgattaccgattatgcaaatgtgagaaagacaggtcttgcagccatcaatctgcgcgaggacgacgagctgatcgaggtgaagaagaccgataataatcaggatattttccttgtcaccaaatacggacagtgtatccggttcaaggagacagacgtaagaaaaacaggcagaacatccatgggcgtcattggtatgaacctgacagacggagatgaggtcgtcggcatgcagatggaatcccagggagattccctgatgatcgtttccgaaaaaggtctcggaaagtgcacgttaatctccgagtttaccacacagaaccgtggcggtaagggtgtgaagtgctacaagattaccgagaaaacaggtaatatcgtcggtgtcaaggcagtcaaccatgacaatgaaataatgttaatcacgacagagggtatcattatccgcattaaggtagcggatacggcacttcttggacgtattacctccggtgtcaagctgatcaatctggacgagaatgtgactgtggcaagcattgcgaaggtgcgcgagaataaggagcttgagacagccgatacttctgagcttctgaccgatgaggaagaggcggcaagcgcggctcttgcagcagaaaatgcgaagaaagcagccggtcagtcagacaattccgagacggatgacgagctgatggatgagctgttgaagcgtgctgaagacgatgccaaggatgacagtgacgaggaataagcatttttctaaaaataaaagaaaaataaaaaatataaaaaaaatataaagatacatttgacatcgtatagccttttctatatgatagagtgtgaagagagattttactattaaggaggaacaggttatatgagtacttatggagcaattcttggagcaagcatcggtgtcattctgttatgtcttgttgttatggtagcatgctatgtgttatatgcagtttcccacatgaaggcattaaaggcactgggatacaaaaatgcatggcttgcatggattccatacggtgtattttatgcatgtgcggatgcagcagcagagggggaaggcgagaaggtaaagttatttggaagccttgaacttccggcaatggtattcaagctctggtggattttaccgcttgcactgttgtttattccggtaaacggcacggtagaaaatgtcatcacaatcatattaaacgttgtattcttaggatgcagctacgctaagatgtatgcaaagttagagggcaagcaggagagcgagacacaggcaatcggctgtgtatccggtctgatcccgatcattgcagttgtaaaattcctgtcttataagggaaataactaaaatcgaagatgtatcggaacccgcggtcaaaagaccgcgggtttttcttattcctttatttacttttgaaataccaggtgttatagtaaatcacggatgatattccgcagcgcggaaatgataccggagaagaaaagagaacgaaccctagatcgccagtttccgacgggacgtggatcgaggagaccatgatttcacaggaaaggtgccgcatactgcttccgggaggaggcgtttgtatttcattgaatgatgtacagaccgaacgtatgcagatcggttttatcggtgccggcaaggtcggcgtgtcacttggcaaatattttaaagaaaagggcaggaacgtaggaggttattacagcctgacccgcgcgtctgctgcatgggcagcagcatttacacagacaacctgttatgaaagtttagaagaaatcatcagcagttgcggcatgattctatttactgtaccggattccgccatcgcagaagtgtggcggcaggcaaagccctatgtatccggtaaagtgatcggtcattgcagcggtctttacagttcagacatcttttcagactgggacagcatgaactgtcatgcatgttccgtacatcctcttgctgcaatcagcagcaaagaaaatgcatggagagaattatccggcgtattgttcacactcgagggagactcctcctatgtgaaggatctggagacatttttccattccatgggcaatcgtactcgtatcatttccaaagaagacaaaatcaaatatcacgcggcggcagcaatctcatccaactatatgactgccttattttccatgtccgagcagctacttctcgactgcggattcgcacaggaggaagcgcgaagcgagctctatgcacttgcaaagggaaatctggatcacattctgacacagggatgcgtgcagtctctcacaggtccgctggagagaaatgattgtgcgaccgtagaaaaacatatttccgcgttaaatgtaaaacagcggaaaatatatacttcctgtgccgaatatctcacagatctcgcacagagcaagcatccagatcgtgattacacggagatgagaaaattgtgcagaaacggggaacacagcccgggcgcggaatgcgcggaaacagtgtgaacaggaaaacacagtctatgcgcctggggcgcaggaaaagtggagggaaacatgaaaaacacagtattgacgttacagaagcagaaggaagaacacgataagatcgtcatggtgacggcttatgattacacgacggcaaagatcatggatgaagccggtgtcaacacgatcctcgtcggggattcattgggaatggtaatgctcggatatgaggatacgctctctgtgaccatggaagatatgattcatcacacggcagcggtttcacacggtgcaaaagatgcatttgtagttgcggatatgccgtttatgtcctaccagacatccgtgtacgacgcagtggtcaatgccggaagactgatgaaggaaggccgcgcgaatgcggtaaagctggagggtggtgtggaatttgcacctcacatcgaggcgatcgtgaaggcatccattccggttgtggcgcacatcggattgaccccccagtctgtcaatgcattcggtggattcaaagtgcagggaaaagatgtggaggcagcgaaaaagcttctggccgacgcgaaggcagtggaagcggcaggtgcctgcatggtcgtgatggagtgtgtgccggcgaaactggcagctaagatatcagaagaacttacgattccgaccatcggtatcggtgcgggagcaggctgtgacggacaggtgctcgtctaccaggatctgctcgccatgtatggtgatttccgtccgaaatttgtaaaagtatttgcaaacgtaggagaagtaatgcgcgagggcgtcaaagcatatatcaaagagacaaaagagggaacatttccgggcgaggaacattgctttaagatcgatgactcagtgattgaaaagttatactaaatgacagatcatgccgaaaggagcagattatgaaaatcgtatcaaccatagaagaagtaagagcacaggtgaaggagtggaaaaaggaaggacagagcattgggtttgtgccgaccatgggctacctgcatgagggacatatgagcctgatcgatgcagccggagagaatgacaaggttgttgtgagcatttttgtcaatccgatgcagtttgggccgacggaggatctcgcaagctatccgagagatctggaacatgatgcgaagctctgtgaggagcacggtgtggatctcattttccatccgacaccggaggagatgtacggggatcagttttattcttatgtggatatggatgtgctgaccaaggagctttgcggactcagcagaccggtacacttccgcggcgtgtgcacggttgtgacaaagcttttcaatattgtaacgccggaccgcgcatatttcggacagaaagacgcgcagcagctcgcggtcatcaagagaatggtgaaagatctgaacatgccgcttacgattaccggctgtccgatcatccgtgaagcggacggacttgcaaaaagttcccgcaacacctatctgtctatagaggagcgggaggcagcgctcgtgttaagccgttccattttcctcggaaaagagatggtggaaaagggagagcgcgactgcaaaaagattcttgccgcaatgacagcggagatcgaaaaagagcctcttgcaaagattgattatgtaaaaatcgtagatcttgacacgatgcagcaggtggagaagatcgacagaggaatccttgccgcgatagcggtctatatcggaaagacaagactgatcgataattttatgtatgaattggagaactaggcgatgacaattaaaatgttgaaagcaaaaatacaccgcgcaacagtaacacaagcggaattagactacgttgggagcattaccgtggatatggatctgctggagcaggcgggaatcctggaatacgagaaggtacagatcgtggacgtcaacaacggctcccgctttgagacctacacgattgccggagagcgaggcagcggcgtgatgtgcttaaacggtgcggcggcacgcatggtgcagaccggcgacaagattattctgatggcatacgcgcaggtgacgccggaggaagcatcagagcttcgtccaacggtgcttttcgtggatgagaaaaataaagtcacaaaggtgacaaattacgaaaaacacggagaaatcggataatataggattgtttcataaaattctatggactataatgattcttatgagtacgtggagaaagcacgggacaaaggagaatgattatgccgcagaatttttatgaactggtctggatttttattatctatgcatttatcggttggtgtaccgaggtatcctacgctgcactcgataccggaaagttcgtgaaccgtggatttttaaacggtccgtactgtccgatctacgggtgcggcgtggtgattgtggttgccatcctgacacctctgaaagaaaatctgctgatcctgtttgcaggatcttttcttcttacctctgtgctggagtatattacaggttatattctggaaaaagtatttcacaacaagtggtgggactattctgacaaaccattcaacatcaaaggttacgtctgcctgaagttttcgatctactggggactggcatgtacctttatcatggatatcattcatccgatcatctatgccgccatccgctttattccgttcgtgcttggcgtagtgctgctcagcattatcatgtgcgtgttcgcggcagactgcatcatcacagtgacaacgattctgaaattcaataaacgcttaaaggtcatggatgagatggcggcatctatccaccggctgtccgatgagatcggcgaaaatatctatgaaaatgtgacagacgttattgaaaaatccgcaaaattccaggaaacacatatggagctgatggataagatcagcgagacgaaggaaaatatttatggactgccgcagacagcgaaggataagcttgcggagacgacgggagcggcgaaggataaacttgcggagacgacgggagcggcgaaggataagtttgcggagacgacgggagcggcgaaggataagtttgcggagacaacggaagcagcgaaggacaagctcactgagacaacggaagcggcaaagaacaagcttgccgagaaggcagagaattatgcagcttcccgtgaggagaaaaagcgcgaacgcgaacttgcactcgaggagaaaaagcgcgagcgcgcagaacttatggagcgctacgagaagctgtacgaggagaaaagctttggttttcagcgtctgatgaaggcattcccggatatgaagtcgcgggataacaacgagacgctggaaaaattcaagattcactttaatatcaaaaagaaagacgaaaacaaaaaagatcaggcatcctaaacgccacatacacagcagacagggagaggaagaacggtatgataagaacaattcaaacagatgagattacaaaaaatatcaaagaaatgtgtatacaggcaaatcattatctttccgcggatatggatgcggcgatgaagcatgccgctgacacagaacagtctgaactcgggaaaaagattttacatcagctgcaggacaatttaaagattgcggacgaggagatgattccgatctgtcaggacaccggaatggcagtgatctttctggaagtcggacaggatgtccattttgagggagcagcgattgagaatgccgttaacgagggagtccgtcagggatacacagaaggattcctgcgcaaatccgtggtcggtgatccgctcattcgtgaaaatacaaaagataacacgccggcagtcattcattattccatcgtgccgggcgatcaggtaaagatcaccatggcgccgaagggattcggcagtgaaaatatgagccgcgtgttcatgttaaaaccggcggacggcatcgagggagtgaagcatgcgatccttaccgccgtgaaggatgcgggaccgaatgcatgtccgccgatggtcgtcggagtcggcataggaggtacatttgaaaaatgtgcgcttctcgccaagcaggcgctcacgagaccggtcgatgaacattccgatatcccctatgtcaaagatctcgaggaagagatgctctcaaagatcaatcagcttggaatcggaccgggaggactcggaggaacgacgacggcgcttgcagtcaatatcaatacctatccgacgcacattgcgggacttccggtggctgtcaatatctgctgccatgtcaaccggcatgtagtgagaaccctgtaagatcgtggtgcatgtagcatgtaatgcgcgtagaaaaataaaaaacgacaggttttccacaaaatgaaaatccaatgttgataagcaggaggtttgaaagaaagattatggataagtatattacaatgccaattacagaagaaactaccgcagaattaaaagcgggggactatgtctatctgacaggaaccatgtatgtggcgcgcgatgcagcgcataagcgcatgatcgaggcgctggatgagggaggggagcttccgattgacatcagggatgcgacgatctattatatgggaccgtctcccgccagagaggggcgtccgatcggatctgccggaccgaccacagccacccgcatggataaatatgcgccgagactgttggatctcggtgaaaaggcgatgattggaaaaggaaagcgctcaaaagaagtcgtagacgcagtgatccgcaatcatgccgtctattttgcagccatcggcggagccggcgcactgctttccaaatgcatcacaaaatccgagattgtatgttatgaggatctcggagcggaggcaatccgcaagatcgaggtaaaagattttccggtcatcgtcgtgatcgaccgtgagggaaacaacctctacgagacagcaatccaacagtaccacaccctcgaggaaatgtagcaggtcatttcctcgcaacgaggtgcagatgctcgcagtctcccacaacaaactctgtattggagagataaaaaaagagcctttcggctctttttaattccggtcttattccagaacaagcagcagagacattttgaagcgtccctttgcggttacgctgtgcagaccgttcttctcaaaacggaagctctcgcctgcgtttaaggtgtagtcggtaccctcgtatccgatgacagctgtaccctcaagcgcggtcaggattgcgttgcccggtgcgcggtgcggtgccagtccggttccctcatcgaatgccatgaggacaaacttcattgtatcattgtgtacgatatccacgtttgcaatacttccctcctcgtaagagatcagttccttcagattcaatacctcttttgcttttacaagatcgttcatagtgttctccttttttgtaataatttctgtatagatacaaccctcgctggttttgacgccgcagagagttctctccggtacgagcaatatctcatccgggtgcagatccattgtttccggctgttcaccgatgagaaacgttccggtgccggcggctccgatatagatggacatcgtatcgtagctttccggtgtgatggatgtgcctgcgcccagggaaaaccaggtagcggaattggaagtgccgagtccggtatttcgtgagatggtcatctcctcgcggatcggacgctttgctgcgatggtaaatacgccttctgacatagtagatcctttctgtcacatcgctttgtctgtcagggagacaggtacgatgctttttatttttttctgatgatggctgaactcattgacaaccacattgacgtcaaaggacacggaaatattctcttctgtcagaaccttctccgtgctgccgtagaaaaaagtgcctttgtgattcatcataaaagcctcgtcggcgacagatacggcgttggtcggatagtgcgtgttcatgattgcgctgatgccgtcctcgtgggagagccggtcgatcatgttgagaaccagaatctgattgtgaaaatcaagacctgtctccggctcgtcgagaatgatcagcttcggttcattgatcagtgcgcgcgcgatcagtaccatctgaagttctccgccgctcatgcggttgcagtcctttttggcaagatgcgtgatgcctgttttctccatcatggcttccgccatctcaatctcccgtctgccgggctgttcaaaaacgccaagatgcgaacaacggccgagcatgaccatttccagtccggtgtaggaaaaagcaaaaccgtggctctgcggaatgtaggagacattgctccacaattcctttggttttaatgttttgatgtcctgcccgtacagaaaagtcgcaccctctctccaggggagcagaccaatcatgcattttaatagtgtggtctttccgataccgttgggacctaagattgctaaaatatgaccttcctctaatgagagattgatatcaggtaatattatatcctgtttgggatatccaaaacagccattttttatttcaagaatcattgcagattgctcctgttcttattcagcagtgaaataaagaccggtgctccgatgatggcggtcagaatggacagcggaagctcgatgacgctgatggttcttgagagtgtgtcaatcagaatcataaagcttgcaccgagacttaagctgatgggaaccacataacggttgttgcttccgacaagcattctggcgcagtgcgggactaagaggccgatccagccgacctgaccgcacatggataccgccgaggcggtaatgaccgtcgacgccaggatgaatatcatctgtgtccgttttaagttgatgccgctggctttcgcttcatcctcgcttaaggataaaatattcagtctccatcggagcagatagatgacgacgattccaatgagaatgagcggagaaccgatcagcaattttttataagtggcgcttgtgaagctgcccatcagccagtaagtaatttccggaagcttgtcctgtgggtcggccgtatatttcagcagagagccgatggcgttaaacagggaggaggcgatcacgcctgccagcacaagatagaccacctggcggttctcattttttcctgcgatctttaatgtaaaaaatacggaggcaagtccgaacacaagtgcaatgagctgtgtctccagaataccgcaggaaaggatgatcgcaaggatcgctcccacgcaggtgccgctggtaacaccgagaatgtccggtgttgccagtggattggaaaacagcgattggaacgtgtttcccgcgcaggtaagacctgctcccacaataattgccatcagaatacgcggcagccgcagattgattacaatggagtaattctgcgcatgtccttcatttcccgtgagaacatcgcggaaaacagcgatcacgtcgccgaccggcacattcattctgccgaggcagatacagatcagtgcggtgacaagcggcagcagtatcatgaagagaatggcaagcggtgtaaaatgcccccgtttgatcaaaaaattatcattcatcagtactgaagcatttcctccatttcctcatcggtaacatcgtagccataccagtcatggtaatattcacggatggtatcctccagaggatagtctgcgaaaacttccgggtaagtgttgcatgcaagccatgcgaataccagcggagcgtccgggtttggtgtaaaccagttccacatgccgagcgttgtgtcatagacacgtccgtcctgaacagctttgatggaggagaaatcggttccctctaccctgttctccagcacgtcctccgaggtaagaccgatgagtcccggaccgtcgacaaacagaatatccggattccagtcgtagatctgttccatgctcacctgtgtaaagccggttgcctccgcggcaacgtccgtgacacctaagtgtttcatccagtaggtaccaaaggttccgttgccggatacctgcggtacgccgtcgctgtatttccacagaatcagtgcgctcgggcgctcatcctccggaacggctgcaatccttgcctccacatccgcaacaatctcgtcgccggcagcagtgaaagcatcggtcttgccttcctcaccgaagacatcctccagaagatccagccactgtttgtagcggtttaacggatcagcttctgtctcgtgaccgacggttgcaaatccgatacacggaatgccgctctcctgtaagatctctgcgtgtgccgtattgccggcattgtataagatgacatccggttctaacttcatgatttcctcgatattcagatcactctgtgcatagacggtatccgcggattccatcagctccggtgcgatatttttgagaaccgtctttgagatggtatccttgaaagaaccgcagtagcctacgatataaggagcttccccgccgaaataggacatgtaggtggagagaatcggaatctggtcaatcactacgcgggtaatgtgattcggaacttccacagtgttgccggcatggtcaaccacagtgtgggtgccggtgtcctcggtggcagcagtttcagtgtctacgctctccgccgattcggaagcggcagcagtcccggtggctgctgtggctccgttatctgaagtattctctgttccggaagccgcattgcttccgcaggctgcaagctgcagtaccatggcagctgtcaataatgcagcggtaagttttgtcttttttatcatatttcctccctctgaacggtatcagtatgtaattattggttagttaaaactaaccaacgagacatagaatactggaaaaggaaagaaaaagcggttgctattgcaaccgcctcaaaaaaagattatattgccagaaaatccggatcaagaatctgcagcctggaacccgaaaaattcagaatcccctcgtcgcgcattttgcaaagttcgcgggagagggcgctccggtccgcgtagagatattccgagagttctctgcgggtgtaaggaaggcagaccgttccgtccggtgcgatctctaacgtctgcagatagatctttaacttgtcccgcagctttttctgactgagaatccgtattttgctgttaaaaaacatcacctggcgcgcaaattcctgcatcagattggtggtgacctgcatacggcaggagcaggaaaatgttttttccgacaagagcgcggcaaaatcgagcatcaggatcttgcttttttccacggtgtgaatgtagacatgactcgccacctgtccggcgcacacagactcggcgccgaagacatcgccgcttcgcagatgattgatgatgatctggttcccgttttcgtcgaccagatattcttccagcatgccggtgagcagaatgccggagcagccggaggaatccccgagtgcggcgatggatgcatcctgcggataatcgaccacgcgcgcatttaagcagcgcaggacattgggatatttatcttttggtaattgacggaagatactggaatgttccagtacatccttatatagagctgtttcaataatcatatatttccggttgccgctgcaaccgccctccgtttttgaaatcaggtaaaataatgagttagtcaactctaacattataactttgccggaaggagaagtcaaggtttacataaaatcaatttcggggagaataccatccgtccggggatcgaaattcagaagtgaaaaacagaaaaaaatagggtataatctggatatgcggaggtgagaggggtatgatactgaatacaggaagcaggacagacataccggcgtattacagcgactggttctatgagagggtccgcgcgggagaagttctggtgcgcaatccgtattatcccacgcagataacaagataccggctcgatcctgcggtggtggatgcacttgtattctgtacgaaaaatccgctgcctatgctggagcgccttccactgctggatgcgtttaccatgttctggtttgtgacgatcacgccttacggcagggagatagaacctcatgtgcctgataagaacctcatcgcggaggcattttgcagattgtcggagagcgtgggaagagaacgtgtcagcttccgttatgatcccgtctttttaaataagacctacaccgagcagtatcatgtggaaaagttcggggagtttgcagagaagctgtccggatataccgggcagtgcgtggtgagttttattgatttatatgaaaaaaccaggcggaactttccgggcgtaaggagcgtcggaaaggaggagcaggagcgtctgattgcagcgttttccgagatagcggtaaagcagcatcttcagattcatctgtgctgtgagaaccgcagtcttgtgcggcagaatgtggatgcagacggctgtttatcacagtctgtgctggaacaggcgatcgggtgcagattaaaggtgccgcagcagaaacgggcaagagacgggtgtccctgcctgctcggcgcagacatcggtgcttataacacctgcggacatgaatgtctgtactgctatgccaactatgacagccgcaccgtccgggagaaccggctgcagcatgatccccgctcgccgcttctgatcgggcatgtgcagagcacagacattgtaaaagatgcaatccagcgttcctggaaagatccacagatgagtatttttgatttgtattgataaaaaaagtaaaatcatgcaggaggtaccacaatgaaaaaagagttgaactgggcagtcttgggatgtggcgtcatcgcaaatgaaatggcacaggccctagagcatatgggaaagcatctctacgcggtcggcaaccgcacacatgagaaagcggtcacatttgcggagaagtacggtgtacagaaggtatacgacgattttcaggaaatgttccatgatcccgacgtcgatgtcatttatattaccacgccgcacaatacacatatcgaatttgcccgcgaggcacttgcaggcgggaagcatgtgctctgtgaaaaatcggtcatgttaaacagccgtgaacttgcggaggcgattgcgcttgcagaggagcaccacgttgtgtttgcggaggcgatgacgatctggcacatgcctttatataagaagctctggcagattgttgagacgggggatggagagattccggcactcgggaaggtgcagtttattcagctcaatttcggcagttacaaggaatataatatgaagaaccggtttttcaatatgaatctggcgggaggagcactcttagacatcggtgtctatgcactttccattgcaagaagctttatgtcaagccagccagaccaggtgctttcccaggtaaaatacgcaccgaccggcgcggatgaacaggagggaattcttctgatgaatccggacggacagatggcggcgctgtcgctgtctctacattccaaacagccgaagcgcgctgtgatcagctgtgagaaaggatatatagagatcatggaatatccgcgcgccgaccgcgccatcgttgtggaagcagagaccggaaaggtgcatgagatcacggcaggtacaacggcggatgcattattatatgaaatgacagacatggaagacgccatcttaaacggaaataccggggtgatgcggttaaaagatacccgtgacgtcatggaactcatgacaggcctgcgcaaagagtggaacatgaaatatccgggagaagagtggtaaaacaactagtttgacacaaaaaaatgtaggagtaccaacattaccagaaggttcacaatgggaacgaaatgttttaaattcctttgcaggaggaaaagcaacacctactacgtatgaaggcgggactacattatatagaattggtggaaaaaatggcggattttggagtttagaaccacctcctgcaactgaatatcaatggagagtggattatgcaattaaacaggagttctgtaatgatgcatctactttatataagatgactataccagaaggttcttctttaggagctttagaaggaaaagttggaccacaaggaatgggattatatggtggggcacatcaagcatatattgattatagagcagtacctgcagattggattgagataacacctgcaacgtggaagtgagaaaattatgaacaagattgacgacgaaaaacataacgaattaatagtaatattgagtgagttaatagaaactattgaattaatgaagaaggaggaaaaagattatttattgattcagaatgaaaatgaagccagagattggatggattttttaaagaatcatacagataaagacgaattgaaatctttagaaaatgaaatatcagataggtttttctttaagtttgatgttcaaattggaacatcagaactagataataaaagagcggaacttatgaaaaagtatatatttaagtcaaatgaatatttaaaatagttataatcagggttatactttcggacattcagaagaactgttatgatgccgagggtcttcgtgcagagatggaagagaacggcagattagtgcagttcctctataatgaggatagggaagtagtcgcagagaaagactgcagcggcaacatcatccgttatatacgtggactgggcttaatcagttctgacagcgagaacgccaagacgtattaccattatgtatccgatgaacagggcagtgtgagccatatcatcagagatgaggataaggagagcggagtatcagcacagggaagagagcaggacagaatactcaatcaatatgagtatgatgcctttgggaataccataagctgcaaggagcaggtagagaaccgcttccgttatatgggagagcagtacgatcctctgacgggacagtattacctgagggcaagatattataaccctgtcattgccagattcacacaggaagatacctactatggcgacggactgaacctgtatacctactgccggaataacccgatccttaaccatgacccgacaggacatggaacgaaggagaacagcccatacagcaggaaagaacagcagtacattgatgcaggggcagacccggatacagcaaagcttgcaacgcagtgctatcctgatgcaaactcgaaacaggacttatacaataagtacaagagtcagggatataatgcaacagatgcgaagaagctggcaaactatgagattgtccatggtgaggagagggcaaagaactatgctgccaacaatgtaaagaagagcggtcctgattacacagcgacttccccaagagataatgtcaacaccgactggagaacccaggaaaggcttaatgcgcagaagaaagcaagtaattcccaattgatgccaatgaatttgcagttctttgcggcaaaaggggatgaaagcggcagtaggagtggtagtaacacaacagcgacagaaagaagaaattcacctggtgttgtagaaggaaacggaaggaatacatcaaaaatgatgtatggaacggataagaatgcaggtgttattccaaaagaaattgctgacaaattaagagaaaagcaatataataattttgacgaatttagaaatgatttttggaaagctgttgcagaaacagattatgcaaatgaatttttaataaatggagatcctaagaactattaccgaatgaagaatggaggcgcaccacttgtggtatctaatcaagccataaatggtagctttacatatcagcttcatcatattattccaattaatcaaggtggaagtgtttattctgtagataatcttgttgtggttacgccgcgttatcatgctgaaatacttattcctgaagtgcatgggtataatggatttaaacaattttttagataaggagaaaggatatggataaattaagtagagaagaagtaaaagaattggttgaaaaaataagttatggtatgggaagtgatgaagaagtttcagagtggattcaaaagataatggatagtgtgcctaatagaaatgtagtggaagctattatgtcaggtccgaacgcaagtatagaagagatattagataagttatatacaggcaatgtaattcgtttataatttaatccttatatgtaaggtttactttagagatacctagtacaacattaaataaataactagccaaatatcatgtatggtgttatacttataatatcaacggaaatgaggtatcagtatggcacacgcacgatctattacacttacaaatgaagaagttttgtaccttcagtcactcactcgtcagcgtacaattcaagcgcaggtagttgaccgcgctaaaatgcttctttacaaagcacagggagcatcgaatagcgatattgctgaacgtttagatgtaaatataaacaccgttaaactctgtctttccaagttcagggaaggcggtgtacagcgtgctctgttcgatgacaaacgcaaaggacgacctgttgaaatcacagatgacgctattgcatggatcatcagcattgcttgccagcgtcctaccgatcttggctacgcacaggaactttggactttaaaaaatcttcatcagtacatccaaaatcacgcagaagaggctggatattcaaggcttacaactatcacaaaaccaatggtacagaagatactgaaccaatccgaaattaagccgttcaaaatcaagtattactgtgaaaaacgggatcctgattttgagactaagatgcatgatgtccttgttgtttacaaacaggttgaaatgcagtttgacgaaaacggagacatcatagtttcaactgatagtccaatgattcataccatttcctgcgatgaaaagccgggaatacaggctattgcaacaacaagtgatgacctccgtccgacggaaggaaacggctgtgtatatcgtgactatgaatataaacgccttggcacattgtctttaattgccggaattgatcttctcacaggaatagctattcctgttgtaagtgaaactcacaaaagttccgatttcatctgtcttctgaagaaacttgatgaaatgtatctggaaggggatgttatcaggattatctgtgacaaccattctgcacacaaagcaaaggaagtgcagaattatctggctacaaagccagaaggacgttacgtatttgtgtttataccaaagcatgcatcctggctcaacctgattgaatgtttcttcagcaaaatggcaaaacagatgttgaaaggaatacgagtcaaatcaaagcaggaactggcggacagaatctatcaatatttcgatgaaatcaataaagagcctgtggtatttcattggacatataaacttgatgaaatatccgaagaagaagctaaccccaatatggccagttaattattattcaatctactagtacattgaataataattaagactaaatcgagaatgttttattggcaagcaccatgaagcattctcgatttttctgttacaaggtaatttcgataaaatgtctcaaagcataacaaatttttgaacagtagagaaagttatgccataccatctttctcccaacggctttgcctgtgggtgttcatcggcttatgctaccttctggcgatataaaacctttaacctgcactattttcgacactacttattttggcggtatctcaagaaatcatgtctttcacatttccccaacaaggctcaataattctattatgggtaactacctcgacttcggtcttaaaatcgcacacaggggcaacacaggctctcacaggggcaagagaaagttgatttgtctgtctaaaaaatgaatttgtgcatatttacggttttttctctgtttttggtctatggcataaagccaattctgtcttcacatcgccaaagtttcctccgatttttcaaaacaaaaattttgacttgcaactgttctttttcagagttaacatcacacaccacgaaggagatttcttctgcttcgtgtcctgtgttctacaggatgtatccatctccatgaaagtcagcggtgttcctttgcggaatattttgtgcctgaccagaagtggataggctataccactcttgcacacttggttgctgaaaagatgcgtaattccgagaaagatgcttaacagttgagattgccactattttgccaaacattgagattggagttgattttatggttaaagaaaattttatttatgtgggtatcgatttacacaaagaaacccacacagcagttatgattgactgctacaatcaaaagcttggagagattacttttccaaacagaccagccgattttcctaagctggtaacaaaggttaaaaaatgtaatactgatgcaaaagaagtagtctatggtctggagaatgcttatggttacggcagacctttagcggtgtggctgattgataaggggtattttgttaaggatgtaaatactgctatttctcatcgtcaggcaaagcaccgtggtgccatgtatcgcaagagcgatagcgacgatgcagaagctattgcacttgcaactctaaatatgcttgataaacttccggatgcctgccctaatgatgcatactggtcacttggtcagttggtgcatcgcagggataacatcatgaaacagcgaaccagactggttaatcagttgcacgagcagctgtgtattgcatatccgtcttacaagtcattttttaatgacatcagtagacctactgcactgtacttctgggagcattatccatccagaaagtatcttaggggtaagtctgtggaagatttacgtaaggaacttgttcccgtcagccacaatagatgttcgaccaaaaactgtgagaaaatcttggatgcggcagcaagtgacaaggtaaaaaataatgcttaccaagatgccagggacatggtgactcttagcattgtcagtgatttacagcactatgacagccaactggcagaggtagacaagatgctggaacagatgtataagatgcttggctgcacgcttacaaccattcccggtgtaaatgttatcacagcagtgaagattcttgctgaaatcggtgatatcaaacgctttagtaatgctaataagttggcacagtttgcaggaattgcaccacttcatttatcatctagcggtaaggggaaagatgtagctaccaagcagggtaacagacgattgcaggcaaccatttatttccttgcaatccagatggtgcaggtatcctcaaagggtacaccgagaaattcggtggtacgggcatattatgagaaacgtaaggcagagggaaaaaccagtcagcaggcactgatttgcatttcaagacggttaatcagtattatttatggaatgttaaagcatggtacggaatatcgtatgccagtagtggaaaacgctggcgaaaagttgtagagcaaatggcaaatatatggtaaacttttaagcagatgcaagagtcggctttgggaagtgtattcatttttcggggtaggagcatcggcttggataattataagagtaaagagtctttgtcaagagtggtaatgaatcaaacgtttgaggatatgaaagagatcgtgcggaagaatccgtttgcacagcatataggcatggaacttctcgaagtgacggaaggatatgcgcttgggcggatccgtctggcaaagcaatacgagaatatctacgggggaatgcacggaggctgtgcatattccctcgcggacacgctatccggcatagcggcatccacttacagggaatacgtcaccatgctggatgcgtcgatgaattatctgcttccggtggaacatacagagtatgtctactgcaaagcgagggtgctgcgccacggaaggaagatcacggttgtccgggtagaactgttaaacgatgagcagacgctcctcatagatggaagctttaccttctatagtataagaaaaagagacgaataataaaaatacgctgaatggattgtcgcaataagcatatcgtgctttggagtaataagtaatattataaaaagaccacaccgtgggatttcagctggaaatgcaaatggaaattcggttcaaaaaatgtggcatttctaaccagccggatgtttgcatcttcgatgatccgtgtctttccaagtttggagcactccgcgggtcatgtccgtatcccggaagacaatttgtaggacttttgtgtgtgtcccttattggcacctctgaacaaaacataaccgcgcgaagccgctgtctgagtcggcatctgccctattttcaatagcagatgctggcgagttcggttcgcgcggttttatattgtctgtgaagaggtgccattagggacaccagaaagtccgcccattgtctccggtgtgccggacatgcacccgtcggattgtccaaacgtggaagagacacggaatccgatgcaaacattcagccggaagaaatgctcacatttttctccaacgaatattccatttgcatttccacatgaaatcccgaagttgtgtttcttagtaatattacttatcgccctaaagagcgctatgcttatagcggcaattcctttgaaaataaaatttgaatatttccattgacaaacggagaaacttctagtattattatctatgcgtcacggcgcagaacaatatcatattgtcagataagaactttggagaagtactcaagtggccgaagaggtgcccctgctaagggtataggtcgggttaaccggcgcgagggttcaaatccctccttctccgctttatttgaagatatgagttgttcaatttttttctgaaaaagttgttgacatacgcttcgatacatgatattataaatgagttgtcgcgtaaaacaagtaacacagacaacaacggcttctgaaaaagaagcaaaagaaaataaaaaaagttgttgacaaacggttgacagtatgatatagtaaataagctgtcgccgagagatgacaacagcgagtgaggttgaaaaatccactcagaagttgcgaagcaacttctaaggacaacgcaaagcgttggctgtacattgataactgaacagtgaataaaccttgaaagatcctaaatttcaagctgtcgatcaagagattgaaagacagacgaacgttcttataaagaacaacctaaaacagtaaattcagagtaac

SEQ ID NO: 18 - DNA, 64748 bp, Roseburia hominis
gccctgcatcatcttcttgtgagtagtcctccggcttttcatccatttgttcaatatattggatagttggagcgcatataatcgcatctgccgattcaccgatcatcagttttcccttttccaattccttcttcaatagctcatccgttcccgttttacggagctggtccataaggaagaaagaatttccgccggtaaaatatatcacatctgcttcttcaaaaacagactgtatcgttgaataagcctccgttgaaatatcaatttcagttacgattgctcccaactttttgaataattttcgagccgatccgacataaccggtgtagccttcacgtagtgaagctgttggaataaatgcgactttcttattttccatttcttcctttatcagacttcctacacttgaaaagtgcgaacataaaaatagtttcatcaatattctcctttataaattcaaattttgtctatatggcaactaatttgaaggaggataaagtgatgatgggatttagcatagcatttataattattgttatttctatccggaggttactgtggagaaaatgagatcgtaccgcaagaagcagtaaatgttatcgcataggcacaggaggtgtggtatactgtgcttatacgaaacgaacgtgttttgttattcggtattaagaatacagtaattcatattaaccagattaggaggagatgtttaatgagtaaaatgaaaagctggaatgatgaaccagcaatacagcaaaaagaatactcacaggaaaaatacaataaaaagaaaaagagatctcttcgggttgctaagctgtcttgttattcaggagagctggcagcagttttcggttggaacagtatgttgtctcttattctgtttttagtattattgttaggcacatcagcacttccatatattctggatgttaatatcaatttcggacctgaaacattttggtgcagaggcggtatctttgttaatatatgtttagtattacttattctgttttcaattgcagcatttacgtatgctattagctataaagtagcggaagtcatgtgtatacttctggatggtggattggatggagctatagaggtaaatgatgctgccatgagagctaactttaaaggacaggtagcaaaggcagctggggtggcttatgtcgatacagaagcacttgcaggaccgatgaatattctgaccagatactgtactcaaaataatacaacaatgctaacgccgcgtttctttacagttttgcacagaatattagttgttgcgcagattttccttgcatgtattagtatctttgaattgtttcattaagtattagtagaaaataggttgcgttgtgtaatgattatattatctactttgataaatattccgttgtaccatagtgataaggatacgattggatttgtaggattgattcttatggcaattcaatgttttcttatagttgtatctaagtcagcaaccaccagttcaactggtggtttgctataagccctccaaagggctatgttatctgcaaatcgttaaaccctttcagaggaatatgtacccactgcaatacgggcatttactgccaccagaacgagtagaaataagggtgttccactctctgccgcaatccttacacttccaccaagccttacgattggcaaagaccgtaacctgagttggaagtaacggataatttctatccgaccactcggcagctatatccggcagaagtgttgcaaggtcattaaatcctgccaacactttattatgagagcaatatgggcaatctgttttatttattgtcctgctcttaacggcagcttcccactcgtgtcctttctcacatctccaaatcactttcttatgagaaccaatagaaacctctgtcggttttatcttattctttttcgaccactgctttaccagtaatggctctaatgtcgccaaatcgttaatacctgcaatcactctcgcaccggaacatatcgggcatttttctccattggaacgagccttaacgcttgcctgccattcgtgaccgcaagtacctttccaccatacttttttatttgaaccaaaggtaatatcatcaggtgtaagcggtaaattcttctccgaccattccgtaataagctctgggtgtacttctgctaaactgttgttcatagccaaacctcaacctccttgtgcttagagtatatgaagttttggctttatcttgtagtttgcgaatatccgtataaatagaaaaagccctttgagaaaagaatttctcctctcccaaagggtagtttaacttttacttagaattatcttttttaataactaagttataattgctatcataatacagtccaagttctctacacattctatcgttcacattatctaacgctttcttatattctgcatacgttggagacagaaccattaaattaggaatgaatatattgttatatcctttattttgtaactctttctgcatttttctctgtgcaataaatgctggatggtatttcattataccgtttttcattttagcacctttccatactttttcttttagtctttcatattcactttcactcatatcacgataataggctatcatctcatctgcggttctggtttcttgtgcaatcccacctatcatcttcgcacctattcccataataaaaggaactttcaatgtcgtttcatcgcaatattctaatatattatgtagtgcctgcttctgttccagagtcttcaaccttacattaagaaatggtttgaaatgacttttaaaataatctccccattcttttcccggtagcaaagactcaattgcattttcaacggtttgataatcaagtgcctcatttgctttgtctgcgtcaccatcatctataaattgcttcaaagcttcaagttctgagtcttttaaaactttttcctgcactttttcttgataaatacgaagaagaatacttttgtcgccagtttccaaaaggctctgtatgtctttaatactaataccgagttttctatatactgaaatcttttttaaagtttcaacatcttgtgcagtatagttacgataaccattgttatctttatccactgacagcaatcctttttcttcataatacttaactgcacgctttgtcattccaacctcatttataatttcatttaataacatccgatgcacctccttatgatttatgttgatagtataagcgtatacgctgcgtgcaggtcaagagtttttcgtctttcttctaaaaatgggcaatcccgatttcaggactgcccattcattctgccaattatgcgatttttccttgcttgcaccgatttctgcatcaattgatgtaagtttgatgtaaatcgctgtttttttagttttttatcaaatgaagtacgtcccgtctattcggtaaaacggtacatctttacatcatcttaatagagctttgcacctgctggaatatggtcatcaaccatcagaagatgaagcttttcttcgccttcttcttcatgaatagcactgaggagcataccgcaagagtcaatgcccatcatagctctcggtggaagatttgtgatagcaataagagtctttccaaccagttcttccggctcataaaagctatgaataccgcttaaaatggttctgtctgtgcctgttccgtcatcaagagtaaactgtaacagtttctttgacttcggtactgcaacacactctttaacctttactgcacggaaatctgacttgctgaatgtatcaaaatcaacaaattcctcaaataaaggctctacctttaccttagaaaaatcaatcttttcagactcagtttttacatttttttcaggtgcttcagaagctgtattatttacatcatttttcttatttacatcattcagggacttcatcgtcgggaacagcagtacatcgcgaatcgccgggctgttggtcatcatcatgaccatacggtcgattccgaatccgatacctccggtcggcggcataccgatggaaagtgcatttaagaaatcctcatcggtgtggttcgcttcctcatcaccagccgcaaaagcctcctcctgggcagcgaaacgtgcgcgctggtcgatcggatcattcagctcagagtaagcatttgccatctcccagccgttcatgaagaactcaaaacgctctacatagtccgggttctccggcttcttcttcgtgagcggagaaatctcgatcggatgatccatcacgaacgtcggctggatcaggtgctcctcgacatactcctcgaagaaaagatttaagatatcgcccttttcgtgacgctcctcgtactcgatgtgatgctcatctgcaagcttcttcgcctcggcggtatccttcacctcgttaaaatcgacgcctgcatacttcttcaccgcatccaccatggtaatgcgctcaaacggcttggagagatccatggtatgctccccgtaggtcagcatctcggaaccggtcacttcctttgccacatagcggtaaaggttctcagtcagatccatcatgccgtggtaatcggtatatgcctgatacagctccatgagtgtgaactccggattgtgtctggtgtccagaccctcattacggaatacgcggccaatctcatagacacgctccatgccgccgacaatcagtctctttaagtaaagctccagagaaatacgaagctttaagtcctcgtctaacgcattgaaatgtgtctcaaacggtcttgccgccgcaccgcccgcattcgacacgagcatcggggtctcaacctccatgaagccctgtccgtccagatagcgtcggatcgtgctgataaccttggaacgcttcacaaatgtgtccttcacatcctcattcatgatgagatcgacatatctctgacgatatctggtatcggtatccgtcagtccgtggaacttctccggcagaatctgtaagctcttggaaagcagtgttacctctgctgcatgaatggaaatctcgcctgttttcgtcttaaaaacgatacccttcacgcctaaaatatcgccgacatcatactttttgaaatccgcgtaggactcctcgccgatgctgtcgcgcgctacatagatctggatacgtccctttaagtcctgaatattgcagaaagatgccttacccatgacacgtttgaacatcatacgtccggcaagagatacctccttgccttccatctcctcaaaatgctccttgacatccgtgctgtgattcgtcacgtcatacttggtaatgacgaacgggtcctttccgttctcctgcagttcgtgtaacttatcataacgaaccttgagcagctggttgacgtcctgctgctggttattattctgctctgccatgcttttcctccatttatcctgcgccgcctgtccgcatgaagcggagtccgcagacggtcatgctctactcgtttgatgatctgtgaatggaaagtatcttgtactcgaactctcctgccggtgtcgttaccgttacggtatcgccgattttctttccaagaagcgccttaccaaccggcgactcattggaaatcttgccctttaagctgtttgcctctgtggaacccacgatcttgtaggtcagctcctcgtcgaattcacagtctaagatctttacctgacatccgatacttaccttatctaagtcagcctcttcctctacaaatacttcagcattcttgaggatcttctcaagctcttcaatacgtgcctcaatatctctctgctcgtccttcgctgcatcgtactctgcattctcggacagatcgccctgctctcttgcttccttgatcttctgggagacttcctttctcttgacaacctttaaatcctctaattcgtcctccagttttttgagtccttcatacgtcagaatgtttttcttgtccattactctctacccttctttgtaatttttatcagttcaattttcataaaaagcttcttcaaatcggtcacgtccaagcttttctctctggtgatgcatgctcttaacaatcacagtattataaccgataggcaccatgatgtcaagattttcgccctgtttccagggctttttgtggatcggaatgtaggttgccgcggcgcagatcatctctgtccggtatgctccctcccactcaaaatccaggattaccttccgggtcagaaacgtttctctcacccccgcctgtccttcccacgcagacagtctggtttttggaaaaaccatcaccaccagcccgttctcctcatacattctctctgcaaacccggaaaaatatgcggggcgtccggtgtacaccgtaagataattcagatcgtctccgatctgttcgagcacatcgcgcacatccgccggttcaaagacatggctctgctcctcgtcaatcaccacaagctccacgcgctccgggcgaaagctttgcgcctttaagatcgccagaaataccggtcggaaatttctaagaaactcattggaataggacattcctatgcctcatatccgtttttctcattatatgactccacttcccggaataatgcctcgagctgctcgtaattctccacctcgttgatccttcctcgaagcttggacgaattacggtatcccgcggtgtaccatgccgcatgcttgcggatctcacggatgcccgtatagtctcccttgcagtcgatctgcatctttgcatggcgcagaagcatctccgtcacctccgagaaatccggccgggcaaggtgctcgcccgtatcaaaataatgcaggatctgacggaaaatccagggattgccctccgctccgcgcgcgatcatgtagccgtcgcagccggtctgctctgccatcgctgccacatcctccggcgtccggatatccccgtttccaatgacgggaatcgataccgcctccttcacctggcggataatgtcccagtccgcatgtccggcataatactgctctctggtgcgcccgtgcaccgcgaccgccgccgcaccgctctcctgcgcaatgtgcgccagctcgaccgcattgacgtgtgcatcatcgaatcccttacgtatcttcaccgtcagcggttttttgatcgcccgcgccgtcttctctatgatctccccggcaagccgcggatttttcatgagcgcggagccgtccccgttgttgacgaccttcggaaccggacagcccatattcagatccagaatgtcaaacggccgctcctcaatctgcttcgcaatctcactgataatatccggatcggagccgaaaagctgcagcgataccgggtgctcctttgaatcaatggtaagaagctcctccgtgttgcggttcttatacagaatcgccttggcgctcaccatttccatgcacaccagccccgcgccctgttccctgcaaagcaagcgaaatggcaggtcgcttacgcctgccattggtgccagtatcaaattattttctaaggttacatttcctatctgcagtgttcggattattgccacgctgccaccctcattttctacttatttaatcttcccggatttacggttctgctttttatagatgagattcatgcccttcaatgtcaggttcgggtcatacacatcgatcattgtggtctcatttgcaataattctgcccagtccgccggttgccacgaccttgacctcgcccatgttcgcctcatcgatcatatgacggatgatgtattccgtctgtccgatctgcccgtagacaagccctgcctgcatggaggagatcgtctccttcgcgaggatgctcgccggcttgcggatctcaatctccggaagcttcgccgcatcttcccacaatgcttttgcggaaatgcggattcctggagctgtaacgccggatacaaacgcgccgtccttgtccaccagatcgtacgtggttgccgtgccaaaatcaaggacaagcaccggtccgccatacagctcatacgctgccgctgcatccacaatacggtccgcaccgatctggcgcgggttctcagtcacgacacggataccggtcttggttcccggctccacaataatcgggcggatgctaaaatacttgataatcgccccctcgagggaatgcatcacattcggaacaaccgatgcgataatcgcatcctcaatatcgtcatgtgaaatcgaattctgctccagcaggttgctcaacagcatcccgtattcatcggatgtacggggcattttcgtcgtgatacgaaaattcgataccacctcgtctccccggaatactcccacggtaatatttgtgtttccaacatcaatcgtcattatcatcgtccgtaccccctatattcccacatataaaaccttataatacatctgcagcgcttccagcagttcctgttttgtctgctgtaactgacggatcttaagtccgcagccgatctcgtcgtacagcagatcattttcatcgcaggaggtgcggaattccagttcgcccgtttcgctgaacaccagctgaaaaataccgcccacatcctccgtgaaaagcacgcacatgatcttcagttcattcttgatctgctccggaagacctttaaagtcctcgttcagataaaattttttattgtatgcgctcgcaccgcacagtaccacttcttccattcagacattcctttccaaaccgtttccacagacactgtttgcacagtatcccttacacatatccgtagacaccgcgcacagagacttctcctgcagatacaagtcttctgctctcccaggtatccacgatcagctcgccccgcggcgtgatgcccatcgcttttccctcaaacggttccttcggatcaagcaccttcacgatctggttccggttgatcagatgcgtatcgtactccttcacaagaccgctcagatcctcggtctccatgaaaattgcataataatgttcaaactgttcccatacttcctcaatcagagccgcgcggttaaaatgttctccagtctccatgtagagagaagttgccactggggcaatctcctccgggaacgattcgttgtgaacgttgatgccaataccgatcacaatgtgattgacataatccatctgtgcgctcatctccgtcagaataccgcaaacttttttcccgttcatgacaatgtcattcggccatttgatgcccgccggtctgcctgtcgtcttcacgatcgccgcagacaccgcaagcgccgccaccagcgtcagcatcggcgcattcacgggcgacaactccggctttaacatcagcgtcataaaaatgccggctccctgcggggactcaaagcttcttcctcttctgcctctgcctgcatcctgctgtccggcgaccacaagcgttccggtagggtaatcttcctccgccagctgcttcgccctggtattggtggagtcgatgaccggatagtaaaaaatctcctgtccgacccacgcggtcttgcggatactttttaattcttcctcgctcagtgtgtccggcaccgacaacagcttatatcccttgttcggcaccgcctcgatctcatacccggcttccttgagctggttgatgcccttccagaccgccgtccgggatacgccgaacttttcacacagatcctgcccggacacgtaatcgtcggcatctcttaaaacggaaagtagttctgctttcatgatgttccctcttattctcccagtgtagcaagcatgactgccttaatcgtgtgcatgcggttctctgcctcgtcaaatacaaccgactgctcactctcaaatacttcgtcggtcacctcaagctcgctgtaaccgaatttttcatagacttccttaccgatcttggtctttaagtcatgaaatgccggcaggcagtgcatgaagatcgccgttggcttggcatttgccatggctgccttgttgacctgatacggcatcagatcccgcaggcgctctgcccagacttcgtccggctcacccatcgatacccagacatccgtgtaaatgacgtccgcgtccttcgtgccttctgccacatcctcagtcagcgtgatcgacgctcctgtcccggccgccacttttttgcagtaatccaccagctcctcgttcggaaaatatttcttagaagtacatgcgacaaagtccataccgagctttgcgcaggtcaccatcagggaattgcccatattgtagcgggcgtcgcccatgtatacaaacttcacaccctttaagtgttccaggtgttcccggaccgtcagcatatctgcaagcatctgcgtcggatggaactcattcgtcagaccgttccacactggaacccctgcatattttgccagttcctccacaatgtcctgtccgtatccgcggtactcgataccgtcaaacatgcgtcccagcacgcgcgcggtatccggaatgctctcttttttgccgatctgcgaaccggatggatcaaggtaagtcacatgcattccgagatcatgtgctgccacctcaaaagaacaccgtgtgcgggtgcttgtcttctcgaaaatcagcgcgatattttttccgatcagactgtcatgcagaattccctgcttcttcttgctcttaagatccgctgccagatcaatcaggtagagaatctcttccggtgtgtaatccatcagttttaagaaattgcgtccttttaagttcatgattgcgttcctccttgtcgcttagtgcttccagttgcagaataaacaggctgccactctcgtgacagccccctatttcaatctgatctatctgatgttctatttgttctccagagctatttctgtcacagattttgccagccctgcgattccctgaatctcagacggaatgatgatcttcgtcgccttgccgtctgccgcctttgcaaatgcctcaaggctctttaactggatgacgccctgatccggagccgcatccttgatcatgcggagaccgtctgcgtttgcctgctgaatcttaagaattgcctcagcctgaccttctgcctcgcggatggttgcctccttcttcgcctctgcacgaagaattgccgcctgcttctctgcctctgcatcgagaattgcggattctttcttaccttctgccacgaggacggtagacttcttctcaccttctgcacgaaggatcgcttctcttcgctcacgctctgccttcatctgcttctccatcgcatcctggatcgctgcaggcggaatgatgttcttaagctctacacggtttaccttgatgccccaaggatctgttgccacatcaagtgttgctctcatctgcgtgttgatcgtctctctggatgtcagtgtctcatccagctcgagatcaccgatgatgttacgcagtgtcgttgcggtcaggttctcgatcgccatcagcgggttctccacaccgtatgcatacagcttcggatctgtgatctggaaataaacgaccgtatcaatctgcatcgtaacattatcctttgtgattaccggctgcggcgggaagtcaaccacctgctctttcagggtaaccttcttcgccacgcggtcaataaacggtatcagcaggtgaagacctaccggccatgtcgcaagatatccgcccagacgctccacaatgtacgcatgcgcctgcggcacgatcttgatacaggacaccacaactgccaataccagaataaccaaaatcaaaaaagctactaataatcctcccattatctaacctccaattattttctgtccggatctctaacactattttccccgttaaatatcatattactatatttgatttgaaaatacaagaaaagccgtaggaaatgtcttgtcatttcccacggctctgccatgatacctgtttaataaaatacgtggtttccgattaccacacccgcgtgtcctcgggaagctctgctaaagcaggtagcgccgcccgtattgtcagcaccgttgattgcttcctgtgccgcctgaatacaactggacttcggaccgtttgccgcaatacttgcaacggatcctcttcctgccggcgggaactgtcctgcctgatatattacaccgtaaatgctgcccgcatatctgccggatctcacacggttcataacaaccgcaccgactgcaagctgtccttcgtagcactcgtttcctgcctcgcactgaatcagtgcggcaagcagtgtcacgtcatccaccgaagcggccactgcagaattctgaacggtacccgcgctggacacctgtgcggactttgccgcttctgccgcagccttcgcagctgctgcctgctcctcctcgatcgtgacagcctcaccgagtgcaagctccgtcgtcacatactctgcgctcacataaccggtggttcccttgtaatcgatcgcaacccatccgtctacggtctctgcatctgcatccagcggaaaagtcattcccgtcgataccgctgccagcacggacgcatccgggtctgcgctgcttctgatgcggagtccgttcgtctggatctctacctctgtatcaaatgtatcgttcgcataggtatatgcttccgatcccgtcacgcagtaggaatttttcacatatccgtctacgtttccggattccacatgtgtccaggtatcaccagcctcggtgatctctgccacatctcccttgtataatttgccgacaatcgctgcattctcgtctccggattccctgatatacaggaaatcgtcgacatctgccatcaggcggttctgccactcctgctcttccgcagacatctgatctgcatccgtgctctgtgcatcctccggctgcccgccggcgtctgtctgctctgcatccgctgtctgctcaccatctgcctggctctgcgctgcctctgtctcgctctgctcagcatctgcctgctgtgcctctgttgcttcggcctgctgcagctgtgcatctaatgtctccgcagcttctgtatccgaaaccgcttcctccgccgtagcgaccagaagtcttcctgtctgattcacaccggctgtcgccgcttcaatatcaccaaatgcctctgcttctaactgatctaaccgggcaacaactcctgctgttcccactgtagcgaagtccgtctctgcctgtaccgctgcattccttacctgtactccgtcaagatcagcagcctgtgcgattgtgctcatcatcaccagagatccggcaaccacgattccctcaatcgctcttttcttcaaactcatagaaccctccatcggtgtaatcacatgtttattgaaatagtattacacctttgtgctgttttattcatattttgttacaattgttacggatttgttacagcaggaattataacaaaggtactgttttttgtcaagttttcggggctttccgcgtcttcatgccgctgtttttctatagaaagaggcagccggaagccccattttacaagacttccggctgttttttgtgcattttgccagtttttcgtttttatgaagattttcttaagaaaatacctcttcaataacctcatcaatcagcatgtccgccgggtattttttcgctccttcggctgccgcctcacactgcgaaacaccttccgccggaaaagcgctcccgaactctgcgctctccattctgtcggtgccggtctgtttcttctgtatatatctctggattctgtttatcttatgtaatgtgacaatcagaagcatcacggtgagcagactgcacactgcaatccccatctgcaactgttccggtgaaatatgttccagccagagcatgtccattacctctctttccgatcagactttttcctgtccgatttcttctatattataaggaatctgcacggatttgaaaagaggctttccccgtgatctcgccgcaatttgcgacaatctttttacatcccatgccggcatcatccgcaccctttttccattgccgccgcaaagcccgatctccaagtcttttcttgacttttatgcataagggtattataaataagggaagcagaccattaggaaagggattcttactatgaagaaaattgttatgaccggagggggaactgcagggcatgtaacgccgaatattgctttatttccagctctgcagaaggaaggttatgaaatatcctacatcggttcctatgagggaatcgaaaaacggctgatcgaggagcagggtgtgccgtattacggtatctcgtccggaaagctcaggcgttattttgatccgaaaaatttttcggatccgttcaaagttttaaaaggctatcatcagtccgtccgtcttttgaaaaagttaaagccggatgttgttttctcaaagggaggctttgtctccgtgccggttgtgcttgcagcaagccgctgccatattcctgcgatcatccatgaatcggatctcacgccgggacttgccaaccgcattgcaattccaaaagccacaaaagtatgctgcaattttccggagacaatggcacatgttccggaggaaaaagccgtgcttaccggcacacccatccgagcggaattactgtcaggagatgccagccgcgcttttgcactctgtaattttacagattccgcaaagccaacacttctggtcgtcggcggaagcagcggctcccgtgccatcaataccgccatccgggatctgcttccggaactgattaaaaattacaatgtcattcacctgtgcggcaagggaaatgtggacgcttccctgaatgccatcgccggttatgcccagtttgagtatgccaatgaggaacttgccgatctgttcgcgctctcctcccttgtcatctcccgcgccggagccaacgcgatctgcgagcttctcgcactgcgcaaaccgaatatcctgattccgctcccggcagcagccagccgcggcgatcagatcttaaacgccaactctttccgttcccagggattcagttatgttcttgaggaggaggagctgaccaacaccactctgctggaagccatcgaccatgtcttccacaaaaaggacgcttatatcgatgccatggagcacagcaaggtcacaaactccatcgagacgatcatgggactgatccgcgaggcatcttctcacaaatagcggttcctgcataaaaaggaattgtcgcaataaacatatcgtatgttgataagtaatattatcagaagatcatatcgtgggatttcagatggaaatgcagatggaatattcgttggagaaaaatgtgagcatttcttccagctgaatgtttgcatcggattccgtgtctcttccacgtttggacaatccgacgggtgcatgtccgacacaccggagacaatgggcggactttctggccgcactaactgtactccctcatagacaatataaaaccgcgcgaaccgaaactcgttgccatctgctattaaaaacatggcagatggcaattcagacatcggcttcgcgcggttatgttttattgcgggagtacaggtaagtgcggcacaaaagtcctacaaattgtcttccgagatgcggacatgacccacggagtgctccaaacttggaaagacacggatcatcgatgatgcaaacattcggctggttagaaattccacattttttgaccgaaattccatctgcattttcacatgaaatccgcaagtatgtttctaataatattacttatcatccaaaagcggtctatgcttattgcgacaattcctttgaatgatcgtctctaatccaaagccatgctccgtttctagttccggctcagagaatctctgatctgtgccatctcctcatccgagaagttctcatggctccacatcagaatgtcgttattcttcgcgttctgatagcgtggaatcagatgcatatggaagtggaatactgtctgtcctgcaacttcgtgattattctgaagaatattaaatccatcacagccaagagcctctgtcatatgtcctgcaagcttcttggcaagcttcatggcttttcctgcaacttcctcatcgatatcatagatatccgcatagtgcttcttcggaagaatcagcgcgtgtccttttgacgccgggcttgcatcgagaatcaccttaaatgtgtcatcctcatagatcgtgttggacggaatctctcccgcaataatcttacaaaaaatacagtctgcttgtctcataatatgattactcctttcttacacctgtcgaattttgtaaactggttgttattgaacttcttttgtataaatgctacactaagttgtgtcacgtgttaaatcagaccaacaaggcagggattacattgttaagcaacgaggattaccttcatattttccacgaaataaaaaattctattacgttgataaacagctcccttcagctcgttgaaaagaaacaccctgaagtgcgggaatttgactactggagtgaatccatgtcggaactctgttttctgaaaaacatggtcattcagctgtcctctgcgcggctgtgcaatcaactgaatctgatgcaggtaagcatttattcgtttatgcatcagatcgacacttccatccgtgtactgtcctggaagaactttgtctgtaacttccagcttgaagagaaccttcccctgatcgaactggatccgcagcttttaaaacaagctgtcataaatattatcaaaaatgcatttgaagccatgcatgagagtggcactaccgatgtccacgtcttttatgaagaaccctttatgagcattgccatcactgaccacggcggcggactcgacccggctctggcggataccatcttccagccttttattacctccaaaacgggaggcagcggtctgggacttgtcattacccgtcagatcatcgaatcacaccacggtacattaacctgcgattccagaccgggtgacggatgcaccttcaccatcgcacttcctcttacgcaaaattgaacacggtatccagcatccgcagaatcttaaaattgcccttcgcagtcatctcgcctgtcataaaggctctctggaatgtcatcctcccggcaatcacgccatccattacttccggcgtcagttttgcatagatatcaatattctcttcctgaccatattgtatcgtgagatcctcatctttcacttcaataaaaagcggctttttcttatctgcaaacataaacagatatctggcatgaaaatcctgctgcggaacaaacgcattgcgcagctgatcgatataggctacatcctcttcctggctgacctttccaagcatatccttgaacatggatgccagttcctgaatatcttccttctgcttcttcacatagctgtcatccgatacatacttggacagctgctcactttcctgtggagtgagttccatctgcggtgtgcgcagcacactctgtctgaccgcgaggttactgttcgggagacttttcatcttctgagaaatcgtccggtagagattctccgccttcttctcaatgatgaccgtgtagtccttgttcatctcaaacgacaccagatcctccacatatccgcagagtcccggacacggaagcccgccgagaatctcccaggcatttgccagcgtcatctcaccctcacgctccccgtaggtcgtagacatcacgatcggctgcatataggtcgtctgaatcttctccttatcgccgtacagccagcatgcatcgagaaactgctgcatgtagccgccgattccgagccactcgatcgtggtcgcaagaataataccgtccgcctctttcatcgtctgcggcagggtcgctatttcattcttgtgctcatagatattgatccgatcgaccgtcacacgcagttcgcgcagcacttcttccatcttattcaaaacataaagtgtcggatcgtccaacagtccccgtccaccgtaataaatatttactttcattcaaagcctccgttttgtcccatctgtcgctttatggaacatactgctttcagtatataaatttttgctcacaaaatcaatatttttgacggtttctgtgatataaaatgactgtcgcggcaaatccggcaagcagacctccgatgtgtccccagttatcaattcccgccgaggaaaacccgtaatagatggtaagcacaatcatcatcataattccccgggttgtaatctgctcaaatctgccccggtgcagtatcacgatccacaggaatccgccaatcactccgaaaatagcacccgaagctcctgccgacactgcataatcgccggtgcgaagcatcatcccgtaggagagcagtcccgccccgatcagggaaaccagataaatcaaaaaatacttcagatgccctgtgacacgctccagtcttgatcccatacagtataaaatcaccatattattcaccagatgtaccgcgccgaaatgaaggaagccagcagttatgatcctccaccattcatggttgatccggataaaatccgggtacatcgcgccgtgctccgccataaaaaatccgttcgtcgtatctccgagccattcaagcacaagatatgttataacattgacagtaacgagagcgatggtcacatattccgcccggatgttcttccacaaaatgcccaaccggttctttgccgtattctgtgcagatgcatatgcggtacctgtgtcctgccacgacgtctctgcccagccacatgctccggcaccctgccgcgacgtctctgcccagccaccggctccggtaccctgccgcgacgtctctcccgcgccgcctgttccggcaccctgctctaatgccccccggagtccgaaaaagtctcccggctggttctcataaatcagcagccgtccgctttggggctgatatacccacacattcctgcactctgcgcacaactttcgttccacctcggaatctccgccgatcagaagtgtcagcatctccacatgatataccggaaatccatccgggaaatccccaagtctcccctgcgggtgatagaacagatccatggcgtgttcttccatgctccggtactgctgcacagagaaccggtttccgccggagagatctaccgccattacaatatggaacccctcctgataatacttataataaattccggcttccgccagattggtgtgacaatagcggtagccttctcctcttaatacatttgcgactgctgcattttccatacgcgttacctctgtctgcactcttataatatggttattatagttagaccgggcgcagattgcaaacgtacttccctcattttttcttaaataaatctaaacttttcatctgcaaacatcacgacctcatttttctgcagactcattcctgttttataattcagtaattctccacccactctggtgccgttcgacgaattgagatcctctataaaaaagacagctccctttttgctgatctttgcatgcctcctgctcacggtcgcactcggaatccggccatcacactccgctgcactcccgattacatagttgtctttctctatcaccagatccgagtatccgccggttccttcgtagcgcaggattccttccggtttctgcgaaattcccaccaaaagcaccgtgggatttacggatttatgttcctcttcctccggttcaaagacaaacggctcctgctccttctgtgcatttttcatattcccgccgatcttccatctgcccgttcttcttttatccccggatactgccgctttgcctgtcactctgcctgccttttcacctgccggtctgcccgcagctgtgcctgtcagtctgcccgccttttcacccgccggtctgcctgcagctccgcctgccagtctgcctgcagctccgcccaccggtctgcccgcagctgtgcctgtcgttttccatattttctcccacactgccgcaagcagttcctgcaccgtgctctctccgcgaaaaatctgcttccatatggaagcatcccgcttcccgtcctgttccttctgtccgacagtggcatatgctttcggctcttccggttctgtgtcatccagaccctccggctctgtcttcgcttcatccttttcatacggcattaaaagcagcgatttcagctcctttaactccattccccctgcactgctctgtccgtaaatatcatatgccgctttgaccgcacgctcatccgaatgatccagtcgtgtcagcagatattccatgaacgtccggaaggcttccggcagcggcattggattccccggatagtagcagaaagaaatctgtctggtccggtaatctacgaaaatactttccgccgacaacagaatactctgtgccggcagcagcattccctctaactgctgcactgcctcataaattccgttgagtacattgcacaacatatcataggaaaacgtctccgtctccaacaccgcatccagcgcctgttttcctgtaatgttataccacagatacttttctccgttctcctgcacacattccgcaaacacaatattccccttcggagcatgagcaatcatctttttttcccattcctgcaattcttcacactgcgcgagcaccatgtagcttgccgtcagttttctaatatactgtatcttcattttgaaataattcccccgcttcctgccagcggtaaaacatctttaccgcctctatttcctgctcctgccctatcgccagcgcggtgtccctgcactctgtatacatctgaataccgctcttcatggcgaatgcaaacaacgccagcacgagcggcaccacaagcgccgcctctatggtcagacttcctctccatccgttcataaattctccatttcgtcccgttttctaccgccatcccagctgaaatacatacgccgcaaaaaggaatggaagaaacggcatccggtaatcctttcttctatgcttcacaatgagtccaaacaacgccgccggaacaatcaacataagcgccgttaaaaacaactccacattccgccagaatcccagaaaaataccgcttgccatcagcattgcgccatccccgtagccaatctcctccctgctgacccaagccgcaagcaaaagcaccgcgccgattcctgcacccaacagcagatccgtcagcttctgtgtcgggagcatcaggtgaagaaccagtcctgcaattcccgccgcaagaggcacatacacgcatatcatctgttccttccagtcgcggtatgccgtgaccgcaaatattccaagcagcaacacctcacccacacaattctgcattgtctttcttctcctctcatccatctctctcccgctactgcccgcaccggctgcacggtctgcgtgttcccacctcggacagccgtatcatgcggacggttcgcttgatgccgctgcagccaagatctttgtggtagcagtcgccctggttcgtaatatagagccgtccgaatgcattttccgcataccggcactgcatgcattttctatatgcttccccgttctcattgcgaagtgccgcaatttccgcctccgccacagaccggatcgacagctccagatgcgtgcagctatactccctgtgatagacggttcctgtctgtgtgacatacacccactggtcttcatcacttccctctgcagcactccatcctgtccatttcctgcaatctgcccgctgtttcatcgcaaaatcccacaaccagaagatccggatgggcagccggatatgatacgccgcccgcagtgtgatctcctccccggagaaatcggatccaatcaggctgattccaaactttcctcctgtgatgtaagtttctgcttccgtgcggtccgccatctctctcaaaagcaaagcctctgccattccagggagcgccgccccgtcggatgacacagttgtcgcgcagactgccagcttccgtcccgtatcatccaatgccctctgcacctcaagctgaatctgcatgatgcggaagaaaaagagaacactcacaaaaaagcatgccagcaccggcatcacgactgctgcctccagtgtaaatactgcagacagacggaggcattgcggtgtcccttttcgcgcgatattttctgaaccagatatggaattttgttcggggagagatttgtcctttcttattatttttatgattcgccttgcttctacctcataaagagacaccgcaacacctccctcctcaatcatacgaaaacgttcgctgtgtctgatagcatagaccggacagatctctccctgtatgtaccatcagcccggaaaacaacggctgccactcataatccatgcggtaacttatgccacacagcacatgatccatgcggcagtctgcatacattggatgcaggcgtactgtccgttccatgatgtccatcatccggtacgccagccgctctgatgacactgtatacaggaatcccttcaggtagccctgataactcacaccgttttcgcagttttttgcctttttgccgtcttcaaacgccgccgcaagactgccaaactgcgctgtccactgcgtctcagtttttatcaaggcaatcttatcccccgccagcaatgcccggatgtccaaaatactctccacatacgcccacgccgcgattacccccgtctggacaagccgcacaaccgcaggatttcccgtaaatcccgccagcgcctccgccattccaagcgtctttgcccgcttgtccccatctccgaggatatgcgtgatattggctgcctcccggacaaacagcaggcgcttgatgacgctttccagattctctttatccgatccttttcctgccagcacatattccagttcatatgccagcgcgtgatcctctgattctcccagataatctccaaaatattgatccatatattccagtgcgagtattctgtcataccagtccgacacctgtatttccatattgccggtctgtttctgccgcctctctatcgaatcacccagatcggtctgcctcgtcgagaccgcaccaaaatcccccagcgtcattccaagcagtgcgttctgctttatcgcatgaacaacctctagcggattttcctgctccggcggaagttccggtatcaccgcttccgtcccgtccgattctgcctgttcccggcgttcactttttgcctcttcgatcgctgttctggcatcctcgatactctcttccccctgtccgctctgttccacctgctcatgctcgccatagcgttcctgtaatgcccgtatggtctccatcgccatattctgcttcatatatgctgccacacagtgcagaaacacgcttccctcctgatccgtcatcagacggtatgccaccggctctgctcctgcaagggtgacctgcaggatgcttcctcccgctccatcaacgtccagattccggtcaagccgctctcttaaaacagcggttacatgatccatggaaaatatatccccaccgtaggcgccatccagtcccagcagatgaaattcttcccagagcatcggctgatactctgcgcataccgactccagcgcaagcgtggacttcatatctgcatacgtctgtatctggtacacccttcccgcctccagaagagccataaggaaggatgccaccagcgcaaacgcaagtgcggaaaataccgtaatacttgctctctttctcattctcagacctttcccgcctttttcgtgatcgtatcgaaaatatcgttcaccagacttgtaagttgatctttaaagatcagtaccagcccgatcaacacgaccagaatcagaatcaattccacaactcccacaccgtcttcttctctgataaactctctgatccctctcatagaatccctccctttctaaatttgaaatgccagcaccgccggcaccaacagtatcaccatcacaattccgagcatcagcatcatcggaaacagcaattttgttccggcttcctcaccgtaacgttttgcggcatgcttccgctcctcaaacgcattctgcgcttcctgctccaacagtaccgtaataccgcgggttcctttttgcagattctgcgtcagtatgccggcaagcttccggtaggatgccacaccgcaccgttctccgaaatgctcatacgcccgctgttcccccacaccgctctccatctgtcggcaggcgaccagcatctcctcataggcgggcatttccgccgttttattctgtgtccgcttctgtccataagctccggcaatttttctgaacgctccctgaagcgtcattcccgcccccagaagcaaggccagcttgctcaccagatccggatactcgagttccagaagcattttgcgcttcttttgctcctcctgctttctgctcatggataccaccggtacaaagcaggcgagaatcacgcccagtataaggatcttttccggtctctgatcgcgcctttgctcccagtgtatggtatgtccctccacctcatccggcagaaaaagtctgtctgctcccgcctccggctgctgtcgcgcaatcttttctgaaatccccttccggaagcgctcttcctcgtctaacagtctgggatacacgcagatataaaactcctgtacacatctggattttccacatgtcagagtgacctgcacattcaccagctccccctcctcgtccggttctcccacaattcttccagtgcggctctctatcagccggtaattgtcaaagctccattccgcctcaacatgcccttcctgatattcctcacgaatgacaacagtatcccgtatacaattcacagattcattgtctcccgggaattccttaatgagttcttcctctgccgctcgaagatatgcctgctcctcctgctttgtcagctcctgctccggcacatgcaccttgtaagctttggcctttttcgccccatccacatacatacgcaggtctgcctcgtagtcaccttctccattttctctccgaagcagccccttctccggatcctcatctgtctgcagttccatgtatccggacagcagcccgagacatgccgctgccgcaatgactgccgcccctttctgccagtctttcctgccccatttccggctgactgcccatccgagcaccgccagtccaagcgctattccacatacaatcacattttccccctctttatccacaaacctttcgtcagatctgaatatccaatatatgctctgaccatttgatggcggcaagatagcagcaaaaagcgatgctcatgacagccactccgaatgcgctgccatacaaagcgtccagaaattctcccgatgccacctgaagatatgccagaattgcaagcggcattatttccataatccgcccctccagacgctttcctgcaagcacggttgccacttccctttcgacttcaatccgccccgcgagtttttgtaccgtcgtctgcataatgtggacaaagtctccgccgctccgctttgcaaacgcgaacacctccgcaaaactctcgatctcctcacacccgcttcgcgccgcaaacgaaagcaacagtcgctccaatggttcgttcatgcgcaccccctcattcatccagcgcacctctgccgccataaatcccttctccccatgcaattccagaagttctttctccgtctccctccatgcattttctacagaatatcctgccagcagcgccgccgatgcagactgcatggcatccttgaactccctgagcagctgttcctttctcttttccttttgcagagcgcaatactttttcacgcataccaggtacgctgccggaaacagcagcattccccacacagaccggtaaaacagccacgctgccattcctgccgctcctgctcccactgccgcacaagccagtttctccacaaaacctgcccggtattttctatagtccactgctcccctccttctccgggttcattcctgcacgctcacatttttcggtatgcatcagccggccggttctcatcagggttcccctcacatgccttgcctcctccccggactcttcatacctgaacaattcatggagcataacctcaccctgctccattcctgctatttccactatttttaataccttacggcttttatcccgcagccttcccagatggatcaggatatcgatccccgatgcaatctgactgcgtatcgcgggaagcggcagttccatgcccatcagaaccatcgtctccaatctgcttaacatatccttgcacgagttggcgtgcccggtcgagagacttccgtcatgcccggtattcattgcctgcaatacatccagcgcctccgcgcctctgcactccccaacgataatgcgctcggggcgcatgcgaagcgccgtccggatcagatcgcggatcgtgatcggcgtaacgccttctgtattggcattgcgcgtctcaagccgcaccagattcggcttgtccaaaagctgtagttccgccgaatcttcgactgtaatgatacgttcctcgcggggaatatactgggaaagtgcattcaaaaaggtagtctttccggaaccggttcccccggaaatgaaaatattgtagccgcaccgcaccagtattttcagtagatctgccgcttcctgtgagatgcttcccatccggatgagatcctccataccgatcggattttccggaaacttccggatcgtaacggccgacccgtcgatcgccaccggctccagcacaatattgacacgggaaccgtccgccagacgggtatcgacaatcggagatgcctcattcaccatacggttgctgtatcctgccatctgctggatcacatcatttaacttttctttggaggaaaacccgtactccgctttgtacagccgtcccgctttctcgtagaagatatgttctgcaccgtttaccatgatctccgtgatcgtcggatcttccagcagttcctgcagtacatccagcttgcgcagggaataaaacaaggtctgtaccacagcttcccgctcccccagcgtaagcatcctctctctggcaaagtcccttacctgtgcttcgatcagctgatatacctcctcatcctccaccgtccgcgtcaggtcgatctgctccatgatctgtctgcgcagccgttctatctcttctcccgcaatctgcattgcgcatccccctgtcccggtcttattcttcctgtccaccgatatggttccggacatagtccccaaattcactccacaaaaactgacggtacacatccattcccgcacgtatctttcctgcagaaaacgggagccttatcacctgcatccggtctgcaatgtccaccgcaggctctctttccaggtatctgcggaaatgatccatccggcagtcgtagtaaaagccgctcttcattggacaataaatactggtgcaaagccccagaaaggatagaaaatcccttaacccctgaccaaaatccaacaggaggatctcatatgacgtctgcttctccagaaaggagatcagttcctgcagatcccccgcggtcatctcccccagatcctccggattatcaaacggctctacatagtgcatccactcggtctcatgaatccctctgccaagcgtttccgccgtaaggcgctgcctgcgcaatgcgagaatcacctcgcccagatcacattctcccggaacgccaagcagctccagcatccctgaatgttccatcagattcacatataataccttcttctccgtcgacagcttctgtgcgagaaccatcgaaaacggcatctgcatttcatgacagatcggagagtaaacaccaattacctccattcccgttccgacattctccatccttctgctgccggctcccgtcagagtcatcacctgcacctcatgcagaatgacctccatggactgataacgacagattccacggcagctttccggcacggaaccgtacgttaccggttccgcaaccgcatctgccatcgtctcctgcaagaccagcaccggaatatcatatcccgccagtctctccgccatctcttcaaatccggttccgcatatcgcaagatccggcttctcttcctccaacgcttccaaaagcttctccggcatcgaaaatgcggacactgcatattcttccgccttgcgttccaccaggtatgtgacaaatctgtcccggtattcccggtctgtatcacagactgccaccgcaattttattcaatggcacacccccagactacaataaaatatccaattaaaatcatcgctgaaaaatgaatcagtgttctctgattcccgaatattcccgccattcgcttctgatacagcagcttccccagtccaattactgctgccgtcacaaatgccgccagtatgacatataacaactgtctcattgaaagaaatccaccagctacggaaaataacttgatatctcctgcgccaattacacgcagttgaaataaaagaaacaataagataaccggaatagaaatgttcaccaggaaatgaacaatgcccgcaccgccttcccccagaatgcgcagtgcaagtcccatcataagtccggaagcaatcagccggttactgatccgcatctcccggaagtccgctgcgaccgcaaatacaagtaccgtcaacagcgtcagtgtcataagttccccaactcaccaccccttcgttcatttgtaaatcggattatagcaattcatttttgctttgtctataggtttttcgcattttatttacatttgtaagattctcacaaaattttgagcagcaaaattccataaagaagcgcaaccccgctaaaaccaaggcttccggttgtcaaaagggtcaccggattgatgccgacggcaagcatgattccctgctgtgcgagccatttgttcacacatgcgatggcgcaggcacccagaaccgcgcgcaccagaaaattcaatgcaaaccttgcccgattttttaatatcataattccaaggaccagcacacagcttcccgcaatgatccagaatgatgtcagcgacatttcctgcatggcgtttcctccacacttttttctatatctatgaatgtccgcgtccgtttatgccagtttgtctgttcctgcggacggacagatttttaccgttttttgtatagaatgggatttatttgcttatactttgaataagatagaaggaacaacactgccgcagacttcggcagaacccatagatctggaggaactatgctgcgtttttttcaacctgaaaaaacgaatgataatcattatacgctgctgataaacgatctgcaccagacggcacaggatctgcaggacgcctaccgcaatctggaaaacgtcatcgatccggatctgatcgactgttacatttatgaattaaattccgtgcagatgcgctacaaatttcttcttacaagcatccgcaactatgagctgcgcacacaaaaaaatccagaggatttttataccaaaaatcctctggaactatcggaatcctgacaagtctccaccagattgtcacgtccgtaagtatacccggcatacacctgctgcgtatttttcataagcggctccgaatgatcctgctcggccgcatgcaaaaagccgtcatagagctttttcatgaggcggcaggcatcctcggcatctgccagatctctcttgtagagagactttgcgatcgaatctctgcagaacacatagatactgtagagattcttcgccatgtcataggagaaattgagcgccgatatcagttcgtcaatcgcgcgctgcgctctccgcaatgcttctttgtaggcatcccagtcggctgcatcgtatgccgccctggcatcatccagatatgtgaaaaaaatatcatacataaccacgaccagtccgctccggttcgcctgactgatccgcctggtaaaatctacaatctgttcttttttcaaaacagacctccgttctcatacctcatcgcgcctactgcagaatctgcagtacctgctgcggcagatcatttgcctgtgtcaaaacagaaattgccgcctgattgagcacattctgatgtgtatagttcgtcatctcttccgccatgtcaacgtccgtaagtctcgacattgcatccgtcatattttccccaaactcatccagactgtttgtggaatactccagacgattctcataggctcccagattagaacgcgcttcgctgactcttgcaatcgcatcatccagacggtctaaggcacggtctgcaccattgaccgtcgtcacatccagatcgtcgatatagaggctctcgcaggaaatctccggaatccggatgttcatattctgatccatgtttgcaccgatatgaagcgtcatggttcccatatctgtcacctcaaatttgagggatccgtcataggtctccaacacattgccggcagaatctgtcttggtcgcaccgtcctcatatcctgcttccaccaggaatgagagggaaaaaccgcccagatccgtgatagtcacgcggttaccgtcgcactttgcggtcgcggaagaggtaaatcccttccagttcgccacgtcatccaattccatgtccgatccgttcggaacactcgttgtcgtcttgccggaagcatctgtctgctggcttccgtaaatccactgttttgtcgccggatcctgcaccagaccgttattgccggatgcgtcggacagtgcaaactgattggcaagcgcctgattgctgaaggaaagcttcaatgtggcgtcagatccgtaagcgtctgtcgtgaatgtcaggcttccgtccgccttgctgcgctcgatctgtgtctcgccgatctctccagccgtccggagcttttcgtatacttcctgatacgtgtcggttgccgcgatctcaacggttgatccattgacgctcatcgtgccggaaacgccgattgccgccgtgctgttaaaatctgcaccggacgtcacctctgcctgtgttgctgccgttttgactttaatctcgtaatttcctggactcacctgatccgtcacctggatgcggctggcatgctttgtgtacactctggtgtccagcgagccgtcaagcagtgtcttcgtattgtactcggtatccttggaaatacggtccacctcatcctttaaagatgagatctctttctgaatggcttccttgtcttcctgacccatcgtcgcgtcactcgccgcctgcacggaaagctctctcatacgctgcagaatacttgtcacctcacctaacgcaccatccgaaatgtgaatgacggaaataccgtccgacgcattggcagatgcccggtcaagtccgtcaatctgtgctttcatcttgcgggaaatcgccattcccgccggattatcctttgcatgattgatttttaaaccggaagaaagccgctccatggactggcttaaattactctcaatcccgagcagattcttgttcgctatcgatgccgaaacattataatttattctcatcctgtcgttctcctttatccatatctgtcctatatatcgaccaacttgccgcttcactgaatacccggcagaaaagatttcccgcgcacctgcgtatttcacgcaaactttgtttgcattccacggcgtttcgtattataattagcacattgccgggcatactaatgtaatcatacatgcccataatcacataaggaggtatcattatgacacagatcacaaagtccacgatgattggcgaattacttcagatcgatcagaatatcgcaccaatccttttaaatattggaatgcactgccttggatgcccgtcttcccagatggagacagtagaagaggctgccatggtacacggtatcgatccggacgctctggtaaaagagatcaacgattttcttgcaaaggatctcgcttaatccgcaggcagacaccagacgaaaagggtatcccggttcccactggaaccggaatacccttttttctgttgcttaacgccgcaagacctttaaagctctgccagcgtctgaagcgcatgatttttcaaaatcacctgatagtgctctttcatgaacgcgcctgctgccggcgtatacgtctgctgcgttccatattcggataaaatattgcacaccttgttgaactcttccggtgtctgtctgctcttgctgaccagaagataatacttgtgcgccgcctcattcttatacagatcgttattcccctgatagaagccctgcagcgtgtgcgccagtctggttatctcagaaaaatcactgaacacaaataacttcgtaatgtctacaagtacgtttaccggagtttcttttttcttatcattctcttctgaaacgaagctatccttactgccctgtgcatctgccgcctttctgcgctcttcctgaatcctgcggaacaaccccagtatgtcatctgcaccttccggcgccggtgctgctccaccgcctgccattgcctcctcgtacacgtcttccggatccggatcggagaacctggaaaatctggtatcaagctcctccggatactccaccttggtaatcaccagaataatcgtgtcctgtgacaacggtattgcctctatcatcagcggaatatcatccgcctcaaaaccaaattcatacgccgcctgctgcatcatatcgcggaacagaagctttgccttctccgttccgtatgcaagctcactcagcttgatctgacgctctgccagatcctccctcgtcagcgtacagcgaatctgattgtcgtttactttttcaattttcatactacaccacgcctttccgtattctgaaagccaagcttccagccaaactttcatgcgaaactcccgcattacttcctttatccggaaaaccttgtaaactgtacatttattataatcaaatgctatattgatgtaaagtatacctttttattaaatctttataaactgccgaaaagctattgtcaaactacatttttcatgttataaacatatgcatgagatgcgaatctgccacactatgaaaggagcggattttgcatagaagaagttattctgttcggcaagtaccggattctttccgtactcggttccggtagtttcggtaccgtatttctcgccgagcatctcaagctgaagatttatcgggccatcaagcgaatccccaggtctctggcggatagatcttctttctccctggaatctgacttcctcgcggaagcagctcttctgaagaatcttaatcatccaggaatccccctcatatatgatatcgacgaagatgacgcctatctttatatgattgaagaatacattcagggtgaatcactcgagacgtttgtctctcatcaaaaaagcatttctgaggaactgatcgtaaaactgggcatacagctatgcgacatttttacctatctgcatcatttgtctccatacccgatcctgtatcaggacttaaagccggagcatattatattatgtggagatcaggtaaaattactcgattttggcattgcatctttttttaccggtttcggaaaaaatttccaactttacgggacaagccgctactgcgcaccggaaatcctgcgcggacagcccgtcactccggctgccgacatctacagtctcggcagggttttaacggagctttcggacgccatgtcctgccgctgttccagacagcttcggtgcatcttagagcaggcatgcgccgcagatccggcagaccgctgtcaggaggcctgcgatctgaaagccgcactgcttcgtgtaccattatcagagaatcagcagtcttcgcatctcattcggaacattgccgtcatcgggagcagacccggtgcaggcgccacgcatatttccatttctcttgtcagcaccatgaatcaaaaacatattcccgccatttatattgccgcggacgggagcgcatcgcttctacacgccgccagggcaaatcatcgtctgatcgaccagaacgggatctttatttatggaagcttccgcgggattccggactatggggacagtatatctgtttccgttccgccggatgactgcgttgtaagagactatggcacccgcgcgcccgcgcttgccgagctggcttcttttgacctgattcttttcgtcttaaacggaggagactgggattttgtacaggcagccgcctatgggaaacagctggcactgctgccgcagacacgttttctctgcaatcacggctgccgctctgccgcaaaggcatacgcacggcagttagaccaccgcgtctactgctttccggaagatgcggttccatacgatacaacacccgaaaaggaacggcttgtttcgtccatcttaccgaagaaaggagggagacggcatcttctattttgatcgcaacgaaaccaaagcacacatcaccatcggcattctcggatgtcatccgggggctggcgtgacacagctcgccataagccttagcacatactgtgcctccaggcgaagactgcgcaccgcttgtcttgaacttcacaagcgcagcgaactggcgcggctgattccggaatctgctcttgcggactccatacaccgccatgccttacaatgcagcaaagcgccggatgccgcggacacttcaaaggcagagttttttcacttccgcctgcacggcgtggattattatccgaatctggcaccggatgctgtgccccgcctgctgaatatggggtatgattatctgatcctggatctcggcagcttaaacgaatccgctgccgcagaattcctgcgctgtgaccgcaagattgtgctaggcagtcttgcactctggaaaacctggagttatgaggaatttttcaaacaatttaacaactttacaaaccttggggaaggttatcattatctggtacaggtgggaacattccagaatcattccgttttttccaggcagcactccatatccatgcaggaggttccgttcatcaaaaacccttttcatatagagaaggagcactttctattttttgacatacttctgtcattttattcattgtaaccgcaacacactgtctgccggggatcaggcagcgcaatttttctttatatcacgaaacgtaaccagcgaattccttttggtatttttcagatttgggggaatctaatgtgaatgatgaacatatgcaaagactctatctggagcttacgtctctggagaatcgaggcattaccatctggctggagggcgcgaaaagcagctcgcaggatgtagccagccagctctgcgtgcaggaggaaagcacgtacatgagagattatatttttgacgagggggtgttaaaggaagtccattttgataagatcagaaaagatcttccgtaactagtcgtaactggaacagaatgactgagttcctcaatgcccggtcatactgtctatgcagtgaatattatttgataaaaagacagccgggaactgccgcccgagttcacaatctcccgcggccggttcccgtttttcattctgcggcacgcaaaaaatggcagatgcaaatagctttgattttgtgctgcaatatgctacaatgtaggggaaatctctcagaagaagaaaggatttttccatgaagaatacaaaaaagaatattataccggtcattgccgttcttgttttaatcgtcattatcattctgttcatgctgctcggacgactgatcgaaaaatacacgccctccaaagagcaccaggagttatccgagtattacgggcttgcatctgatgattccgtagccctgatctttaataatgaagtgttgtctgtgcaggggcgactgatcgacggaaacgtatatctggattttgagacggttcacgataagatcaacagccgttttttctgggatgccaatgagaacaagcttttatacaccaccgccaccgacctgatctcggcggatgcggagagcacgacctactatgtgaccaaagacgcccggacgttagatcacacgattgtaaaggcagatgcctccaccgcatatattgcgatcgatttcgtaaaacagtattccgattttgattataccgtatacgatcagccgaaccgcgttgtcctcacaaaccagtggggcgactacaacaccgctcctgtcaagaaatccacggagctgcgctatcagggcggcatcaagagtccgattctcgccgaccttgcaaaaggaaccgtgctcacggttttagagccggaccagacctggacgaaggtgatgacggaggacggcatcatcggctatgtaaagaccaaagccctcggcagcacctccaccgcgacccggaccagcgactacactgcggaagaattttcgcatattaaaaaagatttctccattaatctcggctggcaccaggtaaccaacagcagtgcgaacgcaaacattgcgaacgtactttcaaacaccaagggactcaatgtcatctctccgacctggttttacttaaaggatacgaacggaggcatcggttccctggcaagttctgattatgtaaactattgtcaccagaacaacattgaagtctgggcgcttgtaagcaacttcggcgccaaggatcagggactggagagtccggataccacgcaggtgctgacctacagttccagacgtgagagtctgatcaacaacctgatctccgctgcgatccagtacaagctggacggcattaacgtggactttgaatcgctcgacccttccatcggtgattcctatatccagtttatccgggaattatcgctgaaatgtgccaacaacggcattgtcctttccgtcgataattatccgccaacagcttacacggcattctataaccgctccgagcaggcagtctttgccgactatgtcatactgatgggatatgatgagcattacgcaggttccgaggaagccggatcggtggcgtccatcggttttgtcaatcagggtgtcgcagatacgctccaaagcgttccggcagaccagctgattctcggtatgccgttttacacacgtgtctggagcgagactccggtatcggacgatggcgcggctgtcagtacaaccgaggacacctccgacagtgatacactctacgagctggactgctactcggcaggcatgaaagaagtccagaacctgatcagcacgaacggagccgttccggtgtggtccgacacagacggacagtattatgtagaatacatcaacggcggcgtcacctacaagatctgggtggaggatgccacttcacttgaggagaagttaaaggtaatgcagtccaaccagctcgccggcggagctttctggaagcttggtctggaggatccggcggtctgggataccattatcaaatacatcaactagccgttctaacccccggggatcgtgaatatcattttatgaacgaatccccgggggttttttatttcatgaaaaaaaagttggaacttatcatgagcctctgtcttctggccgctgccttcattctcgcaaagcagggcgccgtactagtccagagtgaaaaggcggcacgtgaaaaaatctgtattgtcgtcgatgccggtcacggcggaagtgaccccggaaaggtgggcatcaacggcgcactcgaaaaggacatcaacctctccatcgctttaaaattaaaagatcttctggaacagagagaaatctctgtcgttctcacccgtgattccgacgccggtctctcacccgcagacgccaccaacaaaaaagccgcggatatgcagaagcgctgccagataatcgcggacgccaatcccgctttcaccgtgagcattcaccagaacagctacacaaccgaagacatcaaaggcgcccaggtattctattacgggcagtccgaaaacggcaagcgcttagcggacgttctccaggaacatctgatctctgaagtcgatccccagaatacacgcgtcgccaaggcaaacgaaagctactatctcctaaaaaaaacacccacacctacggtaatcgtagaatgtgggtttttaagcaaccagagcgaagccgatctgctcctgaccgaagattatcagagcaagcttgctcatgccatctatctggggattctctcctatctcgaagaagaatccctgctataactgttttatgcatccgctccctgcgcatctgttccctgcaaaagatcctgcacctgccgcacaaagctttccgcaatatggtatagccttgttgtctgcacctgatacgtcgtatccgactgtttctctgtggtctcctgctgttctggtgcatccacgccaaagacgcctgttgaaaaacggttcagatccagatctgcgatgcatgcatagtgaagatctgcctcgtttccactgtccaatactgccgtaaggctctcctgccggctgtctaaaagttctttggtatcctcccggtccgatgcaatcagaccgctgacgccatgctcttttgcctggaacgttgccgcaatcttaccgtgaagcttggtttccatcgtgatgtcaaccagccctttttcaccatccccgcgcacaaccttcagcgaaatgccgacaacaccgctctcggtctgcaccggtattgcatactgctcttcttttgccatcatactgccgatggataactgtgccgacaacagacgcatctccctgatatcaaggcttgtcacgtcatcgctgtcgatcattcccttcattacattctcggcaacctcagcaagctgttcctgtgcggcggcaagtccctccgggcttgcgattgcctctccaaaatcctcaagcacctgctccttcgcccgggcaagctgctcctcattttcctctttgtggcttccctttgcgctctcgccgaagatctggcggaatacgccgttccggtcatttaccatggcctccatcgccatgacgttcgtcatggtattcggaatgtcgtacttctgcagtaccgtgtaaatatcctgcgttattttcgcgctctgcgataactgatccagctgctccttcgcatatgcataatcctggctggcatcgtctgtctgtgcctgcgcgagcgcctcctttaactgctccggagtcatctcctcccagtccggcgtctgtgatgcgacaaccttcatgcgctccggtgtgagcagatctgcgacatctttcacgcagttgttctgatatgccgcttccatctgatcggtgatggaagtgccggaatatccactgccttccacttttccaaaggattcatccacactgtaatccatttttccactgcgcctctcggatcggaccgccatcatcagattgcgcatggtgatatcggctccctgatttacaagcgctcccaccgcggcgccgtccgactgctctacctgatggatcaggcgatacgttccgatataagaagcccgctcttcctggctgattccctccgtgcgttccagcttccacaaaaattctccaaagccgcgctcatcgttcgcactggtctcctttttaatctgctccgcggtcgcattcagcgtactaaaatccatatccagcggatcgattcctctgcggatcatctccgtcaccgttgccggcgtcaggttgcggaatacacgctgcacctgctcatccgccgctttcatctccgccacggattcctgtgtaatttcaatctgattataaccgaggatgcgcactgcacgctgatttgcctccgtcgcctccagtccgatatcgttcaaaatatcatccacattgcggaatgccttctgaatcgaatctcccaggtctgcacgtggtgccgtcatcagggtctcataactctgatttgcacgctcaaaggtatcccgcatcgcacgtccggtatcatgaacctctgcgacagacgcatcctttactccctgcgctcccagcacgtatgccggaaccgtttttaaatcgttgacacgctctgtggtctcacggaaaagattcacgttcgtctccgaagcttctaccccctgtcccttcaacagctgttcgtaatattggttctccgtctccttcaaagcctccacaagctctgccagcggctgggtatcaatctggattccctttttgagcaacgcatagtttgcctgtgctgtcatcgcaagacgtgtctcctccagctgtcttctggcggtcagcagatccagttctctctgtgtataagcagtgctgccatccgcactgctctctgccgtctcctcctgcgcgtctcccgaagcgctatccgccgtctcctcacccgagcgatgtgccatcgcttcttttaagctgcggatatttaactccatgccgtgatccacgacatatgcgacatcctcatccgtcgcttcgccgatcacatcgcaggcatcctgcgccttgtccgcaaatgattgtccatccacaagcagtgcgtcctgcgggctttttccttctgcgaccgcagccgccatactgcccagcagcgcctctgcctgcaccggcagactaagatttttcagttccatatagtaagcaagattctcctcattgagtggcacgctattgtccagcagccactggcacgcctcttttgatgtatcatccaccgaaagcccggcgcgcgcaataaccgcgtcaatctgatctgaaaacatcgtcatatcgactgctgcctccggatttgcctgataagcagcacttccgctgtactctgccttgtacaggttgccgatcgtgggctccatcccgttatccagcatatacttcactgcgccgtcccccggcgtctgaagtgtctgcgccagtgagagcgcctccatcacgccccgcacattttccccggtgcacgggagatcggcttccttcattgcctgcgccagctgtcttgcaagcgcttcgcttccggtaatcgccgccatctgctcgtaatccagatcatctccaaagaaagagatatccactcccgcttttgcaagctgtgccttaatcttatccgtctcggtcacaatcgtattggtcgtcgtatcgtccagtgaaaatccgtcttcctgcattttcgcataatcttccggggaggtagtgttggacaacaccgccatctggttcttgcgctcttcggcatcaagcgtcgcggacgcttcgatctcctcggcaaccgtctgcttgtcttccgctgccggcttggcataggtggcatcttttaaattcacggatttcgcattgtcactgacactgcttttttccacggcagctcccgcggctcctgtggtatattggctcagaacggacccgctcttttcctccggtccgatactctgctttacaacatctataatattctggctctgctgctctactctcatcctgtgcactccttaccttttcagctgtggttctatagagtaatcgaatataaagcataaaaatggcgcataacactatgcgccattcatagctgatatatatatcggtcatatcagcaccattattaagctgttcttcgcatttcaccagcccccgaaatgcaatcagtaacgaaataccgccacgccgtacggctccagaggatacgcgatcgagtatggtctgccgtcacattcggcctccaccgccttgtaactctgcggacgctgtctgccgcatcctccaaactcttcggagtcactgtccaatatcagcttgtaggtcttcttggcaggcactcccactctgtaatccggtcttgccaccggtgtaaagctgcacacaaagagcagctgattttttccgtccttgctcttgcggatgaaactgtagatgcttctgtccgcatcgttcgcattgatccactcgaaaccgccccagctactgtcgagctcgtaaagcgccggattcttccggtaaatatgaagcagttttttcacccagttctggatatgcttgtgatccggattgtcgagaaggaaccagtccagttcacgctcctcactccactcgcgaagctgtgcaaattcctgtcccataaataaaagcttcttccccggatgtcccatcataaacgcgtagcctgccatgagattgcggaacttatcaatgccaagtcccggcattttgttaatcatggagcatttcagatgtacaacctcatcgtgggagagcaccagaatgtatttttcgctctcattgtagctcatcgcaaatgtcatcttgtgatgattatccctgcggaagtaaggatccagcttcatgtaatccaggaaatcatgcatccagcccatgttccacttatagctgaaattcagtccgtcatcctccaccggtccggtcaccttcggccatgcggtagattcctccgcaatcatgacagctcccggatttcttccgagaaccagggtattaatatgtttaaagaactcgattgcctccaggttcttattgtcgccgtactggttcggaacccactgaccggcctcctttccgtaatcgagatacagcatggacgccaccgcgtctacacgcagaccgtccacatggtaatgctccacccacagcagggcgctgccgatcaggaaattcttgacctcgttcttaccgtaatcaaaaatcttagtgccccagtccggatgctccccttttctcgggtctgcatactcatagagacagcttccgtcaaactctgccagaccgtgcgcatcctttggaaaatgtgccggaacccagtctaagatgacgccgatcttgtgtctgtggcattcatttacaaaataagcgaagtcttccggtgttccatagcgcgaggtaggcgcataataaccggttacctgatagccccaggaaccatcgtacggatattcgcagattcccataagctcgatatgggaataccccatctcagtcacatacggaatcaaagattttgccagatcccgataactgtaaaatccgtcatcctgtctgcccggatgacgcatccaggatcccgggtgcacctcatagatggcaagcggctgttcatatacatcttccttgtgtgtggcgcgctctttcatccactcggcatctgaccacttaaaatgttcaatatccgtaactgccgacgccgttccgggtcttaactccgcgtagttcgcataaggatccgccttgtacaggcgctttccgtccttcgtctcgatgaggtacttgtacagatcaccctcctcgacacccggaataaacaattcaaaaatccccatcgtctccggctccaggcgcttcatttcattggcgccctcatcccatccgttaaaggaacctatgacccatacacgcgcggcgtttggcgcccacagatcaaagcagactccccggatgccgtattcatctgtgggatgcgcccccagcttccggtaaatctcatagtgtgtcgcctgcccgaataagtaccgatccagctctgaaaaatttgccatacccatctacccctttatcttgattttaaaatccaaaatctttttcatgaaggatgacatagtcatcatcgtcatatcttctggaagtgataatactgaacgccttcttaagtcctccccgttctgcgtgggcgattgcctcgtccacaatatccttaacctctgtaagggttgtcgcccgatccagcttctgaatattgctgatgctgttgtaaagtgccagaactcccatctcatcgatggtgtatcccagttcgttggcataggatctcgcaaacgccaccagttcgtcgctcgtaaagatcgggatattgattttctccgaaaaccgtgctgcaaatcccgcatcccggctgagtgccttctcgattcctcttctggtgtcctccataatcacaaacagtccgctgttgtcactgtcaagcagcgtgccaagcttgactgccgtctctcttgagatggctcccgccttttcgataatcagacatccgcccgccacttttttaaggagcgccgccacatctttctgattcagcacggaagcttcgatcttgccgatttttccgttcggcttgcccacttccttctggagcgccttaatcatgctggtcgcgagcaccgtcttgccgcttccctgtccgccctgaataatcatattcccggtggaagccgttttaccggacgaaagtcttgccgctgctcccgtaagcgcctggcacagctgctgttccattcccttaatcggcacaaaatatgtaaaaatctcccgctgctctttggaaagccgggtaattgcctgatgtccttcctcctccggctcctcgatcttcggaagcacgtcgtctgccgctttcgcttttgaagctccgctcttcgggtgtcccccgcctgccagctttccgccggacttctccgccttcggaagttcctcgtcctccggctgtatcttctgctcttccatcaatgcctggatgtcggctcccagtgctgccgtatccggctcttccatcccggcagcatcgtctgtatcctccggttcttccgccgcctgtggctgcgccgtgtcttttgccaccgcttcctctgccagaagcgcttggacatcggcccccagggtaaacgtatccgggtctgtctcttcggtatagctgcccggaatctccggttccgcgattccgccatagcttcctgccgcatctgcctgttccgtctcacttaccaccgcatctgtctgcggttcatataccgcccctgtctgcggctcatataccgcctctgcctccggtgcgtataccggctctgtctctgctccgtataccgcatctgtctgcggttcatatgcagcctccgccgcaagctgctccgcatctggttctatctcatacgggctctgtgtcagctctgtgatgccgttcccccagaaatctgcctcctccggctgcaacgcttcctgcggctccgccacacctgctgcctccgccgcacttgccgccgcaagctgttcatccattctcgcattctcggaggataagcggtcgatctcctgctgtaagatctggttcatgttcgccaccatctcagccgccttatcgtcagcaatcggctggccgcccagatactcttcatccagcagatccttcggtgtcagtccggagtcaagcttcggaatcacatccaccagacgctccataatatcgcctgcctcctgcagtgcacgcgccttcgcggattccagcttgcgctgcttcgcctcctcaagcgccgtctctgccgcacgcttggtcttctcccagtctgcaagcacctcatcaatactcatctgtcccgtcacctgcggctctgtagcccccttatccggaacatacatgctgatctgtccgtcataatcctctgcaagaagctctttaaaattgctcttgagcgagttgtcaatctctgcatccgtctcgatatggggcatctcgatcgtatcctgcggcaacggttcctccttggggatctgaagatacggaatctcctccacgagcttcttgatcgtatccatgctgtcctcgaccttttccttgtcggtcgcttccatgatctgcaccatattcttgcgaagttcatcctgcagattctgtgtattaaaacgctccggtgaaagctttaccttcggtatctgcaccggttcgctcacaatctcgccggactcaaggtcgtcctccggccgcacttccacaacgccctcttttttgaggcggaactgccggtacttttcctcctgctgtctggtcagcggctgatagagcatcttaagctccagcgcccgctccacataaggtccgtctccgaaccagagaatcagctcatcgcaggcgtcgatgcatttttcgctcatccccgccttatggtaaaggcatgccagctcaaacgcccactcctcggaatattcctgctcttttaattcttccagtattccgatcagcgtctgcagatcggcgccctccgccttactgatctcgtagcgcagaacgtatttgagattgtcgtgcggggcgatctccacgaattcctgatagtagtctctcgcttcctcgcagttccccatcttgatggcaacctccgcaagccggtagataatcattcgtccgatcggggatctgtcatacgccatgagcagaatatccctgctctcctcatatcttcccacattctcgtagatttctcccgccttaatcagtgcgttgacgttttttattttatgccagttgatcgtgtccgcaatctccgcagcggctttgtaattattctctgcggtaaaggacttcatctgatccagctttaatttatattcgtatttatccaatttgtgccacctcaaactgtgcgattttcactctttttattaccttttagtttatcatacgcactaatagatgtcaaaaatattcgtccgaaaaggctgtcacgcagtggtgtgctgcctgtctttttttattggaattatcttactttttccagacatgaaaatacccccatataggacttttatatttcattgtcctatatgagggcagcatattatttttcaggtgattcttcgattttttccccggtgcctttctccgttttttcctcatagacaagctcgtttgtcctcttgtcaatgcgcatcagatgaatgtagcttcccgtatcgtccaccagaccccgctttcgcagaaaataagataccagcttctgtgccacatagtagattactgccatgagcggcacaccgagcagcatgcccgggaatccccacagcccgccaaataccagaatggcaaataccacccagaaggaactaagcccagtagaatcgccgaggatcttcggtccgataatattgccgtcgatctgctggagaataaagatgaaaatgagaaagtacactccctgcagcggattctgcaatacaacgataaggaatgacggaattgctccgataaacggtccgaaaaacggaataatgttggtcacgccgatgatcactgcaagcaggatcgtatccggcattctcataatagtgagcaccacataggcaagaataccgataatcgctgaatccagaagttttccggaaataaatccgccaaagatttcgttgctcttgcgcaccgtctcaacgatcacgttcgcacgtaccggcttgaacatggcgtaaatgattttcttcgcctgtcctgcaaacgtctcctggctcgccagcacataaatggacacaatgatgccgaccaccagattcagcagaaactttaacgtatagatcacaccgcttgcgatcgacgtcagataaacctgaacctgcgccagcagatcattttcaagaaacttctgtacggcatcgcttgctttttgcagcacatcgtttataacacctacaatctccgaatctcccttgaagaattcatccgaccagtccatgatattcttgacctcgctcggaagccccgtggcgatcccctgtatactctgtatgatagaaggaacaatcgccgcgataagcagtacaacgattccccctaagaacacccacgcccccgcgatcgcaacgccgcgcgacattttttttgcttttgttttgctcttcatccgcggttccaacagcttcatcagatgacgttccagaaacttcattaccggattgagcagatatgcaagcaccagccccataataataggctgaagaattgtggtcagctttttccagaaatccgcaaacccgttgtaacgatatatcataaagaaaaacagtatacagcagcaaaacgtaataaacactaccaacgcgattactacatattgctttaaattccatccgccatttctgtcgccggaagtattgtctgtctgtcgtctctcactgtccatagtaaacctccttgctgttcctctgttgtctgccgcttctgctctcgcagtgcacgtccggtcagcttttcacgcctacggcaaaaggtccgaaaaacctacggttttccggacccgctgacgcgttcacatgcatcggatccggctgccgctgcaagcatctgcatccgtttcgatgcatgctcacttttgcctatgcgtacattataccccatgcagggaggttttccaatcgctattctttatttgccgctaatttaatgttaatttttcaatgactgccttcagctggtctgccgacgcaagaagtgcatttttctccttctcattgagcggaatctcaagcaccttctcgattccgttcttgccgaccaccgacgggatgctgagtgccagaccggacagaccgtactctccctgcagttccaccgacaccggaagcacggcatgctcatccttcacaatgctctctgcaattctcgcaaccgccatggcaatgccgtagtaggtcgcacccttgcgctctatgatctcataggcgctgtcgcgcacctcctcatacaggcgctccatggatgcctcgtggttgaaatgtccccgcagttcgcagaaatgattcagatcgattccggacacattcgccccgctccataccggaagttcgctgtcgccatgctcaccgatgataacggcatgaacgctgcggctgtccacatccagatgtctgccaacctgatatttgagtctcgccgtatccagaaccgtaccggagccaaagactctctccaccggataaccggatatctgctgtgccgcataggtcagcacatccactgggttggcaactatcatcaaaattccctcgaacgccgtcgccgtgatctgcggaacgatcgattttaatataccgacattcttctcgatcaggtccagacgcgtctctcccggtttctgatttgctcccgcggtaataatgatcagaccgcagtctgccacatccttatagtccccggcatagatgtccatcgacgccgtgtagggaaggccgtggcttaaatccatcgcctccccctccgcttttgcgtgattggcatctatgagcaccatctctgaaaacagtcctttctgcatgagggcaaacgcgatggacgcccctacaaaaccacatccgattactgcaacttttcttggattcatcatcattcatttctcctttctatttcacacacgcggtcgttttcctctatgttctattgttacacaaccccgtgttttctatttcttccaaatcctaccatggtaccaggaattagtctgttgtatttacaacaaaataaactttttggttagtcaaaacaaactccgctgtaaaaacacaggcagtgcatttcttaacactgcctgttctctctgatcctattgccacgaaacgggcttatccgcgataataattgatcagacaaccttttaagataatctctctctcgtcgtccgtcatcgcacccagtcccagcttaaattcctttaactcagaacccttcaccacgtatgcggtaatctcgctctgcttttcttccactgccttgcggatgtccggcaaaaacagataatccagattctggaacggaagcgctccctccggaatgacaaacggaagcataccccagttgataaggttcgagcggtaacgctttgtcgcgtactcattggcgatgtttgcccagccgccaagcaccttctgacaggacgctgcctgctcacgcgcagaaccgtcgcccggcttcaccgcgaaaatcgtacttccgaagccaagtgttcccggcttcatctcttcgccaaacgttttctccggaaaagctgcacggatcgcatccattaccgggcgcagttcttcgactgcctcaaccggacatgtgccctcctcgactgctttctgtgccttctggatctcctttgcacgtcccacgtactgcgggtcttttctggaaagtgcaaactctgccagtccgagcgggttcgagcggaaagaagaggtctcgccggaaggaatcagctcatctgtcgtcgttaccggatcatgaatctccgatactacttttaataccatattctccggaagcgcactcatcgccggccagtccttgatgttcggtccgaactggatctccacggacggatctgccacgcccttgctgtcgaagacacggtttgcatagatcgcactgtcaaaatgatacttcggcttggaaaaatctacatccacgtccgtagctgccgtcaaatatcccttgtttgccgccgtcgcagcgatagaacgcgcgtccataagcgccacggaagcgacctgtcccttctgcaccttggaaccctcgcggttcgggaagtttctcgtggagtggcggatggaaaatgcattgttcgccggcgtgtctcctgcgccaaaacacggtccgcagaatgccgtcttcacaatcgcgcccgtctccatgagcgtggcaacggctccgttcttcaccagttccatataaatcggcgtacttgccggataaacgctgagcgtaaactcatccggtccgatcgacgcaccctttaagatgtccgccgcatcacagatattctcaaaaccgccgcccgcgcagcctgcaataataccctgatccacatacagtctgccgtttctgaccttgctctttaagtcgagcttgaccgcaccgtcaaagcttacctctgcccgcttctcgcagtcatccagaatatccatcaggtttgcgttcagctcctcgatcgtgtaggtgttgctcggatggaacggcatcgcaatcatcggtttgatctcatccagattgatttcgatcattccgtcatagtaagcaactgctgccggattcagttccttgtaatctcctgctctgccgtgaatctcatagaactccttcaccgcatcgtccgttctccagatagaggaaaggcaggtcgtctcggttgtcatgacgtccacaccgatacgatagtccacactcatgttggaaacacccggtccgacgaactccatgaccttatttttcacataaccgcggtcaaatacttcgccgatgatcgccagtgcaatatcctgcggtccgacgcccttgcgcggtgtacccgtcagataaacgccgactacgcccggcatatcaatatcgtatgtcttggagagaagctgctttaccagctccggaccgccctcgccgactgccatggtaccgagcgctccgtatctcgtgtgggaatccgatccgaggatcatcttgccgcctgccgccagcatctctctggcaaactggtgaatgactgcctgatgaggcggcacatagattccgccatagcgctttgcacaggtcagcccaaacatgtggtcatcctcgttgatggtgccgcccactgcgcagagactgttgtggcagttcgtcagtacatacggaatcgggaacttctccagtcccgatgcacgtgctgtctgtatgattcctacgaacgtaatgtcgtgggaagtcagcttatcaaacttgatctgcagcttgtccatattgccggatacattgtgatcctttaaaatgccgtatgcgatcgttccctgcgccgcctcggcttttgccacctctctgcccgtcctgctctttattgcggcagctgcctgcgcgtcatccgcaaccagttccgttccgtttaccagatatactccgctgtcatataacttcatgatttcctccttgcccttatcatagcctttcaaaaattatatcggtcttgcaggtaaaaatcaagcactttcgcgctttatcatgacaaatcgccgtcttcaaacatcagtatgatatcaaagagtgtacccgcttttgccgcgatgcgttttgccgtgtccgcatccggttccgccagatccggcaccatgaccgtccggattcccgcatccgttgcggagcgcacgccgttgggggaatcttcgaccgcaatacagtccgcaggcgcttccccgatctgctcacaggcatagagataaatatccggcttgggcttgccgttctccaccatcgttgcgcacactatacggtcaaacttgtcgtagatgccgattctggtgagataatcctttgtgcgcgccggatctgtggcagttgccaccgccgtcttaatccgatgcgcccgcagatagtccagaagttcatccacacccggctttttatcgatcccgttcgccgcgatgtgcgccttcatcagttccttgcgccgctcgcggatcgtccagtacgggaaatccgctccaaaccgctcctgcagaaacggcgccgcatactttgccgcgagactccggatcgcaagaccatcctccaccgtcatatcataccccgcctccgctgccgcctggcgccagtatttgttcagccatttttccgtgtcaatgagtaccccgtccatatcaaagatcactgcttttaccatatcactgccccctttcttcctgtccctccacatagagcggaagagcgatggtcgccttaaacaggtctccatccacagaaatatcaaacattcctcccataagaagcgtgagattcttcgcgatggaaagtcccagaccgcttccctccgtcgttctggaggaatccccccggataaaccgttccgtcagatcttccacttcgctgttctctcttgccagtgaccgcgccgaaacattcttaatagaaaagacggcacgttcttcttccgcctgcacttccacatagacacgcgtcttttgaagtgcatacttggcgacattattatagagattctcgatcacgcggtagaggtgccgtccgtctgaccagatgtagaccgcctggcgcggaagctttgtcactatcgtaagttctttgtcctcgaacttttcattgaattcgccgccagtctggcacaccagttccacaatgtcgatcttgtgcatctcaagcttcacattcccggaactgaccttggatgcctccaccagatcttctgtgagctgctttaagcgctgggacttttcgtccagaatcttcacataatttttcacgcgctcgttgtccacatcctcgcgctgtataaggttgacataattgataatcgatgtcagcggtgtcttgatgtcatgggagacgttggtaatcagatccgctttcatgcgctcgtttttcgtgctgtcgtccacggcatgcaacagtccggcgccgatattgttgatcgtctccgccagcttccggtcctcaccgtgaagttcttcgacgtcaatcttggcagagagatcaccgtccgcaatctcctcaactccctgcaggatctgatagtgctccaccgatttccggagcagaatgtatgcctccatggcgctgaataagagcagggcaatgagtgccggcacatttctgtagtaaaacgctcccgccgccaggaaaaagcagacgatcatatgaatcgcaaagatcatcaaaatcttaactgtgacagacctttcccggaacgtcttctcaatcccgcgtccaagccagcacacaaggctgttctcccacatcacttccgctttcaggcgacgcaccatactcagatagaagataagaaacagcgtatcaatgagaaaactgatggtccctgatgcgacaaggagacctgcaacctcccattcccggctgcttgctctcgcaagcagcataaccagctccgccgataaaaacacaaagccagcaatcataagttcggtcttgatgcggtcaatggagcttaaggcgatgccttcctccccctccttgtgtcccgctgccagtgtcaggtacacaagcgtcagaatccagcccagcagactgataattgcccctgcaatgctcactttgatccacggatgaagcctttcatattctatcttggcatcccgcagatcatcccctgccgaaagctgtgtgtccacgccgatgacaagcaccacgtcttccaggggccagtagatctgattgccgttattgctgaaaaaataattctccagtccccggatatccgtgccgaattccttgtcttccatatcgtaaagcagataatctcccatggtctttgcctccatgagaaccgtctgcgtatcgaactgctgcccctctctggtatctggctgattagtataccacacgccattgatcttataccagtagcagaaatttgtactctcctgcttaaattcattggtatactgcagatagcgtttctcatcctccgctgtccgaagcgcgcctttctgtgtcaggagcagataatcgttcagatcattgcacttctgctccatgcatttcagataatacccggaactaaggaaatcatcggttccaatatcggtaagctccagaatattcttgctgacaagcgatgccagaaggaacacggacactgtaagaacgattgtaaaaaaggaatgaaggagcactcccgttattttcattccgtaactgtaggatcttttctccataaagacgctcctctagttcttgtcaatcttatagcccacgccccagactaccttgaggtagcgcggctctttcgggttgatctcgatcttctcgcggatatggcggatatgaaccgccaccgtattgtccgcaccgatcgcatcctcgttccagatgctctcatagatctggttgatagaaaataccttcccctgattcttcacaaggagaagcagaatgttgtattcaatcggcgtcagcttaaccgtctccccgtccaccgtgacctcttttaaatcatcgttgatcgacagaccgccgacggtatatacggacgcgtcgttctctgccgcattgccaagctgcgtataacggcgaagctgcgactttacacgtgccaccagttccagaggattgaacggcttttccacataatcgtccgcgccgatattaagtcctaaaatcttgtccgcatcttccgttttcgcagatagaataatgatcgggatactgctctcctcccggatctttaacgttgcccggatgccgtccaaccgcggcatcatgacgtcgatgatcagaagatggacttctttttcttttaagatctcaagcgcttcctctccatcgtacgcctttaatacctgatagccttcctgctgtaagtatatgtcgatcgcttccacgatctctttgtcatcatcacataccagaattgtctgcattctcttctctccattctaacgtggcagatatcgcactgcatatcagcctttctattgcctgttttcttcattttaacagacacgcgcaaattgttatagaggagatttcttaattatttttaaaaatctgcgcgcaaaattaagagaatctttattgcgggcgacatattcccgctttaagataagcaggtaacccaaccatgcttttattctggaggatctttgatatgaaaaagaaaaaaacgaagaaacgccgcagagtcattttgctgattgcagaaattattctgattcttctactgactcttttgttgtttgcagttgtaaaactttcaaaaatacagaaaacaaagcttgacatggatcaggtcgccatcaatgaagatctgtcctccgaaacaatggatgccatgtcagactatcgcacagttgctctcttcggtctggacaaccgtacaaacaattccctgtccaaagggcggagcgatgtcattatgctcgccaatatcaacaacaaaacgcacgaggtccaactggtctccatctaccgggatacctatctggacaccggcagcggagtctttgaaaaatgcaacgccgcctacgcaaaaggaggacccgagcaggcgctctcaatgctcaataccaatctcgatcttgcaatcacagattatgtgacggtggatttcagtgcaattgtcgaatgtgtggatctgctgggcggcgtggaaatgacgatcaccgatgacgaagccagcctgatgctcggctatattcaggaattaaaccgccttaccggaaataccgcttcctgcccgtcttccggcggaacttacaccttaaacggcgtgcaggcaacggcatttgcacgaatccgttacggcggcggtgatgattacaagcgcacggaacgtcagcgtgcggtactttcagctatgattgccaaagcacaaaaatccgatctgaagacgctcaacgcactaatcaacactctcttcagcgatattcagaccagcttctccaatgcggatctgcttgcactcgccaccaatatttttaattacaagctcagcgagaccaacgggttcccatatgaaaaaaccgcccaccgctatgacaaagtgggagatgtcgtgattccctgcgacctatcgtccaatgtcacggcacttcatcagttcctctatacagatatggcttacacgccttccgatacagtgaaaaacaacagtgaaatgatcaccagcaaaaccggttaccgcgagggcgacggcttctgatcccgcttcaaatgggctttctgccatatcagtgacaactgcgcctttaatgataaaaatacacctgctatgatattctttatcttcagcgggtgtattttttcatgtcatgcatattctaagtagtaccattttcaacttgcagttgaactcttcataaccgcaagtatgggaaaagtgcactagactaagcaggaaagcgaggcgttgattatggacaagaatatggcagaccgtttaattgaattacgtgaaaagaatcatctgtcccagagtgcagtcgcaaatcgtctcggtgtaacgcctgccttaatcagcgcttatgagaaaacggagcgtaaccccagtctggagcgcctgatcgcactggctgatatctatcacacatccacggactatattcttggacgaaccacgaccgattcctacgctacgatcatcgaggtaaaagacctcaccgatgcgcagatccgtattctgcgtgaacttgtcgaagtcatgaagcacacggacgctacccggtcgtagtgtcactctttcttttgtctcttttgtctgtccctcctcttctcctgtgtcttttattcttatcccttttatctgtgtgatctgtattctgttccctcttcatctggtctttttcacttagttcccgcgccatctgcaaaagaacctctgtgcggtcaccgagccgggcatacgcctgatcctcccggattcttcggattgcaaaatgcctcttggaaaagatgacgatcatgtcaatgatcagataagacagcgcaatattaggcgtaatccctgtaaaatagtaaaataagatgcaaaaaattgccggtccgatcaataccagcgaatacaggttgttgcgctgtatgttcgtcataagataaaaccagctctcttcgggatccgcatccacccagtgtgcgcgttcgtatgcaaatctttcccgccttttcagaattctatctttaatactcatgtcctgtcctttattctatcgaattgatactgttttagacattttaacatagagttgaaatatttgcaatctataggtgtagtttttatttcttaatttttccgttctccgccaaaataccgcacatcgtatgtgttacagattctgcgtatctcgatgacgcccaccaccgctgcaagcacgccgctcgccacattgctcaccgccatgacaatgccggcgctgacgtttccgagatccgtgaactgctgcaacgcccaaagtaccggcactcggaacagaaagacacggcagaagttcatgaccagcgtcacacgcgtctttccaaatccatagagcagcgccattaccgccgcgttgacgccgagcgggattgctccgaccgcctcaaaccggtaaatctgtttgatcatctcggcaaactctgcattgtccccggcaaagagacctgccagctggtttaagcataacagcgacgccgtcatgatgaccagtccgatgagcatgtcaatgtaaagcacccagcggaacgccaaaagcgcgcgcttcggtctgccagcccccagattctgactgataatggaggagcctccctcctgaaatccgttctgcgggtttgtcgtgattccgccgatattgttggagattccaagcgctcccaccgtccaggaaccgtagacggtactcatcgaattgacaatcacctttccaaccgcaaacgcaatccgctccacgatgaccggaaacgacagcgtgagcatcgggcagatgacctccttttttatggagatggcacgcaatgagaagccaaacgcatttcccttctggttcatattgatgcacgcagcgagaagaagaaagctctgtgagatgatcgtcgcacaggagatcatattgatgcctccgtccagcccgtagacaaaccatgccgtcagccccagtttcactacgatgaccgccgtattgagaatcagaatccgtttggaatttcctctggcacgctcaatggcgatgtagacgttattgaaaaacgtgatgaccattccgaacaactccagcctgaaatacgtgctcccgtccgcaataaattcttccggtgtattcatcaggcgcaggaactccggcgtgaacggcaccaggacaagcagtattgcgataccgagcgccccgcacatggcaaacattgtgctgacacgcttttttaccagcatgaaatcgccggccccatatgcctggctcaccttgatgctggcgcccaccgcaagcccggttcccaccgccgagatcatcatgttgatctgggacagatacgcgaccgcggacaccgcggatgcgccgatatgtgacgccatcatggtatcgagtatcttaaaaagctggttcaggctctcatagagcgccagtggaaatcccacatacaataccacccgccacatgggtccgttcagggaaaacttgcgaaattgttcgtccttttttgaaagatctgcctgcatgttcttctccattctttttgtatctgcgtttctttacttttctgttctcccatggtataacaaaaatatatttatttatacgaattttttccgttattttgctttatactactgattttttgtcattgcaggcaaaaatccagaatcaccattccgcagaaaccttcacggaaccaggaacaggagttatacccatgaacgatttcgcttcctccagctgtcacgaccgcattgccgattttaaaattacgcaggtacagcgcgattcgcattttgatatgggagaatcccattatcacccgtactacgaattttattacctgctgtccggtcagtgccgctgttttatcagccacagcatttaccggctctttccaggggatctgattatgattcctccctctgtgctgcaccgcgttctctatgaaaccaagcgtcctgccgagcgcatcaacatctttttttcggaagattacttacactgggtgtctgccgccagcggcccggatctttgcgtcgggcttttttcccgcagcagactcaccattccgtcttccagccgtccgcagttagaacgcctgatgacgcgcctgcgccttgaatccgaaagcagcgatccttatgcaccgctcatgaccaaaagtcttttttcagagcttctggttgagatcgcgcgctgccaggatgtccaccagactccgcaatttctggacgagaccagcaccgccatccaggaaagcgcgcgctacatctacgaacattacgaggaaccggtctcactggcagccgccgcggcggtcgcacatatgaatcccacttatttttccaaaaaattccgggagacaaccggattcggatttaaggaatacttaacgcacatccgccttcagaacgccgcgcacctcctgcgcacgacggacacttcgatcactgaaattgccgggatctgcggtttttccgacggcaattatttcggggacgcgttccggaaacactatggcatgtcgccgcgcgcctaccggctgacgtaacaaaacgcctgagtcccccaagcacctcgtgagatgcaatataggggaactcaggcgtataacccggcaatacttcttccttgcttcctgtatgaaattgaatggtggaaatatctttctccggatctgctccttttgattctcttacttcggccgcttgccaaagaaagaatggcgctccggtttcttctcctctttcccgccgtcagcgtcttccttccatttaaagtattccgcatcaagatttacttttatctccgccccggtctcaccagtgttcttctccagctcttcctccgtttcctctgtctctaacggaatcccgttcttctcaaaatactcttcgtttatcttgatctccggctttacggatgcatagacggaagtcgcctcctcttcctcctgctcacgcttcgcgcgttcctttgcaatctccttgttgcgctgctcgatcagattcatgtatttgttcgtatcccttaaatcctcaaggtggctctttaactccgactgatctctgcgcacatttgatttttcctgcgcaagcgcatcattcatcttatcgcagatctcccggacagagtccatcgcatcctgcatgatatcctgtacgcggtgaagcgcctcatccgtatacatgaccgatccggcatacacatcctccgccatgcggttcgcatcctcgacgattccgtccgtcttcttgcggaactgtcgttccgctgcatcgcggctctgctgggtaagctcatgttcctccatgagttcgtagatgcagacattcaggcgctgcaggagatttaacgcctcctttttgtctatgataacccgatttgtcgctttatcatacacctcgctgttggcatacatgatatgcatttcccgcaacacctgctctgtcttatcctgcgcactcataatggtctcctgtatttcaattatcttttatgtattgtatctgctttccgtctccgtatacgttttatcaattttaccactaacacaatcagtaatacaaccagaattatcacaatcagaatcacggcgataatcatagccgcatatttattcgggctctttacaagatctccgagcgagcggctctcatccaccaccttgcggtcgtgcatctggctgtaataagacggcacattggcaataccgtcgccgtctgtatcctcaaaggactgcatatatctggcaatcgaatcccacgcttttaactcgcggtccccctccatcacgatgacgtcctcaaaatcctcgatcggcgttccgtccgcatactttggcacaagcgacaacagtccgtgcgacatatccgtcaccgcacttaacatctgtccgctgtagagatctgccacaacgcggtacagcttatcgtcctcaagctccacgcggcttccgttctcatcggtcagataaacatccgtcaccttatttaaaatcatgcggttcggattgtatgtaaaatgaagtccgctcatgtaaagtctggctgtcgtcatgtaatcagaaacggacgcgtcaatctccgcggctgtgcgaagttccttccctgtcagatagacactgatcagcgggtatcccggcacgccgtccggaccaatgccaagggaaaaagaattaaacacctgctccaccgtaatgtccccggccgtgtaggtatcgcgcaccgtaccgctcggaaccacggcaacgtccaccggtactccgtcaaaatcatcggagttctccacggcatacacataggcgtccgacatcaggtcacccagattgtgttccgtgtgctcatactcgagatcatgcagcgtggaaaactgcacattattggttgcaagcacctcatccttggtgtaaccgaaatccgcgagataaccggtatccaccgcttccatgaagccatcaatcttctcctgggtcgctccgtccgcagtgatggtcgaaagaatcggaaccagcttataatccgttatctcccatctgccatcgctcttctgggtcatggaaagttctccgatctttctgccgtactctcccgtggatacaatatacgtgtcgccgtgcacgatcggctccgcgagctctgtgtgggtatgaccgctgataatcaggtcaagatccggcacactcttggcaagaatctcatcctcggatttgctctcatcctcccacgtaccgctgtgtgatacgcagacgatcatgtccacatcctcatttgccttgatctctgccaccgtctccctgaccgcttccaccggatcgcggaataacagttcacaggtcggcgcgcaggcaagtgcgtccacaccgaacacacctgtcacagcgacattgacgtctcccttttgcagcacgacataatccttcacgccgtactcctcaaatccgctctggatctgctgctgtccgtcatttaatcccgcagcctccatcgcgtcccagtctacattacacaccacaagctccggcagtacgtcgccgctttcggctgcactctttatcatctgtgccagtccgctggaacggtaatcaaactcgtggttaccaaacgtcgtcacttcacagccgattgcgcccagcatccgaagctccgccgcctcatcctcatagacggtctgcaccagcgtacccatggaaaaatcaccgccatcaaccacgagcgtgtccggattctccgctttctgctcatcgatcactgtcttgatccttgcaaaaccgcccacctctgtggattctccgtcaatcactgtggaaaaactgttcagatgggagtgggtatcgtgtgtgaacaccacatccagtgtcttcccggccgcctccgcagccgcagctgtctgtgcgctgccgacaaacagcggcacaaccaaggctgccgcaagcagccctgtcagaattctttttttgtttttcattcaaaaaccctccttaattatgaaatatactccccatttacactcatcggacccccttagatcccgatcagctcttaagataggtttattttaccacgaaatgaggtctgacgcaatgtaacgcggtaacgcaaaaagaagcccggcatgctgtgatgtgtctgtcagcatgccgggctcagatgtctgtagcggtctgtctccgtccgtctatacagcatcatacctgtgtacttgtgcacctatctgtcagcaccctgtctctggcagcctcggactaagagatcttcttgccggagtaccttgcaaaatactcctgtgccgtctggcaggatatgttcagcctctcctgcagccgctcaagaatctccttcttcgatacgccgtaggcacatccggtctccacaatcccctgtgccagaccccggttcagaccttcctgctcccccgcttcgtactccgctttgcgaagcttcttctcttcatattccttatcgtattccagaatactcaccatttccacctccgcacgattcttccgaaggaaatccgctaagatcccttccgcaatacactccttaatcgcccgccgcaccgcctcttccagcttcatagaagcggtgtacccgcggactcttgccacatactgtgcatattccttcagcatcctgcactgctccataagctctgcattatgtccggcattgatgttaagcaccctaaccttcaattccagattcggctctccctcaaagtgttcatatgcctgtgacagtcgaagctccgtgcgctcctccatgtcctccgcgccattgtaaaacacgataaacacgggagcaggaatcttcagcaatgcggacgaatacagcgacttgtcactcacatacttctgatattccaaagaaatatagaacagatcccgcagtggcatgttcgggttcttcgtcgactgatgctcgtacagagagatgtgcagatccagtaaaaatgccagatcgttcttcatccccatgtagaccgcattgtccaacgtgacaatctcaagttccttcgcatcctcatatgaccttccagtcacggcattgtaaagcgacaacagattcttctcgtctgagaagagcatgcggaataccgtatccttgtactcccgcctcgccttcggcttcttctcttccatatgcagttccccctttttgcaggaaccaccaccccagcgtccctgcttttctcgttcgttgattggataaaaagcatagacctctgaaatgtgataagaaaatagacggtgcgaacaccctgaactcgtaagaaatatgcttttgttgaacatattttaacacagaatgcgattattctacaagagtctttttattaaagtccctatttacatttgtgtgtctgatgtatcaacagtataatgatacatttcacgaattgcgtatgcaattagaaaatcaagtagtccaaattccataaaatgaaattttagggcaaattacagacattggcttggctgtagtatttttaaacaacgtgtgttagactactgttatacaaatcgaaatttataaaggagaatattgatgaaattatttttatgttcgcacttttcaagtgtaggaagtctgataaaggaagaaattgaaaataagaaagtcgcatttattccaacagcttcactgcgtgaaggctacaccggttatgtcggctcggctcgaaaattattcaaaaagttgggagcgatcataactgaaattgatatttcaacggaggcttattcaacgatacagtctgtttttgaagaagcagatgtaatatattttaccggcggaaattctttctttcttatggaccagctccgtaaaacgggaactgatggactgctgaaaaaggaattggcaaatggaaaattgatgatcggcgagtcggcaggcgcaattatatgcgctccaaacatccaatatatcgagcaaatggatgaaaagccggaggactactcacaagaagatgatgcaggga

SEQ ID NO: 19 - DNA, 44794 bp, Roseburia hominis
aagaggcggaataaactctaaaaaacgggagctatgtcccaccgcactagccttatccgccttttattataataaaaataagcatgcggatacatacataatgtatctacatgcttatagtacaagccgcactagttgtactcccttatagacaatataaaaccgcgcgaaccgaaactcgttggcatctgctattaaaaatatggcagatggcaattcagacatcggcttcgcgcggttatgttttattgcaacataaggatggctgatttatgccatccgttgcttggtgctggcaagtgcggcacaaaagtcctacaaattgtctcccgggatgcggacatgacccgcggagtgctccaaacttggaaaaacacggatcatcgaagatgcagacatcaggctggctagaaatgccacattttttgaaccgaatttccatctgtatttccacatgaaatccataagtgcgtttcttataatattattgcttattaaagcatgatatgcttattgtgacagttcctttgtgtgataggaaatatgtaacctgcagttacatggaaatccacccgaatgcattggcaactgagcttgcaagaatgatcatggtaaaaaccgggcataagtatttgatcatcaaaacaaaaatctttttccggcggaaggtgccttccccgtgcaggatttcttcctccatgcgatcgattccgattaccctggatacaagaaggcttgtcatcaaggcagcgaccggcatcatcacggagttggtcagaaaatcaaagaaatccagaaactgcatgccgatgatccggatgtttgctaacggaccataacctaaggaggagaggcttccgagcgcaatcatgatcacgccgaccaggacggtggatttcctgcggttccatccaagttcgtcctcaaaggtagagaccgcgctttctgtcagtgcaatcgaacttgtcacagcggcaaaaagcaccagcagaaagaacaggatcccaacgaaagtgccgagtcccatattggcaaatacttttggaatcgtgatgaacatcagcgccggacccgcctgcagcgtgtccggatcgccgcctgaaaatgcaaataccgcggggataatcataagtcctgccataatcgcgatggcagtatcaaaaatttcgacgttcttggtcgatccctcgatggaagtttcctttttcatataagaaccgaaggtaattaagattcccatggcgatggagagtgaataaaacatctgccccatggctgtaacaacggtcatccacgaaaaattcgccggattcggtacaagaaaatatttcacgccggcaagcgctccaggtcttgtcacagaataaacggcaatgatcacggacagtacgacaagaaccggcatcataagcttggaaacacgttccactccgttacggactcctgcaaaaataataaccagcgtaaacatacagaagagaacgaaacagagctccgtcgatgcgccgtctgagataaaggcggaaaaataaccgtcttctgcaagcttagccccgtctccgcggatgtattcaagcaggtatttgatcacccatccgccgatcacggagtagtaagggacgatcaggatcgggattacggcgttaatccatccgccgaaggacatccattttttcttcccgaatgactggaatgcaccgaccggactttttcttgtcatccgcccgagggcgctttctgcgacgatcatggtgtagccgaacgtgagggctaacacaatgtaaatgagaaggaagattcccccgccgtatttagcagcaagatatgggaatctccagatgtttccgagacctacggaggcaccggcagctgagagtacaaagcctatttttcctgagaaggaacttctgttgttttttggattcataattttttcctctttgatgtattgtgtgtaatgagagcacacaaagcctattttagcatagatggcagagaatgtcacgatagcccggtatctttttcgtgttgtttcacttgagaaatggtttagttatggtataatgtgatacaggttgtaaagaaacagtctgaacgaaatgcaggagagaagaatatgaaaaagatcttagaccttatcaccggggaagtcacacaggcatttgtggactgcggttacgatgcaaagtatggcaaggtgacattatccaatagaccggatctctgtgaatatcagtgcaacggagcgatggcggcggcaaaggagtacaagaaggcgccgtttatgatcgcggacgaagtggcggagaagctttccgggaatgccatgttttccatggtggaatctgtaaagccgggatttttgaatctcaagctggatgaggcatatctggcggattatgtggcaaagatgcaggcggacgagggaagatacggctgtgagaaggcaaaggagccgaagacgatcatgatcgattacggtggaccgaacgtggcgaagccgcttcatgtcggacatctgcgctcggcgatcatcggcgagagcatcaagcgcatcggacgttttatgggacatacggtgatcggcgatgtgcatctgggcgactggggcttacagatgggacttatcatcacggagcttcgggagagaaagccggatctggtatattttgatgagagttataccggcgagtatccggcagaggcgccgtttaccatctcagagcttgaggagatctacccgacagccagcggcaagtccaaggaggacgcagcctacaaggaggcggcgatgcaggcaacctatgaactgcagcacggcagaagaggttatcaggcactgctttcccacatcttaaatgtgtccgtcacggacttaaagcgcaactatgagaatctgaatgtatcgtttgatctgtggaagggcgagtccgatgcccagccgtacattccggatatggtgcagaagatgaaggatgacggatttgcctacatcagcgacggtgcgcttgtcgtggatgtcaaggaggataccgataccaaggagatcccgccgtgcatgatcttaaaatcagacggtgcatccctttataatacgacggatcttgcaacgattgtatggcgtatgaaggactaccatccggatgagctgatctatgtggtggataagcgccaggaactctattttacgcaggtgttccgctgtgcgcgcaagaccggactggtaaagccagagacaggcttaaagttcctcggattcggcacgatgaacggcaaggatggcaagccgtttaagacccgtgagggcggcgttatgcgtctgcagtatctgcttgagagtgtgaacgaggaaatgctcaaaaagatcacggagaaccagaaggcaaaagagaaccttgagatcagtgaggaagaggcgaaggagaccgcgaagatgatcgcgcttgcagccatcaagtacggtgacctctccaatcaggcaagcaaggattacatctttgatattgaccggttcacctcgtttgagggaaataccggaccatacatcctttacaccatcgttcgtatcaagtcgattttgaacaagtatcacagcatggggaaggatgagagcggcgcagtgattgaggcggctcattccgcaagcgagaagaaccttatgctggcactttctggatttggtgctatgatggagaacgcttatgaggagacagcgccgcataagatctgttcttacatttatgagctggcgaatgcattcaacagcttttaccatgagacaaagatcatgtccgaggagaacgagcagatccagaagtcttatatccgtctgttagagctgacgaagtcggtgcttgagacctgcatcgatctgcttggctttaaggcgccggagcgcatgtaacctatttagtgagttgataaaaaagaaggggctgccgcatgaaacgggctgccccttttgctgtgagaagtaataggataagaagtcatgcttttcgatttctgatggaatgtagctggaaattcggatcaaaaaatgtggcatttctaaccagccaaatgtttgcatctttgatgatccgtgtctttccaagttttgaacactccacgggtgtgtccgcaacccgcagacaattttaggattctcgtgtgtcccttgcggcaccagacaacagatggcataaatgccatctttatgtcgaacaaaacataaccgcgcgaagccgatgtctgagtcggtatctgccttattttcaatagcagatgccggcgagtttcggttcgcgcggttttatattgtctgtgaagaggggccattaaggacaccagaaagtccgtccattgtctccggtgtgtcggacatgcacccgtcggattgtccaaacgtggaagagacacggaatccgatgcaaacatttagctggaagaaatgctcacatttttctccaacgaatttccatctgcattccatcagaaatcgaaggacatggtctttttcgcatattacttctctcatcaaaaggggactgtctgcttcaagtgggcagccccttcttttttgcgcttttttatgaccgacgcaaaaaggagtcatattttttcggacaggtcatagaattagacatagccggaaaggaggcatggctttggagatcgtcaaaatattcccggtgcatataagagaggcgctggcgaacgatacatggaaggcgggattggaggagatccgtgtccgggtgggcagtccgcttgaatttatatacggcggggagagccgctatctgccggagcacaagggcgtatgtatcctgccttctgcctgcggatatgagagcggctatcggatgacgccggaggaccttcgtgagatgctcaactatatcagcgattattcgctttacgcctacagtgaggaggtaaaggagggctatcttaccatcgagggaggacacagaatcggaatggcggggcaggtggtaaaaaaggatggaaaagtgaccggtcttagccatatcacgtttttaaatgtccggattgcacacgagaaacggggctgcgcggatgacattcttccgcatatcaggagatcggacggtatctataatacactgatgctctcgccgcccggaatcgggaagacgacgtttttgcgggatctgatccggcagttgtccgcgggggatgcgggtgcacccggaatgaaagtgggggttgtggacgagcgttccgagattgccgcatgccacctgggaattccgcagaacgatctgggcccccgcacggatgtgctggacggctgtaagaaaacggagggaatccggatgctcctgcgctccatgtcgccgcagattctggcggtggatgagcttggtggaaaggaggattttgcggcggtaaaacaggcactgtgctgcgggtgcaggataataggaaccgttcatgcaggctgtgtgcaggagcttttggacaaaccgtatctgcaggcatgcgtcacacagaagctgttcgggcgctacatattgattcaacggaattccagaggggggcgcagcaccacaatctacgatgaacggatggagcggatatgttaaaaatcatgggaagcatcctggtctttgccgcggcggcggggatggcaggtacatacaaaagagagctggcagatcatctggcacttttgtacgcgctgcggaaacttctggtggatctttcctgctacggaaatggaaccagacagccggtggaagttctgctgggatgctttgtgagaacgccggatgaaagattaaatgagatctgccggaagattgcagactgcctgatagagaaaaacgagaaaaatggggaactggtgtggaagcgggtttttgaggaatatcggaaaaaactgtatttaaccggagaggagagcgcgcttatcggggaggcgggcggcgcacttttcggaagaagtgaggaagaaaatcacagaagactcacgctcattttagaacagctggatgacaggatcaaaaccgtgcgtggcgagctgggagaaaagcagaagatatatgcgactgtcagtatggtgctggggggaatgctcgtcattcttctgatttaggcggcaggaaagcaaaacagaaaggaatgaaatacgatgagcgtgaatttgatttttaagatagcggcagtcgggattcttgtgacagtgatcggacaggtcttaaagcacagcggcagggaggagcatgcgtttttgaccagccttgccgggcttatcattgtgctgttctggattgttccgtacatctatgaattatttgagacgatgcagtcgctgtttgcgctgtaagcagggagaaaacgatggatattgtaaaaatagcggttcttggcatcgcgggagtattccttgcaattccgctcaaaagagaaaagggagagtacagcacgtttgttgcaatggttgtgggaatctgcatttttatctatctgctcacaaaggtggagaccgtactgctctttgtggattccatcaagtcgcagcttctggttgacagcaggtacatcgggctggtggtaaagatggtgggaatcacgtatgtgtcggagtttgcggcgaatctgtgcagggattccggttattctgcgatcgcaggacagattgaaatgtttgcaaagctgtccattctggtggtgagtgtgcctgtgtttggggcatttttggacgcggtggggagttttttatgagagagtggggaaagaggagcttctgtctggtgtgcatgtttttggttttgaccggaatgcctgtgactgtgcaggcgacagattatgacggcgggacggggagcgcggagaagacgcaggagacatatttaaaaacttttctggaagatctggactttgcggaactggatacgtggaccaaagaggagctgtttccggagcagagggaaaaattcagcttctccgtgatggtgcaggaactgcttgcggatggaatcggagtgacctccatggaaaaaatcggacagtggctgtgtgatgccctgctgtatgagataaagaccggcaaaacaattctggtggaggtggtgctgcttgcagcgggtttttccatgcttaagaatttctcgggaacctttgagaaaaattatgtttccgacatctgtttcctgctggtctacggcgtgctctgtgtgctgctgctaaagtcttttgaaatctatggaacggtagcggaagaagcgctaaacggcagcatcgattttatgaaggcactcattccggcgtttggcatcagcatggtattttcctcgggggcggagagctccgccgccttttatcagctggcgtttctggtcatttatctggtggagtggctctttctttcggtgctgcttcccttcatccgtgtgtatgtggtgacggagctgttcaatcacttttttgaggatgaaaaattccagaattttacggaattattggctggagtgatctcctgggggatgaagagcgcgatgatggcggtgctcggattaaacgtcatgcagggactgcttgcaccggcaaaggaccgccttttaaacggagcggtcagccgtgcggcgatgatgattccgggggtggggaatgtgcttggaggaatcggggagcttatgttcggcgccggaatactgatcaaaaactgtgtgggggtgacggcactgatcgtgctgcttgcggtgggctgcatcccggttctaaagcttgcctgtatgtcagttctctataaacttgcggcggcggtggcggagccggtggcggataagaggattgtcggatgcattaagagcatggcgcagggaggcgtgctttatctgaagctggtctgctatggcattgtactgttttttgctacgattgcgctgcagacggcggcagtcacatcacatgcatagggggacgtgccatgaacgcatatatgagaggatttgtcattctgtttgtgcttctggtgctgctaagttatctgccgccggggaaacaataccggaaatatatccgtttttacgcgcagcttctgatggtgcttgcagcattgagaccgctgtttgtactgtttggcggaaaagatacgttttatgaaaaaatggcatatgcccagtgcatggaaaaattgtcggaattttcccgcgatacgcagaaaatcgcttatctggatcaggacagataccgcacagagtatgagaatgtcatcgcggaaaatatcagggagaaggtggatgatatgctgcaggagtacgggcttggcacggagagtgtcactgtggaactgggggaggataacataatgcaggagatttgcatttacatcacagatgagagcgcggatacgatttcggtcggaagaatcagcgtgtcagatgcggcagagtcaggggagaaccaggaggtctgcgggaaagtaaaggaagaactggcggtgtactacgggatggaggattccggaatacgggtgagttatgtgggaggaacgtaaatgcctgaaaaactgaaacggatcttacagaacaaaaactggcgcagctggaagaaaagcgactggctgctgctcgcgctggcggggatattattgcttgtgattgcactgccggtggagagtggggatggcacagcagaaaaggcatataacacggcacagggggaaaaggagacgtcaggcggcagcggaagaacggcgtcaggagatagtggagggacggcgtcaggcagccagacatcggaggagggagagcaggaatatgtccaatatctggagaagaagctcgagaatattctgatgcagatggacggggtgggcagagtggacgtcatgattaccgtttcagacgggggcgaacagattgtggagaaggacaaaaagacaacttcatcctcgacgggcgagcgtgattccggaggaggggagcgcagtgtgacagaacaggcgggggaagattcgacggtatatgtggagactgcagatgaaaaatatccgtatgtacagaaagagacgctgccgacggtggcaggcgttgtggtggtcgcagagggaggcgggaacccggcggcggtttctgagatttcagagtccgtgcaggcattattaaaggtggaaccgcataggattagagtagttaagatgtgttccagggaggaatcggagtgaagaaaatatttcggaaaaaccagctggtgataacagcattggcacttatgattgcggtggcaggatatttcagctacatgaacaacaatatggaagatggccaggtgacggcggaagcgagcgcggatgcgggaacggtgcaggatacatacgacatatcggaggaggatatgcttgcggagcaggagatctttaccgatgagggaaccggggaggaactggcgcttgtggaaggaacggagacggcagcagtggatgccgcgcagtccggggatgtggcacagatgacggacggtgccgcggatgtcgagaatcctggggaggcagtgcttacaagcacgacgattgcgaacctcgattatgcggcggagatgaaattaaaccgcgagcagatccgctccaagaataaggaatccctgcttgagattgtaaacaatacgacgatcgatgagagtttaaagcaggatgctgtcaacaagatgatcgccatgacggatattgccgagcgggaggcagctgcggaaatgctgctggaggcaaagggattttccgatgtggtggtgagcatcacggaagataactgcgacgttgtcttaaatatgggagaggtgacggatgcaaagcgggcacaggtggaagatattgtaaaacgcaagaccaacattgcggcggataagattgtcattaccccgattgtggtggatgagagcggggaataagcttaaaatactggtaaaagaggcggatatgtagtataatctccatgctatttgaggcatggagatttttttagattggagtaagctatggcaatgcgcatcatgatacaggggaccatgtcgaatgcgggaaagagcctgatcgcggcgggactctgccgcattttccggcaggacggctaccgggtggcaccctttaaatcacagaatatggcgttaaattcctttatcacaaaagaagggcttgagatggggcgggcgcaggtgatgcaggcggaagcggcggggatggaaccgacggtagcgatgaatccgatcctgttaaagccaaccaacgacatcggttcccaggtgattgtgaacggcgaagtgatcgggaatatgagtgccagggattatttcgcttataagaaaaaactggtgccggacattcttgcggcgtaccacaggcttgaggagcaggcggacatcattgtgatcgaaggcgcgggaagcccggcggagatcaacttaaaagagaatgatatcgtgaacatgggactggcggaacttttgaatgcgccggtgctgatcgccggagatattgaccggggcggagtgtttgcgcagctgctcgggacacagcttcttctggaggagtcggagcgcaggcgggtaaaaggatttatcatcaataaattccggggcgatgtgtccattcttgcgcctggaatccggatgctggaagagcgcggcggcgttccggtcgtcggggtggtgccgtacatgcagatttccctcgaggatgaggacagtctgacgacccggtttgatgcgaggcaggaggcggcggtcgacattgcagtgatacgttttccgcgcatctccaattttacggatttctcggtatttgagcagtttgaggatgtgtcgctgcgctatgtcgattcggtggaaaagctgcatcatcccgatatgatccttctgccgggaagcaagaatacgatggaggatttaaaatggatgcgccagaacggtctggaggcagcgattcttcacagaagcgcggagacgttcatttttggaatctgcggcggctaccagatgctcggaaaacagattgcggacccgcacggcgtggagacgggcggtgtgatccggggaatgggattacttccggtcacgacagagctgggggaacagaaagtgcgaacccgggttggcggagagattcttggcgggatgctggacggatgtgaactgagcggctatgagattcacatgggaatcagcagaccggagggggactgcgaacctttctgcaggatccgcgacgagattaccgggaaggaacgcacggacggcatctttgcgggaaatgtgtgcggcacctacgtgcacggcatttttgaccatggctcaatcgccgggaagatcgtgcggcacctcgcagagaggaagggactcgtgctcggggaggacggcgtggactacggattgttcaaggagcagcagtacgacaagctggcggcaacgctgcgcaagtatctggatctcgatgcgatctataagatgatgcgggaatatgagtgacaaaagagagaggtgtgtgggatgttagacagacagcagatgagacagttgaagatagagccgccggatcaggcggtctataaggaagtcctcggcaactgggatgcgcttgcaaagccgctggacgggatgggagaatttgaggaattgtttgcccgcatcggagcaatccggcgtgatcccgcccttgatatttccagaaaagcagtggttgtgatgtgtgcggacaacggaattgtggaggagaagatcagccagtccggacaggatgtgacggcgaaggtggcggcagccatggggagagggacgagctccgtctgccggatggcaaaagcagccggcgtcgaggtaataccggtggacatcggaatcaacgaagagggatcgccggagggcgtgctgccgtgcaaagtgcgtcgcggaaccagaaattttatcaaggaacgggcgatgacggagcaggagacactggcggcgattgagatcggcatggagcttgcgaagcggcttgcgcacgagggctataagctgcttgcgaccggtgagatgggaatcggcaacacgacgaccagcagtgcggtggcggcggcactgttatcctgcgatccgaaggagatcaccggaaagggagccggactcagtgacacggcgcttttacgcaagattgcggtggtcgaagagggaatccagatgcatgaactctatcaggcggacgcatttgatgtgctgtgcgcagtgggcggactggatatcgccggactttccggcgtgtttatcggcggcgccctggcacatgtgccggtggtcgttgacggagtcatcagtgcggtggctgcgcttgcggcggagcggatgattcccggcgtgcgcgattacgtgataccgtcacacaagagcagggaaccggcggcggagcgcatattggaagaactgggaatccgcccggtgttagatgcgggactggcgctgggagagggaaccggagctgtgatgatgtgcggactgctggacattgcgcggacgatctacggcgagcgcaccacgtttgcggatattgatgtggcaccgtatcacagattcgggtagcctcagagaggagtaggacatgattctggtgatcggcggaagcggcagcggaaagtcagcttatgcggaaaaagtggcattggagtgtcaaaaagagaaaaggcacttctacctggcaaccatgcatgtgttcggcgaggaggggcaaaaaaaggtggagcgccataaaaggatgcgcgcaggcaaaggctttgtgacgatcgagcagccgacggacatcatgcagtgccttcccgcacttcgggaggccggtggcggcgtggtgctcctggagtgcatgtcgaatctggctgccaatgaaatgtttgacacggaagaaccggcgggcagtgagcaggtcgcggaaaagattgtcacgcagattggcgtgctggcgcaggagacggaagaacttgtcattgtcaccaacaatgtgtttgaggatggcattgtctatgatacttccaccatggaatatcttcgggcgctcggcagcatcaatgtgagactggcagagcgttcggacgttgtggtggaagtgattgcgggaattcccgttgcaagaaagggaaagcttccggtagcggcggcagagaaacagggacacagacagaaaggagcaccggcatgtccgtgataaagtctttttttatagcattttcgatttattctaaaattccggtgccgcagttcgcgtggaaggaggaggacatgcgctatacgctgtgcttcttcccgtgggtcggagcggtgatcggattgtgtttcctgttgtggaaccggttcgcgggcgtgtatgggatcccgtccactgcccgggcggcggtaggagcggttctgccgcttgcaatatccggcggatttcatgcggacgggtttatggacaccatggacgcgctgcattcttaccgcgacagggagcgcaaactggagattttaaaagattcccacatcggcgcgtttgccgtgatctgttttgtgatgtatgagctgatctatctgggagcagtgtccatgatcacggaaaaagaacagattttagtacttgccgcaggcttttttttgtcgcgcaccttaagcgggatcggtgtcgtatccctgcgctgtgccaagacgaacgggatgctctatcagttcgcgagcgaggcgcaccggcgggtggtgctaacggcgctgtatctgcagcttgtactctgcgtcgggctgatgcttgccgtatcggtgaaaaccggtgctcttgcgtgtgcggcagcagggcttacctacgcgtactacagacagaagagttaccgggaatttggcggtattaccggagacctcgcggggtattttgtgacgctgtgcgagggtgtgatggcggtgcttgtggcggcggcagggctgatcggctaggaatgaagcattgcgggatgacgcatcagaaaggataacacatggaactatacattggcggatatgcacagggaaagcttacttatgtcacagacaggcatccgggggaaaaacatccggtgtgggatggagccacagagacatttaccgggagaacattgaaggaggcgccggtctgcaaccactatcatctgtgggtgaagaggctgcttaaggatggagcggatgtaagagcgctgaccgggcagcttcttttggaacacccggactgcatcatcatcagtgatgagatcggcaacgggatcgtgccgatggagcatgaggagcgcgagtaccgggagttgaccggcaggctgctgtgtgaactggcaaataaggcagaccgcgtggagcgcattgtgtgcgggatcggagagcggatcaaatgaggtatgaggcagacatggcactgatccgtcacggtatgacgcccgggaatgaagagcaccgctatatcggaagaacggatgagccgctttcacaaaaaggcagagagcagcttctcacattgcagaaaaaaggcgtttatccggcggcagcatgcgttgcggcaagtccgctggagcgctgcagacagacggcagagctgttgtaccccggacaggcgccatgcgttttcgatcagttccgggagatggattttggcgcgtttgaagggcataactatgaggaactgaaagcggatgtccgctatcaggcgtggatcgacagcaacggaacgctgccgtttccgcaaggggagagcagagaacagttccagagacggtgcgtggagggattttgtgagctgcttaaggaagtgtggacgcgggagaagcttccggcgtcgcttgcactcatcgtgcacggcggaacgatcatggcgcttctggacgcttttgcggagggcagttattacgattaccagtgcgcaaatgcgaaaggatataaaggacgactgtctgtggaatttgatgcagcgggaaatactttaagagacacgataaaaattgcggatgtgagaaagttggaggaatgacatgctctcggtatatcatatgacggcgtttacaatcggatttgtgatggatctgctgttcggcgatccgtactggctgccgcatccgatccggtggatcgggcgcctgatcggatggctggatcgaaagctgcttggagagacagacggcgcggtgcgaaatgaagccgccgagaagaaaaagggaaggtggcttgtggcgttcgtgcttcttccggtactcttttttgcggcagcagtcctgtttgcggcgtaccggatccatccggcggcgggggttgttacagagagtgtcatgacctaccagatgcttgccacaaaatgcttgaagacggagagcatgaaagtgtacaagcagctttcggagcatgatctgtgcggggcgagaaaggcagtctccatgatcgtcggaagagatacggaatgtttggatgaggagggcgtggcgaaggcggcgatcgagaccgtggctgagaatgcctccgacggagtgatcgcgccgatgctctatctggcgctgtttggaccggtgggaggttttttttataaggcggtcaacaccatggattcgatggtgggatataaaaatgacaggtatcacgcatttggcacggcggcggcaatgctggacgatgttgtcaatttcattccggcgcgcatcagcgccatgctcatgatcttatcctgctgtttccttggaaacgaatttgaccagaagaatgcgatgaagatttttaagcgggaccggtatcagcatgccagcccgaactccgcacagaccgaggcggcatgtgcgggagcgctcggcataagactggcgggagatgccagctattttggaagaatcgtcaaaaaaccgtacatcggtgatccgctcagagcggtggagacagaggatatcagacgtgccaaccgcctgctgtacgggatggcatttttcggatggggaatttgtatggctgtctggttgtgcgtgacagccattgtgtggtagcatagagacagaacaggaggaagaaccgggatggtgcagcagaacatacatggaggagacatataccgcaatcaggtatcgcttgatttttcggtcaacatcaatccgttcgggatgccgcagagagtgcgtgaggcgcttgatgcggcagtggcatggtgtgagcggtatccggatatccggtcggaggcattgcgggatgccatcgccggggcaaaagggattgcgcctgcggatattgtgtgcggaaacggtgcgtcagaactgtttcctgccattttaagagcggttcatgcgaaaaaggtgctgcttcctgtaccgtcattttacggatacgagtatgcggcaaagtctgtgggagcagagatctgctgccacgaactgcttgagacggacggctacgcggtgacggagcgctttcttactgccatcggggagggtgtgaatgccgtttttctggcagtcccgaataatccggtgggtacggtggtggagccggaactgttggagaagattgcagagcgctgtcagaagtacggtgtgaccctgattctggacgaatgttttgtgatgtttaccggagcggaagaacgctattccttcttaaaaaagtatcggaattatccgggagttgtgatcgtgcgggcatttacgaagctctatgccatgccgggagtgcggctcggctatctcgtctgcagcgatgctgctcttacggaagcgataagagccgatctgccggagtggaatctgtcggtgtttgcgcagcaggcgggatgtgtggcctgcgggcagcgcgcgtatgtggagcactcggtggcatttgtctgcagggagcgtgcctggcttacggagcagctgtcggaaattggcatcactgtgtttgcgtcaaacgccaatttcctgatgataaaggacgggcgtccgctggcaaaagagctcttaaagaaggggattctgatccgcgactgcagcaactaccggggactttccgggggatattaccggattgcggtcagacggcgcgaggagaatgaacgcctgcttgcggcgctggcgcaggtgacgggaagcagcgtggtggaaaacggcaaagatgataaaaagccggcagcagtgcccgacggaatcgagtatgtgatgccgcaggagatagagaagcgcagcttttccatcatcgaggaagaattgcggcttcgggggattacgctgcctaaggaggaagcgatggtcacgaagcgtgtgatccacacgagcgccgatttttcctatgcgcagacgatgacctactccgcgggagcggtggagacggcaaagtggctcatcacagagggcgcggacattgtgacggacaccaacatggcgctctccggcatcaacaagcgcgtgctcgcacgctacggcggatcggtacactgctttatggcggacgaggatgtggcaagagaggcgaaggagcggggcgttacccgcgccaccgtgagcatggaacgggcggcaaagatcgaaaaaccggtcatctttgcgatcggaaatgcgccgacagctttaatccagctatacgggatgatagaggagggctaccgcccagcgttcatcatcggcgttccggtcgggtttgtcaatgtggaggcggcgaaggaactgattttacagacgaagataccacatattgtaaaccgtggaagaaagggtggcagcaatgtcgcggctgccatttgcaatgcgattctctacgagcttgggaggtgagcccatgcgctatggatttacgacgggaagctgcgccgcagcggcggcaaaggcggcggcttatatgcttcttaccggcagagaaaagcacgagattaccatcaccacgccaaaaggcatcctctaccatgccaggatggaagagatcagccgcacggagcattccgtgcgctgtgctgtcagaaaagatggcggagatgatccggacatcacgacgggaacactgatttttgcggaagtatcctggcaggagcagaaacaggaaaaagactgcggaaaaccgcagattcttattacgggaggcgcgggtgtcggaacggtcacaagaccggggttagaccagcccgtcgggagcgcggcgatcaatcatgtgccgcgggagatgattacccgcgaggtggaagaagtgtgtgcgcttaccgattatgcggggagccttttggtggagatttcggtgcaggggggagaggaacttgccaaaaagacgttcaacccgagactcggtattgtgggcggtatctcaatccttggaacgaccggaattgtggagcccatgagcagtcaggcgctccttgacacgatctatgtggagcttaagcagaagcgcgaagaggggcaccggtttgcggcaatctcaccgggaaattacggtctggaatatatgaagcgcgcttacgggttcgacctggaccgaagcgtcaagtgcagcaattttatcgggaagacgatggatatggcggtggagctcggatttgaggcggtgcttctgaccggacacatcggaaagctggtaaagctctccggcggaattatggacacatattccagggaggcggatgcgcgcatggagcttttgatggctgcggcataccgcgccgggtgtgcgcccgatacgctggggaagatcttagactgtcttgtgacggaggaggcgctcgcctacattgcgcaggacggatgtctttccgcgacgatggaacttttaatgaaaaagattcttttttatttaaagaagcgggtgaaagaggaactgcgtgtggaatgcattctctatgcgaacgggtacggcgagctggcgagaagcgacggtgcggtagaacttctggaacgaatccgcggggaagaagaacatttgcagtaacgcagtttaaggaggaaacggtatggtatattttgtcggggcgggtccgggagcaaaggatttaatcacggtccgcggaatgagactgctggagcaggcggatgtcattatctatgcgggatcgctcgtgaatccggagcttctttcttatgccggaagcggggcaaagatctatgacagcgcaaaaatgacgttggaggaagtgcttgcggtcatccgagaggcggaggaaaaagggcttaccaccgtgcggcttcacaccggggagccgagtctctacggggcggtgcgtgaacagatggatgtacttgcagcggaggggatttcctatgagagctgtcccggcgtcagcgcatgctttggcgcggcggcggatctgaatctggagtatacgctgccggggatctcgcagagcctgattatcacgcggatggcaggacgcacggcagtgccggagcgggagagcatcgagagttttgccgcacatcaggcgtccatggcagtctacttaagtgcgggaatggtaaaagaactgtcgaaaagactgatggacggagggtatgcgccggatacgccggcagcgatcgtctataaggcgacctggccggacgaggaggcgtacgtgtgcacggtggagacgcttgctgctgtggcggtggagcatcagattacgaagacggcgctgattctggtgggagatgtgctggcagcgccggggtatgagcgctcgaagctgtatgatcccggatttaccacgggataccggaaggcaaaaaaggaacagggagagacaaagtgaagaagacggacatagctgtcatcagctttacttacaggggggcagaactggcagaacacattcaggaagcgatggatgccgtatggtcctgtaaattatatacaaaatgcagcgacgcccgggcagaggggatagggatttccgtggatcagccacttgccgaatggacaggaaaacagtttgcggcgggaaatgcgctcctgtttatcggggcatgcgggattgcggtcaggagtatcgcaccgcatgtaaaagataagctttccgatgttccggtgctcgtggcggatgaggcggggcagtttgtgatcccgcttcttgcaggtcattacggaggagccaaccggcttgccggggaactttcaagagccctcggtgcgactgccgtgctcaccacggcgacggatgtgaacgggctttttgcggtggatgtgtttgcagcgtcaaaccgtcttgccgttgccggtcatgacggaatcgcccgggtgtccgccgggcttctgcgcgccgggtatcttaccatgtccgtcgccggagaatgtgaaggagagattccgccggaggtaagactggtaccgtatccgccaaaggagtcggtggatgtgctggtcgcgccgcagtgcgaagccggggaacgatgcagcttatggctgattccgtcctgcctgctgcttggcgtcgggtgcagaaggggcaaaagcgaagaggaactggaagcgtttgtgcgggagaccctggaaaaagagaagctttccagcatggcggtggcgggaatcgcgtcggtcgatgtaaaagcggatgaggtaggaattctggcactggcagagcagttagcggttccttttctcacttatccggccgggcgcctgcagtgtgtggacggtacattcacgtcatccggctttgtggcgcaacaggtcggcgtggataatgtgtgtgagcgcgcggcggtctgcgcggcgggggagggcggcagacttctggtgcaaaagacggcatgtgagggcaagacgcttgccatagcagagaaaaaatggagtgtgaagttttgatgaaacatgaaatctatattgtcggaatgggaccgggcagagaggaagatatgacacaggaagcgctcaccgtgctggattcctgtgacgtaattgtgggatatacggtgtatctgaatcttctcggggaacgatttttggggaaaacgtttttgtcgactccgatgcgccaggaagtggagcgatgcaggatgtgctatgaggaggccaagaagggaaagtgcgtagcgctgatctgcagcggggacgcaggaatctacgggatggcgtcactcatgtatgagatgagcgcagaatatccgtcctgtgaacttacggtggtaccggggattaccgcggcaagcagtggtgcggcagtgctcggcgcaccgttaaaccatgacttctgcgtgatcagcttaagcgatcttctgactccgtgggagcagattaaagcgcggcttcgggcagctgttctgggggatttcgcgatagcgctctacaatccgtcgagcaggaagcgcgcagattatctgcagcgcgcctgtgatattctgctggatgccggggcgaagggaacgcgtgcctgcggctatgtggaaaacatcggaagagacggggagacggcacacacctgcaccctgcaggaacttcgtgagattcaggtgaatatgtttaccacggtatttatcggcaactcacagtcggtcattatgggagataagcttgtcacaaagcgcggctatcagatcggggcaggcgccagggcgcgtgcgaaggagcgcggataagaggtctggaaatggagagaatatggcagaaatattgattttttccgggacaacggagggaagagaattggcggaggcactctgcggcaggcagatcgactgcgtggcgagtgtggcgaccgagtacggcagggaagtgatgcgtcagcaggagcatcttgtgatccgggaagggcggatgggcgaaccggagatggaagaactcatgcgaaccggtacatttcttgcagtggtggacgccacgcatccctacgcggtggaggtgacggagcacatcaaagagagcgcaaaaaagaccaatcttccctatttaaggctcagccggagcacggcagcggagcgtgagatcgcagagcacgagtggatgatacatacggtggcggacacgcaggaatgtgtagaactgctgtctaagctgccggggaacattcttcttacgacgggcagcaaggaactgcacgcatatgccgcccgggaggagatccgtgagagactttttgtgcgtgtgcttccgggggtggagagcatcgaaatctgccacagggaacagattccggggaagcagatcattgccatgcagggaccttttggaacggagctcaacgaggcgctgatccggcagtatgacatcggcgtgctggtgaccaaggagagcggacaggcgggcggatttccggagaagatccgcgcggcagagcacacgaaaatcccggtggtcatgattcagaatccggagcaggcgggcgggatgagcatggaaaaagtcctgtccgaaattgaaacgctctgcgggaaaaagagcgggacgaagcgtcagccgctgcagatttctcttgtgggaatcgggatggggaacggaaagctgctcaccggagaggcaagggaggcgattgggcaggcgaaggcggtctgcggagcgaagcggctgcttgccgcggcggataccctgatcgcgccggatgcagagaaacgggaggcgtaccttcccgcagatcttcttccgtatatttattcctgcagggaaagaaaaatcgggcggattgccatcttattttccggtgataccggattttacagcggcgcagaggcggtgtataaggcattgcaggaagaagtgcgccttggaaaattacaggccgggatcaccatctgtcctggaatctcctcgctctcctatctggcggcgcgcgcaggtaaaagctggcaggacgcgaaaatagtcagcacacacgggagagaggcggatgttaccgcgtgtgtgcgcagggagaaaaaggtatttctgattgtttcaggcagaagcgatctaatccgcatcggggaagaacttgaggcggcgggactgtccggggtggagcttaccatcggataccagctctcctacagggaagagcggatctggcacggaacgccggaagtgtgccggacgttaaaggacgatggactctatgcctgcctgattgaaaatccgggtgcacagggggagacgctcgctccgggagtccctgaccgctggttcgtgcgcggacgtgtccccatgacgaaggaggaaatccgctggctgtctctgtgcaggctcgggttaaagagtcagagcgtattttatgatatcggaagcggaaccggctcgattgcggtggaggcggcgctgcggtcaaaacagctgcgggtgtatgccgtggaacatggagaggaagcctgtggactgattgcggaaaatgcatcgcgtgcaggcgtgaagaaccttgttgtcgtaaagggggaggcaccggaatgtcttgggaaactcccggtgccgacgcacgcgttcatcggcggaagcggcggcaggctgcgggagattcttctggcactccgggagaaaaatccgaacgtgcgcgttgtcttaaatgccgtctcgcttgagacggtcgccgaggttgtggcactgcggaaggaacttttgatctgtgacgaagagatcacacagattgcggtcagccgtgcaaaaaaggcaggttcccatcatctgatgcaggcggagaatccgatctatgtgatctctttttccctgtcggagaacggcgagggggaagaacaaaaaccggacagacgggaggagaggtaagatgaacattcccagaattatgattgcggcggcgggaagcgggagcggcaagacgcttctctcctgtgcgctgatgatacttttttcacaggaaggaaaaagcgtcagtgccatcaagtgcgggccggactatatcgatccgatgttccatcggacggtgctcggcgtcccttcccggaatctggacacttttttcactggggagagactgacgaaaagcctttttgcgcgcgcggcagagagcgcagaccttgcggtgatggagggcgtgatgggactttacgacggcctcggtggaatccgtaaggagggatcgtcctaccatctggcagaggtgacgaagacgcctgtgattctggtggtcaatgcgcatggaatgggacgttccattctgccggtcataaggggctttctggactatgaccggcatcatctgatccggggcgtgatcttaaatcagacgtcggtgacattctgtgagacaatccgtcccgaaatagagcgcgaattgtcgcttccggtgctggggtgtctgccgaagttaaaggagctgcactgggacagcaggcatttaggacttgtgatgcccgaagagattgcggatgtgaaaaagcagattcagacggtggcggatacgctcggaaagacaatggactgcgggaggcttcttgcgattgccgcatccgcggaagagctggagacagacccgctgccgaaaagaaagattgcggatgtaagaatcggaattgctagggacgcggcgttttgtttttactatgaggacaatctgcagctgctgcgggaggcgggagccgagttggtgccgttttctccgttacaggatgagagcctgccggaggggatagcaggactgattttaggcggtggctacccggaactgcatgcgaaagcattgtcgaaaaacaccccaatgcgaaaagcggtgcacgacgcggtggcgggcggtctgccgacgatcgcggagtgcggcggattcctctatctgcatgagacgctctgcgacgatgagggagtgtgttatccgatggcgggagtgatttcggcgtcagctaaaaatactggaaagctggtgcgcttcggctatgtgatgcttacggaaaaggaggagaacttcctaccggcgggcgtgcagattgcgggacatgagtttcactattatgacagcacggacaacggcgcgggtgcggtggccaaaaagccggtaaccggaagatcgtgggagtgcgtacatgagagtccgtcacagtggatgggattcccgcatctgtattattattccaatccggaatacgcgtaccgttttctgaaaaaggcggcggacagaatctacttgaaaaaataaacatgcaatggtaatatgtttttaatttcataaaaaagtaactggtgccggtgcaaaggtgtgtgcagaagatgtacagatgagcctttgtaccggttaaaagggaaacaggtgggaatcctgtacgatctcgtcactgtgattagggagtgcagatacgaaagctttacgccactggcgcgcatacgccgggaaggtaagtatctgcatgaggatctatcagccaggaaacctgccagttatgatagtacaggaagagattccggatcacgagtaattggtcgtacttttgtgtgttgatcagctgctccgtttctatgttttatagagcggagtttctttctgttgttttatggaaaatatacaatcatcagcaggaggaattatgaaaaaaaagacactggcactcttactaagcctgacactcgcagccggcatgatcggcggatgcggcagtaagacagagacaaccacagaggagaacgtgcagacagcacagacagagactgttgcggagaccgagacagaggcagtatccgatcaggatgcggcagatcatgttgcagcgctgattgatgcaatctacgtacaggagcgcacggatgagaccgatgcgcagtgtgcagaggcaagggcggcatgggatgcactgaccgatgcacagaaggaacttgtcgaaggtgagaatgcagatccggattatttcggaaaagataccggggacgcttccaaggacgatccgttaaatgaggatgagatcggcgagaatgagatccttgtcgtaagttttggtacatctttcaatgacagccgtaccgaggatatcggcggcgtggaaaaagcaatcgcagaggcatatccggactggtcggtaagaagagcgtttaccgcacagattatcatcaaccatgtacaggcgagagatgatgagaagatcgacaatgtagatcaggcgttagaccgcgcggtggcaaacggagtgaagaaccttgtgattcagccgacccatctgatgcatggtgcagagtatgacgaactgatggaatcggtagagaagtaccgcgatcagtttacatccgttgcagtcgcagaaccgctgctcggcgaggttggcgaagatgcaacagtaatcaatgacgataaggaagccgttgcaaaggcgatcacggcagaggcagttgcagaggcaggttatgattccctggatgcggcagctgaagacggtaccgcatttgtattcatgggacatggaaccgctcataccgcgaaggtaagctacagccagatggcaagtgtgatgaagaacttaaactacgcgaatgtcttcatcggcactgtggaaggagaaccggaagagactgcatgcgaggcagtgatcgaggcagtcaaagaagccggctacacgaaagtggtattaagaccgctcatggtagtggcaggagatcatgccaacaatgatatggccggggatgacgatgattcctggaagagcatgtttgaggcggacggatcttttgagagtgtaacatgccagatcgcaggtcttggaagaatcgatacgattgagcagctgtatgtatcccatacgcaggatgcgatcgatacgatcggcagcgtagataccgcagcagcggcaaccacaacaggaaatctggaggacggcacgtacagtgccgtcttcgacactgacagcagtatgttccatgtcaatgaggcatgtgccggacgcggcacacttaccgtcaaggatggcaagatgaccattcacgtaagtcttgtgtcacagagcatcgtgaatctgtatccgggaacagccgaggacgcgcagaagagcggagccaagctgcttgagccgacaaaggataccgtgacctacagtgacggaacatccgaggaagtgtacggattcgatattccggtggaagcactggatcaggaatttgatctggcaattattggaaccaagggtgtgtggtacgatcacaaggtgagtgtatccgacccggttgcggagtaagagatgaagaagaaagtaacagaactgatcgtatgcctgctatttgtgatctgttttctcacagcgtgccacgcgccgcagaatgaaaaactggcggacggaacctatcaggcggacgttacgctcaccggcggcagcggcagggcgacggtggactcaccggcggcgattacggtgaaggacggcaaaatatatgccaccattgtgtggagcagcccgtattatgattacatgatggtagaggatgagacctattacaatgaggcggaagcaggagagaactcgacgtttacgatcccgcttgaaaaactgccgtgtgagatctctgtgatcggagatacgacggcgatgagcgtgccgcatgagattgagtacacgctgtcatttacgttaaaagagacggacttttcggaactgacgaagacggggcagtgggatctttcttatgccacgcagtaccaggtggagcagtacgggaagtatgatctgattacgatcgctgacagccggtttttgctggtgccggagaatgttccggtaccggaacatgtgccggaggatgtggttgtgttaaaacagccgctggatcacacctatctggtgtcctcctcggtgatggatatgatccgtgagatcggagcgctttccgacgtccggcttacgggagtgaaagagtctgactggtatatagaagaagcggcatctgccatgaaaagcggtagcatgctgtacgcaggaaaatataatgaaccggactatgaactgatattaaaggaagggtgcaactttgcactggagaacacaatgatcggacataatccggaggtaaaagaaaagctggaaagccttggcataccggtcatggtggaacgttccagctatgaagagcatccgctcggaagactggagtggatccggttatatggtcttttgtatggaaaagaacaggaagccgatgcattttatgaagaacagcttaaaaaaatagaaccaatcatggaaaaggaagatacaggccgcacggtggcctttttttatatcacggcgaacggagcggtcaatgtccgcaagccgaatgactatattgcgcagatgatcgggctcgccggcggtacctacgtcctaaacgaccgtctttcggcggaggagaatgccctgtccacgatgaacatgcagatggaggatttttatgcggcagcgaaggacgccgacatcctcatctacaacagtacgatcgagggggagctttacagtgtcgatgaacttctggcaaagagcacactgttttctgattttaaggcagtaaaagagggaaatgtatactgtaccggaagcaatttctttcaggaatcgacgggtacctgtgatttcatcgaagatctgcacaaggtgcttgcggatgagacagacgagaattatcggtttttaaaacacgtgaggtaagaatgaaacggtatgtgatagcctttggcgcgatgatcctgctgcttggcgggttgtttttctttaatatcggttccggaagtgtcaagatgacgggaagtgagattgcggacattctgctgcaccgctttggcagcacggcggatgagacggcgcggcagattgtctgggagatccgcctgccccggatctgtgcggcagttattctggggggagcgctctcagttgcgggatttctgctgcagtcattttttcagaatccgattgcgggtccctatgtgcttggcatctcatccggggcgaagcttgtggttgcgctgacgatgatcacccttctggaaatgggcaggacgatcagttcgctcggcatgattgtggcggcgtttgccggatcgatgcttgcgatggggttcgtgctcttaatttcctgccgggtaaaaaaaatgtccatgcttgtggtatgcggcattatgatcggctatatctgttcggcaatcacggatttctgcgtgacgtttgcggatgactccaacattgtgaaccttcacaactggtcgatgggcagtctctccggaatgacctggtcgaatgtgcggatgatgacagcggtggtggcaatcacgatgggagtgaccttttttctggcaaaaccgatcggtgcgtatcagatgggcgaggcgtatgcgagaaacatgggcgttaagatccgtctgcttcgcgtattgctgattctgctgtcgagtctgctgtctgcctgcgtgacggcctttgccggaccgatctcctttgtgggaattgcggttccgcatctggtgaagacggcgatgaagacggcgaaaccgcttctgctgataccgggctgttttctgggcggggcaattatcacgctgttttgcgacggctttgcgaggacggtgtttgctccgacggagctttcgatcagttcggtgacagccgtattcctggtgccggtagtgattgtgatgatgctgcgcaggaatgaggacaggtaacggaggaacgtgtgatggaacagaggaaaaaagagtctggaatcaggcttgaggatgtggcggcagggtacggcagaaaatctctgcttaaccatatttcactgcatgtaagtccgggaaatgtcctgacgctgatcggaccgaacggtgcgggcaaatccacgatattaaaaaccgtgaccagacagcttgcagagcttggaggaacgatctttctggaggggacatccatgagccggatgcgggaagaggaagttgcacggacgcttgcgatggtgatgacggagcggcttcatccggaatttatgacctgccgcgaggtggttgcgaccggcaggtatccgtataccggaaggctcgggattctctccgcagaagactggaagcttgtggatgacgccatgcagctggtgcatgccagggacaccgcggaccggaatttttcacagatcagcgacggacagagacagcgggtgatgttagcacgcgccatctgccaggagccgcggattctgattctggatgaaccgacttcctatctggacatgcgttacaagatcgacatcttatccagtatccgaagactcgcggcagaaagaaatatggcggttgtcatgtcgctccacgaactggatctggcgctaaaggtatcggatgtgatcgcctgtgtggagggagaccacatcggaaaaacagggacgccggaggaggtattttcgggtgattatattcagaaattatacggtgtggacgcggagtgttttgatccgcggacaggagctgtgtatctgcgcggaaataagagccggccgaagatctttgtgatcggcggcgcgggcagcggcataccggtctatcatgctttacagcggaaaaatgtgccgtttgcggcgggaattctgatggagaatgatgtggaatatcaggatgcgtgtgccgcggcaagccgggtggtttccgtgaagccgtttttcccggtcgcagagaaggagatcgcggaggcgagatcgtggattgagacgtgcgaaacgtgtgtctgttgtgcggaagctttcggaccttacaacgaagcgaaccgcgcgctgcgcgagtatgcaaaaacactcggaaagctgattcctgtagaggcacagcagaatttgtagaaaatatgaaattgtggttgaatgtgggggatggtgtgtgaattggggatagcaggtgcgtcggaaaggtaaatgtatcgggaagtgcatgtgcaccggcggcagagaaagagaggtgcgcgatggagcgtggcatattggtcgtgagctttggaacgacttatcaggagacaagagaaaagaatatcgatcacatggtggcgcttgtcagagagcagtatccacatgatctggtggaggaggcgtattccagcagcactgtgaggaaggtgttaagagagcgggacggcatcgcgaaagatgatgtgaggcaggcgctttgccggatgcgcgatgccggggtgcggcgtgtgatcgtatttccgacccacatcattgacgggattgagaaccaccggatgaagcaggaggtaacagactgtgcaccgtggtttgaggacgtccggattgcggatgcgctgcttaagacaccggaggattatcagagaacggcggaggctctctggaaatcggtggcggcggaggcgggatcttcgccggtgatttttatgggtcatggaagtgagcatgcggcggatgagagctacgagcgtctggaatgtgtgcttgcacaggtgacagagaacgacgtctatgtggcgaccgtggagggaagcgttacgattgacgatgtgatcgggagaatgaaggtctcaaggcataagagcggacgcgtgcttgtggcgccgtttatgatggttgcgggagatcatgccaaccatgatatggcaggggagaaggattcctttgctgccgcactccgcgaggcgggatatgagccggtctgcctgttgaaggggattggagagtatgagccggtgagagagtgctatttcaggcatctgcggcactgtataggaaccctctacgggatcggtgtgggtcccggagatccggaactggtgaccgtaaaggcgctccgctgtatggaggagagcgatcttatcgtgcttccggtggcggatccggcgggatgccatgcgtatcagattgcaaggaaggcgtaccccgggattgagaaaaaggaacttgtctgcctgccgtttccgatgacaaaggaggaagaaaagctgcgcagggcgcacgaggagatttttgcgcggattgcttcttatcttaccgaaggaaagattgtggcatttttaacgatcggagatccgtccgtctattccacatatggctacattcaccgcagaatcgcggcgtggggcggcaatgttaaaatgataagcggcgtgccgtccttttgtgcggctgcggcgagtcttggaatatcgctcggggataaccgggatgagatccatgtgattccgggatcgtacgaggtggaggagacgatggcgctttccggcacccgggtgtacatgaaatccggaaaaagcctcgcgcggctgaaagcgctgttggaagaacagcagaaggagaagaaactgtccgtctactgcgtggagaactgtgggatggcggatgagcggatccgcctgggagcggaggcgctcgaggagaacggaagctatcttacgacgcttattgtcaaagatgagggagaggtggtataatgacagagaattcatatcgctttttttccaaccgggaatgtcagtattatccgtgccatgagggcattgaggagatgaactgcctgttctgctattgtccgctctatgagagacgtcattgtccgggaaatccggagtatattaagagcagacgggagaatggaagcgaagtacagatcaagtcctgcatgaagtgcacgtttccacatcaggcggagaactatgatgtgatcatgcagtttttgaggaagggagatagataggatgaagagagtatttttgattgtattggacagcgtggggattggcgagatgccggatgctgcagattacggggatgcgggaagcaacaccatcaaagccgcgtccatgagcccttatttttccatgccgaacatgagaaagcttggcttttttaatatcgacggcgtggagatcggggaaaaggaggcagctcctgccggagcggttgcccgcatgacggaagtgtcaaagggaaaagatacgacgatcggccactgggagattgcaggcgtcatctcaccaaagccgctgccgacctacccgaacggtttcccgcaggagattattgaggaattttccaaaaagacagggaggggcgtgctctgcaacaagccgtattccggtacggacgtcatccgcgactacggggaggagcatcttaagaccggagatctgatcgtgtatacatcagcggattccgtgttccaggtagctgcacatgaggacatcgttccggtggagaagctgtatgaatactgccagatcgcgagagatatgctgcgtggagagcacggtgtcggccgcgtgatcgcaagaccgttcaccggaacgccggggaacttcacccgcacgacccgcagacatgatttttccttacagccgccgaaagtgacgatgttagaccagctctcgggagccggctttgacgtgctttctgtcggcaagatcatcgatattttcgcggagaagggcatcacggagtatgtccgcacgaccggaaatgaggacggcatcaacaagacgcttgattatatgaagaaggattttaacggactgtgctttacgaatctggtggattacgacatgctctacggacaccgcaatgatatcgagggctacgcaaaagcactgacgtacttcgatgagcgcctgccggaacttttagcagcgatgggtgaggaggacgtgctgatgatcacggcagatcacggctgcgatccgagtacaccgtccacggatcattccagagagtatacgccgcttgtgatgtacggagcaccggtgcgggcaggggagaatttcggaacaagaaagagcttttccgacattgcagcgacaattctgtcctactttgatctcaccccggagtgcgcgggcgaggcgattccggtatttaagaaatagtacagatcttcggaagagaagtttttgcatttttcatgaaattatgttatagtgccaacgtatgcaaagtttcggctttgctgcgttggcatttttgaagtgatttgttttttggaggatagatagtttggctgatttaagaaaagagattgaaaagagacgtacgtttgcaattatttcccacccggatgccggtaagacgacgctgacggagaagttcctgctctatggaggagcaatcaatctggcgggttccgtcaagggaaaagcgacggcgcgtcatgcagtgtccgactggatggagattgagaaggagagaggtatttccgtcacgtcatcggtactgcagttcaattacggaggttactgcatcaatattcttgatacaccgggacatcaggacttctcggaggatacttaccgtaccttgatggcggcggattctgccgtcatggtaatcgacggttccaagggtgtcgaggcgcagaccagaaagctgttcaaggtctgtgtgatgcgccatattccgatttttacattcatcaacaagatggaccgcgatgcgaacgacacgtttgatcttcttgatgagatcgagaaggagcttggcattgcgacctgcccgatcaactggccgatcggttccggtaagaattttaagggtgtctatgaccgcaacacaagagagattatgacgttttccgatacattaaagggaaccaaggaaggtacggagaagcatatttccgtggacgatccggcgctgattgcagagatcggacaggatgcgtatgataagctgatggaggagatcgagcttctggacggagcgagcgcggagtttgatcaggaacttgtgacgaagggagaactatccccggtatttttcggttcggcattgacgaatttcggtgtggagacttttttgcagcatttcttaaagatgacttactcgccgctgccgcgcaaggcggatatcggagaagttgatccgtttggtgaggatttctctgcgtttgtattcaagattcaggcaaacatgaacaaggcacaccgtgaccgaattgcgtttatgcgcatctgctcgggcaagtttaccgccggcatggaagtgacacatgtgcagggcggcaataaaaagatcaagctttcgcagccgcagcagatgatggcgcaggagcgtcatatcgtggacgaggcgtatgcgggagacatcatcggtgtgtttgatccgggtattttttccatcggagatacactcaccacggcgaagccgtttaagttcgagggaatcccgacgttcgcaccggagcattttgcgagagtgcggcaggtggatacgatgaagcgcaagcagttcatgaagggcatgcagcagattgcgcaggaaggtgcgatccagattttccaggagtacaatatgggaatggaggaggtcatcgtcggcgtggtcggtgtactgcagttcgatgtgttgaaataccgcctcgagaatgagtacaatgtggaaatccgcatggatacgcttccgtatgagcatatccggtggattgagaatgaggacatcgatatggataagctggtcggaacctcggatatgaagaagattcaggatctgaagggcagaccgctgttactgtttgtcaatgcatggagtgtcggcatggtattagaccggaacgaaggtctggtactctcggagttcggcagggaatagagcgtgtgtcagagcagctgccggcagaaaacagtgccggcggaatgcacagaaaggaagcagaatatggcagttgttacaattacaaatgaaaattttgaggacgaggtgctggcggcaaaggtgccggtcattctggatttctgggcagagtggtgcggaccgtgtaaaatgcagtcgccgatatttgaggcgctgtccgaggagcttgccggaaaggtgaagttcggaagcgtcaatgtggacgagcaggcggcgcttgcgttaaagtatcaggtgatgagcattccgatgctcgttgtgatgcagtacggcatttttaagaaaaaagcgatcggactgcagacgagagaggaaatcttagatctgcttgcatgctgcgaagcagaatagataacaaagcgtcagagaaggaaagcgccgcaataagcatagagtttttggggtgataagtaatattatcagaaggtctgagaacaaaaaagttccagaataaacagacggcggcaaattctttgaagcaaaattcacgtatttcttccgtgccgcagctggcatcccgttccgtgtcttggccacgtttggacactcacggagtgtgtccgacaagccgcagacaatgagcggactttctggtgtccctaatggcacctcttcacagacaatataaaaccgcgcgaaccgaaactcgccggcatctgctattgaaaataaggcagatgccgactcagacatcggcttcgcgcggttatgttttgttcagaggtgccaataagggacacacaaaagtcctaaaattgtctgctggcctgcggacacagtccgtgtagtgctccaaacttggaaagacacggatcatcgaggatgccagttacggcatggttagaaataccggattttgcgttcagaatttgcctccgtatgtttatctggaacttttaagtatctaattcttgtaatattacttaccaacgcaaagcgcgatatgcttattgcgacagtccctttaaaggttctttccggtgtaggcagttttttctgcgtgcatttccatgagaagacgtggaatcgtccatccggcgtttgtgggcgtgagtacagccttgtagtcgatgggggcgtcgatgcggcgcagttcaaacagcagcttgtccatccggcgctcgggcagctggcacatgacgagcagacggtcgcgggagacggctgccggagtgctgccggcttcgggtatgccgcaggcagcggaaacggcggaggcaccggcaggggcatctgcgcctaaagcagccgtgaggctggcggggacaggtgtgccgggagcggcggggatgccggcaggaaccgcccggccggatgcgattgcgccgagcgtattgtggtacatcgaaacgggaatctgctcgcagtgcagtttcagccgggatgcaaccggttttatcttttgaaattcagtgtcggtaagtccgaagaacaacagtttttccatagatacctccagaaatcagatcgtagttttgtcagaggtcattataacacagatttgcaggaatacaacgaaaagcaatgtgagaaaatgtccggttttccggtaatttctgattgcggatatggggcggatatggtagtataaggcatacccgtttttggaggggcgtctttttatcaaatcatgcaggcagggaagtcctgctgtgcaatcagggctgctggagcggtcatcaggcggtatccgccacggaattcattgaggtgttacttatttttcgggtttgtggttgacattttcccggaagtatactactattagaacagaaaaacgaacataagttcgcaattcgcgcgcggacggttcgcatggaggaaagagaatggctaaggacgataaactgacaagggatgagagacctacgacaaaggaagagaagttaaaagcgcttgacgcggcgatttcacatattgagaagcagtacggcaagggatcggtcatgaagctgggcgataattctgcacacatgaatgtggaggcggttccgaccggatcattgagtcttgatctggcgcttggaatcggtggtctgccgaagggacgtatcatagagatctacggaccggaatccagtggtaagacgacggttgcactgcatgcggtggcagaggtacagaagagaggcggcatcgccggatttattgatgcggagcatgcgcttgatccggtctatgcgaagaatatcggtgtcgacatcgacaacctctacatatcacagccggactgcggggagcaggcgcttgagatcgcagagacgatggtgcgttccggagcagtcgatattgtgattgtggactctgtggctgcgctggtaccgaaggcggagatcgacggcgatatgggagattcccatgtgggactgcaggcgcgcctgatgagccaggcgctccgtaagctgacatcgattgtcagcaagtcgaactgtatcgtcatttttatcaaccagctgcgtgagaagatcggcgttatgttcggtaatccggagacgacgaccggcggtcgtgcactgaagttctattcttcggtgcgtctggatgtgcggagagtggaggcgttaaagcagggcggtgaggttgtcggcaaccatacgcgtgtgaagattgtgaagaacaaggtggcaccgcctttcaaggaggcggagttcgatattatgttcggacagggtatttccaaggaaggagatattctcgatctggcggcggatgccggcatcatcaacaaatccggtgcatggtatgcctacaacggcgagaagatcggccagggacgtgagaatgccaagaactacctgaaggagaatccgctgatctgtgaggaagtggaagcgaaggtacgtgcaaagtacagccctgaggaagatgaggctgcagaacagccggatgagaagagtgcgggaaagacaacaggacgtactccggaagaactgccggcagaataaggataggagtgcaacagacagatcatgcaggaagtccaggtaaaggaagtagccagacgtgagaagggacgggtgtttttccggtttgacaacggaaccgaatttacactctaccggagcgagatccggggactgccgcaggcacagagcatgcttttgatgacggaggatgcgtatctgccggtatcactatatgagaagattctgacggagattgtcggaaagagagccaaaaagcgtgcactgtttctgctggagcgtatggaccgcacggagtcgcagctctgtgaaaagctccgccagaacggttatcccgaggagtgcgttgcggcggcggtggagtatgtaaagcagtatcactatatcgatgacctgcgttatgcgaagcagtatatccgctatcaccagcagaagaagagcagccagcgcttaaagatggacctcatgaaaaagggggtagggcgggagcagattgagcaggcactcgcggaggagtttgtgtcggatgagcgggcacagattgcggagcttttagagaagcggcactacgatgcggcgcaggcagaccgcagggaacagcagcggatgtatcagttcctcatgaggcgcggttttaagagcagtgatattcttgcagtgatgtgcgaagagcattttttcgacgaattttaaaataaatttcagtacaatatcttgtatttttgtaaaaatgaaatgcaatattatgcatattgtacagttattcacttgacataattcatgaaatagaataaaatttatgtgttgtaatttatgacagataacgattatatttttatgttatatgtgttatatgtacaatgaaaacttaataaaggaggtgctcctgtggagacagtgattgctgttgttgttgctatcgcagtgactgccatcgtggtctattttgttacatctgcttaccataagaaggtgacggaagccaagattgggaacgcagaagagaaggcaagagagattattgatgaggcggtgaagacagcggagaccaagaagcgcgaggcaatgcttgaggcgaaggaagaatccattcgtgtgaagaacgatctggataaggaagtaaaagaacgccgggcagagattcagcgcagcgagcgtcgtgttgtacagaaggaagagaatctggacaagaagcttgagtcaatcgagagacgcgaagcgggttttgctgcaaaggaagaagagatcaacaaacagaaagcgcaggtcgcaaagctcaatgaagagcggttacaggaactggaaagaatctccggattaacctccgaacaggcaaaggaatatctcttaaaaaccgttgaagaagatgtaaaacttgatactgcaaaattgatcaaagaaatggaacacagagccaaggaagaggcggacaagaaggcaaaggaatatgtggtgacagcgattcagaaatgtgcggctgaccacgtcgctgagacaaccatttcggttgtccagcttccgaatgacgagatgaagggtagaattatcggacgtgagggacgtaatatccgcacgctcgagacactcaccggtgtggatctgattatcgatgatacaccggaggcagtaatcttatctggatttgacccgatcagaagggaagttgcccgcattgctttggagaagctgattgtggacggacgtattcatccggccagaattgaggagatggtcgaaaaggcacagaaggaagtcgagacaatgatccgtgaagaaggtgaggctgcaaccttagaggttggagttcacggaattcatccggaacttgtccgattgctcggcagaatgaagttccggacgagttatggacagaatgcattgaagcattccatcgaagtagcccagttatccggattgctggctgctgagatcggtgtggatgtcagaactgcaaaacgtgcaggtttactgcatgatattggaaaatcagtagatcatgatatggaaggttcccatattcagattggtgtggatttgtgtagaaagtacaaggaatcaccgattatcatcaatgctgtggaagcacatcatggtgacgtggagccggagtctctgattgcatgtattgtacaggcggctgatacgatcagtgcggcaagacctggggcaagaagagagacattagagacctactcaaacagattaaaacagttagaggatatttcaaacggatttaagggcgtagagaagtcatttgctattcaggcaggcagggagattcgagttatggttgttccagaacaggtcagcgatgcagatatggtattgatggcacgtgatatttccaagaagattgaagcggaaatggaatacccaggacagattaaagtaaatgtaattcgtgaatcgagagtaaccgactacgcgaaataacaaagagagcagagaaaagttgtcgcataaccgagaaatcgtgaagcggcagcttttttcatttcataggaaataccgtgccgccttcatgtgtgaaagcagaaccttcctatgaaataaaaaacgctccgcgaggatgcgcagctcgcggtaaggaaaatatcgctttgcaaaccgctcgcgcgcggagaatctcgcaagcgagattctttttcataggaaataccgtgtgatgttaaagcgtggaagatgtttcctgtagggcaaaatgcttcgcggaggccgcattgcggcgaaggcggggatgttatatcagatgcagaatagaaaggatgggtaatatggatcagcaggtaaagagagtcaagagagaactgataaaacatggtgcaattctggatatgtatgaggataccatggaacttccggatggaaagcaggagacatgggactttatctcacaccgcaagggagcggcggccgttgtgccggtgcgcggggatggaaagatcctgatggtaaagcagtaccggaatgcgatcgaccgcatgactctggagattccggcaggttcgcgcgacagcgtgacggaggataccagggtatgtgcagcaagggaactggaggaggagaccggctattgcagcgacgatctgaccagaatcttatctcttaagacgacagtcgcattctgtgacgagtttattgatgtctatctggcaaaaaatttaaagcccggacatcagcatctcgatgagggggaatttattgatgttgccgcctacggggtggatgaattgtgcgatatgatctatgcgggaaccatccaggatgccaaaacggttgccggaattttagcatataagaatctgctgaatcaggactaggagatccgcataaatataatacagaaaagatatgagcggagtgcaatgtttgaagcgagaaggatgtattgtgatgctggcatttctgggcggaattgttctgaccaatctgcttggcgcaaatcggcagatacatggacagctgctgaatcagacatttctgcaacagtatgcttatcaaaaagtggatgggaatcagctgtttggtcatgtggttatggtgcgcatgcagatgctggttctcatctttttgcttggaagagcggttgacggaaaggtgttttccgtgctggcaaagagcatgctctcagcaggattcggattcctgcttgttgtcggaattatggaatacggaggatatggctgcctgatcattcttgccggattgctgccgcagtggattttttatacggcggcgctgcttttctatgcgaacagtaagaaaagacagagcagaatcgtgggatggaacagctggcaggatcggacgcggcagctggcggaagcggggcttgtgacaggctgtgtgttattgggaacgtttgtggagagctttgtcaatccggcagtattcgcctgggttttaaaaattttttgctaaaatttttaaaatgattacaatatatggtacggagaaaataagggaaacgagatgttgtagtttcgctctaaatgcccgaattataagggaaaaatgcgattgcttttcggtttggttctgattataatgaatgatgtaccgcgtttgcggtacatttttcgatagagaagaaagccgcatacagcggagcaatgcagtgaacaaatgagtggcggggcaggtaaaagttatgacgcaggacatacagaatttcattcaatatttacatcaggagaagaatacctcagagaacacggaggtttcttatgcgcgtgatttgaagaaaatgaatcagtatcttctgacgcagggaatctgcgatgtgaatgaggtgacggctacaagtctgacatcctacgtcatctatctggaaaaggaaggaagaaagcctgcgacgatctcgcgaagcattgcgtccatgaaggcgttctatcattatatggagaaggagcggagactggcagtagatccgtccgagcgtttaaaggcgccgcggattgagaagaaaatgccgacagtattgacgacggaagaggtgacgcgccttttggaacagccgggaggtacatcgccgaaggaactgcgggataaagccatgctggagttattgtatgcgacaggcatccgtgtgtccgagctgatttcactgagggtgtcggatgtgaatctgcggatggagtatctgatctgctcggatggacataaggaacggatcattccgtttggaacgattgcgcgcaaggcactggaagcttatcttgcagagggcaggccgaagcttatatcagatgagaaggaagaccgcctgtttacgaactgttccgggcagccgatgagccgccagggattctggaagctgatgaagggctacggcaaaaaggcgggaatagaagcggagattacgccgcatatgttgagacactcctttgcggcgcatatggtcggcaacggggcggacttaaaatcggtgcaggagatgctgggacattcggatatttccacaacgcaaatatatgcgcaggcgaaagatctgcagatgcgggaggtttatctgaaggcgcatccgcgcggataagaagacgggatataaaagagatatataatagaaaaagaatataaaaaagaagatagaaaagaacataaaaagaggtgcagccacatggtttgtgtggctgcacctcttttgtttcataggaaataccgtgatacattcatgtgtgaaagtagaaccttcctatgaaataaaaaacgctccgcgaggatgcgcagctcgcggtaaggaacatatcgctttgcgaaccgctcgcgcgcggagaatcccgcaagcgagattctttttcagaacgtgcgttagcggcacatatctgcaatggtatagatcagatctctggaatcctcccagccaaggcacgggtcggtgatggatttgccatagatgtgatcgccgattttctggttgccttcctcgatatagctctcgatcataacaccttttaccatgtgttcgatatcggaggaaacctgtctgttgtgcatgacttcctttacaatgcggatctgctccttgaatttcttgccggaattggagtggttgacatcgaccacagcagccggattgacgagatccatttcctggtacatctcgcagagtcggatcagatcttcgtagtggtaattctgtgtggtgttgccgtgcttgctgaccgcaccgcgaagcacaacgtgtgtgagcgggttgccggttgtctcgacttcatagccgcggtatacgaagtggtgtgggtgctgtgcggcgtagacggaattgagcatgacggaaaagtcgccgctggtcgggttcttcatgccggaagccacatcaaaaccgctcacggtgagacggtgctgctgatcctcgacggaacgcgcgccgatggcgacataggacaacaggtcttccacatagccccagttctccgggtagagcatctcgtcggcgcaggtaagaccgctttcctcgatcgcgcgaatgtgcattttgcgcatggcgatcagtccctcaatcatgtccggcgctttttccggatccggctgtgaggcaatacccttataaccttcgcctgtggtgcgtggtttgttggtgtagacacgcggaattagaatcagcttgtccgcaacatcctcctgaatggaagtgaggcggctgacataatcacagacggaatcttcgttgtccgcggagcaaggtccgatgatgacgagaaaacgggaatctgctccggtaatgacggcgctgatcgcagcatcacgctctttttttaacgctttcagcttgtcggaaagcggatagttctgtttgatttcggccggtgacggcagttcgtttaaaaatgtaaaactcatatgacattgtgtggataaggaaaagacaccgcacactcctcgtattataaagtagtagtgtttatagaccctctccaaggtctgtatgctatacttttggagatactgtggattgttttcacactcctaccacttgatggtttaagaaaggctacaaccacagt

SEQ ID NO: 20 - DNA, 32963 bp, Roseburia hominis
ccggattgctggcagaatctgatgtttctggcatggcgtctttgctgctgcaggcggacattcctaatacacaaaccgtcatgaaaataaaaagcaatgctctcttcatatgaacacctcctcaaatcccgattgttctaatcttttttacgcccaccttcttgcccttcggacaagaagtatccctcgctcaaagagctcggtcaattccgattttctcaattctccaaacttgaatttgtcaaagaggattattccaatattccacagtatttctatttacatcataaaaagtaatattacccgcatttataggcaagacaatcgcaaaaggtttattgcggtcaatatcaaccacttgaattgtgttgccatcatctatttcaagttgttgcacctgctgttgattcatagaaataaatgctcgttcattatatccctctacagtaaactccacaattcctctttgaatccccgaaagagttccacctccacggaaaaaatatccgaaggaaagtcctggacgattgacatagacggaaaaagtgtggtcgctcatgtcttgagaataagaaatataagcagccatcgtgttagaaacgcttccatcgagcgtccaatcatctttaatcttctgcgatgaacgaatatccgtttccaaattggtcgaagtcataccgatgttattgtttgcataaagaaatccaacgaataaaatgcaaactaaaacaatccctatcacaattttaagaaatctctttttcatgctatcaaaactccttgccaaattccgatttgttgtcatcttcattatacttcatcgcctatcgaaaagatagcgtattttatgaaacttgtcggctgggaacaacttgcaacgcaaagtgtccccagatggcaagtccacaaaagggtagctggctgcagccagcgcaggggaagtgtagcgtcccctgtatgatttggagcagaccatgactgcggaaaatcacagccctccggcgaggagccttcggagaacgcaatgcaccaacctctgggtggtgtataattgcgcccttagtaaactaaggggtttccggcttctcccgttccagcagttttttcaatagttcctgcgtgtcctgcctgtgaaaaatgagtttcaacaacagcatgacatcatcatctgtcaggcgttccggctcttgcagaaaactttccagcataccgccacgggtacagagccggtgcgtccgttcctttcgggtaagctgctttaactggtgctgcaatgccttttcatcattgatggctttccgcagtttcttttcgcttttctccagctcccggtttagcttttccagctttgaggtatcaggcaagggcagcgtcctcctttcccggtatcagcacataaatcctgtttggctctccaacgccctgacgcacccgcatgatcagtccggcggtttccagttcattcagagaacgcttgaccgtcatggggctgcgggacaggactgcggcaatgactgtgacagggaagcagacaaacaggattccgttctcatcctcctgccctttggatagcatagcgtccagcatccggcagtacatgacctttgcggtgctgctgactggaaatcctgtcaacactctgggaaatggcatacagggcggcaatggtgtgtctatcgtcataaattcaaaattcattctgtgtgttcctcctttttctttgctcgtttggataaataatgagggcagtcaatcacaaccgcccggaagctctgcctgcacccatgctggcatttccggcataattcgttgtaagtgacacgcccccggtcattgaggtaaaaggaaagctcatgcttcctctttttgctcattctcggcatattgcgcttcctcccgtttttgtgtatggtttcggggcgattttcggaaaaattatagccatagagccgcctaaaatctcccgaagtatcagcgatagggtagactatccccctatcagattgtcgtgtttcggtatcatttcggtgtcagttcgccagttctccccggtgtcgttcctcccctgaatctcacagcggcgtatcgctccctttggtatgctcgtttcggtcagggttcctccacatccctgccaaaagtcatggcactacatcgccggggaagcatatcccacacaggctggtcattcgattggaataatccatcgatgaactacctgtatcatagaacatttttgtgccctatgccgtatgtccacaaagtaggaattaggggtaaaattcagaaatttccacgattgcggaattgatatggtataatcaattcaacggttataaatgttgtcagaagggggaactgcttcaatgaacggagctactacaatacaggaacggctaaaagatttacgattaaacaaaggattaaaactggaagaactggcagagcaaacgggtatttcaaaatcagctcttggcagttatgaaaaagatgactataaggaaatcaatcatggcaaccttatcctgctggcagatttttatggggtgtccctcgattatctcttttgccggacagagaaccgggcggagatcaacacgccattaagggagctgcatttgagtgatgagatggtagcacttctgaaaagcggtcggattaacaaccgtctgctgtgcgaacttgctacacataaggattttatcaagtttcttgcggacattgaaatttatgtggatgggattgccaccatgcagattcagaacctcaacgcccttgtcgataccgtccggcatgaaatcattgaacggtatcgccccggcgaagatgacccgcatttgaaagtgctgcaagccgcccatatcagcgatgatgaatatttcagccacatggtgctggatgacctcaacctcattatccgggatattcgggaagcccataaaaaggacagtgagagtgcgccccagaccaccgttgccgatgaactgaaagaaaatctggaagcggtcgaaaactttaagggcagccgggatgaaaagctcgttgtcctttactgcaagcagcttggtatcaactataaaaatctgtcagacgaagaatttcgctggctgattcggattctcaaaaaatcaaagaaaatgggaacgcctatcagccagaggaaaaaacgataaagaaaaaccgctgttgcatggttgggatgccttccatgtagcagcggttcttactgtggttattatttcattcgttttcttaatatccggcgataatttgtttctccctttggtgcgtcctgtataatttccaacacaccatcttcaagcattttatcaatgcgattggaaatccatacatcactaattccaagttgatattttcctaaaacattacctatgacaatagccattttgaattgttctggctgttccgcaatttcacgaagaatgaaactatcatatatatcttctgaaacgctttgcaatttaccatttaacattgcacgcaaaggtgcattttcattttgaagttgattccatttcatagcgcaagctgaaagaaatacaggctcagctttctcttgtagagttatataatttccccattcgccaggagacacctcaccccatgatattttagatgtcatagcattttcttttccatattcccatgtaggtaatttaaccaaataaattgttgtctgacagtttaatggtcgaagttgtttcataagccagtacataccgcaaagttcatccggattatagctataccaaatgcgaacttcttccccagctacatatcgttcaataactgaggacaatgtagttttaattttctgtattttttcttcaacctgataatctaaatcctctacaaaccagacagacagcattttcttgagaacatttttcctctgttcgccaatttcattatcagaaatatctcccacactaagagccatatcaaaacaataaacatcactgctcttgcctcccaatggaatagcattttcccaagcaatacattcttgttcttgtgcttgaagttgtgcttctttcatttcatttgaagatggaacactcccgttttcgtgccttataaataccgaaattgcacttcctctatattttcccctgccgtaagtttgggcaattttcaaacttccacaggcactctcactaaatacaatttcaaccatctgatatacctccgatttaattgctcctgtttatgaataaatcatctcatgcaaaacaatttcttctgcccggttatggatgttattacatcgttgtacccattccatttgacaggtacgctttaattcctctgtcacgccctcggtagctttcatctgctccataatagtgtctaaccgttcctgtgcctgttcgttcaggtctgcaagatatgtccacaattctccggtcagtatcaatgtattcaatctgactgggtggacttctcttaaatattcccggtgcatccgtccgtactttccgatagggcggtgttcctccggcagtttcaagtccgggatgtagtaatctccgacaaggatataatcaattccgttttccgttattcttggtttcaattcgctcatgttccttacctcctgtggaagcaggctcgtctggtactaactcaatcacatcggtaatctcacaattcagcgtttcgcagatacgggctaatgtatccatgctgatgtgctttccctctttgctcatgttggcaatcatatttgttgtcataccagcggcaagccttaaatcctcttttctcatatcacgctctaacagtgtgtgccagagtggtttatagctgatgtgcatattgttttcctgcctttctatccataccaccggggcggctgccccggcaggaacttttctcttattataacaccaatcttgtgaaatcacaatttattcttgtaacctgccgctgataccgtctggattgtgcttttcctttctttttgttacctttaattagccatgaactgtttcataccctggctttttggttgtgtgagataaagaagcaatagaagtgtaaaattttttgccgttcctatccggcacttgcgcattgtgccagacaggtcgggcattattcgggcaagtctaccttgccgacaaaagaataatagatttcaatttcctgcctgcggtttttgttctcgtcatagctgcactcatgcactacgattttctcgataaactcccgcagcagggtaggggtaagttcctcgaagctggtgtacttgcggacaatgttcataaacttctctgcgtttactgtggcttcctgcgcctttgcaagttccccttgcagttcggcggctctctctttaagctgccgctgctccgcttcatagtctgccgacaactccgcaaaccgttcatcagaaatgcgcccggtcacgctgtcctcataaagccgcttgaagatagcggacaactcggctatgcgcttctcggttgcgtccagttcctttttcttggcggcgttcctgcgcttgcccccgtcctcgttctgctcgatcagcagcttcataaactgcttttcgtgccttgccgcatagtcggtcactttccgcaggttggcggtcactccggcggtcaaaaggtcggtgcggataaagtgcgccgtacagtccttgacacgcttcttgtagttcccgcagatgtagcaatcctgccgccttgtcttgttctcatacctctgctggtagaggacgctgccgcagtcggcgcagaacagcaagccggagaacaagcccacttcatcatagcggttggggcgtttgcgctgcttgcgtaactcctgcacacgctcccatgtggcaaggtcgataatcggctcatgggtattctcgaataccgcttgcttttcctccgggttttctacgctggacttcactttgtaagagattttctcggtcttgaagttcaccgtatgccccagatactctttgcgttcaaggatatggacaacggtatttgtcgcccatctgtaagggtaatcggggtagtagcggcgggtgctgcccgtcctgcggtattccagcgtccccggcgtggggatttcctgctctgtgagcatacgggcgattttggtcgggccgttcccggcaaggcacaagctgaaaatctgcttgactaccggggcggcttcctcgtcaatgataaagcgtccgtcctcgcctttgagatagccatagacgggctggctggtaatgggcttgccgctcatgcccttgcttctgaaaactgccttgattttcctgctcgtatccctcaccatccattcgttgaaaagattttttagcggcgttaggtcgttgtcgccctgtgcgctgtccactccgtcattgatggcgataaagcggacgcctttcttggggaaagtgatttccgtaaacattccgacttgcagatagttcctccccatgcgggataggtctttggtaatgacgcattttacctcgccattctccacgcaatccatcatctccataaagcccggtctttggaaattcgccccactccatccgtcatcaacgaaaaaacggtagttcaaaaatccattgtcacgggcataggtttccaaaatgcgtttttggttggatatggaattgctctcgccctgcaattcatcatctttactcaatcttgcgtaaagggcggtaacgggtgctaattgggtggtctgtctaatcatggtttcctccatttccgacagccgccccgctattccgtacaaatagtataccatacggggcggctgtctgtatagtggtttctgcttctttatcgcccgtcaaagtgacgatttttcaaaaaaggcttgtcatgtcacatagacggtagaaaaatttgaaattctgtgttatactttcctcgttcaaacaatgataaatcccgtatttgatgaggtaagattgagtgatgaaatgtactgtgttttatgatagttggcaaatggaatgttgtggaacgccattttccgtaggggatatagtaaaatggcttgttctcaaagcagaacaactgaacactcctgttaatgtaggggcgattaactattgttacgaagcccatagttctgattggcaaaacatatttgtattagagggaaaggttgaaacaatcaaaattttgtatcattcgtatgccccatcagaaaacaatccccgcctattgattcctattggtggaaaaaccattgatgcagaaaatgcaaaagggtttgataaaaaagttgatgatatggaagcaagcggatacattgttgtcctaaacgaatatgcgattaggtctgccaaaaaagaagaagttactttcaaataagtttccgttcttactcccattccagcggtcatgctccccagcatgaccgcttttccatgttccggctcatgcggtgtagggcggtcttggtgcggctgcggtttccgcttccagcactttcatcatcttgtccgctgcggtggcggtggtgtctttcttgaaatagccggacacaatgagtacggtgttacccatgcgggtttccgtcacgcaatccgggcggcggtctgtggtgctggcggtgctgtgctttttatcggtcataggcaactcctttcatttcagcagttctttcagtctgtccagcttggcttttgcggcttcctttcggaaattctttgccgtgaagcagacaggggaacacatttcaatcagtcggtcatagatacgggcgtgggcggtgtcctgcgggttttccagcatatccggcgtgtggttggtggtgacgatcagcggcttgccgctacggtatctgctgtcaatcacattgtagacttgctccaaaccgtactctgtccctcgctccattccaaaatcgtcaatgataagcagcgggtagcggcaaaggcggtcaatgtactcattgcgtccctcgaagctggcggcaaggtcattgaggataagggcaaagttcgtcatgcggacgggtatctctttttccatgagggcgttagcgatacacccggcaaaatagcttttccctgtgcctaccttgccccatagcagcaagccgtggtttccctctttcatctgctcccaacgctccacatagctgtgcgccattcccatttgggggcattttccgttgtcattggcaaaagtccattcccgcattttactgtccgtaaagccccggcgtttcagttcttctacggtgtcaaggtgtttcctgcgctgctcggcggcttcacgctctaaccgtttcgcccgctggcagtcacattctgccgggtggcggtcacgcccgaacagggcggctttgtctgccgggaaatacctttctttggatgtccggcacttgccgcagtacaaaagcccgtcctccccggtgtagtcctccggctcggctgcggtatcgaaaaccttttcaaaatcattcgtcataagctctgtccctccttgtaggtgtaatcgggtatgccctgcttcggggctgccctgttgctgtattcgtttgccgcccagcggcgcagggtggcggcgtggtctgcgtactgtttcccctcggatttcatgtagccggatagctgctcaatgaggttgtccagtccggggatttcctcttgcagttcccggtagtcgctttccgaaaggaaaacatttccatatctgccataggcggcgggtgtccccctcgctctattcaggtcgttattactcttgttgttaatactcttgttgttaggggacagttttttgtccatcattggtaaagttttctgtccatcagtaggacagttttctttacttctgacggacagttttctgtccatcagtaagacagtttcctgtccgtccggcagcttcacataaatgcggttgggggctgaaaagccctgccttttccgttcaatcagccccgccgcttccagttcgttcagacagttcttggcggtcatggggcttctgttcagtgcgtccgcaatcttcccgataggaaagacaatgtaaagcctgccctgctcgtccacccagccgcttttctgtgagagtgtcgcccggtctaacagcagggcatagagcagttgggtggtcaatgtcaagtctgcgcccagcaggaaacggggaaagggtatataggatggcagcttggtatctttggtcatgtagtctgcaatcggtgtcacctccctttatcggtgctggttgccgccgttcccggcggtttccagcgtttggaatagtaccgggggcagagtaccacgattgcccggaaactctgcttgcagtcgtgggtacagccccggcataggtcgttgtaagtgatacggttgcggtggttgaggaaaaaagaccattccagccgccgcttcttgctcatgcgtggcatgggtgacgctcctttctgccgtttcgccgggtgtggcggtatcggcggtaaatctgtatattcccggtgtcattttcgggcattttctgccctgtaagccccttgaaaaagccgggcagtattgcgatagggtgtcgggcatacccttgtttctgtatggtttcggtatcatttcggggcggtgtttatcggtcatgttcgtgccttttctgctggctcggtgcgcccctcatcatttggtcgatattgcccttgacggtctgcaactcccgcacacgctcttttttctcccggtaatcgttgtaccgggcgttcttttgggcggtaagctgctcaatctcggcttgcagggctttgtaggttggcagcttcttaatgccatgctcccggaaataccgggcggctgcgtccgctatgataaagtcgctttcgtgcttctggcggtaggcggcttttgccttgcccgatttctgcgctttcagaccgtcccgcacatctttggtcttggcgaattgcagtacatagccctgcaattcctttttgccctgtatcgccgcttcaacggttttcagttctgcggtgctgtcatggagatccgcataagcggcggtaatggctgcgtcaagctgctccggggaagtaaagccgtactgctcataggaggcaacggtagccgccatctgtttgaggttgtggacagccgcccagcggtcatagcccacgcctttcccctcggctcgcttggcttcccggtcaaccatgcgctgtatgccgtcctgtttcggggcggttttcgccgtttttccctgctgtaatcgctccttaatgctgcggaggtattcgggtatggctgcggtctgttcggcggctctttgggcgttctgctccaaaagggcaagtacggcggctcggtcaaaatcatcccccagcttccgggcggtgatgggcttggtgcgctccggcgcaaggtaggacaatcgcccccggctttccttgacagtcacgccctgttgcagcagcttcccggcaaaatcatcaaaggaaacagcagaggacagggcggctcggatagtctgccgtaacttctctttgtctgtttcaaacttggtgggcttgggcggctgctccccggctggcagggctgcggcttgtgctgcggcctgcttgtccagcttggcttgccctttccgctgcgcccagtattcacgctcggtcactctgtttttgctgccatgcaagaggtcaatctgatagaggttttcccggtggcacatctccatgacttcggctttgaaatactccatggctgcgtctgtgcagcggtgcttgcacccggctttggtgtccgctggtctgtccatgtagggcaacaggggtacttcctcaatccgcagggaattgataatgatatgcacatgaatattgccgctgtggttgtgtccgtccgggtgggtgcatatcaaggcttggtgtccggggaagtgggcgtcgcaaaatccctcgcccaattcctgcgcccggtctacggtcaatccgttgtccgtcccgtcccgtgggtcaaaggaaatgatgtagtgatggcttttcacatcttcccgcttttggtttttgccgtaccgcagattggagcgcatacaggcaacggcaaaatcctcgccgccgcagttcagcgttgctattctgtaatcgtccctcggcacaagccgcccgctttcatcaagcgtggggcgcatggtaaactcgtcatgctcaaaggttagatactgttcggctgcgccgtagtcggcatttttagagctgatatgtttgaatgtcgccaacggcttcacctacctttcgcaagacttcaaacttcaaggcggcaaggtcggctatggctgcccgtacctcgccggacaggtttttgtatggtgcgccgtactcattgagggtgcgggcgatctgattgaggttgccgccgattttcccgtactcggcggtcaacttcccaacggcggcaagcagttcatcattgaccggggaaacggtgacaatggggcgaatggtcgcccgtgtgatagcctgccggataaactcggcctggctgatgtcgtaatgctccagccgcccggtgaagtcggcgtattcttcctcggtcatgcgggtcttgactacatggctgcggtggggcgtgttgtatctcttggctatgggtatcaactcctttctgtgggtgtggttgtcctctcactaattggagaaaagcagggtgtgaagcggaactgtttttgaaagaatttgaaaaaacattccctcataattcagtacaaaaattatcaaaaacagggtgggtgctttgaaatatctgcaaaatatttttaggcagcttcacgctgtttttcttcccccgcaggggataagcagggtttggggaaggcactccccaacaagatttaccgcaggggcaaaaccacagatatgcggattttggcaccgtggtagaatcttgctctaagaaactgccgctttcctctacggctgactttgcggcaatccgcagggggcggcttggcttgtttccgtcaatatagcgattgcggtggcgtgtcctgcccgctgtggttttgctttcttctacggacggaaatggaaaatgccaaacgctcccttggatttcttcatcactactacggtagccccatacctttcttccaaatggctgcggtattcttttcatcactactacggtacgcaagaccgttttgggcaaatttccccgtcactttctacaacaacaggaatgtgcggtctgccaaaaatgggcgcaaaaaaaaaacgccacggactttcaaaaaatctgtggcgttgcagcttggtcgatattcaattttcatttccataatgtgaggggagcgacagcactttagtctgtcgctcccttgattacccatcagcggaaacaggcagggctgtcaacggcggcgcatttatgcgccgttcatcttgaccgttgactgctccggctgattccgctatttgttgtgggattacagctacattcaaatcttttgcgctgattagtgtttcttgtttgcatttcggacagaacagagggaaattttcaagtattgtatcggggcgtatctttgttcgtgttttatttccacaaatagggcaaagcacccacctatcaggcgatttaatcattttaattttcattatttaaggaaagaaatgtaaattgtgaagttatcgggaatgtagctgatactcaatcccttttcgccatttgacaaaagcgtaccgatagaaacatagtcctgtccctcaatttcttccgacacttcctctattatagaaaacccctcttgcttcaaaagctctaaatagtcgttatagtcggtttcgcttatatccacaatactgatactgcaattctcatgttccgtatcaagcatagcccaaccgaccgtaccggacgggacgggaagcccctcggtgtattcattcacaggccatacacccgcgtcaagcatggtattgctttctgtttgtgtattgcttggattatccgcagcggacggcgtatcttgattggaacaggcagccaaagaaagcataagtaaaatagcgattattgaaacaaattttttcatagctacctcctgtttttgcggacggttcggataatctgaatgattgcgattgtaaccgcgattacaccgactgccaaaatgatttgtgaagcgtcaaatccaaaagctccctcaacttgaatgtttgtcattgcgtctgcttgtccgattgccccgtccggcactttcccggattgggtagtggcgtaaatcacaaacgctgcaacggcaacgacaagggctgcaacgctcgaaataatccctttccgtttctgcggtgctgcgctgtcaatgcctaactgctcggcggtattctctgcaaactctttgggagtgcctaaccgttcgattacctgttgttccgtttcgccatgctccaacgcagaagcaaagacttcattcagatcacgcacgacctctttttttgctttgcgtgttaaactcaattccttttccacttgcttaatgtattgctctttcattctgatacctccgctgtttgataggtggcaataaagccatttacacaactttcatagctcgcccaaaataaaatcagctcgtctaatacctctctgcccttatgggtaagggagtagtatttttttgatccgccatttgccgctgccggggctaatcggcattggattaactcggcttcctgcaaacgatacagaatagggtaaatcgttccctcttttgcatagcccaaaatggacgcgctgttatttagctctgtaatgatttcatagccgtaggtttctttgcgtccgatcaagcacaaaagtatcatttcaagagagccttttttgaattgctgcacatacctgttatccatactctctacctcactttagttttgctatttagcgttcctaaatagcaaaacatattataactcccggaggtgttcaagtcaatagagtttatagaaatgttacaaatgctttttagactttaccctataatttgccttgctcggaatagcggcggggctgactgtccttgtcctgttttgttgtgcttctttattaaccatgagcattggaagcagggttgtcttggccgtaaccttccagaaggttgataacgccccagataccaagacctgcgcccagggccactacgagagtctgcaaaacaccaactgcgctgttgaaaaattccataaaataatcctcctaaaaaatgtttttgattttgggttaagttgttgcgtcaatctcgtacacatcgaaggtgtccgtgggttttaccacggcacgctgcttcttcatgtaccgttccatgtcaaagacatttttagggtcggcgtcggccgtgtatctgtaattcgggtgccgggtgaggtcgtacttgtccgaaaggaacgggcgcacgccccgcagcatgaagatacacttgccgccgtccatcactgctaattcgtcctgggtcatcaactctttgccacaatgtcaagtgatgaattaaaaaaatggcagccacgatcaaagaattcctttttgtggctgccattctgataattattagcttgacttgtactgcttaacttgttttattcgagagtacgaattataatatggcagtacggaggtgctatatggattacatgactttgaaagaagcaagcaaaatttggggagtaacaccccgttggataaattactactgttccgcaggacgtatcccaggagcggaaaaaatgggaaccgtctggcttatcccaaagaatgctacgaagccattggatgggcggagaaaatctgccgggcaatcaggaggagaacatcatgattgaagtttattatgcggaagatgacgaaacgattggcaagtctgtaaaagaatatttggaacagcagaattgcaaagtagccgtttttgatagaattgcagatgtcaagaaagcattaatcggtcatttacctacaatcgtcttgctggactggaatatgccggacggacaagggagtgaattatgcctttggattcgggaaagatggaaaactctgcctattgtttatttaacgattcggggcgattcccacgacattgttactggtttccaaaatggggcggatgattatgtggtaaagccctttgatcttgccgttctgtattcccgtattttggcactgctgcgaagaaccaaaaccgtaaccgacacaaagctattctgcgatgacctgatgttggataaagaaaaaacggctgtctatgacgggcagaaagaaatcgttgtaagccagccggagtaccgcattctgctgattttgatggaaaacaagggaaaaacgatcaccagaaatcagctattagagcaggtttgggatcgcagcgggaattatgtaaacgataatacgctgacggtcacaatgaaaagattgcgggaaaagctgaatcatccagcctgcctaaaaacgatccgaagttttggctaccgtatggaggacacacaatgagcgaaaaatggaaacaaaaaatacttctgatttttccgtttgctgttcttgcggcaggcatgatacttaccgccgctttcttcctgcacacgtaccggcagattgcatttgaacacacctcggcattatgcgaaaccatattggcaaattctcctgaagcagagccacagctattagcggctctgaaagactatcattcattgacggaacaagaactcagaggcaacgattatctggaaaaatacggataccgggtcgatgatttttgctatgatttcccgctggataccgtgctttttccgattctatttttccttgtgactgcttgtgcttttggagctggaacttttttgtcccacagaaaaaatcgaaagagaattgatgatttgaccgagtatttggaacaggttaatatcggtgctggcgggacattgatacaggcgaaggaagatgaatattcccatttgcaggacgaaatatacaaaactgtcacgatgctttatcaaacaagggaaacagcagttgccgcaaagaaaaattttgcagagaacctggctaatatcgcacatcaactgaaaacgccgatcacagcggcctttttgtcgttgcagcttatggaaaaagaaattccgggggcttacgcagaacaggtaaagcagcagttgaaacgattaaaccgtctggaagaatctctgcttatgctttccaaaattgatgctggaacgctgccgctcaaacgggaaaaggtcgatctttatacggtattaaatctggcggcagataatctgaacgatttattgcggaaaaatcatattactgttgaaattccagaaaatggctgtattgaattttggggggatttggagtggacaatggaagccctcatcaatctcatcaagaattgtatggaacattccaagccgggcggcgtagtccattgtggctactctggcaaccctctctatgtagaaattcaggtatgggatgacggggcgggctttgacacagaggacttaccgcatctttttgatcgtttttaccggggccggtgtgcggttggagatggaattggaattggtctggctcttgcccgttccatttttgaattgcagaacggaactataaccgcctgtaacttgcaaaatggcggtgcttgttttgaaataaggatgtacagtcactgagatgtcactttactttgttatactgtacgcaagaccatttcgtagagaggagaaagtgacatggaaatactaaaatgtgaaaatgtccgaaaggtatatggttctgggaacaatcaggtcgtggcgttggatcacattgacttgtctgtacaaaaaggagaatttgtagcaatcgtaggggcatccggttcgggaaaatctaccctgctgcatattttgggaagcgtggataagccgacagaagggaaagtcctgatagaggggacagaattatctgccatgaaccgaacccaggcagccattttccggcgcaggaaggtcggattggtctatcagttttataacctgatccccacccttaccgtccgaaaaaatatactcatgccgctcctgttggacaagcgcaaacccaataaagaatactttgagcagattgtacattccctgggaatcgaagataaactggaatcactgcccagccagctttccggcggacaacagcagcgagttgctatcgcccgttctttgatctatcgcccggcgctgttgcttgcagatgaaccgaccggcaacctggatcggaaaaacggagaggaaattattgatttgctgaaattatctaaccgtaacctggaacagacgattcttttgattacccatgatgaaaagatcgcattggaggcggatcgcgttattaccatagaggacgggaaaattgtcggcgatcagaaacggaggtaagaatatgtggaaagactattcgatcggattcatcaaaaagaatcgggcttccagcgtatccgttctggttgcggcgtttatttctgctctgtttctttctttgctgtgcggtttgttttataacttctggaattatgaaatagaatctgttgttttagaagaaggaaactggcagggacgcatcagcggagcgtttgaagaagataaagtgtccgagattgagaatttcgccaatgtaaaaacggctataatcaatgaggatttatcagacgatcaaactcttgtagttgatatttgctttgataacatgagggctgtgtatcaggatatgcctcttatcgcccagcagttaggtgttccggaaacttccgtatcgtatcatgaatcactgctgtcaagttatttcatcaacgatccgcaggacagcaatccgcccttattgatggctttttatctctttgtactcctgcttgtgtcggtgtctttgattttaatcatccataactcgtttgctgtatctatgaatgcccgtgtccatcagtttggcattttttccagcattggggcgacgccggggcaaatccgcacctgtcttttacaggaagcggcgatgctttgtgtgattcctgttttgatcggaagtattgtcggaatcgctttgaccttcggagccatccaagcagtcaatattctcgccgatggtattgtcggcagacatgaagctgcctttgcctatcatccgctggtgtttgcagtcacgattctgacctcgtttttgacggtactgatttctgcctggctgccagccaggaaattgagcaagatgaccccactggaagctataaaaaacactggggaattgcagctaaaacggagaaaaaaatcccgtattcttgcgctcttctttggaaccgaaggggaacttgccgggaatgcgctgaaagcacagaggaaatctctgagaaccgctacgctgtcattgaccctttcttttctgggctttgctctcatgctgagtttttttactctctctggaatcagtacaaaccatacctattttgaacgctaccaggatgcctgggatgtaatggcaacacttgaggacacaaagatcgaggacttttctcatacggatgaaatccatgctttaactgatacagacagtgtgatttatcaaaaggcaaccgccgtttgttctgttccaacggacgctgtcagcgaagaagtaaaaagtctgggaggtcttgaaacaatcgccggaagtaatgtcagtatggtggatgggatttataccattcaggctcctattgtaatcatggatgataacagctttgccatgtactgtgagcagattggcgtttcttcagcggaaaacgggagcattgttttgaatcgtatttgggacaacataaacagcaatttcagatacaaggaatacgttccgtttttatccgagaaccaggatacgatgactttgcaaaacctggaagatgcggctgcgtctgtggagatcccggttttgggctttacacaggaaccaccggttttgagagaagaatatgataactatgctttagtccaatttgtgtccctttccacctggaaacaaatcggagggacgattggaaatgctgagccagacacctatatccgcattctttcagaaaaagagagaaccctaacagaactgagtatgattgaaaccgagttgacgaacgtgctggggcatgacatttcttttgaggtagaaaaccggattcaggaaaagatagacaacgatgctatgctgaacggatacaaactgataattggggcgctgtgtgtgctgctggctttcatagggattgctaacgtattttccaacacgctgggatttatcaggcaaaggaaaagagaatttgcgagatatatgtccattggcatgacgccagaaggtatgcgaaaaatgttttggatcgaagccctcgttatagcgggccgccccgttctgatcacgctgccgattacggctgtgtttgtgtggttgatgataacggcaagctacctgaatccaatggaatttttggcagtggctcccatcgttcccatcctactttttatcgtggcactttttggctttgtcgcactggcctattacctgggcggcaagaaaattctgaaatgcgatctggtagaagcactgcgaacggattatatgggataatactatcgttcagacaagttgcttcatccacaacacaaaagccccatccctcaaaatagagagatggggcaaactatttacgctgcaatctccgggatttccccgacaaagttataaacaatcctgacttcctgcaccttctggccgtccactttcctgacttcgccaatcagaatccggctgatgagccggttcaacaccgcctcatccaattcctcaatggcggaatagcgccggatttccttgatgaaggtacggacttcattttcctgggcctcggcacgactctgcatcatcgtcaggtcatgcaggcgcttctgattggattcctgctcctgttccagcgccgccgtcagcttcacaaaccgctgttcggtcaggacgcctttggccttatcggtgtacaggctcaggaacatcccgtcaatctcctgatttcgggcttccagacgctggcgttccttctcggtctgagaagcatccaccagataccggcgctccatccggctgctgagccgctggtagaacgcatcggcatccttcatggcctgttccgccaattcctgtatatccttcagcaccagatcatacaaatcccttgcttcaatcttgtggctggtacaggcgttcttacccagccgattgtaagtctggcagatatagtatgccctgtcaatcggctcccgcatctcaccggtgaagcggttcttgccggttcgacctaccttctcataccgcacctgcatggacttcccacaggtggcgcagtagaccagaccatgaaacaggttatagaaggggcaggcgttgcctttcataatggttggcctgcggtcaatgatttcctgcacctgttcccattcccccggcgtcacaatcgcctcatggcagccctcaataacctcccattcctcacgggggataatgtcataggtattggagcggatgcctttctggtgcgtccggcagacaagatgtgcgcctttataaaagggattccgcaggatatggctgatccttgcgctcccccatgaatagtagttcacatcacattctgtattgccttttactctggtgatggggattttatcctccatgagctgctttgcaatccgcatacagccccagccatccagtgccagatcatagatttttcggatcaccggcgctgtctccgggtcaaggatcaaatgtcctttgtcctccgggtcgcgcatcaggccaagaggcggctgcccgccgcagaactttccctgccgagaacgggtcatgcgtcccgccagcacctttttggaaatatcccggctgtacatatcgttcaggatattcttgaaaggcgtaatgtccatctcctgacgggtcagactgtccacgccgtccgtgatggcgatatagcgtacattgtgtttggggaaaaagatttcgatataacttccggcttcgatataattcctacccaatctggataggtctttcgtgaccacgcaaccaatcttccccgcctcaatgtcagcgatcatacgctggaacgaggggcggttaaaattgcggcccgtatagccgtcatccacataatactcatactggaacatcccatgcttttctgcgaagtcccggagcatgattttctggttgctgatgctcatgctctcattgtcaccgccgtcatccagagagatacggcagtagagagcggtgattttctcatagacttgttttttcctgctcatagcgttctccttctatgaacagggacacgataccattatagtaccatgtccctgtccctgaatcaaccgtttttacgcagctttttctgccatttcccgctgatgccgccattcctcgaagtgttcgcaggtctggcgctcaatgagctgctcaaaggcttcccgcatggatttctccccggagaactcccgcaccaccacaaaacggactttattcttctgatttttgcttttttccataggctacctccatagagagacaggccggacggcagtaccggcaacgaagtccggcaacgaacctccaaaaacctgtaaactaccgtctggcctgtaaatcttactttgtgaattttcttgaaaaatctcgttgctttcgttgccgaagataaagataatgattaaaatatcccttatttactggcttttcccgtatccagacagggaaatccccggcaacgaacccggcaaccaactggcaactatcccggcaacagaccgccattttcaggcaatccactccttcggaagctccaactggcggcattcttcctcgctcagttccacaaattcatcttcgttgccgggcagttcgttgccggaaacctcccgttcccagcccttctgcctgccatatccggcgaacatcctcggattggagaatggcttccagcctgtcaccaccgtgttcatgatctcgttgatattgtgaagctgccaccgcttcggttcatcgtaggtgtggcccagcgcctccttaaaaagctgtttggagcagaccatgctgccggtgtagtgttccagaaagccctgtatctgtccggcctccgtgtcctccggcatgaaatccttctgcacctccacaagctgccgctggatggacttgctgaatttcatggagtagtggccgctgcggtaaaacgtcatggcctccgcccagacctgcaacaggtaggccctggaagcgtcctcgtcctccaaaatgtgaacctccgcattctccgggtaaatcatgatgggaaggaaacgccggttcccggcccggtcaaggggcaggaagtccagcgtgttggaagaaccgccgaacacacactgccgcagccggtctttgggctgggcctcgtagggcgtccggtaggtttccttctggcggctgatgaacgagcggatttcctcaatgcttttggcgctgctggtcgccagcatctctgacatctcgatgatccagtggccttgcagcttcaaaaacacccggtcatcatccagctttttcaggtcgtcactgaaccactcgtcccggatcgccagcaggcggaagaagctggacttgccagccccctgtccacccaccagacaaagcatttcctcatatttggagccgggagaaaacacccgccggatagcccccagcaggaagtgctttaacatttcctccacatagtcgctgacctccgcacctaagaagtgatggagacaggagcggatgcggggcgtctcgtcccacacaaggccgttcagcacgtcctgtatgggatggtagcagttctcattcgccacaatggacagggccgccgtcattttcttctcgctggtcaggccgtagttctgctcaaaatagagaagcagatacttcacatccgtatccgtcaaggcgctggtgttcctgcgccagcccaaatcccgcacgatgtccacccggtcagtcaggaggttcagccggattgccccacgcagcagcgggtcatggcagaacactgtccggcagttgccgatggtattggcaggctggcccttctccgtgacggagaggctttccctaacctcgtcaacgctctgctccggcgctaaggcttcggctgcgctcatggcggcctgccgggtggctggcggtaaactctgatattcgctgctcaatcttcctcacctcttttccgtattcagcgaccacgcaggcccgttcctccatactgccggacaaaagaatatccagcagatactccgtgtacggctttttttgcagggcctccacaaacagcgggttccatgtttcctccggcgtctgcggggcatattccttctcccagcgttccagcagatgcaggtaatcacacagcacccggaaacatttctgctccgcctgccggtagcgcagttcctcgctgattttccgtttgaccggcctcctgcggggcgggtcatggcccttggcgtcaaagctgaccgagaaatcctccgccagcttcaaggccgcctcttttttgttcagcccgaacagacgggcggtaaaatcaatcacatccccgtccgcctgacagccgaaacagtggaaccggcggtcaaccttcatgctgggatgtttgtcatcatggaagggacagcaggccatcccgttcctgccgacctgcactccgtaagattccgcagcctgccttgtggggacagcctgctttaccgcttcaaacacattcgattttctcacctccagacagagaaaaaggcacccggtttccgcagaaaatcagatgccttacaactccatatcctgtttctttgtaggggcaatccgcccctcccgttcccaacgctcccggttatcccggtcagcgttgatctttgcctttgccagcatatccataatggattctttggctttcttcttgacctgctccttcccgaactgcttgacctccggctgcatcagcgtccgctggatttttgccagagcgtgctgcatggcgtttttgattttggtaatgaccccatccagacgctcagcggcatactcacgttcctttttcggggctttgcgctccggcgaaagcacccattttttcgattcttccaccagacgaatatcttccttgtgtgtctcctgccggacggtatcggtcacgacctccaccgccttgtcataggccgcatcggaaacatcatctaacaacgtctccacgtcctcgattttgagcgtcagttcttccagcttctgctcctgcgccgcaagctgctccttctgcttcatcaggatataatcctgtttttccagataatcccgcccgccgtaggacggctcctgatccagatgcagcccatgccgtctggcgatgtcaaacaggatcgtccggcagaccgcatcaaaggtctgcttgcggttgttattccggcctttgggcttctccgggttggggagggggatgccaagtttttccagcgccttttcctgctggggacacagctccccgtagcggttctcacagtcaaagacgtgccgctcatggatgtggggcgtcccctcgtccagatggagcgcccagtccaggatgtggatatgggaaccaaagcggcgctcaaattcctgataaaactcattgacgatggaaaagagcgtatccggcgggacggattctcccatcgtgccgatctggtagatgctttcctccgggcaggtcttgttgtttttcagcaagtcctccacggtgcggttgcgctcgatgtggcgggttttctcattccgggcgttctgggcctccacatggccgccgtaatgctcgtagtagtacatccgctcaatttcttcaaagctgaaatccggctgctccgggttctcccggaactcatgggtggtaaagccccggtagcagtcccagtagacattttgtcttgcccgttctgcgtcaatgtgttcgctgttctccacatcgaaccggcggtcattgtgacggggattataggtgccatgcttgccggagcgcccattgtgtcgtgtcagtttcaaacagatttcctccttcctgcaaagatgttcttgggccggggaggggcggcgaagccgcaaatcctgcgaattttgcgtcaggtaatacccagtacaagttgacgcaggcatcaactttccctgggcaaggcgtttcacccttgacccgatgggactgccgccctcaacccgccaaggcacttcgtccttgacccgataatggctgccgcccttaacctgccaatgggcgttgccccttgaccccagcagtgcgctgccgcccctgcacccagccacaaagggattgcatccctctgtactcctgcaccggaaaaaccggcatccaccgctgatacggtgtccgccagcttttccggctccgtatccatacatctgcaccaatcgcaggaagtggatacggaatacgcctgcggggattaccgttcaaaatactgggtgcagacccggtattttttggtaaatcgccctcatttcaagcaattttttcttctgtctgtatgacttgaaagccatgttcctttgcgtactcccttgcagccgccagccgttcttcactgtacggcggcaccagccggatagaaaggcgggatttgtccagcacataggtcgcgctgccttccggtgtgctgcgctccaacctacacaatagcggatacttcctactgaaatcttccagcctgcgttttaagctggcgttgaaggtgtaaatactggcaatgttctcgccctcgttccagttgatgatggtttctttttcatatttagacagcttcctcatacagttcctcctcataatcggtgtttgctttcagcacacgcaggcggtgcttgatccggtaatactcatccatctccatgcgtaggcagtgatagaagctgtcgtaccagctttcgtctgtctctgcctcaattttcctggtcagatgaagcatctgccctttagcctccgggtcaacggtcagcgctgtcagccatttcagccttgtcactgtgttgtgatggctggggcaggcgtaagcgtaaagaattttcttttccttcatattcagtttcataatgatctacctccattcatttgctgcggtgcggtatgccccgcatggtttacttttctatctgccggtctgtctgcaagccgctcctgcccggattttctcccggcgtattgtcctctttggtgcgctcccgtcgtcacaaaatccatgattttgcgggaacccttttatcgcgtcacttccccggaggtcataccccttgcagccggtcattcgattttcaaggttctgtgtctcctgacaagaaccagtttaccgaaaaaagggggctgctcccgtatgtccaagacgttggaatagcgcacaaaaaccgcatatttccacgctctcggaaacgtgctataatgaaaaaatattgaaaaatgttgacgagagggggtgctttgatgtacacaaaactgtcaatcccggaacggctcaaagacctgcgggtggtggataagcacctgacactggaacagctggcagaacaaaccggcctgtccaagtcggcgctggggaaatatgagggcgatgactacaaggacatcagcccatttgcgattgcaacgctggcagagttttacggcgtgtccaccgactatctgatggggctgtcggaaaataagaccatccctaattctgatctccagtcgctccatttgagcgatgaaatgattgagctattaagaagcggcaggatcaacaaccgtctgctctgcgagcttgccacccatgaaggttttccccggctcatgacggacattaccgttatcgttgaccgtatcgccggtatgcgtgtcagccagatgaatctggaactggaagctgcccggcagagcgtcatggaaagctatgcgccgggagacgatgacctttatatgcgaacccttgaagtcgcacagatagacggagaggattatttcaatcacatcgtccataaagacattgacaagatcgtaaaagacatccaaacagcacacacaaacgacgctaccaccgctgatgaacggcaggaaaccgtagccgaagtccggcaaaagtttgaaaagcttgtgcagacgggaaccagcggagaggaagcctttattcaggttttctgcgaccagatggaaattccttatgagaaactgacttctgcggaatttactgcctttttgggaatcctcagaaaatccaaaaaagcaaaacgaactaaaagtatgcggggaaagggcagcccaattcctcccaaccggaatggcagacagaagcgttaataaaagaaccacccgctgggtaatccagtgagtggctcaaaaaagatatgctgttatttctgacagacatcctacctttttcagaatccagctgatcgtgtccctgttcatgtaaaattcaaggcaactgaactcttcatcaacaagtatggcatatcctttcctaatttttgataactgaggccgtgggaaacctggctaccccggttttcggactggttgtagagatcaatggtctctttccccagcagctccgaaatttccttgagggtggatttctccttgcctcccaaaaacaaggtgctgtcacagttaccgacgatggtatccgccgcatccttgtagatggtctttaactggctctgcgactgcaaaataatagaagccgatatctcacggcttcggatggtggcgatcagcttatcgaagttcggtatctggccgatgttggcaaactcgtccagaatcagacggacatggacaggcagccgtccgccgtagaagtcatccgccttgtcgcagagcagattgaaaagctgactatacatgagggcggccacgaaattgaaagtgctgtccgtatccgaaaggatcacaaacagcgccgtcttttggtcacccagggtatccagttccagttcgtcatattccatcaggtcccgcagctccttgatatcgaagggagcaagccgggcaccgcaggaaatgaggatggattttaaggtcttgccagagacgaaaagtcaaggactttttcatcaaattcaaaaagcagtcacattttgcggacttcctcacggagcagacgcttgattttgtcctccattgtctcttttgcggtctggctgaaatgcacacggacgatataggttgtcttgccgatctgctttctgacagtcgggcaagtggcggtgttggttgcggtattgttcattcaaaatcctcctgtaaatgaaaaatgcccggtgactgttcatcatcgggcggtgtcggtatgagggaacaaggcaaggcggcaacattaaggtatctataaaacccttgccgtctttgccacgcttgccgtgttcccgttgtcagtctcggagatagcagacccatgctgtgccgtctttctcggtcacaagtctgtccccgatacggctctttgccgttctcatggtgcgtgaggaaatcccacgctcattgaccgctttttccagctctgcgctcggcatacgctttccgtccgcaagcagttccagaatgagcatttgcgcctgtgcggtcttactctcggtcttgccggagtccgtcccagcaagaagctcgtcagcggtaatgtcataagctcctatccattcaaagcctttctcgtctcccagagaaaaggcaagggactgtccgggcggcgcaagggagcttttctcatggataagcaccctcgttgtcggactgtccttcagcttgccaataaacagcagactgcggactgccgccgtaatgtcgatagaccccaatccccggtaggtgctttgcgttcctgcggctttgttgaggtgtccgatcagcacgatagcgcacccggtagcctgtgcaatgtctcccagactgcggaagatgggacggacttcatttgcccggttcatgtccacatctgcgcccagaaacgcctgcaccgggtcaatgataaccagccttgcgttgttctcacggattgcccttgctatgcgctcatcggcaagggtcagcggtgtgtccctatcgtcaatgacaagcactctttcaaggtctgcttccgcttccatcagccggggcttaacggtatcgcccagaccgtcctcggcggtctgatagatgatgttgaaaggctcaagggtctccataccgggtaaaggctttcggttggtgcaagccgccgcaagacgcatggcaaagtaggtcttgccctcgccggggttgccctgtataatcgtcagctttccaaagggaatatagggaaaccatagccaatccacgctcgtcagctccacatctgccatgcggagcatgggaacaggctgggcggtgggcagctctcgcagcgtgattgtctcggctatgaatttgcggctgggaatgtccccttgctgacggagaacatcgttccagtctttccttgccgggacaaggcgaatgacggcgatctcgccgggaatggactgtgccagtcgggtacaggcttcgcttcctgcggtgtcgctgtcaaggcagaggaacacttttcgggtgtccttgcgttcagaaaggaaacggtcaagggctttgcccgaaacgccgcccagggcaagatagctccttgtctgccagtcttgcgtatataggcagataaaggataaaaggtctatcggtgcttcaaagacaaagagctggttgccgtttccctcatagcggaacggataggacttgtcagacccggcaatgtcctgtctgaatgggtctgccgttcctcgcacatgggcgtatctcggcgtaccgtttcggtctctgccgacaaacacaacattgtgccgctttgcgtcctcgtaaatatccccggaaagaagaaaatcctcaacaagcgttttgttgagacctcggctttcgcaaagatattgaattaccctgtcggctgttcggttgtgcaagggcaagtggaacgctgtgggcggtgctgtggtggcttcggtctgtccttcgccgctttcaccggtcagcatttggacggcttcgggaaaggacttgccgtaaaactccatgacgaaatcaatgggatagccgcccttactctggctgtggcgaaaccacttgtttccccggacggtcaggctgtcatgttctttccagcggtattcccgtccgcttttgataagtgtctctccctgtgtgcggagaaaatcttccagactgacggcgtttgcccggtcaatctgcgcttgggtgtaattcatcgggatagttcctcctttttgtgtcgtgtttggggtcgattttggagcatttgttcctctgtacgctcgttaaatcgggcggcagtatctacacatgacttgaccttccaaaggcggtgtaaatcgtctctgacggtcttaaactcgccataggtggtgttgtgcgcctgttccagctcgtcatactcgtcggacagctttttcatatccaccttgccgtctgggaactccccggtcagctttcgtctggcggcgtagaactgtatcagttccgcttcatgctctgccttgtacttggctctgggcttctcaaacttgattttctgcaagccgtcatagaccggcttcaacctctggaaagcggcggagctgtcatagagctgcttaattgctttcattcgggcggtctgttcgtctagcgttttcttcaagctctctgtggcagcactgtgttcgctgacacggcgttccaaatcctcaagggagtaaatgccgtttgcccggagataattgaaagtctcgttcatctcctttagattgctgaccttgcctttctgcgaatatgccccggctctgcgctgggtgtaataggcgttcagcagagaaacaaggtcgggtgcctgcggcttggcaagctccgcttttgcttcggcaatccaatcaaacaggagagcgattttcttcttgatgtcccggataacggcattggttgctctgatccagcggttgaactcgcctttctcggtgcgtatgcctttcttctccattgcccggacggttgcgccctcatggacggtgggaagaagctccacgccctgacgctcatagcttcggtggtcgatacgaacatcaagccctttctccgcaaacttggcgttgcatagttccgcccatgtctgccgccaatgttccagcgtttcgggactgccccagtcggtagtgggaacggcgttgaacacaaactttccgtctgcgtctcggatacggttgccgtcctcgtccagctcatacacccggcgttgctttagtccccatttgccgttctgctcgatggggcggatggggcaaagcacatgaaaatgcgggtttggtatgccgccgtcctctctgtctggctggtgtacagcgaagtcaaccaccatgccacggctcacaaactgctccaataaaaattgccttgcaagagcgatgttttcctcaagggaaaattcattctgcaaagcaatgtcaaagctgtatgcaagctgtgccgtctttccacgctcggctttttccacggcgttccatagggtctgacggtctgcgtattctttcggtgcatgggacggcaggagaatgtcggagcatatcacgccgcccttgcgggtgtagtcgctgtattcgccataatactcgctatacaatcgctccccggcacggtaggcggcagaagcaatagcggactgtcctgcgcttcgcttagtctgcgtgacgctcagatgaaatagtgccatcggctttctgctcctttcctctgctcgcttggttgatgtgggtaatcgccatgtgacggacggctcgctggacttcgggcagagaaaagatgtactccatcagctccgtcatttcggtgcgtgtgagatctttgaactccggggcaaggctctcaatcgtgccgcccagattgcaaagacggtgggtgcgcttttgtctctcgcctttctccagatacttctttctgttctccagacgctccagcttgtgctgttcctgtgcaagctgtgtctcgacctgttccttttcggctcggagctgttcaaggtttttcggttttgccatttttcgtgacctccttttttgaaaatggggataaaaaaagaccgtcaacttttcgcagattgcgaccagtcaacggtcagtttttcggtattcagttgttgtgttcagttcggtaaattgaagttggtcaaagttgttggcgaagatattccacaacatttccattcgtatcatagaaacagatgtttcctacattgaggggcaggacaatggcgaaaggcttgccactatcaatatcaatcacctgaatgccgttgccatcatctacttcaagtcgaacaatattttgggtattcattgagataaatgccctttcgttatttccctcaacaacaaactctgcaatgtaatcatcaacctcaactatatctccaccaccacggaagaaatatccaaaagacaagccagggcgatttacatagacagaaaaagtgtggtctgtcttgtcctgtgggtaagaaataaatgcagccattgtgtcggaaatgcttccatcaacaatccaatcatccaaaattttttgagattggcgaatgtctgcttctaaactgtttgcggttttaccaatgtcattgtttgcataaaggaaaccgaaaaccaacacacaagccaaaataacacccaagaggattatgggtaatttctttttcatagaatcacactcctcgtattataaagtagtagtgtttatagaccctctccaaggtctgtatgctatacttttggagatactgtggattgttttcacactcctaccacttgatggtttaagaaaggctacaac

SEQ ID NO: 21 - DNA, 23227 bp, Roseburia hominis
tgcatttaatacttctgccatgtcattgatgatgtcataaatttctctacccataagagcacactcctttttgaaggagtatatcgtagaaaaatcagcacatcaacagagcgtattactggaatttctgttatagatttacaatcataataaattcctcgctattttcattaacaacagtaaatcccactttctcgtacatcttcactgcataattacttttctgaacagataaggatatttttgaatatccagctaatctttccacttgtaataattgtttcaataatgaagttccaatgcctaaccctctatattgggggcagacagacatggcaagagatggagtatcattatcaatgtgtccatagtcattcataattcttacccaaatagctcctactacatttccctgaatctctgcaactaaggctttatcatgttttcgatttccaaactcgacgatatattcttgtaattccggacattctattactgatttaggtggaggttcaataccttccggaatataaatcgcttcgtataaaaaatcacttaataaacagtattcttcgcttctcatttctcgtattatatagtccataagtttactccaaattcaaagtttctgttccttacaaacttcgatttgttagactgttttaccataccatatctgactggctattacaataactgcccagcctccgcctaccgtatgccacctgttgtctaacaaaacataaccgcgcgaagccgatgtctgagtcggcatctaccctgttttcaatagcagatgccggcgagttcggttcgcgcggttttatattgtctgtgaaacggagagccaccaggggctctcttcccatagccgcagagacggcgcgctagttctgcttcctcctgcgctccatacgtgtctctgcaacgtaaagtacaagatatgccaccgccgcatacaaaagcgtgagtaccatcacagcaatattcggtccgatggcagctggatctgaaagagaatgaagtaatgccggaaccatgatgaccataaccaccagaccggcgggcagcactgttttccttaagaaatgaaccacctcatattttgtccggcagccactgaaaagcacgcacgccgcacagatacatactataaggatgatggacgggcaatccacataccacccgatcttcgcctgcgacaaaccaaatgtcagaaagactgccactgcgagcaatgcgattcccaccagcccctgccatctgcctgcatttttattattctgattctcctgcattaaatgtttcatattttcttccgcctttccaagatattcttcggaaggaagcttctcacccgacagaagttcgtttacattgatgtccagcacctcacagagcggcgacagatatgctatgtccggcatcccgttcccggtctcccacttggataccgtcttgtcactgatgccaatctgttctgccagttctttctgcgtcaaacctttttcctttctcaatactgcgataaatgttccgatcctcgtctgatccatatacttcctccattttccgaacaggtcgctgtccaccgttccgagggacctgtcatgcttttgtaaagctgcagctttatagctacaccttagttcaccgacccgtaaagtgcaatcccttcaccgtagaatacgctctataaagcaaagaaagccgcgtagattatctccctgcgcggctttttctcctactccatatattcctgcaccagcgtcttatactgctgcaccttattggcaatcccgccctgattgtagcggtcgacttccgccgtcaccgtaatctgcatcttgcggtcttttccaagcatcttattgccggaaagatcctgtgtgatctccggcataatcagcgtaatctgatattcaatgcttcgcagaatctgattctcatcgatcacataggtcgccgtcatatcctcgtaatgtgcctgcttgtgctgctggacggatagcgccgccgtcttcacggcgttctcgtctgccccgcttttttcataaaaagcataggacttctccacctgtgccacctgattctcccatgcctcctctaaatattcctgcgtaaaagagcaggtaatctccacagccccgtcctctgtgacacgctccaggtcttccacatctgtcccgtcgtaacccagatctgtcaccatttcataatcaggaatgacggtgttctcccgctgctgtggcagtatctgctcccactcaccactccagtcaatgtaatgatacagattcctcccgtcacagaactgctttaaatagagtcttgtcccgtcctcatccgtcgtgtagtgttcgcttatccagtcacctgtcagcatatccgcccaggcatgcatcgtctctcctccggcgcttccgttctgcttccagcgatattcataggaaagctgcagattgtccacttttcccaaattccacatggcaacctgaatctctccgagttctcctcttcccgtactgttctgacgcagtgcgccaaatatcagcacaccggcaaatacaacgactgtcagtatccgcagctttcttttttccatagcactatcctctatgccagcaatcccaatgtttcaaatgcccgataaattccatcgtcgtcgatggacgatgtaaccatgtccgcccgttccttgacttcttctcgcgcgttgcccatcgcaataccgattcctgcgtattccatcatctgaagatcattcggaccgtctcccacggcaatggaatcctctctcgcaatgccggccgccttcagatatcgctccatgccggttgccttattgattccgttgatgccgatctcgcccgcatattctcccataccttccaggctgatcgccaccgtgtcaaagtaaggctccagatctgcatgtaccttcgccaccggaaacggcgcattataatatagaagcttttcatttctcggattcttccaaggctcttctgtcagatgcatatttccggtcagacgcacaaggcgctcctcgctcatccccatctttcggtagatctctaagattccttcactgctgcggcggttcaacaccacaccgtcgtccgcctgatagcaaaacaggaatccgttgccctccagataatcgtaaacgctcttcctgtgctcttcatcaatatatgcgtgataaatttccttcccatcggcgatcacaaacacgcctgccgcgccgacaatcccggaaaacccaagttccagcagctcatcataaatctggaaacggcttcttcccgtacagacgaccatcttgtgaccgttcgccttcgccctgcggaccgcctctttggtagattccggtatctctccccggtcattgaccatcgtgccgtccacatccagaaacaccacttttttatggttatttatcatttctgcgctcatattttcctgtcctcttcacgattgcttttatgtacatgatatgttgttttggggatggaatcaagctattttaaacgttatatggaaaaaaagtatctttattttttcgactcccaccttacctgtccttcctatagccgccggatcggctgctgttcttgcacccgatcgtatatttatcaatgatcgtggcatcatagaaactctgctgtgcttcctgtatcaatttatctgctataattattttttctatatttcagcggtgataccgcatatgccttctggaaacttctgataaaatagcttacattctgatacccgctctgcatggctacatccgtaaccgggatatcggtgtcctgtaacagctgctttgcatgctccaaccgcaggtatgttacatattgtgacagtgtaatatgaaaatgttccttaaaatacctcgatatatatttttccgagagatgaaactgttccccaaattccctcagcgatatctttcctgtaaaattctgctgtatataggaaaccatctctttttctactgtatttctgccacttgtatcattttctattacaaatcctttcttccacatttcaagaataaattgtaaaagaattatttttgtcctgacctgtgtcgttattttcgattcactttcatccttttttgcctcatatatctcaatcagctgttcacacagttcttttgctgtatcctttactcttggacatatcatcaagtgaccgctatttaatggttcaagcaatttttcatctaacatgtcatctgtacgaaaagatatatactttaacggaaataggaaggtataataatccacagtaccggtctgtgatcccataagatgcagattgcccggcgacaccacaaacgcatctcctgtttttccaatatagctctctccggatatacttaccgccagaaaaccgcttcttacatatataatttcaaattcatcatgccaatgtaccggtatctgaaatgagcgccccgcattctctatatgatatgtgctaaatggatcgtcctttgtgccatgtggtttgttttccttcaattcaaagtacatattctctcctacagttctacaagactcttacttttccattttccgcttttccatctaaacaccattccaacagctctcgcacactcatccgctgccatggcaatatatgctcctacagcctgaagtcccatatgtattccaagaaaatacgttccgccaactgcaaacaggtacataaatatcgcacccataataaccgggaaaattgcatctccactggtttttaacgcctgtccatatacaagatttgtcacccttccaaactcaagaaatatatctactatcaacagctttaccacaagatttatcatttgtgtgtcatccgtaaatatatgaatgataaaatgtccggacattgcaaatgccgcagagaagcacgttgctgttataagaccatatatcacagcttttcgtgtccccctgtcacattcttcaaactcctttgccccaattctccagccagtcataatagcattggcctgtgcaagtgcagctcctatacagtacgagaaatttgctatctgcatagtatacgaacgtgctgtaacattcattccgtccgcatccatctgattcataaatcgtactatcagtgtcattgccacattataaagcgctgtttctaatgcagaaggaaaacctatcttaacgatctgcgcaagtatcttccgggacgaaattcgctccgggctctgctttgcttttataagtaccgcgcccatgcctgctacaatcagtagatttacaacccttgaaataactgtggcagcggcaactcccattactccccagttaaacacaaacaaaaataccgaattaagtattatattaatgagatttccaacaaccgttcctatcagtgagtgctttgtatatccaaacactctcagataactggaataaataggaatcagtgcatttaaaaaacatgcgcctccaacaattttaagatatgtttccgccggttcaaacaaagccggggcaatacttactattctaagtattccaccagaaaaaacagcaagaataacagacatcaggatgcccatcactgcattaaacatcagtccaagctgtctggcctgatatgcaactccaggtcttcccgctccgatattttgtgacataaccgctaccatacctgatgatattacgccgaacatgatgataaaaacgcctatatatgtatttgctgttccaacagctcccacagcctggtcacttacagatgataacataagtgtatcaaccatgcctgaaagcatataaaataaagtctctacacatattggcacaaatagctgtgtcaatgtttttctttcagctgccatattttctcctcagatgctccttagatgctaatataatctatattatcaataatacgatatatttgcatatatttcttgtataatatcatgcaaaaattgcactatttctactatgcagtctgtgagaaatctacggagcgtctgacaccgccctcaaacctgctgctttaacctcttcatcacagttttttcgtcaccaaatgtaatctgcaataattttcatcttcaaaaatgacaccttcatcctgaaatccattgctgataaaaaagtccaaatccccatttggaaagacgcctttttcatcggatattgcaaggattcttttatattcgcccgctaaatatttttccagttccataaggggagcacttttataatcataggctgcatccgtcatgtatacacaagtcagaaacgctatatcatcatcgtgtggaatgtcgtatggaatgaccttcgcaggcaggtattccacaccgccaacgagctctcccttcccgtttttatgaataaaaccatagatatccagctcgtactgttttagaaattctattttctttttacaatcttcagacgttttgtccccacagcactcacaggcgatgtcgaacttgtctaaggagagcggctctatgatccctttggtaaaatttctggatattgttggtaaaaaaggtttctcctccggatatattccgtttgctgcctgctccagaaaagacttcctgagcggactatagtatctttttttcttatccagaacaatcagtgtgggaaaaaacatcttcatttttcccgccaataaatgattgttggaaatgtcatatagattgatatctattttatcccgatattcatttaacagccggatcatgttgtcattcaacggacattgatatgaaaaatagtaaaaatcaagtaccatacacccctccatcatctctggttatagaaattttcccacgtcatcacatactccttttcaccggtagcttcatccaacccttcacaccggatcgcaaagccttcccgctgataaaaatggatcgcccgtatgttcttttgatacacatttaagcttagctttgcttttctgtttttcacaaaatccagtaaaagttttccgattccctgcgaccgcatctcatcagaaacgaaaataccctcaatatattcatcatttaatccgatgaatccctgtatctgccgggcatcctcatatacgtaaacctctgcctgtcccaacagttcctttaccagttcaaagttatccctccagtattgagccggaataaaacaatgggcgtttaaattaccctctaaccatatctcggcaaccctgcctgtgtattcactctgtaatctgctgatcataataaatcccctaaataaacggtctactttttcttatagccgcagtcacaataaggtccgccggaggcaagcgtgtattccctgacaaaatccgtcacaccgcctgcttcgctcattgtataatccagacggcacatcgcaggtatcagactggtaagccccaactctcccataagtctgcagattccgcagcttgtaaatcttgcctcgtatccgcttccgtcttcatactcataaaagtccatattccacgaatacggatttctgtcgcccgctttgagttttgccgtatccttcattgccttgatatctgactccgaatattttttcttcccgctcatcctgcaaaaccgctgcatcatccccgtcatcatggactttttataatacttcgtcgcgtccgaaagctccggctgtgttggcatattcaggaaaaatgcagacagcatggcacaattcacgatattcatcttgaatctgtccgccttctcaaattccggaagtctctctatgagctctctgtactttttctttgctaaagcagtaattttcctgctttcctcttcatcatacttcaaaacctctgtgagatttctttgaaaagatttgtgaaaaatcatccacatgcccatcggcatacctgcatatttcatataaactcaacctcctgttaaaatttccgctttccacgctattcccctaaaagccctgcccgctccagataccacgcctgaaaaccgtcgaacgtcaatcgtttgtccagattttcattcggtctggaagcggattcgataatctcccggcagttcttcgttctgcgcagcatgtcataggttggtcccagcggatctccgtatttcgccgctgttgcggcataaatataatcagctgacattctttttcaaattcatccatcttctgctatccttccgctgccgtatgtgcctgtttttccatacactgctgctctcccctttatcttagcataaaacaagcggtaacacacgaatctttcatcccgtgataccgcctattgtttctacattgacttcatgctgccgatcatctgtcagatcttgcaaccgaacaaatccattcctttacaccatctgcaccagccatacattactccgcaccatgcggtatccgatcaccaccttaatcagctcggtcgcctgcaccagaaagtacacactcacaatgccaagtcctgtaaaacgtgccagtacaaacgcggccggcacgacaacgatccacgtgaaaacagagtcaaacaggaacgtaaccatcgtttttccgcccgatcgcagcgtaaagtacgacgcatggctgaacgaacagaacggcatgatcatcgccgatacggcgatgaagcttgtcgcaagcgccttgatctcctccgttgtattgtagatctgcgggaaaaatcctccgaccaccagcataagacctgccacgatcacgcagcagaacacactgaacacgatcatcttgttgtctgcgtcctttgcttcttccagctcgccggcgcccagatactgtccgaccacgatactgatgcaggaaccaagctgcagatagatgatgttgaacaggtttgtgattgtcgtcgctatattcagtcccgccactacctccagtccacggacggaatagcactgtgtgaccgccgtcatacccgccgcccacagaacctcgttgagcatcagcggaaatcccttcacgataatcgccttcaattcctctcccggaatgccaaatccggtataggcgccctttaaatacaggttctgtccggtatggctgtgcgcccagacaataatgatgaacgcctcaatgtagcgtgcaatcaccgtcgcaagcgcggcgccggcaacaccaagctccgggaacggtccgattccgaagatcagaagataatctaacagcgcattgcttcccacagcgacaaagctcgcaaccatcggcaccatcgtctgtcccgtctccttgatattcgtcgcatacgcctggttgaccgcaaacggaaccagtcccactaccatgatcccaagatactgcagtccatacccaagcgccacatccgtcgccccgtctccggcggtatccgtcagataaagcgagatcagattgtccccgcatgttagaaacagcagaatggtaagccccgtcacaagcaacgccgcatatagcttaaagcggaaggaatacatatgtcccttgtgattcctcttgccgtaatactgcgccccgaaaatactggctgccgaaaccgcgccgaaaatcgccagattgtatacaaaaatgagctggttcacgatggcaaccccggacatctgctccgtgccgagctgtcccaccatgatgttatccagaaagctgacaagattcgtgatcgcattctgtacaatcatgggcagcgccagatataaatatcttttataaaatgcccggtctccgatatatttttccttaaattctgctaacttcataagttcttttccttctataagatctcttgtgtgtttatctgatcatcttaacatcttcccgcaaaaaaagcactgtttttttgaaaaacagtgccatttcccgcctgccgcccattgctgccgctcagaacagatccagcatattgtccagatagattttttccctgacgtgcagctgatacccgggtttcgtcatatagtagagcaggaactccagaatcagcgcactgccaagtccccgcccctcgatcttgaactgggaaaatcccatgggcaggtagatattttttatggcgtccgtaccgataaatcccggattggccatcgctttggaaaacagatagccgccctctgcatccggagccgcgcagtgatgctccgcgccgctttctccgagatttttgcggctgacggcttcgtaacagcgcttcctgtccccgcagccaaaccagcagcattcattgcaaagaaattccactttgtccctctgccatccggtcagcgtatcccattgcgcaaacgccttattcagccggaaatccggcacgacatagcggaaatcctcccggtcgatctccccgcgaagatcctcaaaatccgtcagaaccttggtggtcgaggagacaaaatagaaccccggatactgctgcttcaaatacgctaacaacagatccgagtgaacgatcacaccgtttctttgatccccaccttcctcaaacagggcacacaggtcattacatttccgatccgagagatgctcctcccgcagcagagagttgctgaacgtcagccgggcagaaattccgtactcccgcagcaacgccagaatctccgcggagtcgtgatctccgaacccgacgcggcctccgccccagagacagtccgccggtgcaccatagatcgatccgatgtcgcaccagtcgtaaaaatattccctgtgctcatagaacagcggcagaaacacgcgatacaattcataaaattcaaacagccccggaaggtgatagtatgcggtatctttttttaatgaagccatatctgcctcgtcacctcgctgattcccggtctaggcaaccgtgatcagttcgtactcgcgggttccgaaacctaaggctgctgctgcctcgatggtgtgtacgccatgtctggattcgattcgctcgagcagatgatctctgcccggatcgtcactcgcatagaccagatcaaggcatgcctgatcaattgcaatcggatctgtcgaaatcaggatacccatatcctccatgcacggatcctccgccactgcacagcagtcacagtcaaccgacatatttttcatgacattgatgtaaactgcattccccttaaagtaatcgacaacggaagatgccgcatccgccatagactccaggaaagagtcgtggtctgccgtccagatatcttccggctttcctgcaccatgaatatatgccttgccggcggaagatgcaatgccgatcgaaagctgtttgagcgctccgccgtatcctcccatcggatgtcccttgaaatgggaaagaaccagaagcgaatcataatccgcaaggtcttttcctacaaagttcttctgaatgactttgccgttcgggatcgcaatctccagatccggtccctccgcatccagaagatcgactttaaagtaccggctccatccatgtgcctccagcgtctttttgtgcttggcggttgtattacgctcgccttcgtatgcagtgttgcattccacaacggtaccgccaacgtaatcaatgaccggcttccagaattccggttttaaaaaattctggttccccgcctcaccggagtgaagcttgatcgccactttgccgtccagcttcttcccgagaagctgatacatctctaataccttctccgggctgatttcttttgaaaagtatacgtttgctttttcactcatatacagaatccaacctttctcctgactcgatttcaacatcgctgtttggaacgtatttctatccgttacttctattttaaagagtcatggcgcaaatttcaaggtggcagacgggattctgctgcattctggagcttttttatgtaataggaacgaagtttcctaattacataaaaaaagccccgcgtgcggaactctttgcaccgggacttctcttatacatgatactttatctgctttatgacatactgttgacggtcttatacttatagagcatctccgcatgattctgctcctccacctgaatgtctgcgagtagtttgcggacgcccgggtctgcaaacacaaacacgtcggtattatactcggaagacaccagcttctcggtaccgatacagtcagtcgcaaggaagcagtcgtttttcttgtcctcggactccgcgagagagtaggtggcggtcgggttataattctttccgtcgctgtcgttgcagttgcagttcggtacggtaccgtttaacacctgtcccagcgaatcaaaatgctgctgctccttcttgtgaagatcggtgaacaaattcacaagaaccggatcctttgcctccttgctgtatctggaatacttctccacgcaggttttctcctgggtctgaagatccttgatcgccgctgtctctttttcacttaataccatcgttgttacctcttttcttatttttttctatgctggtattattgggaaaaagtttcgcaattatacacaatatttattttccggttgacaaatgcgcgcggacgcgtctataatggcgttaatcggagcagaacacaggctttgacgggaagaagtaagaataagcggaacgaacagaaagcaaccggctgatgagaggtgcacggaaagcttattacgaatacatccccgagcttcacacccaatttgcatgaccgttctttttgcggcgatgcgatagtaggctgtgacgtagcggcgcacgttacaagcgcctgagtgttgtcggacactcgcagaggcagaccgtgtgaatggtctgtgaacaaaggtggtaacacgagtttataccctcgtcctttttgaaggacgggggtttttttgtgcggcagcaaaggtccggcaccgtccggctgttgtaccgccgccagaaaaagacaaccacaaatacaaccacaaagaaaggaactgacatcatgacattatacgatgaattagttgcccgcggcttaatcgcgcaggtaacagacgaagaagagatcaaagaactgatcaacaatggaaaagcaaccttctacattgggtttgacccgactgcagacagtctgcatgtcggacatttcatggcgctctgcttaatgaagcgcctccagcaggcaggcaacaagccgatcgccttaatcggcggcggtactgccatgatcggtgatccgtccggccgtaccgacatgcgccagatgatgacaccggagaccatccagcacaactgcgactgcttcaagaagcagatgagccgctttattgatttttccgacggcaaagcgctcatggtcaacaacgcagactggctgatggacttaaattacattgatgttctgcgcgaggtcggcgctcatttctccgtaaaccgcatgctgaccgctgagtgctacaagcagcgtatggaaaaaggcttaagcttccttgagttcaactacatgatcatgcagagctacgatttctacaccttattccagaaatacggctgcaacatggagttcggcggcgacgaccagtggagcaacatgctcggcggtacggagctgatccgccgtaagctcggaaaagacgcttacgccatgacgatcaacctgctccttaattccgaaggcaagaagatgggcaagacacagtccggcgccgtatggcttgatccggagaagacttccccgtttgatttcttccagtactggagaaacgtgtctgactccgatgtcttaaagtgcatccgtatgctgaccttcctccccctcgaggagatcgacgcgatggagagctgggaaggcgcgcaattaaaccaggcaaaagagatcttagctttcgagctgaccaaactggtacacggcgaggaggaagccaccaaggcacgcgaggcatcccatgcactctttgcaggcggcggagattccgcacacatgccgaccgtagagctttcggctgctgactttgcagacggcgatctcgacatccttgcacttctcgtgaagacagagcttgctccatcccgctccgatgcaagacgtgccgttgagcagggcggcgtaagcgttgccgatgcaaaggtcaccgatatcaagaccacctacagcgctgattccttcggtgctgacggtcttgtcgtaaaacgcggcaagaaaaaattcgtcaaggttcttgtaaaataaaccgtgcatcaacgcaaaaagaaattgccgcgataagcatagaccgcttttggggtgataagtaatattacaggaatatcagacaacaaaaaagttccagaataaacagacggcggcaaattctttgaagcaaaattcgagtatttcttccatgccgcagcaggcatcccattccgtgtcttgaccacgtttggacactcacggagtgtgtccgacaagccacagacaatgagcggactttctggtgtccctaatggcacctcttcacagacaatataaaaccgcgcgaaccgaaactcgccggcatctgctattgaaaataaggcagatgccgactcagacatcggcttcgcgcggttatgttttgttcagaggtgccaataagggacacacacaaaagtcctaaaattgtctgctggcttgcggacacagtccgtagagtgatccaaacttggaaagacatggatcatcacggatgccaactgcggcatggttagaaataccggattttgcggtcagatttgccgccgcctgtttatctggaacttttaagtatctatttcttataatattacttatcagcgcaaagcacgatatgcttatcgcggcaatttctttttactaatagtgcagcatctcgatcaaaaagagccacgcaagcccgtagtatgtcactaccgccaccagatcattgaccgtcgtgatgagcggtccggatgcaacggcaggatcaatatgaattttgtggaaaaacatcgggatcagcgttcccaccaggcttgagatcagcatggcaaggatcagcgccgctccgatacagccggacaccgcaaaggcgaactgcagggagccggacttgaaaaagtaaatgtaacacccgatcaggataattgacatcataccaaggatcagaccgttgctaagtccgacgcgtgcttccttaaagaccaggtgcactttctgcccggcagtgagattttcatccatcaacacacggatcgtcacagccagggactgcgttcccacatttcccgccatatcgagaatcagcgactgaaagcacatgacaattgtcagttctgcgaccacgtgctcgaacatccccacgacggaagacacgaccagtcccagtccgagcagcacgatcagccacggcatacgctttttgatactgtcttttaacggctcttccaaatcttcctccgcagtcagaccggcgagcatggcataatcctcgcccatctcgtcatcgaccacctcaacaatgtcctgcgaggtgatgactccgatgatccggttctcctcgtccagaactggaatggaatcttcggaataatccttgatccattcgatgcagtccgcgatctcctccgtggcatagacgaacgggtaggacaccacgatcagatcctccagattcgtgtcctcccgcgcgatgatgagatcattcagactgatcgcaccgcagaagatacggttctcatctacaatgtaaagtgtggatatgttgtcattgtctgccgcctgccggatcaactcgcgcatagcctgctttacggtcacattagacggaatctccacatagttggtggacatccggtttccaatctgctcttcatcaaaagaatcgatgagatcgatcttatgccgtacctcctcatcgagcagctccgtcagcgtctcgcgttcttttttgtccatctggcgcagcagatcggcaatttcatctgcgtccatctccgagacgactgctgcctttttcttcatatccatctcttccagataggacggaatctcctcctcatcgatgtaggagagaacctccgagatctcctccgcatttagaatgcggtacaggcgctgccgctcggtgggattcatgtcttcgagcgccgccgcaatatcattctcatgataatccagaagtctgtcatgcatcaccttcggggatgacattccgcggacaatcgcctcgatctctttttgatatttcatctgaacttccgtcacatcttccagtttctttttttctgtcatctgctctttcatgcaagccaccatttcctttccgatgttgtcacattccgccggggcaaaatgtgcacgcaaataacgaacaccacactatttatggcattctgatacagacagcgcacggctgtctccttgtcttcggcatgatttgattacgttgtctggaaatattgcctgtgaatacagagcataagaaaaaaagatatcctcaataatcgttcttcgatcaaaaaatggcaggcagactgccgctcatttttccctcacagacaatatgattacttcgtccgcaactgtcgtcagtcatgctgccacctccattcttattttaatccgttgctatcctaacacatttgtatctgttttgcaacgcactttttctgtcagccaggtgcgcaccagcggaagccagctctgacactgctcctgcacaccatagccatccacattcatagactgctccgtacaggtggataacccgtgtccgcctgccggatacatatgaaattccaccggcacattcaccttgcgcatcgctgcgataagcagcagggaattctcgaccggcacacagtcatcggtaaacgtgtgccataaaaataccggcggcatgtgctctgtcacctgcttctccagtgagactttttccagcatctcctccgtcttctgtccctttaacagagcttcaaacgatcccctgtgtgcgtattcgccggacgtgataaccggatagcagagaatcagtcccgccggacgcagaatctcatttgtcactccggctctctcagaaatccaggattcatgccagaatacgcctaaacttgccgcgagatgacctcccgcggagcatccttctacataaatctgatcctccttaacgccccattccgcagcgtgtgcatggatcagtttcatcgcctccgccagctctaaaagcgctgtcgggaacaccgccggcgcgcaggaataacgcagcacggcaacatggtatcccattgcgagaaactgcactgccatcggctccgcctcccggtctgaggtccattcgtatcctcctcccggacacagcagaatgagcggtcgctccttgatccgaagttcccggcttttttcctgaatgtagatacagagtcttgcccccggcagggatccctccacctgtattgcgattgtttctgtcagcatctgtctattctcccccgtgttttcttaatatacaatctggttccgtccgttttcttttccgcgatagagcttctgatccgctgcacggatgaccgcttccatatccttctctccgctatactcctccagtccaaatgtcatggtgacatgaatccaatcactctgataaggaatgcccatgccgcgaattctcttcaatatatcgtgaagtacctcattcgcctgatcgccgtttttattctgaaatacaaacagaaattcctctccgccccagcggcagacttttccttcttttcccattacctccagaaagacttttgccagttctttcaacaccatatccccggcatcatgcccgtaggtatcgtttgtcttcttgaaaaaatcaatgtcgccgattgcaacggacacatatccgatctctccagacgcatattttccgacgattttctccagatacgaccgcatgctccagcggttgtacaggccggtaagcggatcaatggacgccatgtgttccagcttctcattatattttacaagcttgtattccatctcctgcgaatctttggtaaacacgatcatgattgccgtcaattccccaaaaatagcaagcgtattgataatctgaaagagaacaccggtgtccgcagaaatatttgtcaccggatcatacctgttcgtataggcatacagaaaaatacggtacgcacatgccagtgctgcagcgccgattttcattcccatcgttcccgcgctcacggtaaaattgagaaccagaagcacaaacacaaaatgttgtacaccgcagttccagccgtactcccagataaaaatcagaatccataacgccatcagcgcctgcgaaaatattgatgcaaacttcgtatgattcagataagttgtgtaaaaggacacgagataacatcctatgcacaccaggcagatcaccgctgagcggatatccttaatcgcgcagaatacagcaaacagggttaaaaagtacagacacagcatcaatgcactgatccgcagcgtaaccgccgtcttctttgtctcgttctcactctgcacgtcctttaatataaaatcctttatcttttgcaccatagtacagtcccctccccggaaaaccgacctttctccatagttctatcatatacatttgaaggctttttttcaaggtcttccttataccttaagtactatatattgtattccgaaaaacattgcatccccggcgcaacgtcatttctttttctgattctgatgtaaaacaggataacatgtaaaaaggcgtacgatttctcgtacgccattactgacccaaaggcgactgacggatttgaaccgacgatcagggagttgcagtcccacgccttaccacttggctaagtcgccctatctctcttatatgtctattatatgcagattcccgtcatttatgacagatcccttctgccggaaagcgccgcatcagacacacagagattttaacaaaaccattgtctcacgtcaagtcatatttttaaaataaacagcatctgccgcctacggcgttccaaaaacaaatgtcacatacattgttgcctgatcgtaagttccgtcttccttcggatcaagcactgtcttcgtcagcatatattccccatccgtcagcgtgctgtacagccactcccatttgacatccgtgaccacgctgctgtgcgccggaatggaatagaccccctcgttaaacttataattgggaaccaacgtcgacacatccacccagtcgctcccgatatatttctgcagatgaaaatcggttccgtacaaaatctcctcatccgtataatttgagatcgtaaccgatgcctttccgccttccacacgattaatatacattgcataaggtacttcccggtctgcttcctccgtatccccgatcggtacaacctccgttttatttccaccgcaggctgtcagcattcccatacagatcatcacgatacagcctgttatccataattttctcatgaattttcctccgataaaatcttcctttttattataaccgataaatgcattgtttgtctcgaaagattttcttatttattttacttgacaactttacttgtcaaacatataattattttgacaagtaaagttgtcaaatgcatggctctttgtgccgcagatgtcacaaagccgccacaaccgccgacggacggaagctctggctcccggtttcttcggcacacaacgtctgcggaattggaggattatatgaacgaagaaatgacgccggattacatgaccggcacacccaatactgtctgtgcggatgccagacgacagttttcccgcatcggtctgatgtttctggtcggaaccgcgctcatctatggagttcagttcggcgcaagcgcgatcgcaaacgcgatcaatccggatctgctttccagcacgagttacgcgcttttaatcgttatgattcctatgtatgtgatcgccatgccgatcatggcgcttctgatcaagaggattccggctgtgactcttcccaaaaagcacatgaccttcggtcagtggctgattgcttttctcatgtgctatggtgccatgtatgtgagcaattatatcggtcttatcctgacacagttgatcagtatcctgaagggaagcccggtaaccaataccatgcttgaagtcgctaccagctccaatctctgggtaaatctgtttatcatggtgctctgcgccccggttgccgaagagctgatcttccggaagcttctcattgaccgccttgcgcagtatggcgagggcgtagctgtgcttttctccggcctgatgttcggactgtttcacggaaatctgaatcagttcgtctatgcttttgttctcggtctgtgcttcggctttatctatgtcaagaccggcaacatccgctacacgatcgggttacacatgctggtgaacttcctcggctctgtactcggtgtggcgatcttgaaatggctgggagatgattttctctccatcgcttccgatcctgcaggcatgatgtcctacatgacaggaaactttggaaaactgatcgtttactttatttacattttccttttgctcggcgtggcgattgccggtattattctctttatcgtcaatctgaagaaaatccgcttcctgcctggaatgaacacgcttccaaaaggaaaacgcttttccacaaccgtgttaaacgttggaatggctctctacatgatcgtctggatcgtgattatcattgtacagctctttcaataatgaaaaaagctgccgcaggaatcccgttttatcggttctattcctgtgacagcttttattatgcaatatttactgctctttcccgcagcttctctaattttccgcggtctgcccatcctgtgcatttaagatgctcataaattcttcccctgtgatggtctccttgtcatagagatatttcgcaagttcatccagctttgcgcggttgtccttaaggatcttcgccgccttctcatgctgcttttttaccagttccactacttttctgtcgatctgtgcctgcgtgtctgctgagcacgccagggatgcatcgccgccaaggtactggttggtcaccgtctcaagcgccaccatatcgaattcatcactcataccgtagcgcgtgatcatcgctcttgccagcttggtcgcctgctcaatatcgttggaagcacctgttgtaacacaatcaaataccacttcctccgcagcacgaccgcctgtcagcgttgcgatcttgttctcgatctcttccttattcataagataatgtgtgccttcctctacctgcatcgtataacccaatgcaccggaagttctcggaataatcgtgatcttctgtactggagcagaatttgtctgctttgccgctacaagggcatgaccgatctcatgataagccacggtccatttttccttatctgtcagaatcgcattcttcttctggtaaccggcaatgacgacttcaatgctctcttccagatccgcctgtgtcgcataggctctgccatcacgcaccgcgcgcagcgcagcctcatttacaatattcgccagctccgctccggatgccccggacgccattctggcaatcttgttaaaatccacattatccgataccttgatcttcttcgcatgtaccttaagaattgcctctctgccgcttagatccggcagttctaccggtacacgccggtcaaaacgtcccggacgcgtcagtgccgggtccaaagactccggccggttcgttgccgccaggataatcactcctgtgttgccctcaaaaccatccatttccgtgagaagctgattaagtgtctgctcacgctcatcatttccgcccatatttccgtcacgctttttaccgatggcgtcaatctcatcaataaatacgatacatggtgctttctctttcgcctggcggaacaggtcacgcacctttgaagcgcccatgccgacaaacatctccacaaattctgagcctgacatcgagaaaaacggtacatttgcctctccggcgacagccttcgccagcatcgtcttaccggttcccggaggaccgacaagcagaataccttttggcatggatgcaccaatctcccggtacttgtccggattatgcagataatccacaatctccgtcagattctccttcgcttcatcctcacctgccacgtccgtgaacttgattccctccgaagactttacgtatactttggcattcgacttgcccataccgaacatcatcgcgttcccgccgccaccggctttgtccatcagacgcttatacataaactggccgattatcatgaaaatggcgatcggcacaatccagcccagcaatgcacttaagaacggggacatctgctctacaatctgacttgcaaactccgccccggaatcatgaagccgctgcaccagatccggatcattcatcggacccgtcttgtaaatatttccatccttgtccgtaaagacgatctcactctcatcgatctcgacttttgcaatctttttatcttccgtcatggtcataaacgttccatagtccacttccctgacctgacgctctgccatccacggaatcgccataaaattcagcatcatcaacagcagaaaaaccataacataatagaagatcagaggttttttcggtgtttttacttcattcatactgactcccctttcctgtttattctcttatatattgtgataattttaacacggtttctaaacagtgtcatattatatttttataaacaaatctaaaaaatttgcgatccgttttccacacaatccagatgcagagtgatttttaaacaaaaaaagatcccgaaaaaatcttcgagatctttacagaggcgactgacggatttgaaccgacgatcagggagttgcagtcccacgccttaccacttggctaagtcgccatatttaagcacggacagaataatgatgcccgctttacaaaattactgataaaaaaactccccgagtaggactcgaacctacgacagcgcggttaacagccgcgtgctctaccgactgagctatcgaggaatactaactgaaagatacaaaatgacacaaaatgacgtagctagtacgtcatttactatataacagaattgttataattgcaatacttttttaaattgtaccttcaaaacttcatacagaaatcatccaacaaacctgcgatcattgttcgctatttggtcaagccctcgatcgattagtaacagtcagctccacacgttaccgtgcttccacctctgccctatctaccttgtagtcttcaagggatcttactcacttatgtgagggatatctcatct

SEQ ID NO: 22 - DNA, 15128 bp, Roseburia hominis
cattttaatctcaaacccatcccggaggtggaacaggtcactgcctgacctgtcccgccgggacggttctcttaacaacaccatatagattttttgtacgccgccgcccgccatcgagcagagtttttacacctaattggggataaaactgtttacaccgggaggttctttttttatactggaaccatcaaaggagttacagagatgaaaataaaaattgagattgacgagagcgccgcggaggatgaagtgattatccgctgccgcggtctgacgaaacaggtcgctgccgtgcagcgcgccgtgcgggatgtcaccaacgcttccgagaagatcctgctttataaagggaacacggaatactatgtgacattgtccaagatcctgtttttcgagacagacgagaacgggatcagcgcacacacccgggatgagatgtatcagacccggtacaaactatacgagctggaagatatgcttccgggcgtttttatgagagtatccaaatccacgatcttaaacacggatcagatttactctattgaccgcaatctgacggcgtcgagtgtggtggcgtttttaaacacgcacaagaaggtctatgtatcgcggtattactataaaccgttgactcaaaaattagaagaaaagaggttgcatcatgaaaagtagcaaagtattctggggaatcttttttatcctcgcagcagtgtatgtcgttataagcaaatttggaattctgccggatatcggcgtgttcagcattattctgaccgtatttttcctctggctttttgtcgagggaatccgcaatgtgaatttctgggaaatcctgttctcaattgcgtttatctgtatcatatacgatgagccgcttggaattacggcactcacgccgtggacggtgctcggcgcggcattcctcggaagcatcggtctgtcactcattttcggcgggaaaaagcggaaatggaagacggtgaccggcaatgtcgggacatccagcagtgaacagtataccggcgaagagatccggtgtgagaacagcttcggttccgcaatccgctacatcaactccgacaacttcagacgcgccgccatcgaaaataatttcggatcgctttcggtgtacttcgacaatgcgatcgtgcaggaaggctctgcaaatgtgagcgtggagaataatttcggggagactaacctttacatcccgaaagaatggaagattcagaataatctggaccgttcgttcggcgccatccgtgagaccggcagcagcatcggaacgagcagcacggtgctgtatctgaatggatccgcgaactttggagagattcatctgcactacatttaagaaataccgcggaaagtggaagcagcagggatcgcgggcatcatgtaaaaaggtttacagcgtttcagagtgcaaccggagacggtcattcttttgagcaaaatccctgtatttcttccacactgcgtttgacatcggattctgtgtcttggccacgttttgacaatccgcgggatgtgtccgtcacgccgcagacaatgagcggacttcctggtgcccctagcggcaccgcttcacagacaatataaaaccgcgcgaaccgaaactcgctggcatctgctattgaaaatagggcagatgccaactcagacatcggcttcgcgcggttatgttttgtttagcggtgtcgacaaggggcacacacgaaagcccttaaattgtctgcggagtgcggccacatttcgcggagtgctcaaaacttggaaagacacggatcatcgaggatgtcaaacgcggtgcggattagaaataccggattttgcgatcagaatgaccgtctccggttgcatcctgaaacgtcagaaaacttttacatcatccgggcactgttccctgccgcctccgcttttggcggtatgtttattcctctgtatctgcgtagctggtatcttcgtgaagattcggcttcatgtcaataccgcggttcgcgtcacctgtgatgtcttttccgaagtgatagtcgttgcccggcaggatggcatttaagaaaatacctgcgatcgctgcgactgccagcgcggtgagtgtgacggaggttccggcgatcgtaaaggtaagaccgtcggagaaaccaagaccgcacacgaagatcacgcctgcgatgatcagattgcgtgactgcgtaaaatccacatgattttccacaacattgcggacgccgatggcggagatcataccgtagagcatgaagctgacaccgccgatgatagcggacggcatggaaccgatcacagcagccatcttcggaataaagcttaagatgatggcgtagcaggctgcgatgcggatgacttttggatcgtacactttgctcagttcgagtacgccggtattttcaccgtaggtggtgtttgcgggaccgccgacgagggcggacagggaagtggcgagtccgtcgccgatcagggtgcggtggagtcccggatcctcgataaaattctgatcaaccgtcgcggagatggcggaaatatcgccaatgtgttccatcatggttgcgagtgcgatcggagccatgaccaaaatggcggacagattgaatttgcagagggaaaatgccggtacaccgacccaggaagcgtttgcgatgtcggtaaaagaaagaagggcagagccgtctgcgtttgtcatgcccatggcgttaaagatcaatgcggcaatataagaaataatgacgcccatcagaatcgggatgatcttaaacattcctctgccccagatattgaaaacgatgatcgtaaccagggcaatgagggcgagaagccagttggtggaagcgttgttgatggcagaaccggcaaggctcagtccgatgcagatgatgatcggaccggttacgaccggcggaagaaaacgcatgaccttcttgacaccgacaagcttgataatcagcgcgagaatcagatataaaagacccgcgacaacaattccaccgcaggcataggaaagtttgtccgcgttggacatatcggcgaatacaccggaatccatgtttgcaatcgtggcaaaaccgccgaggaaggcaaaggaagaaccgagaaacgccggaaccttgaatttggaacatagatggaaaaataaagttccgataccggcacagatcaatgtaacctgtacatgtagaacatcttcgccgaagtagctgttgacaagaattggtacaagaatggttgcgccgaacatggcaaacatatgctgcaggccaagaatcagcatttttggtacgccaagtacgctggcgtcgcggattgctccgtctttttcgttcatagtaaactcctcctgatgtgaaatgattggtagttgcgtatatacaaatggcaaatcagaacttctgatttgccataagatatcaaaaaatagatccggtgaaacgtcttgcctcctgatcgtaatcacggacgggaatctggtccagttcgccggtaccgtcgagatagaaagtgagcagcgtctgcgtcatatagggactgatccagagagccgcaatgccaaaagagcagatggcaagcgcgccccagccgagaaagctgaataaaatgtaaagcagcttcctgcgtcgtccgcgcataaatttacggcaggtgcgaaaagcatcccgcacgcttaaatgcggatggtctaaaagaaagaagaaaaccatgcggtaggtaagcaacacacagaaagtaaaaatcagaccgaggatgcttccggcagcaagcagggcaccggagagatcggagacaccggttttataaaaataaagaacaccggcaatggcaggaatacctgcgatcaccagaaatacatcgaagagaacggcagcgagaaagaagcgctctgcgccattgcgaaacggtgtaaaaacatcacggatgcggtatgtctgaccgcgcgtcatattcatatgaaccagcataacgccggtgtctagcatctgggcgatcagaagaattaaaatatctgcaatcgtgctgatgataagctgcggagtgccgggataatcgccgagcgtcatggagaacggaatctcgatgagcgtcggaattaaggaggcagtcagaaatgctgccatcggtacggaataacggttatttaaaatgtcgcgtgaaatacgttttaattcgctggatgatcttgacatgtgtagactcctgtggatgtgatagttgtgtatgttctggtgaaagttttgctttcgcgaacattatattcctatagttacgcactgctcattgctttcgcgaacattatttccctgtatctgcgcagatttttgcgcatccgaagttccgcaggaacttctaatatgaactcgccagagttcattatagcatggaagaccgtgatatgctactggcagttaaatagatttggaatccggaaacgtgcgcgtgctttacaaccgaaaatgcggcggttataatagcagggagtaagataggaatggagatcggaatgtttcagacggatagacgggtagaccgggatttttatattatgggctggtgcgcggcgggaattttcgcggcgctgtttttgtttgtcagagtaacaggaattccggtctggaaatttttgctgccctgcccgtttcatgcgctgaccggagcgtactgtccggggtgcggagggacaagagccgtcagggcgctgcttgccggcaaatggctgcgctcctttgtgctgcatccgttcgtgccgtatgctacgctgcttagcagctggtttatgatcagccagaccattgaacgcgtgagcggaagccggatacggattgccctgcgctttcgcgatatctatatatggatcgccctgcttttgattgtggtcaactgtctggtcaagaatctcgccctgttcgtatggcatgtggatttactgggctaaagaattcatcagtgtatcaaaatcgatgccgagcgtgccgtatacctgacgcgccatattttccacgccgccataatataattcggcaatcgcaaatgtgtaaataatcatggcgaggacaatgccaagggcgatggagccgaggattaaggcagctttcgcgcgggaggtcagcgtgcgctcgccgccccgggataaaagtgcaaaaacgatggcaagagatccgcagatcagtgccggatagaccatacaaaaagtagctgccccgatcacgccgagaagcagagcggcattttccattcgctgggaacgtcgtttgttgttcatgataatcagacctttcccgatatgccggtattcccagtatatcgcaggataactttgtctattgtaacatgggaaagccaaaaagacaatgaggaaggcacttgagattacagcggattttcggtatactgggagcagactcggtaaaatttggaggacagatatggatattattgcaaaaatttctgaggaactggggattaaacgccatcagacagaggcggcagtcaagctgattgatgaaggcaataccattccttttattgcgcgttaccggaaggaggcgaccggcgcattaaacgatgaggtgcttcgtaacctgtcggagcgccttacctatttaagaggactggaggagcgcaaggagacggtgctcgccagcattgaggagcaggggaagctgacggacgaactgaaagcgcagatcctttcggcggagacgatggttctgctggaggatttataccgcccgtacaagccgaagcgcagaacgcgtgccacgatcgccaaggaaaagggactggaaccgcttgccggtgtgattacactgcagatgataaaaacgccgctcatagaagaggcggcaaaatacgtggatgccgaaaagggagttacaaccgccgaggaggcgattgcgggagcgtcggatattattgcggagtccatctctgacgaggcggattaccgtacgcatatccgtgacctcacggtgaaaaaaggccggatgacttccactgccaaggatccggaggcggaatccgtctatgagatgtattacgattttgacgagccggtggcaaagcttgcagggcaccggattctggcggtgaaccgcggagaaaaagaaaaattcctcactgtgaagatcgaagcgccgcaggaggacattctgcgctatctggagaaaaaggtgattgtacgggacaacccgcagacgaatgaggtgctgcgcgatgtggtgagagacgcctatgaccgtctgattgcaccggcgatcgagcgcgagatccggagtaacctgaccgagtgtgcggaggacggcgccatccgtgtattcggaaagaacttagagcagctgctgatgcagccgccgattgccggacaggtggtgctcggatgggatccggcgtttcggacaggctgtaagcttgctgtggtagatccgaccggaaaagtgcttgatacgacggtgatttatccgacggctccgcagaataaagtggcggaggcaaaagcggtattaaagaaattgattgccaaatatcacattaccctgatttcccttggaaacggaacggcatcgcgggaatccgaacagatcattgtgggcctgttaaaggaacttccggtaaaagtacagtacattattgtcaatgaggcgggcgcgtcggtctattctgccagcaagcttgccacggaagaattcccgaattttgacgtgggacagcgaagcgcagcgtccatggcgcgccgtctgcaggatccgttggcggagcttgttaaaatcgatccgaagtccatcggtgtggggcagtatcagcatgacatgaaccagaaaaagctcggggaggcgctcggtggcgtagtcgaggactgtgtgaacaaagtcggcgtggatttgaacactgcctcggcatcgcttctggaatacgtctccggcatcagcaagacgctggcaaaaaatattgtaagctaccgcgaggaaaacggcagatttgtatcccgtgcaggacttttgaaggtgccgaagctgggaccgaaggcatatgaacagtgcgcaggattcctcaggatcggtgacggaaagaatccgctcgatgcgaccggtgtgcacccggagagctatgatgccacgaagaagcttctggagcggctggattatacgttatctgacgtaaaagagcggaaggtagagggcatttccaaaaagatccatgactacaaaaaactctcagaagaactgggtgtgggagagatgacgctgcaggacatcgtcaaggagctggagaagccggcgagagacccgagagaggacatgccaaagccgattctgcgcagcgatgtgcttgagatcaaagacctgacgccggggatgattctgaaaggaaccgtgcgcaacgtcattgattttggtgcgtttgtcgatattggcgttcatcaggacggactggtgcatatttcgcagatgagcgacaagtttatcaagcacccgctcgaagttgtcagcgtcggggatattgtggaagtgaaagtattaagcgttgatccgaaaaagcagcgcatccagctgacgatgaagctgaacggatagagaaaaagggttgacagtatgcccatatgggcatacaatatagaagcaaaataaatataggaattcttcggggcagggtgatatgagttcacagagatggaagcatagattcccgaccgacggtgattctggcagacgccagatcagtccgtgagctgcagttgcagttgagccggtgtgaatccgggaccgacagtatagtctggatgagagaagagaagcatgttaggaggacctgcggcagcagggtcttaagaatgcagtttaacgccccggatgtagagatcatccggggctttttgtgtggcgggaataagcgctgttccgctgccggaatgcaatccgttgaaagacggctgacacgcgagaatacctcgaatttctgcagagaaaaggagacgagtcattatggacacaaacagtacaatcacaggtaggacaacaacaaacagtatttcgagcgttcgctacatgagcgtcacggcaatgctttccgcagtagcatttattttaatgttcctggatttttccgttccgtttatgccggctttcatcaagatggatctctcagagctcccggcactgatcggtgcattttccatgggaccggtatgcggcattctgatctgtctgatcaagaatgtgcttcatctgtttattacaacaaccggcggcgtcggtgagctttccaacttccttcttggcgtagcattcgtacttccggcaggattgatttaccgccacaaaaagagccgcagaagcgcattgattggatccctgctcggtgcggtgatcatgggtgtattttccgtggtatccaactacttcctggtatatccggtatactacaactttatgccggaagaagctgtgctcggcgcttatcaggtgatcgtaccatccgtgaagagcattctgcagtgcctggtgtgcttcaatatgccgtttaccatcgtgaagggactgttttccgtggtaatcacattcctggtatacaaacacatttcaccgattctgaaaggagcgaaccgctagaaaaggggctgtcttagacgacagccccttttcttttggaatgaaaaatgctatactagcttagatatagacaggagggactgttatgccgctaaagtttgatattacattgacagcagaagatatgtaccggtttaatatgtaccagacctactccggatttcacgggtggttttccattgcgttttccatcctgatttttgtggtggcaggagtgacccgcgggaagatcgaggcggcatacaccgcattatatattgtatttggcatcgtatttctggtctatcctccggtgagcctgtacctaaggtcgaagcgcacactggcaatgtccgaggtgctgcggggaacgctgcactatgaggtggacgaggagggactgcacgtatcgcagaaggaagagagtgcgctgcttccgtgggagcagatctataaaatggtcgcgacgaagcacaatgttctggtgtacagcagccggatcaatgcctatgtcattccgagagcacagctgggggaaagctacgcggcactgcagacacaggctgcggcacatctgccggcgtaccgtttgaagatgaagtagagaatggggattttaaaatatgacagaaaagatctatgaaacatattcgccggaggagacgcacgcgcttggaaaacgtctgggcgcggaggcaaagcccggcgatgtctatacgctggtgggagatctgggcgtcggaaagacagtcttcacacagggaattgcggaaggacttggcatcacggagccggtctccagcccgacctttacaatcgtgcaggtatatgaggagggcaggatgccgttttatcatttcgatgtttaccgcatcggggacatcgaggagatggatgagatcggctacgaggattatttctacggggatggtctgtgcatgatcgagtgggcgaatctgatcgaagagattctgccggagcggcgcagcgaagttactatagaaaaagatctggaaatgggatttgattatcgcagaattaccataagagagcatcaggaggacagaaaatgaaaatattaggattggacagttccggtctggtggcgagcgttgcaatcgcggaggatgacaaccttctgggagaatataccgtaaactataaaaagacacattcacagacccttcttcccatgctggatgaggtggcgcgcatgatcgaactggatctttcgagtatcgatgcaatcgcggttgcaggcggaccgggctcatttacgggacttcggattggttcggcgacggcaaaaggtttgggactcgcgttggagaagccgatcctcaatgtgccgacggtagacgcacttgcatacaatctggtgggacaccgggatatggtatgcccgcttatggacgcaagaagaaatcagacctataccggtttgtaccgttttgatggaaacgacatgcaggtgctgcgcggagagtgtgccgtgggaatcgatgagattgcggcggacatcaacagcagaggtgaggcggtcgtatttttgggagacggtgtaccggtttttaaggcatacctggaggaacagcttacggtgccacattcctatgcgcctgcacatctgaacaagcagcgggccggagcggtcgctgtgcttggcatgcagtattacagagagggaaaaacggagagcgcggcggaacaccgtccggaatatctccggctgtcccaggcggaaagagagcgcaaggagcaggaagccgcaaaaggaaaggaaaacatatgagtattatccggagcatgagggcagaagatgcggcgaaggtggcgtctctggaggcggagattttttcgcagccgtggagtgagaatgcttttttggattcgctttgtctgcccgacacgatctttctggtggcagaggaatcgggtgtcatacaggggtacatcggaatgtatcttgcggccgatgagggtgagatcacaaatgtggctgtgaatcctgcgtgccgcaggcgtggaatcggggaagggctgctcacagagatgaaaaaacgtgccgcagaccacaagattgcccgcattgtccttgaagtgcgcgtgtcgaatgagggggcgatccgtttgtacgagaagcagggattttcctcggtgggtatccgccgggggttttatgaattcccgagagaagatgccagaattatggtctgtgccctgtaattccctgtgggattgcacggcggctcaatgatataatgaatcctgacggattcatattagaagttcctaaggaatttcggatgcgcagaaagcggcgcgaaacagacgatagaatggagaatatatcaatgagcagacgaaacggagtgatttattgcaaccgatgtggcagcccgatctgtacggaaggggaagcaggaaaaagttcctttcttactatttgtaaagagtggggctatttttccgaacgaaaagacggtacggtgcacaggatggatctgtgcgaatcgtgttatgacgcctgggtgcggacgtttgccatcgcgccggaggtggaacaaaagacagaactgatatagcgataaaggagtttattcatgttagatgtatgcctattgggaacaggaggaatgatgccgctgccccgccgttttctgacggcggctatgctgcgttacaacggcagcagtctgctgattgattgcggcgagggaacacaggtggcgatcaaggaaaagggactgacgtttaagcccattgatgtcatctgttttacccattaccacggagatcacatcggcggactgccgggactgcttctcaccatgggaaatgcggacagaaccgagccgctgaccatgatcggtccgcgggggttggagcgggtggtgaacgcgctccgggtgattgctccggaacttccgtttgaaatacgttttattgagattacggaaccggaaatgcggctggaactcaatggatactgtatacatgcatttcgtgtcaatcataatgttacctgttacggttattcggtcgaaataaaacgtgcagggaagtttgacgtggagagagcgcgtgcggcggcaattccgcagaaatactggagccgtctgcagaagggagagatcctgtccggggaagacggaacggtctatacgccggagatggtgctcggaccagccagacgcggcatcaagatgacgtactgcacggacaccagaccgacagaatcgatcgtggcagcggcggagggatcggatctttttatctgcgagggaatgtatgcggagccggagaagctcgtcaaggcgaagcagtacaaacacatgacattctatgaggcagcagacatggcgaagagagccggcgtcagggaaatgtggctgacccattactccccgtctctggtgcacgcggagaactatctgccccaggtgcgtgagattttcccggatgcgtttttgggaaaagacgggaaaaacgtggaattgatgtttgaggatgaggactaaagaaaaagggaggttgtcataatgaagaagagtggcgtgattaaggcagtgataacaatactgatcattttactgatcgtgggcgtgtattacttttttacgacacagagacggacatcggtggaagatacggtggagctgacagagatacaaaagctcatcacgaagaatctggataccaactatccggcaactccgcgtgaggttgtgaagtattacaaccgtattctggagtgcttctatgatgatacctatacggacgatgaactggagtcgctggcggatcaggcgagaaagctgctggacgacgaactgttggagaacaatccgcgggatcagtatctttccgacctgaaagcggatattgaagattaccacaacaaatcaaaaacgattcgcagcagtaatgtctgcgacagcaatgatgtggtgtatcagacggtggacgggagagagtgcgcttatgtgacggcgtcttattttatgaatgagaacaacagctttgaccgtaccaacgaaatgtatgttttgagaaaagatgacgatggagactggaagattctggtattctatcaggtggagggagattcttccgatgaacagtaatgaaataaaaatattggcgattgaaagctcgtgcgatgagacggcagcagcggttgtcgtgaatggaagggatgtcagatcaaatgtgatatcctcccagattgcattgcataccttgtatggcggcgttgttccggagattgcctcgcgcaaacacattgaaaaaatcaatcaggtgattggacaggcactttcggatgcggggatgacgctggatgatatggatgcgatcggtgtcacctacggcccggggcttgttggagcactgcttgtcggagtggcggaggcaaaagccatcagctatgctaaaaagctgccactggtgggcgtgcatcatatcgaggggcatatcagcgccaattacatagagaacaaagatctggagccgccttttctatgcctggtggtgtccggcggacatacgcatcttgtcaaggtgcttgattatggaaaatacgagatccttggaaaaacgagggacgacgcggcgggagaggcttttgacaaagtggcgcgcgccattggactcggctatccgggcggaccgaagattgaaaaagtggcgcatgaggggaatccgcatgcggtagagtttccgcgcgccaaaatcgtggacggtccgtatgacttcagcttcagtggcttgaagtctgcggtgctcaactatttaaacggttgtaaaatgaagaacattccgatcgtacaggcggatattgcggcgtccttccagaaagcggtgacggacgtgctgatcggaaatgccatgaaagcgattgatgaattcggaatggacaaatttgcgattgcgggtggagttgcgtccaacggcaccctgcgtgagggaatgcgtgcggcgtgcgagaagaagggcgtggcattttatcatccgtcgccgattttctgcaccgataatgcggcgatgatcggtgtggcggcatattatgatttcatgcgcggtcagagggacggactggatctgaatgcggtcccgaatctgaagctgggggagcgatagtggaaaaaataacagcagtggtacttgcagccggggcgggaaaacggatgcacagtgatgtgcacaagcagtatatgatgcttgccggccgcccggtgcttttttattcgctgcaggcgtttgcagagagcgcggtaaccgacattgtcgtcgtagtgggggcaggagagatcgattactgcagaaaagagattgttgaaaaatatcatatccaaaaggtctgtgcggtcgtggaaggcggacgggaacgctaccattctgtgtatgaagggcttaaggcggcggacgggagcgattacgtgctgatccatgacggggcgagaccgcttgttaccgccgatatcatcagccggtccatagcgtgcgtcagagagggggattcctgcgtggtgggaatgccggtaaaggacacgatcaaagtggtcggggcggatggctttgcaaaagagacgcccgagcggagcagcctgtggcaggttcagaccccgcagacatttccctacggacggatccgggaggcgtatgagaaggtgatggcacagggagattctgccgtcacagatgatgcgatgatgctggagactgcatttggagagcaggttcgtgtgattgagggaagttatcagaacctgaaaatcacgacgcctgaagacattatgacagcggaattatacttaaatagaaaaagtgaaaaaagtgttgacattggtggaagcagatggtaatattatttctgcactgatttgagacaaggacacggagaggtatcgaagtggtcataacgaggcggtcttgaaaaccgtttgtccgaaagggcgcatgggttcgaatcccatcctctccgcttatcaacacagacgataccgactccggtaacagaagtgctgatacaattttatatcattattttattcggagaagtacccaagctggccgaagggacacccctggaaagggtgcaggtcgttaatagcggcgcgagggttcaaatccctccttctccgctcgcttgatagacatattttctgagttgttgaaacaattcaaaaaaagtcgaaaaaagttgttgacaaaacagtcggcacgagatatactaatcaagctgattgcgaatcggaaacgaaacgcgaacaaccgcttcgaaagaagcaaaagaaaaataaaaaagttgttgacaaacggttgacggtatgatatagtaaataagctgtcgccgagagatgacaacgatgaatgagattgaaaaatccgctcggaagttgcagagcaacttctaaagtcaatacgaagtattgacgatgtacattgataactgaacagtgaataaaccttgaaagatcctaaatttcaagctgtcgatcaagagattgaaagacagacgaacgttcttat

SEQ ID NO: 23 - DNA, 13958 bp, Roseburia hominis
cctccgggtctttccgatacccaaacggggcaagacacccggtaaactgtcctttctgcgctttcagaagataagaggaatggactttcttggaaatatccttgctgtacatctcgttcaggatatttttgaacggggcgatgtcgttgttatcccgcagggtgtcgataccatcattcatggcgatatagcggacaccgtttcttgggaaaaagtcctcaatcaaatgcccggtttgcagatagttccgccccagtcggctgaggtctttcgtgataacaaggttgatttgccttcgctcaatggctctcaacatcctctgtaaatcaggacgctccatgttaagacctgtgaagccatcgtcctgatagactgccacaacctcccatccctgcttttcgcagtatttttccagcatatcacgctggtttgcgatactggcactttcgccttgcaggtcatcgtcctttgacagcctgcaatagaccgccgcacgatagcccccggcaagtgcctttccgattgttctgtattccatttcgttcatcatagccatttacccacacaatccagacggtatctggctcttttgaacctcatcttcattatagcccatatctttctttttagcaagatattctttcgtatttatctttccgtatttctgggaaatcaggctgacgaacacatcagtggcgtccagttctccgtcaaacacagtagtcacatgaatctctgttttgtttttcgccataggcagttatcctccatacatgaaaatagccagacagagggtgtcggcaacgaagtccggcaacgggcttcaaaagaccttgcaaacaatctcaatctggcactacttactatttatacttttcttttatttttctgttgttttggttgttataagggagaaaagcccggaaataagggattttccccggcaaccggctcggcaacgggatagcaacaggaggtgcaacgggctgtcattctcagaatggaagctccatctgttctgtgacctccacaaaaccgtccatcgttttttcagacgggttgccggagtccgttgccgggttttcacgctcccagcccttttgtctgccatattctgaaaacattcttgggttcgggaagtaccgccagcggtcaatgcactggttcataatctcgttgatttcccggatttcccattgcttcggctcgtcaaaggcatggttcaaggcttccttgtaaagctgcttggagcagaccatgctcccggtgtacttatcaagatacgcctgtatcattccggctttggtgtcctccggcataaaatcccgctggtgttctttgagataccgctgcatggcggggctgaaagccagcttgaacctgccgcttcggtaaatctccatcgcttccgcccacatctgcccgatataggctctggaagcagtttcgccctccaaaatgtgaacctcggcttgctccgggtacaccatgaccgggataaagcggcggttgccggaacggtcaaggggcaggaagtcaagggcattggaagtgccgccaaacacgcactgacgggggcggtctgccgggtgggtttcatagggtatcttgtaaacctctttctgtcggcttaaaaacgacttgatttcctcaatgctcttggcgttggcggttgccatcatttccgacatttcgataatccagtgaccttgcagcttgcggtacacattgtcatcgtccagcttccgcaaatcatcagagaaccactcgtcccggactgccagcagacggaagaaagtggacttgccagccccctgaccgcctaccagacagagcatgatttcaaatttgcaccccggctgaaaggctcgtgagattgcacccagcaggaacagcttcaacgcttcataggtgtaatcgtctgcgtcagtccccagaaagtgccgcagacagaagcggatgcgctcagtcccgtcccatgcaaggctgttcagaaaatcccggatggggtggtacttattctcattcgccacaatcccgatggcggtttcaatctttttctcactggtaagcccgtaggtttcctccagatagagaagcagatacttcatgtccgtatcggtcagggctgtgctttctctgtgaaaaccgatgggctttatgatgtccttgcggtcggtcaggatgttgtaggcgattgccccggcaagcacagggtcacgctggaatacggtcaggcagttccgtatgctctggcggacgccgcctttctcggtggtttccagagttgcctttacttcctcaacgctctggggcggctgcatggcgttcatggtgttttttagttcttgctgcgtctgcggctgcaagctctgccattcgctgttcaagctgtatcacatcctttccgtagtccataatcaaaaccgctttttcctctgtctccccgaacagcagcacatccagcagatattccacatgggcttgcttctgcaaggcttccacgaaccggggatgaaacgcttcctccggggagtgcggggcatagtcggttttccatacccgtaagaggtgtagataatcggcaaggacacggaagcaatgtgcctttgcttcccggaactgttcttccggggatttctgccggggcttgggcttccttgccctgcccggtggcttccagtcctcataggcaagcccaaagtcctgtgccagttgtacggcggcttctttctttcccagcccatacagggcggcggtaaaatcaatcacatccccatccgcaccgcagccgaagcagtggtaacgctgatccagcttcatgcttggggtcttatcgttatggaacgggcagcaagccatcccgtttctgtttacccggattccgtaatgctccgcagcctgtcttgtcgtaacggactgcttcacagcttcaaatacattcaaatcaattcctccttgtaaaaaagaaaaggcacttatcattctcaatctgaaaatggcaagtgcctgttaaagttccatatcctgttgtttgtgtttcgtctgcgccggggcgtttttctgtgctttcttctcgtcagccttatcctgcaagacttctttgaggggctgcttcttgggcggctctttgctttcctctgtgccgggtgtggctttccgtacccagtagcggatgtcccgcagcttcttcaaatcttcctgcacctcggtcaacggtactttcaagtctgcgatttcgcccacaagcttcgcctgttcctgcaaaagctcctttttcgtgctgtccttatcatccgggtgcttggcaaggtaggcactggctttctcaaaccgggcaacctccgggtgttccagcttgaatttttccttagttttcttgaaaaatatcttctggtatttctcataaacgggcttacattccttacagtccgtccgggcggcaaggatagcgtcaatcacgttgctgcgggtttcctttggcttcatctgctttcggtagtcggcggcagatttcccggacgtttctataaagttttccaaatcctccacggtggaaagtccctttctctgaagataggacagggcttcgctgactgcctttaagtctttggaagttccacggttttgtcccgcccgtgtccagtcgctccgttctgcctttcgtacctccatgtacttcatcaacagattgggaagaaataccgcttcctccgcagctttttccgcaagcagttcttttcgtttttcactaagctcgataatccagcctttgagatttttaataagctgccggatagacttcatcaggctgttggcggctttgatttcccggttcagatttccgatgttggtctgaatccctcgcttttccatctgccggacagcagcaccctcatggacggtagggataatatcaagcccctgtctttcataagaacggagatccacccgctccgggcggttgttggcttccagatagcggttctggatgatctcccattcatgccgccagatttcacaatacttgcggtcgttccagtcaaccgtatcttccttgtgacttttccatctgccggacggaagttttatccgttccccgttctcgtcaaggtcataaaccttgcggctcttgggaagccatttcccatgttcatccattgcccgcatagtcagcatgacatgagcgtgagggtttccgtcccctttgtcatggatggcaaaatccacgcacattcctttggaaacaaactgctgattgcagaaatcccggacaagggcggcgtactggtcgggcggtatctctctggggatggtaagcacccaccgccttgcaagctgggagttccattgtttctccaccgcttcggcggcgttccatagggtattgcggtctgcatatttctgtggggcatttgccgggagcaggatttcattgtggacgataccacgcttttccgggtagtgcttcacttgctggtcgtattcacagaacagcttttcgccgctctggtaagcagcggcagcaaccgcagactgccgctggctgcgctgcacaatcgtgatttcattgtgtgggcagggcatttagtgtccctcctttctgtgattgacggatggggtggcgttttaccacctcattttgggcagaaaaaagcaggcaacctttttcagatttcctgcttggtgtgtcgctgtatgtgcggcgggtatttagttaaatatcaactactacttaatgttataaacggcttctattgcttgtgagaagaattcagaagcacctttaccgtatttttcatctatcattggtttgattttttcgttgcgatagtactgtgcctgtgccagcataaattcttcttcattttttatctgcgaaagctccttcataaccaaaccatactctttgacgattttcttaacttccgaagaatttacatcacagtttcttttttcaattagtttttgtaaaattccctcaattcgtttgttataactttcagccacctccttactaataggactatttgcaacagataaaaatttctcttttccgccataccattcaacaaccttggcatagcccttctgcatttcttctgatgaaaccacctcgatataatgttttttccattcttcaacgcttccaaactctttgaccgcaagatttttcatattttctggcatatgctcaatcatagtttggaacatttcttccacttctgttttactgaaaattgcaaaatccattttattatctcctttcagaatgtcatcaatgctgttaatcaatcgttccatgcgttctttttttgctaccagcatttttctctgcatttgcaaaatttggtttctttcaagaactggattttccataacagctttgatttctttcagcggaatatcaaactcacgaaaaaacaaaacctgttgtaatgtttccaatgccttatcgtcataaagccggtatcccgcatcactttttttcgttggttttaacaagccaatttcatcataatagtgaagcgtgcgaacgctgatacccgttaaatctgatatttcttttaccgtcctcataactgctgacctcctgttcttgataagataactttattctatgacgctccgtaagagtcaataggtatttttaatttttttcagtataacatttttctgtctttatcaaaagatagagaagttcttcaactatacttgtcggctgggaacaacttgcaacgcaaggtgtccccagatggcaagtccacaaaagggtagctggtggcagccagcgcaggggaagcgtagcgtcccctgtatgatttggagcagaccatgactgcggaaaatcacagccctccggcgaggagccttcggagaacgcaatgcaccaacctctgggtggtgtataattgcgcccttagtaaactaaggggtttccggcttctcccgttccagcagttttttcaatagttcctgcgtgtcctgtctgtgaaaaatgagtttcaacaacagcatgacatcatcgtctgtcaggcgttccggttcttgcagaaaactttccagcataccgccacgagtgcagagccggtgcgtccgttcctttcgggtaagctgctttaactggtgctgcaacgccttttcatcattgatggctttccgcagcttcttttcgcttttttccagctcccggttgagcttttccagctttgaggtatcaggcaagggcagcatcctcctttcccggtatcagcacataaattcggtttggttctccaactccctgacgcacccgcatgataagtccggcggtttccagttcattcaaagaacgcttgaccgtcatggggctgcgggacaggactgcggcaatggctgtgacagggaagcagacaaacaggattccgttctcgtcctcctgcccattggagagcatagcgtccaacatccggcagtacatgacctttgcggtgctgctgactggaaaccctgtcaacgctcttggaaaagccatacagggcggcaatggtgtgtctatcgtcataaattcaaaattcattcggtgtgttcctcctttttctttgctcgtttggataaataacgggggcagtgaatcacaaccgcccggaagctctgcctgcacccatgctggcatttccggcataattcgttgtaagtgacacgcccccggtcattgaggtaaaaggaaagctcatgcttcctctttttgctcattctcggcatattgcgcttcctcccgttttcgtgtatggtttcggggcgattttcggcaaaattacagccatagagccgcttaaaatctcccgaagtatcagcgatagggtagactgtccccctatcagattgtcgtgtttcggtatcatttcggtgtcagttcgccagttctccccggtgtcgttcctcccctgaatctcacagcggcgtatcgctccctttggtatgctcgttttggtaagggttcctccacatccctgccaaaagtcatggcactacatcgccggggaagcatatcccacacaggctggtcattcgattggaataatccatcgatgaactacatgtatcatagaacatttttgtgccctgtgccgtatgtccacaaagtaggaattcggggaaaaatcagaaatttccacgattgcggaattgatatggtataatcaattcaacggttataaatgtcgtcagaaggaggaactgcttcaatgaacggagctactacaatacaggaacggctaaaagatttacgattaaacaaaggattaaaactggaagaactggcagagcaaacgggtatttcaaaatcagctcttggcagttatgaaaaagatgactataaggaaatcaatcatggtaaccttatcctgctggcagatttttatggggtgtccctcgattatctcttttgccggacagagaaccgggcggagatcaacacgccattaagggagctgcatttgagtgatgagatggtagcacttctgaaaagcggtcggattaacaaccgtctgctctgcgaacttgccacccataaggactttatcaagtttcttgcggacattgagatttatgtggatgggattgccaccatgcagattcagaacctcaacgcccttgtcgataccgtccggcatgaaatcattgaacggtatcgccccggcgaagatgacccccatttgaaagtgttgcaagccgcccatatcagcgatgatgaatatttcagccacatggttctggatgacctcaacctcattatccgggatattcgggaagcccataaaaaggacagtgagagtgcaccccagaccactgttgccaatgaactgaaagaaaatctggaagcggtcgaaaatttcaagggcagccgggatgaaaagctggttgtcctttactgcaagcagcttggtatcaactacaaaaatctgtcagacgaagaatttcgctggctcattcgtattctcaaaaagtcaaagaaaatgggaacgcctatcagccagaggaaaaaacggtaaagaaaaaccgctgttgcatggtttgttggcttccatgtagcagcggtttttgctgggattattcagttgaatttttagaacgacaaacttgaattgagatttcacctgttttaagagatttaataactgttatattttgttattaaattctccacaagcccttgaaaacactggatttatcgcaggtgagcttttccttattgtttcccttgtgttatatcgtcccatcagtgtttacgaactctgataagggcaaatacaagggcaagaaaaatctataaaacagtataacacaaaataaaagtgacatggtgaactgattgaaatgcttctgatttttgtaactgataattgattgaatgataaggagagataagatacgatgagaacaatatttgcagaatacaatccacagcgcaatagtattgatgtttacacctctgctggctatatgctccgcattgattgctgggaagctgaaaagaatttaaaaactacacccggatcagactgtgcattaaacgcacttgctattgatgaaccacttgaatatgtacgattatatttggacgggaatatgcagatgtgggtagatgcagaagattcattagaactatggtgatttttcgacggtgtgaaattttttctgtaaattcagatcttctatgataattgatgcggcttaatagcagttttctgttgttaagccgttgtttatttaatagcaaaaataagccggtatgtcaagaacccccagaaaatctgaacgtacatttactcttgatcatccggcttattttcaacagcactaagattaccttttttaatattgtttgggatactccctccataaccgtcacatcaattttatactttacttcgatttcaactttttctggtggattgactaaaagcctgtcaatatcattttcctcaacaccagccatttttgctatcgttagcttggatatgccataataggaaacaagcagttccaaccaatgcaccaatttgatatttcccttttaccgaatccttttatgccttaacatcacaacttcctccgatagatggagctgtacctactgcctgtgctacaacattctctgtaatgcttttcatatccgtaccaattgcaaatattgtgcgtctatcttcctgaattttcttcatcttctcttttctttcagctctccgttctgcaagtttttgttcattttctttccttttctcgatttttctatcttcatcagcctttttttgttcttcgcttggtcctgtaataaccatggagcccatattaccatccttatctatccatacctgacgatacttaacttcactaccagtcattgatttaatcattgagtcagcccatctatctaatgctggaatttttgacaacatattttcatattttgtggcaacctctggattactcatcatcctatttaaaatctcaggagcaatcctcacatctgtttttcctgtacgattagctgtttttacatttttatccgaacttcctaccacaatatctatttgaggatttttttcctgcaatttttttacataatcttcctgactctcttctgttttgctcacctgtgaattttcctttgttttttgaatatcacaagctgcctttttaaccgtgttcttgtaacctgatgcataatacgatgtgtaactgctgttattgatacctgtaattgccataatcctacctccctgttattgaaacttaaaataatttctattatattgaacgacttggatatttaatttccgttgatgtaaattcatcttctgccgaaacattgatatgcccactgctgtcaatagcatactctttaccataaacgaaaaacgtatctccttctttatatccgatttctatccagtttatatcatttaactgttttatctttgcgtcaacatttatggtctttcctgattcctgcaataaataagtgtgttttcctgctcccgcatctatagaaaagaatcccggagaaatcccgactttctcacagacggacaatacctcctcattgctgtagagatacccccacacactctttccctgtgccagatcagacaggatattgcctgccttacacatttcccacttataatttgttcctttttgatttgtattctctgcaagcaacgattccgaggctgcccagcctattcttccattattgaccgtccatgtatatttaccgccacttgatgttgtccatgaataataacttttattacttaataccaaagaattatttgcagcacaaatgcctgacatggtgcttgtattcattttcggtactgcataattaggtactacctgtctgctcccattaaggtcaaaggaaataaccccgtactccttaaaatcagaattatatccacaggaaacattctccccaaaattgattgcatccaaaatagcacttgaattattatagttttcaaaataataagccaattcactgttagaaatattcgcatttttatctatcagtgcagctattgattgctttgaaaagcctcgtgcagcatcagaaatacttaaactgtcctgttttttattatttcctgctccaagcaacatctgtattgctttttggtgtattcctgcctctgcctgctttgaatatgtcaacagctggtttactgtgtttacatctgttactgtcttcatagctagtctccaaaccctttttcaacattaaacgccaaacatatgctgcaatttgtccagcatattatttactctgccttcaacagcttctggctgattccttaattcatacctgcttccatagtaatcatttaaacggtctttcatctcattacaaaataatttttgatctgttttaccatttaaaaactgattgcagataccacttatctctttcttctcatttgtataaaaagctgtctcatctgagattatttctgacttgtacttataagattctgttttgcttccaattccaacaaccatgtaatctggtgtcattttctccatgatagaattacgtgccgaatcattaaaatgaacatattcgtcaatcatgtctgaaaaacctgcttgtaattgctctggaacatacatttcatttacttttcttagccccgcttcacttgcacttaacaaaaatacagattcataggaagttcctctatatccctcctgagcattcaaaaaatctacatctgctgtcattgcattaatcttctcttttaaatctttcatttcatcttctgtcaaatattcagaagcattttcgtccagccatttttcaaaaacctctgactgattttccgaacagccttcaaacgcactttgttctccagaaatggaagttgctttcaaatctaatttgaataaattttcacatttatattctgctggtatctctcttatttctccattaatagatgaaaaatgcattgtatgaaaatccgataccttattacgagcagtctcaactaactttcttgctgaatcactgattttcacatcatcctccgaaataatattctgaggaacagttgttttcttctcaaccttattttttatcatctctggattattaatatacctatttccttgaactttcatagcaacctccttaagttagtccacactttctatacttctttatctatcttgctcgatgtcaaagaacctgcatctattttcaggtaatctacatcactgtcattgctcaatgaaccaataaaacgatttatatctactgactttctgccactctactctctggtgatgccatccaatgcaccaatttgatattttccttttatcgaatcctcttatgccttaatatcaaaacttgatctatcaggtgcagaaatactcacagattctgctacaaggctctgtgtcatactttttacatcattaccagttatggataaggtataatcacccgtttcttttctttctgccgatttttctgcacgtttctttgcagctttttcttcctctgcttttttagcagctcttttctcttttactttttcctctttttctctgttctcttttgcttttcgttcagcattctctttcgctattttcccatctggatcatttgtaccagatactgtctctataatatttccgtttgcatcaatcatataactctgatttgtcacagtgcccaaacatccattaatcgtatcttttgtacaatccggaatggctgctaagttttcctccaaatactttgctttttccggatcattcatgcacttttgtaaaaatgcacttgaaacagataccgttgtcggaataccctgcattgaagtcagccctatattcatataatggtattttccttgcaagtattttgaataatcatttacattactataccctgtcttaatctgctctgtttttgtcacaccgggacgtgatgtttttaattcaactgtacttgttgtcacgttgccatcttttgtatttgtactatccttttcactatctgttttttttacagtattcttataatttgaagcataatacgatgtgtaactgctgttattgatacccgtaattgccataatcctacctccctgttattgaaacttaaaataatttctattatattgaacgacttggatatttaatttctctcagcctcaatatgatatgtaatccaagttctcttttttccctatgttcaaatgactaagcactatttatacttactatttgcatttggcaaattaagatatgtatccatacttttcgtccaaagcaacgataagtcaaaccttcccaatttgtttaaatcttctatgctttttttgaacattgcgataaaatctcttctgtcgttaagtcccatattaccagcttcaagcggcagagacgtgaaacctccctgcttttccactttgtaatgtgcctccaatgcacgcatttcgactactgtagcatttgatggattaacatcattgatataaattctttgctcaaactctttcccgttttcatccacacctttcgctaacaccacaggattttcatccgtcgaatcatccgcatatttaagacaataagaaagacctgtaccattacctcctgtccacaacatattatctgttgtaaatatctgatataccttcggtgtttctgccatataaaatgtcttttccccagatgcaggagttttcatttgattacctttttgttgaccgtacaatgaagatacggtattcagaccagaaccaatgtgcatacttctattcctccaatcagtttatctgaattgtaaatgtactgcttgtattccaccatcgtcatatctttagcagacacagaacctatttttgaattgcccactatacttccactagcttcgctcttttctcttacactatccgcaaaccttgtatcttccttctcctgatctttagccgcatttttctgctggtactgattgtaagcccgtgtcatatagttcacattaattgtattactcatagtaacctcctttgctttctttatcggataaaataacctgttctcctagtcccatatcatcaaacgaccatattacgcacacaaagaccatatttttacaagatgaccactgccttagtagaagctctgtatctcaaactctttgaaatacaatgcttccctgcattttctatatcgtcatgttgatattataactttactatccagcacactctctgagagtgactgtatctatcaaaaaagaagccagcagtttattcacgcactgctgacttcctataatactactcattttatttacttcgctgcgtctcagacaatttttttatttttaaacataacctctgttttcccgccatccctttacataccacctgattccaacatataccagttgcacgaat

SEQ ID NO: 24 - DNA, 10586 bp, Roseburia hominis
tgttagattactacaccgaaaggtgtacaacttgttaagttgattgaaccgccgtgtaccgaacggtacgcacggtggtgtgagaggtcggaatttcttatttaagagaaattcctcctactcgatccttttaaaaatttagaattgaggtatttatgaaaccagaagaaacagtatttcacgagataacactgcaggataaggcatggatggatcagaagttcgcggaggatgaccggaatgcctgcgaatactcgtttgcaaataattttatgtggagaaatgtctatcaggtcagagtggcggagcttcacggctgcctggtagttcggtttatagatggagagattcactgcttttcatttccggttggaaacggcgacaaaaaagcggcggtggaggagctgcttgcgatctgccatgaggagggaatccagctgctgatagcacctgccagcgagcaggaccgcgcgcagatgctagagtggttcccgggaaggttcttaatcgagggagaccggaacgactatgactatatctatgcaagagagaagcttgcgacgcttgccggcaagaaactgcacggaaagcgcaatcacattgcccgctttaaagattcgggagactggtcttatgagccgatgacagctgaaaacatagaagaatgccgcacgatgacgtatacgtggattcacatgcgcgaggaaaagtggaatgaggagatgaaccaggagatctcggtactccatgaggcgtttgatcatatgcaggagctgggacttgtcggcggagtgctccggagagacgggcagatcgtcgcgttttcaatcggggagcggctgaattcggagacgtttgttgtgcattttgaaaaggcgtatccggatcttcagggagcgtatccgatgatcaaccagcagtttgtcctgcatgaatgtgaggggtatgcgtatgtcaaccgcgaggaggacaccggcgatcccggacttagaaaggcaaagctttcctactatccggatattctccttcccaaatatgaactggaggagagcggggtggtctatgcggaccccgagcgggatgcgccgtatattcaggaaatctggcagaaatgctttggcgacgaggaagattatattcagttttatctgaagcaccgaatgacgagagagaatatgctcgtgattttccgggatggaagaccggtatcgatggcaagttttctgccggtgcagtacctgtgcaacggagcgtatgtggacgcgcgctatgtgtatgcggttgcgacactgccggaataccggggacagaagcttgcggaacagattctgcgctttgcagaagaaaaatatcaggtgccgctcattctgtcgccggccgaggagtcgctgatccgttactatgaaaatctgggatttaagaatgcattccagggagaacgcaaaaatgtgagcggcagtgacattacggcgctcgaggtaaaggacacggagccggttgcatgcatggagcctgtcacaccggaggagtatgtacggatccgggatgaaaagtgcgcgaaggaagggtatgtacactgggatgtggatgcggtttcctatgcgatggaactcgcggcaagctgcggcggcggtacggcggcagtcagctgtgaggataaaaacacacggaatgagcaggaagatgacagggatattctgatgtatgatatccgggaaaaagagctcgtgatactggagacaacgctgtcggacgacgctctctcacaggtgcttccgcagcttatggaagagacgggaaccagcgcagcatcgtacggacgggagcggggcatgatctggctgccggagacgatggcagatctgccggttgcgggcgacggttatctcgcactgacgcttggttgatgaattttcagaaaaaattatgaaaaatgcataaattttcttgctataaagccaaaatatgttataatataaccatgatatatcttgtatcaaataaacggcaaaggggttggacatcatgagaattaagattacaggaagaaacatcgaattaacagaggggctgaaggcagcagtggaggacaagctgaacaagcttgagaagtattttacaccggataccgatgtatatgtgacgctgagcgtggagaaggagagacagaaagccgaggttacaatcccggcaaaaggaaattatatccgctccgagcaggtaagcaacgatatgtatgtatccattgatcttgtggaggaagtgattgagcgtcagcttaagaaatacagaaccaagctggtgacaaagcagcagaatgcatccgctgtatttaagcaggaattcctggatggagccgcagacgaggatgaggagatcaagatcatccgtaccaagaagttctccatgaagccgatgtatccagaagatgcatgtgtgcagatggaactgctgggacatgacttcttcgtattcatcaatgcagagacggaagatgtcaatgtggtatataagagaaaaggcaacacctacggactgatcgagccggagaattaagagcgtttgagatgtgctgtctcataatgaactgatatatttacagaaagaagagggagaaccgtattgcagatgcggcactccctcttcttttcgtggagaaaaggagtttaagctgacagagggcgctttctgtaaaattttttgtgcaaaggggtgtacagttagtactaaagtatcttataattgtagttaagcgcgccctgcgtgtgcgagaggtagaaaagttaatcatgtgtgaaacaaaagaaaagggttcaagtaggaaaagctacggacatacaaatgtattggtggatatgatgcagaattatccggggtttatggattatattgcatatcagtacccattggagggagaacggattgaattattggaacagattctgaccgcgcttgcggtgggaagaaagctggaagcggagcagatgatttatcattatggcagtatgattcacgggagggatctcattgcgaggcaggtttttctgtggcttttggggatggcagaatacagcagacgtgagtgtatagcggaagagcgtagataaaaagcaggaaaggggtcgcagcgcaggggcagagctttgaaaaaacaaggaatattcttgtcatcagatcgaaaaaggtatactataaagcgagaaaagttttgaaaaaggagagacggataccatgaagatagttgttttggcaggggggctcagcacagagagagatgtgtccttcaagacaggagagatggttacgaaagcactcagagagaacggacatcaggtaattttacttgatgtttttatgggatatagcaataaggaagaagatcttaccggaatttttgacagagccgaggcggtcagcgtcaaggtggcggcgattccggagaccgcgccggacctggaaaaagtaaaggcgcagagaaaggatcagtcggataatttcttcggaccgaatgtcatcgagctttgccggatggcggacatcgtgtttatggcgcttcatggagagaacggagagaacggtaagatccaggcggcgtttgacctgtttggcatccgctacacaggaaccggatatctgggcagtgcgcttgccatgaacaaaggaatggcaaagcagctgttcctcgagaatggaatcccgacgccgagaggcacgtccttaaagcgtggcgaggatgcggcaaagatcgagacctgtggaattcatttcccgtgcgtggtaaagccgtgcagcggcggatcaagcatcggcgtatcgatcgtgcacgacaaggcagaatacgagcaggcattaaaggaggcattccgctgggagaatgagctggtcattgaggaatatgtaaaaggaagagaattttctgtcggcgtcatcgattttcaggcgcttccgatcatcgagatcgcgccggtggaaggcttctatgattataagaacaaatacaaagcgggaagtacggtagagacctgcccggcggagctgtccgaacagattacaaaggaaatgcagggctatgcagagaaggtggcagaggtgcttggactcaacacttactcgcgcacagacttccttctggatgcggaagatcacattttctgtctggaggcgaacacacttccgggcatgacgccgaccagtctgctgccgcaggaggcaaaggtgaccggcgtggatttcaaccagctctgtgagaagctgatcgagagttccatgcgcaagtacaagaattaagaatgaagtctgaaatgggagccattatgaaaaatatgacattggagcatatcgcgcaggcatgcggcggtacatacatcggggaagaatgcgaccgtaaaaaggagattcagggggcggtgattgacagccgtctggtcgaggagggatatctgtttattcccatccgcggagcgcgtgttgacgggcatgatttcattccggcagtttttgaaaagggagcgcttgccgtgctctccgagaggaggctcgagcatccggcaggaccgtatattctggttgactccacggaggaagccatgaagcagatcgcggcgttctaccgccgctcgctcgacatcaaagtcgtgggaatcactggaagcgtcggaaagaccagcacaaaagagatgatcgcgtcggtgctctccgagaaataccgcgtgttaaagaccgaggggaatctgaacaatgagatcggactcccgctgacgatctttaagatccgggaggaacatcaggtggcggtgctcgagatgggaatctctgagttcggtgagatgcaccgtcttgcagagatggcacagccggatatctgcgtcattaccaatatcggcttatgtcatctggagaacctcatcacaagagacggcattttaaaggcgaagacggagagttttgagcatctggcaccggacgggatcgccgtattaaacggggatgacgataagctctgtgacaaaaagatggtgaatggcagaccggcggtgttctatggaatcggacaggaagcaaagacggcagagacagagaccggcagcaaacggctcgcggaaaaggaagtgtacgcgaccgatgtggaggcgatcggccttgagggaacgaaggcggtcattcacacgccggagcagcagtttgaggtggtgatcccgattgctggtgagcacaatgtatacaacgcgcttgcagcagtctgcgtggcaagacggctgggacttgatgcggaggagatgaagcttggaattgagcatgcgcacacgattggcgggcggagtaatctgatccggaaaaacggcatcacaattatcgacgactgctacaatgcgaatccggtgtccatgatggcttccatagacgtgctgtcccaggcgaagggacgaaagattgccgtgctcggcgatatgggagaactcggcagtgaggaaaagaagctgcacggaatggtcggcacacactttgcggggaagaagatcgatgcgctgtttgtgaccggaacacttgcaggggagattgcggaggaggcgcggcgtgtagcgccggagaccagggtctatgcggaaccggacaaagaggcgctggaggaggcgctgctggagtaccgcagaccgggggataccattctggtaaaggcgtcccattttatgggattttcggagattgtgaaaaaattggaacagccacagtgaataaggaaggtacacatgaaaaagaatatcatactgattggaatgcccggtgtcggaaagagtaccgttggcgtggttcttgcaaaagtgatgggataccagttcattgatgccgatctggtgatacaggaaaaggaaggaaagcttctgcgtgagattatcgctgaagtcggaccggagggattccttaaggtggagaaccgcatcaacagcgggattgaggcggaacatgccattattgcaaccggcggaagcgtggtgtacggagcggaagcgatggaacatcttagccggatcggtacggtggtttatctgaaacttccgtaccgggaattagagcgcaggctctcggacatcaaggggagaggtgttgtcttaagagacggacagacacttcatgatctctatgaggaacgtgtgcctttgtacgagaaatatgcggatgtgattgtggatgaacatcatttgaacgtggaacagacgattgagaaaattatggaattgaaggaacgctttcaatgaagaaacaaacgtttacaaaacaggcagtctggcaggcagctgcggtaggagtcctggcggtcggcggagtccttttttgcctttccgggcagattggaatcggacagacataccggcaggtgcgcgtggatgaccgcatcatcgggtatgcgccggagaacactgatatggatgacatcgtccgtcaggcgagacaggaactgacgcaaaagaccggggagagaatcagcggcgaagtcgtatggagcagtgaggagtgtagaaaaccgttccagaagttgttgtcggagaatgaattaaaagaagccgtagagaacatactaagtgagaaaaatgcagaggaaaagcagcgcgtctatacagtggcaatcgatgaataccgcgccaactttgcgacgatggatgaggtggagtcttttctggaaaaagtgaaggcttctgcggatgaggcggatgaatacggggcggtcattgcggatcagggctcccatgtgagcggaattctgacagcgtctcttgccagaagggacgcaggggctgcagcggatgaaaaggtgctggaggaagcacaggcttctctgccgcaggcaggaatcagcgcctatgtgatctgtacgctggaggaggcatttgcagatccaaaagccacgtatgagacaggcatccttgatatggaatttgtggagcgggtgaatgtgttcgagaactatgtcgatgccgatcagattgcagatgtggatgaacaggttgccgaagtaacaaaagagaaagaatcgaataaaatatatgtagtggagagcggagactgtctctccgtgattgcgatggatcatgatacgacagtgtcgtcgatcgtggcgttaaacgggctggacagcgcggatgcgatgataagggacggtcaggaactcatcattgcggtgccggagccggatctgcagcttcgggtaacaaaaggagaggtctatgaggaggactacatggaagagccgatcatcatagacaacgattcctggtatacgacaaaagaggttgtacagcaggagggaacgacgggacaccgggagcgcaatgacgttgtggtctatgagaacggtgtggaaacaagccgcgagatgatacatcagaacgttatggtggcgtcacaggcggcagtcattgagcgcggtaccatcattccgccgacctatatcaaaccgatttccggaggaagatatacgtcaggatttggcagacgctggggacgtatgcacaagggcgttgactgggcatgcccgatcgggacgacggtgtacgcatcctgtgccggaacggtaatctctgcgtcctataatggtggctacggcaataacgtggtcatcagccatgcggatggcagactgacgagatatgcacacaacagtaagcttctggtgaaggctggacagcatgttgagcagggagagccgatcgcgttaagtggaagtacgggacgttctacaggaccgcatgttcattttgagatctatatcaacggttcagcagtggatccgctcaaatacatcagcaactgatgggaagaggacacagactggaaatagttgtatgctgtacaaatggatgaaatttatggtataatgtacactatatggttgatgaacgaagaacttaagaattacttgacaaaatcatgtaagcgctagtataattacgtgtttgtataaagcgttcatagaggtgtgatatggaacagtatgtgatcaaaggtggaaatccgctggtaggagaggtggaaatcggaggcgctaagaatgcggcgcttgcgatcttatctgctgcagttatgacggatgagaccgttacaatagaaaatgtacctaatgtcagggataccaacgttttactcaatgccatcgaggagattggagcgcgggtagagcggctggatgctcacacggtaaggatcaatggatcttttatccgggattttaatgttgacaatgaattcatccgaaaaatacgtgcatcttattatctgatcggcgcactgctcggcaaatataagcgggcggaagtggcgcttccgggcggatgcaacatcggcggacggccgatcgatctgcacatgaagggctttagggctctgggcgcagaggtggatatcaagtatggtctggtgcgggcttatgcagaaaagttaaccggcacccacatttatctggataaggtgtctgtcggggcaaccatcaatattatgatggcggcgtccatggcagagggcaagacgattatcgagaatgcggcgaaggagccgcatgtggttgacgttgccaacttcttaaacagcatgggagccaatatccgcggtgccggtacggacgtgatccggattgtcggagtggagaagctgcatgcgacagagtattcgattattccggatcagatcgaggcaggcacctttatgctggcggcagcggcgaccaagggtgacgttaccgtgaaaaatgtgatcccgaaacatctggaagcgatcagcgcaaagctgcttgagattggatgcgaggtggaggagttcgacgacgctgtgcgcgtggtggcatcgaagccgctgcgtcatacacaggtgacgacacttccttacccgggcttcccgacggatatgcagccgcagatgacagttgtgctgggagtggctcagggaacgagtaccgtgacggagagcattttcgagaaccgttttaagtatgtggatgaattgacacgcatgggtgcaagcatcaaggtggagagcaacatcgctattatcagcggtgtggaccagtacaccggtgccagagtcaatgcgccggatttaagagccggagcggcgcttgtgattgccggacttggcgcagagggcattactgttgtggacgatatttattacattgagcgcggctacgaggcatttgatcagaagctgtcactgcttggggcattgattgagaaagtttccgacgaaaaagaaatacagaagtttacactgaaagtatcatagaatggaagttttgaaccatcaggtctgctgcgggaggggatcccgcagcagacattttttatttcataggaaatactgcggaacgttaatacaagaaagcagaaccttcctatgaaataaaaaaacgttcttttgacatgatagcgcggaagacagacttggaggataacaatggaagcacaggaaatacaacagaaagagttacatactgtgagaggagaactggcactgcttgttgcagtgctgattaacagcttcggggtggtgctgatgctgcactccggcgcgggaatctctgccatctcgagcgtgccgttcgcgttttcggaagtgtttacgcggatctcgctcggcacatggacatacctgttccagggcgtcctggtgcttagcctgatgattttaagaaaaaggtttgtgccgcagtatctgttcagctttgtgatgggatttgtgttcggagaacttttggatgtgcatgaggcgtggatcaatcttctgccgcttacgcttccgaaccgtattctctattttgcaatcagctatctgttgatctgcatcggaattgcactgtcaaaccgctgtggtctgccgatcataccgacagatctgttcccgagggaactggcggacattacgggtgccgcgtattccaacataaaggtctcgtttgatgtgatctgtctggcggtgaccgccggcatgacgatcttcttcctgggacatctggatggacttggaatcggaacgattctggcagcgtttacgatgggaaaggtgatcggggcgatcgggaaatggatggacggacatctgcagttcgtgtcggttctgactcccaaaccggcaaaactgtgttagaaagcccccggcaaccgggaaagcgtacaggagataagctgtagacaaaaaatgagggaaccataacgttccaatgtaaccggcagcggcgaattctttggagtaaaatccaggtagttcttccgtgccgcgtccggcatcgaatgctgtgtctttccacgtttggacagtcctcggggtgtgtccggcaactcgcagacaatgggcggacttcctagacctgttaagagatgtcaacacaatttttgatttttttgcataagaaataggcctgattattcaggcttgtttcttatgcaactatactatattcttatatatttctatcactcttgcataatagatttgcaaaaacttatttaaaccggctattttggcttgtttcttactttttccttcattctcttttttaattataaaatcatagacacgagtatctgttttgggcggatggg

SEQ ID NO: 25 - DNA, 4638 bp, Roseburia hominis
gataaggagcaaacaagcaatgttgcgttctttgatgcagacggatactttcaacagtatggcacatatgcaagaatgtctgacgaacctgattttcagtatctcggaggtggtgcggtaacatttaggctggaaacagaagatggtataatctataactacacgatcacaatctcgatcgatgacagtaatgtgaattttaaagcggaagatgatttgccaaaataaattcaagtttgtcagcttcacatcgggtcaacttgccccgaacttttacaattaaatacccgccgcccacatagcggcacaccgagcaggaaatctgaaaaaggtctcctgcttttttctgcccaaaatgaggtggtaaaacgccaccccgtccaccaattagcgaaaggagggacacgaaatgccctgtccacacaacgaaatcacgattgttcagcgcagccagcggcagtctgcggttgccgccgctgcttaccagagtggcgaaaaactgttctgtgaatatgaccagcaagtgaagcactacccggaaaagcgtggtatcgtccacaatgaaatcctgctcccacctaatgccccacaggaatatgcagaccgcaatactttgtggaacgccgccgaagcggtggaaaaacaatggaactcccagcttgcaaggcggtgggtgcttaccatccccagagagataccgcccgaccagtatgctgtccttgtccgggagttttgccagaagcagtttgtttccaaaggcatgattgctgactttgccatccatgacccccatccgccgggacacaatccccacgcccatgtcctgctgactatgagggcaatggacgaacatgggaaatggcttcccaagagccgcaaggtttatgaccttgacgagaatggggaacggataaagctgccatctggcaggtggaaaagccacaaggaggatacggtggactggaacgaccagaaatattgtgaaatctggcggcatgaatgggaggtcatccagaaccgctatctggaagccaatgaccgcccggagcgtgtggacttgcgttcctatgccagacaggggtttgatatagtccccactgtccatgagggagcggctgtccggcagatggaaaagcgtggtatccagacgaatatcggaaacctgaaccgggaaatcagagccgccaaccgcctgatgaagtccatccggcagcttatccacaacctcaaaggctggattgccgagctgggagaaaaacggaaggagttgcttgcacaaaaagcggcggaggaagcgacacttcttcccaatctgctgatgaagtatatggagatacgaaaggaagaacggaaggactggacaagggctggacagaaccgggggacttcacaggacttaaaggcagtcagcgaagccctgtcctatctccggcaaaaggggctttccactgtggaggacttagaagcatttctggaatcttccgggaaatcagccgcagattaccgcaatcagatgaagccaaaggaagcccgcagcaaagtgattgacgggattcttgccagccggacagactgcaaggaatgtaagcctgtctatgagaagtaccagaagatattttttaagaaaacaaaggagaaattcaaacaggaacacccggaggttgcccggtatgcgaaagccgccgcctaccttgccaagcacccggacgataaggacagtacccaaaaggagctgcaagaggagcaggaaacgcttctggaagaaattgcagccctgaaaataccgctgaccgaggtacaggaggatttgaagaagctgcgggacattcgctactgggtacggaaagccacccccggcacagaagaaagcaaagagccgcccaagaaacagcctatcaaagaagtcttgcaggataaggcagacgagaaaaaagcacaaagaaccgccccggcacaggcgaaacacagacaacaggatatggaactttaacaggcacttgccattttcaatcagagaatgtcaggtgcttttcttattttcaaggagggatagatttgaatgtatttgaagctgtgaagcagtccgtcacaacaagacaggctgcggagcattatggaatccatgtagggcggaacgggatggcttgctgcccgttccataatgataaaaccccaagcatgaagctggatcggcgttaccactgcttcggctgcggtgcggatggggatgtgattgattttgtcgccgccctgtatgggctgggaaagaaagaagccgccgtacaactggcacaggactttgggcttgcctatgaggactggaagccgccgggaaaggtaaaaaagcccaagccccggcagaaatccccggaggaacagtttcaggaagcaaagaaccgctgcttccgtatccttgccgattatctccacctgcttagggcatggagaaaggattatgtcccgcactccccggaggaagccgttcatccccggtttgtggaagccttacagaagcaagcccaagtggaatatctgctggatgtgctgctgttcggggagacagaggaaaaagcggctttgattacggactacggaaaggatgtgatacagcttgaacaacgaatggcagagcttgcagccgcagacgcagcaagaactaaaaaacaccatgaacgctatgcagccgccccagagcattgaggaaatcaaggcggggctggaaactaccgagaaaggcggtgtccgtcagagcatacggaactgcctgaccgtattccagcgtgacccgctgctttccggggctatcgcatacaacatcctgactgaccgcaaggacatcataaagcccattggcttccacagagaaagcacagccctgaacgatacggatatgaagtatctgcttctctatctggaagaaacctatgggcttaccaatgagaaaaagattgataatgccatcgggattgtggcgaatgaaaacaagtaccaccccatccgggactatctcaataccctggtgtgggacgggacagaacgaatccgcttctgtctgcggcactttctgggggctgacgcagacgattacacctatgaagcgttgaagctgttcctgctgggtgcaatctcacgagcctttcagccgggatgcaaatttgaaatcatgctctgtctggtaggcggtcagggggctggcaagtccaccttcttccgtctgctggcagtccgggacgagtggttctccgatgatttgcggaagctggacgatgacaatgtgtaccgcaagctgcaaggtcactggattatcgaaatgtcggaaatgatggcaaccgccaacgccaagagcattgaggaaatcaagtcatttttaagccggcagaaagaggtttacaagataccctatgaaacccacccggcagaccgcccccgtcagtgcgtgtttggcggcacttccaatgcccttgacttcctgccccttgaccgttccggcaaccgccgctttatccccgtcatggtgtacccggagcaagccgaggttcacattttggaggacgaagctgcttccagagcctatatcgggcagatgtgggcggaagcgatggagatttataaaagcggcaggttcaagctggctttcagccccgccatgcagcgctatctcaaagaacaccagcgggattttatgccggaggacaccaaagccgggatgatacaggcataccttgacaagtacaccgggagcatggtctgctccaagcagctttacaaggaagccttaaaccatgcctttgacgagccgaagcaatggaaaatccgggaaatcaacgagattatgaaccagtgcattaccggctggcggtacttcccgaacccaagaatgttttccgaatatggcagacaaaagggctgggagcgtgaaaacccggcaacggactccggcaacccgtctgaaaaaacgatggatggttttgtggaggtcacagaacagatggagcttccattctgaaaatgaccgcccgttgcaccccctgttgctatcccgttgccgagccggttgccggggaaaaccccttatttccgggcttttctcccttataacaaccaaaacaacagaaaaataaaagaaaagtataaatagtaaccatcgccagattgagattgtttgcaaggtcttttgaagcccgttgccggacttcgttgccgacaccctctgtctggctattttcatgcatggaggataactgcctatggcaaaaaacaaaacagagattcatgttacaacggtgtttgacggggagctggacgccactgatgtgttcgtcagcctgatttcccagaaatacggaaagacaaatacaaaagaatatcttgctaaaaggaaagatatgagctataatgaagatgaggttcaaaagagccagataccgtctggattgtgtgggtaaatggctatgatgaacgaaatggaatacagaacaatcggaaaggcacttgccgggggctatcgtgcagcggtctattgcaggctgtcaaaggacgatgacctgcaaggcgaaagtgccagtatcgcaaaccagcgtgatatgctggaaaaatactgcgaaaagcagggatgggaggttgtggcagtctatcagg

SEQ ID NO: 26 - DNA, 3114 bp, Roseburia hominis
gataaggagcaaacaagcaatgttgcgttctttgatgcagacggatactttcaacagtatggcacatatgcaagaatgtctgacgaacctgattttcagtatctcggaggtggtgcggtaacatttaagctggaaacagaagatggtataatctataactacacgatcacaatctcgatcgatgacagtaatgtgaattttaaagcggaagatgatttgccaaaataaattctagtttgcagaaatatctggctaactttcccaattttacagacattccagcccattcattagtgaaatgatatgtattttcccttatttttgcccttatgagataatcgtaagggaaataagggaaagttttatttagtcgttgcctgccactttatcaagtaactttgcggattcccgcttggcttttcttgtggaatgggcgtagacattcattgtggtactgacatctgagtgtcctaacagttcctgtacatctttcggagctgctccatttgccagaaggttgcttgtgtaggtgtgtcgcaactggtgaaaatgaaatccttcaaatccatccagtttctgagcaatcttcctgcaaacaattcctaacgtgcttggcagttccaaacttccatccggtcttaagcagacaaaggatatttccttataatcttctggaacattctctgttccatccagatgatagaactcatagtaaactctgtttttgtcttttacttctctgtagtagtttttgtggtaaagttctccgtactgcattcggtttttaagttgttcctttcgggcattgcgaagaatctctgccagtgtatctccaaaatcaacaatccttaccttttttcgtttggttggtccgatgatattcttgtgccttgaaccatcatatcggatacttcgtctgattgtaaggcactgttcttcaagatttacatcctgccatgccagaccacaggcttcaccgatacgaagtcctgcataataagctatctggattggaagtattgccggtggattgtaatcctgtagaaattcaatcagtctttcataatcctctcgtggaattggctgtatatcgccatccatgtcatcatcagaaaacaggtcaacctcatccgtctggtatttcagcttaatatactgcatcggattgaaagtgatatattgctttggggatactgcaaaccggaatgactgctgtaatactgccgagaaagaacgaatgtaatctttgctgtaaccttttctttctgaaccatctggataagtgccaccaaaggaaagcagatcgaagaaggcttgtaaatgctcagatgttacatttttcaactttctctctgaaattggatgcttcttgatgttggtaatagcaccaaggtaattctggactgtcccattactgagagtaccggtctttaattcttcctctgcccatatatcaagtaattctccaactgtaatattttccgactttgcaatgaatttcttgctttcgtaatcgtccattgcctgacggagcagtttttccgtttcacttttgctttctgttccagcgtattctttctgaaccagattgccgcttgcatcttctacatagaagcggtagtaccatttctttcctttttttcttacagatccttttgccataatcgtgtgtctcctttcgatatcagacaatcggaactgatgaaatgcttcttgcgtgtaggcatcttatggacaagtccataagccaattcgccgctcgtcaaatctgtaaacagcctgactcgctcgtgctcattgtatcataactccggttgtcgttctataccgaatcggaatcctcatacaaaacttctgataaaagattttcaagcctttgttctgccatttccggtttcttggaatagagccttacaatatctgccatatcattaaaggcattaacggtatgggtgatctcccggagaaacataatctcgttatattcatcattcgattcaaaccccattacttttgcaatatcagcttcattcgtgttgcccttgtaattcttgcaggcaaactggaatgattccagaaacaggttatattgctttaacatcaacagcagtaaatctttggaaaaagcatcttcctttttactaaggtcgagaggtaactgtttgagaatatcgcccattgcatcacgaatctgtaattctttcttatccgtaatatcggtttcgtattcatcggtttcccctctgagccattcaatagatacatgaagtgcttccgaaagaccttccagcaccatctttttggtattgtcaatcgaaccattctcataacgcaggattgtggaagctgtaactcccatcttctctgcaacataaggctgtgtcagatttaattccagacgacgctgttttgccctgctgcctatcagcttgcgtagttctttatctttcatgctgattgcctcctttttcggtatgtatgaattatagcatgtacctcacataattgcaatatgcaatataataattatttttaaaatttcataacgcttgacaacacaatataaaaccgctatactaacagcacaacaaaaattgcataatgcaatttataaggaggtgacaagatgacggaaagaaagattgcattatccatcgaggaagcagccgactatacaggaattggcagaaacactttgagaaagctggttgaatggaagaagcttccggtattaaaggtcggaagaaaagtccttattaaaactgacattctggaaaagttcatggaagccaacgaggggcgtgatctgagggataaaggaaatgtaaaagctgtcacaagaaatgtggcaacttaaaaaggcggcttcctaagaaaccgccaaaggttctatcagaccgaagccatgatatacctacacgcaagaggattataccatgtgcttctcctgatatgcaaccgggaactgttgtttatcggaaaaagaaaggatgaagacgatatggcgaaatcaacaaagacttatgaagaaagaatacgtgcattagagaaaaaggaacaggaaagcattgaagctacaaaaaagctcatagcacagcggaaggaactggaaaa

SEQ ID NO: 27 - DNA, 3106 bp, Roseburia hominis
  modified_base (1681)..(1777): a, c, t, g, unknown or other
  misc_feature (1681)..(1777): n is a, c, g, or t
gattttttatcaagacatccgagaatatcgtaaacaaagtttacgaccaaaccaaacgaacgaaagttcaagatcgaagcaattcgatccgcgttattaaacgcaaagacccagtttctaacgctatagaaactgtaaacgaggtcaagcaaaaaagagcgcagggtggatgccttggcactaagagccgatgaaagacgtgataagctgcgaaaagctacggggaggagcaaatatcctttgatccgtagatgtctgaatggggaaacccacatgagcatacctcatgtatccatacgccaatccataacgtatggaggggaacccggtgaactgaaacatctaagtagccggaggaagagaaagaaacatcgatttccaaagtagcggcgagcgaaatggaaagaggccaaaccggaatgcgtgcattccggggttcggaccgcataattgatttgtcaatcctagcagaaaggttttgggaaagcctgccagagagggtgaaagccccgtaagcgaaaggaaagatgacatggcggtatccagagtacatcgagacacgagaaaccttgatggaatgagcggggaccaccccgtaagcctaaatactccttagtgaccgatagcgcatagtactgtgaaggaaaggtgaaaaggaccccgggaggggagtgaaagagaacctgaaaccctgtgtttacaagctgtggaagtgctttatatgcacaaccgcgtactttttgtagaacggtccggcgagttacgggtaccggcaaggttaagcacttaaggtgtggagccgaagggaaaccaagtctgaatagggcgtcaagtcagtatccgtagacccgaaaccgggtgatctacccatgtccaggttgaagttgccgtaaaaggcaatggaggaccgaacgcacatccgttgaaaagggtggcgatgaggtgtgggtaggggagaaattccaatcgaacccggagatagctggttctcctcgaaatagctttagggctagcctcattttagtcttatggaggtagagcactgaatttccgcgggggcgtcaaagcttaccaaagaatatcaaactccgaatgccatgtagatgatgaatgggagtcagactgcacgagataagttgggcagtcaaaagggaaagagcccagaccaccagctaaggtcccaaagtgtgtgttaagtggaaaaggatgtgggatttcaaagacaactaggatgttggctcagaagcagccacacattcaaagagtgcgtaacagctcactagtcgagaggtcctgcgccgaaaatgtccggggctaaaacacaacaccgaagctgtggaatcacgtaagtgattggtagaggagcattcttaagaccgacgaagctgtaccggaaggagcagtggagggataagaagagagaatgccggaatgagtagcgagagagaggtgagaatcctctcggccgaatatccaaggtttccagagtaaagctgatctgctctgggtaagtcggggcctaaggagaggtcgaaagacgtatccgatggacaacaggtttagattcctgtaccacatatgaacagaactgtggggacgcatgtggagagcacgagccgggaatggaaataccggtacaagcggagaaggagtctggttggcaaatccgccaggcaatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtagcgaagcgtgtgagccatgtgccgagaaaagccgctattgtttcatgtgtgcccgtaccgtaaaccgacacaggtggatgaggagagaatcctaaggccggcggaagaagcattgttaaggaactcggcaaaatgaccccgtaacttcgggagaaggggtgcctgctaacgcaggccgcagagaataggctcaagcaactgtttagcaaaaacacaggtctatgcgaaaccgaaaggtgaagtatatgggctgacgcctgcccggtgctggaaggttaagaggagaggttagcgcaagcgaagctttgaatttaagccccagtaaacggcggccgtaactataacggtcctaaggtagcgaaattccttgtcgggtaagttccgacccgcacgaaaggcgtaatgatttgagcactgtctcgacaatgcatccggtgaaattgaagtaccagtgaagatgctggttacccgcgccaggacggaaagaccccatggagctttactccagtttggtactgggattcggtactgcatgtacaggataggtgggagactaagaacttgggacgccagtttcaagggagtcgctgttgggataccacccttgcagtattggatttctaaccagccgccgtgatccggcggtgggacaatgccaggcggggagtttgactggggcggtcgcctccgaaagggtatcggaggcgctcaaaggttccctcagaatggttggaaaccatttgaagagtgcaaaggcagaagggagcttgactgcgacaccgacgggtggagcaggtaggaaactaggacttagtgatccggtggcataaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcggaggatatttgagaggagctgtccttagtacgagaggaccgggatggacggaccactggtgtatctgctgtcgaccaacggcatggcagagtagccaagtccggaagggataaacgctgaaggcatctaagcgtgaagcccccctcaagatgagatatccctcacataagtgagtaagatcccttgaagactacaaggtagatagggcagaggtggaagcacggtaacgtgtggagctgactgttactaatcgatcgagggcttgaccaaa

SEQ ID NO: 28 - DNA, 1655 bp, Roseburia hominis
catacatggctgtttttgttttatatctgcctgccagtttttccctctgcatatcatacttttccttagctttcagataagctgtctgtttacaattcccgcacttttgatagagtaccggcttttcaaccggtatctctacttttttctgatgggagagtgcataatcccgttcctgttctgcctgtctctgcttatctcgacattcctctatcatggcttggacggtgtgtgttttctctttctcgctctgcaacaattcttttgttttcctcaagtcgttctttaaggcttgaatgttctctgttttgttctcgctgtttaacttctcgttcaaggtcagcgattcgtcgagctgcactttcagttccctgatagtccggtctttctggtcgagttcttcctgcatctgctctgtcagcagaagcaactcttccagttgatcgtcgctctttgagtttcttaattcgttcatcaatcaaccttcctttctctaattgctgttcaagttcagtaattcgctgttctgtttctgcaatagccggttctcgctgtttaatttctgtgccaattcctgccattgctgattttcgtctgtgagtttctgtatctggtctgtcttttcttccagaagcatcaacagttcttctgtatccggtaagatttgtagcagctctgacaattctttctctaattgctgcaatcgttcttcctgctcctgaaagcacatcagcttctcgtccttttcctgtatctcctgaagcatctctgccatgatattctgctgttcctctatctgtgtaatcattgcttccatcatgggaattacttctttgctttcttctaatgtcattcaaccactccctccacatcgacaatgcaccggataccttaccaaaggttgcaattaccttttgcagcagtgcattttgtttttttatcatctggttttcctcgaccttccatgaacctttccttatctgcccggtgagatatttttcctcaatcttccttgcatctgcaccctcatgaatcgtagggactttcaatttgccctgtctttcataagagcggtggtcaatcagattgtctatggataaatgccggttacacatctttgcccattcgcttcgccataactcacaattctttggattgttccagccggtagcgtcagtcagaacccttttccattgttttctgtttcttgccccgactttctgtactccgttttcatcaagtaccggaatacggattccatgacggtctggatttttcttatcctgccaccagtccgggtgggattcatcaaccacgatatttccgtcagtatctctgacaaaatcccagtccttgacttccttgttgccccatgagtggtctggattgaatggtcgcatggttacaagtaaatgcacatgtgggttcccgtcgcccttatcgtgtatgctccagtcggcacacattccctcgtccacgaaagtcttttgaatatattcggttgtataatcaatctgttcctgtctgctccattctttcggcagggaaaattcaaatgagcgtccaagctgtgcatctgcatttttttctatctttaagacctcattccatagacgctgtttctgaaatgtgattttaaacttttccagtgcggc

SEQ ID NO: 29 - DNA, 1576 bp, Roseburia hominis
cctcgtattataaagtagtagtgtttatagaccctctccaaggtctgtatgctatacttttggagatactgtggattgttttcacactcctaccacttgatggtttaagaaaggctacaaccacagtctctttgtatatttgttaatcagttagataccgcatgacggtttatttagaacgaggttacaatcgcaaggagtaccagtgggtctataaacagtatcaaaatatttactcaaaggagatttttatgatatacgtcggaattgatgttgctaaggacaaacacgactgctttatcactaattcagatggtgaagtattattcaaatcttttaccattcctaacaatcgtgaaggttttgaaaccttatttcagaaagtacagtccgtatcagatgatttaaccaaagtaaaagtaggacttgaagccactggacactatagttacaatcttctgggattccttcttgataaaggtttgccgacctacgttatcaatccgttacataccaatctttacagaaaaagtttaagccttagaaagacgaaaacggataaagtggatgcccataccatcgcttctatgatcatgtctgatgtgaacttgaagtcctactcagacacatcttaccacaacgaagaactaaagtcattaactcgttatcgttttgataaagtacaggagcgagcaaagctcaagacctctgtatctcgccttatttgtattcttttccctgaattagagaagcttgttgcaacaatccatatggcatccgtttatgccctattatctgaatttccgtctgctcatgctgttgcatctgcacatcttaccagacttacaaatctgctttccgaaagctcacatggcagatatggcaaagataccgcagtaatgtttcgtgaagccgccagaaactcaatcggttcaaatatgccagcaaagtctctggaactgaaacataccattaagctcattcaggaattaacttctgagattgacgaaattgaaaccgaaatcaaatccattatggatgaggttaattctccgattcttagcatccccggaatcaactaccgtatgggtgccatgattattgcagaaatcggtgacttcagtcgttttgattctcctgacaagatacttgcctatgccggaatgtccccatctacctatcaatcggggcaacttgataactgttactcccatatggaaaaacgtggttctcgctatcttcgatacgccctttacaatgcgactaaatatgtctgccattgggatgaatcatttggaacatatcttgccaaaaagcgagcagagggcaagcattataatgttgctttatcccatgctacaaagaaactagtaagaaccatttatgcaatggaaaaaacagggcaatcatacagtagtgcatcctaattgttttctataaatatctcctagctgagtgccgctaatgacactctttttgtcatgcagttttcaaggtacaaatatatctgaaatgcatttctgcaattcattcaaaatatttcattttcagacttgacttttaatagttagtcttt

SEQ ID NO: 30 - DNA, 1149 bp, Roseburia hominis
gcggtgtcagaaacctgggagtaccaacagtaacagacagatttatacaacaagccattgcgcagatattaacaccaatctatgaggagcagtttcatgaccatagttacggattcagaccgaatagatgtgcacagcaggcaatcctgacagcactcgatataatgaatgatggtaatgactggattgtagacattgacttggaaaagttctttgacacagtaaatcatgacaaactgatgacgattattggaagaacaattaaagatggagatgttatctctattattagaaaatatcttgtcagtggaatcatgattgacgacgaatatgaggattctattgtgggaacaccacaaggcggaaatctctcgccactattggcgaatattatgctgaatgaactagataaggaaatggagaagcgaggactcaactttgtgcgatatgcggatgactgtattatcatggtcggaagtgaaatgtctgcgaatagagttatgagaaatatctcacgattcatagaggagaaactaggacttaaggtcaacatgactaaaagcaaagtagatagaccgcaagggttaaaatgccttgggtttggattctactacgatacaagtgcacagcaattcaaggcaaaaccacatgcaaaatcagtagccaagtttaagaagagaatgagggaactcacttgccgtagctggggcgttagcaacagctataaagtggggaaacttaatcagcttatcagaggatggataaactactttaagataggtagtatgaaaactctctgtagagaacttgatggaaacattagatatagactacgcatgtgtatttggaaacattggaaaacaccacaaaacaaagagaagaatttagttaagctcggtgttccaagatgggcggcacataaagtggcaaatacaggaaatcgttatgcacacatgtgtcataatggatggatacaaaaggctataagcataaagagactaacctcattcggattagtctcaatgttagattactacaccgaaaggtgtacaacttgttaagttgattgaaccgccgtgtaccgaacggtacgcacggtggtgtgagaggtcggaatttcttatttaagagaaattcctcctactcgat

SEQ ID NO: 31 - DNA, 1110 bp, Roseburia hominis
ggctttacatgcacaggcggtagcgatgacaattccagccacaaaaagcgcagctccgccactgtctcgtatacacatctgacgctgccgatgatcacagcactctagcactcgaagggctgcgtgtctaagaggacaaaaacccttaaccccctgtcagccggctgtcaccggctgttatcgattgtcacaaaaatgttaacttatgggagcaacaagtattcatgtacaagcagtgaagccggggagtgagattcacaactttagggaaaaagagttggactatgttcgtcccgaacttagtcatttgaatgaaagctgggttggagatagcatctcccatcggctggaaagtgcgaaacaaagatatctcgatacggttgggcagaagatgcaggctaaagccgcacccatacgagagggagtaatagtaatcaaacaagaaaccaccatgcaggaactccagcagtttgccacggtctgcaaagaacgtttcggtatcgaagcatttcaaatccatatacacaaggacgaaggatacatgaacgcaaagcaatggacacctaaccttcatgcccatgtagttttcgattggacgcagccgaatgggaaaagtgtgcgtttatcgcgtgatgacatggcagaactccaaaccatagcatctgaaacactgggcatggaacgtggcgtttcttctgaccgcaaacacttatcggctatgcagtacaagaccgaatgtgcgaaagaacagcttcaggaactatcaaacgatatatccagtgcattagacaaacacaaggacgtacaaaaccagcttcttcagcttcagaaagaactacgttccattgaaacaaagaagaacgtccaaaaactcatttctaaggcttcagagaagttttacggcttgattggaaaaacagtcaacgatagggaaaaggatgccttaaaagccaaagtaaaggctttagagggggaaaatgaacagctatccgatagactgggaaaggctatacttgaaaaagagcaaaacggcacaaaggcattcaaagccgagaatgacaaggagtattatagaccgggctgttatacacatctgacgctgacgacgat

SEQ ID NO: 32 - DNA, 1105 bp, Roseburia hominis
gtcagtgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagcaatgctccccgacacctagtattcatcgtttacggcgtggactaccagggtatctaatcctgtttgctccccacgctttcgagcctcagcgtcagtaatcgtccagtaagccgccttcgccactggtgttcctcctaatatctacgcatttcaccgctacactaggaattccacttacccctccgacactctagtccgacagtttccaatgcagtaccggggttgagccccgggatttcacatcagacttgccgtaccgcctgcgctccctttacacccagtaaatccggataacgcttgcaccatacgtattaccgcggctgctggcacgtatttagccggtgcttcttagtcaggtaccgtcattcttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgctttggtgggccgttaccccgccaactggctaatcagacgcgggtccatctcataccaccggagtttttcacactggatcatgcaatcctgtgcgcttatgcggtattagcagtcgtttccaactgttatccccctgtatgaggcaggttacccacgcgttactcacccgtccgccactcagtcacaaaaacttcattccgaagaaatcaattaaagtgcttcgttcgacttgcatgtgttaagcacgccgccagcgttcatcctgagccaggatcaaactctcatgttatagtttgtttccttttccagaataatctggcttattcagatgttactctgaatttactgttttaggttgttctttataagaacgttcgtctgtctttcaatctcttgat

SEQ ID NO: 33 - DNA, 129194 bp, Bacteroides thetaiotaomicron
gatgatatgtatctgttaatagagcatatgctgttaagttattgtaaaagaaagatggcgagatgatattcggttttattgcaaaaatatataggaaatatcaagaatatattcatcctggtatttatgttacgaggcatggtattctgtacagagaaaaagattgccgatataatgtatatccgttacaaagattaattgttggtaaggtatgggttggaaacattccttcacaggagaaagggcggcttattcttcatgctaactcggaattgatagtaaaagggaattttgatattatcggttcaactgtagtcgtattgccggatgctaaactgattttaggttccgggtatattaatttccattcgaagttacattgttttaatcacatagaaataggagaaaatgttatcatttcagagaatgtaattatccgggattctgataatcaccagataacgggaggaaatagcatgtttgctcctgttataataaaggataatgcatggattggtatgtctgctatcattttaaaaggggtgacggttggtgaaggtgctattgttgcagcaggttctgtcgtgactaaagacgtaccgccgcatactattgtcgcaggagtaccggcaagggtaattaaaaaagatgtttattatacaatatgattattcaatcttgtgagaaacgaaacattagtatctatcatcgtacctgtctataattctgcgcaatatttaaggaagtgcatagatagtattttggcacagtcatatacagaatttgagcttctcttaataaatgatggcagtgaagatcattcgggattgatttgcgatgattatgcgcaaagtgataaccggatacaagtctttcatcaggaaaatgcaggcgtgagtgctgcgagaaacttgggacttgaaaagcatactggtgaacatttcctttttatagattcagatgactacatacaagagaggtatctggaagaactaatgaaatatgcatcatgcgattttgttcagtgttcctgctgttctgaacctgtgggcaatgactatttatttgttgatggaaatttcgaagggagcgatgaaataaagcaatgtctgttgaaatatatttatcctgaatttacggtacctttcggcagattgtataagtcatccatacaaagaaagaataaattgtttttcgatacatatttgtattcaggagaggatactttatgggtaagccaatatttattgtgtgttcactctttgcgagtatcctcatatattggatatatctatgtgcatcatgtaggggaacatttgtcgcaaaaatcgatttcatatgagcatttggaatatacgttacataaactgttaatttcttattctgatcttgaaaaacgatatgatttcgatttaacaggtgttcgttatagtgtcattatttatttttttcataggtatatcgtatatatagcaaacagaaattatacagaaatcaggaaagagttagaaaagtcatgtgctaaccctttgattaagggggtcttttatgataagaaatatctcttgaaagggaaaaaaatgaaattgtttaattggttagtattacatgatatgtatagtgtattggctctttatgtaaaacgatggaagcgatatttatgagatccgagcttttgtctgctttcggattcagattaatttaataaaagagacgtagaatggtgactttaaaagaataccttaattcggatcgtattgattattttccttttggttcaaaaggatatatcatggattggctcttgaggacagaacaatattggattcggagatatatacgtgcacttcgtaaagaggaattttatatgaactataagagaaataagattttgcaatattatttttctcgaaagaagaatcttttgggtatccgtcttgggttctttataaatgcaggttgttttgatattggtttgaagatttatcattatgggtctattattgtaaatcctaaatcccgtataggtaaaaattgtacgattcatggtaattgctgcattggaagtaaaggtacttttccggatgattctcccgttattgggaataatgttgatattggacagaatgcgcaaattctgggtggaatatatattgcagacggagtgaaaattggagcgggagcagttgttacgaaatcggtattagttccgggagtgacggtagtaggggttccggctcgtattgtagagaagtaatgaagatatcagttataacgattaattataataatggtgagcaactggaagctaccattcagtcagtcgtatctaatgtgacagtattaagagagcttttgggagagaaggctgaatacattgtgattgatggtggaagcgttgactgtagtgtttctgtgcttcaaaaatattctgaatatatttcttattggattagtgagaaagataaaggtatttatcatgcaatgaataaaggaatttctgttgcacagggggagtattgttttttccttaattcaggtgataccttttatgaagatgatacactgaaaaaagctcttcttttcttaaaggaggattttgtatgtggaaatgctgttttaaaatatgcgggtggtataaatgaatggagtgccccagaaatagtaaatacattgttttttatgcagcgtttttccgtgtgtcatcagtctttgtttattcgtacggaactacttaaatcacatccttataatgaaacattaatgatagtggccgactatgaacagatgttttatgaaattgctgtgaatcacaggagttataaaaaaatagatttgactatctgttattatggatgtgatggagtctcttctgatcacgagaaagcggatgcagaaaaaagaagtgtaataaatgagtttcggtatttgggatatatagaaccggacgaactatggaacgtggtgagtaaactaaaaattggcacccggaagtatcggcttttattatctttggcaaaatgtctgacaagtagtcctaaatattgggtgagataaatatatttgtatgaaaaagacctctgttccattggtaattgcttttactcctgattattttattccggcagctacatgtctctactccataattacgagtatgcaggcggaaggagagttacatgtcatttgcttattaagcgaggaattgcctgaacggttaaaactaaaaatacaactaataggtgagggacgcacttgttattcttttgtgaatcttcaaggaaaattgcagcatatatatattgatcaaaaatatacggaagcggcttcttatcgcttgttgttaccggatttattgccagaatataaaaaagtcatctatatagattgtgatattattgttcgtaatgatttggttcaactttatcattccattgatttaggaatgaattatctggcagctgtgtttgaagcttctatggattttcagttggaccatctgaaaacaataggatgtaatccgaatgagtatattaattcaggatttctgattatgaatctggaattgatgcggaaggataatatggttgaaaaatttatagaagcttcaaaggttgactatttggagtttccggatcaggatgtccttaatcaactttgtaaggatcgaatattagccttgcctccctattataatagtatcaggactttttatctgccacaatataagaaattctttttgcagaagtatacagaacaggattggttagaggttcaccggcatggtacagtacattataccggggcaaagccttggaatcaattcacggtgcaattccagctttggtggcaatactatgaacaattgccggagattattaaaaaggagtggcaggttgataagaagatttatttcttatctaagctttatagaacatcttgcgggacctttgtggtagataaactccaggcattatatcgcaaaatgaaatattaatgatggagaaaatgaagttaaaagaactagtaaagcagtttattcctatgaattactggaataccaggcgtaaagcatctatcattagacagcaagggaaagtagccgacttttgggctcctattcttaaagcttattataatggtgagatagaaagatactcactgaagcctaaaaaaaagttgggtactcaaaaagtgatttggcaatactggggacagggcattgataaagatgagttacccgaaatcatacaaatatgttttgattcggttgacaggaacaaaaatgattatcaagtgattcgcctgacggatataactatatctgagtatatagacttgccggattttgtttggagaaagcgtgagtatgtacagtttacccgtacattcttttctgatttgcttcgtgtagccttattgagcacttatggtggtgtatggttggatgctactattttactcactggaagtattccggctgtctatgagaagactgatttttttatgtatcagcgctctgatgaagagaagaacaagaagtactgggaaaatgtttatgcttattattttggctgggaacctaattttaaggtgcgaatgttgtctagtatcctttttgctcaaaaagagagcgagattatttcaactctaaccgatcttctgctttatttttggaaaactcaagactcgctgcctgattatttttgttttcagattctatttaatgaattagtagccaactaccggcctgctgaaaattgtccgatagtaaacgattgcattccgcacatcatacaaacaaaaataaatggaacttatgatgatgtgtcatttgaagaagccttggagctaagcaatattcacaaaatgacttattttgatgctgctgcaatgatacgtctcaagatggtgttacgattagcccgaaatgcttgactacagtatgaaacatgcatatttgataatggctcaccacgagtttgaggttttagggaagttggttcaggcccttgatgatgaacgaaatgatatctatattcattttgataaaaaggtgaaaaactatccattgcttaagacaaagtatacaaatttgtatattctgcaaaagcggacagacatccgttgggggcacatttcacagataaaggcggagtatgctctgtttgaggctgcttttatgcaggatcgatatgattattatcatttgctttccggggtacatttgcctctgaagtcccaaagctatattcatcatttttttgaaggtctaaaagataaggaagtattggtgcatgtcccaaactcagattatcagacgcaccttaaaatgcggagatataacttctttacgaagaattttatgcataaggttctttttataagaagaataaatcagctattgtggagagtatgtattcgtattcaaaaagaattgcatatatgtcggaatcggaatcaatcatatactaatgcggctaattgggtgagtataacaggtaaatgtataggttatttattgcagattaaaaaagatgtattgcgaaaatatcgttttactttatgtggggatgagttttttatcccctcggaattgggtaaatcgtatttaaaagatcgtatatactatgatgataaactattgaaatgtgattttgatggtggttccaatcctcgtatatatcatttgggagactatgacgaattaatcagttcgggttgtctgtttgctcggaagtttagctatacggatatgcatattgttgacaaaatattgattcatatcaccgctgatcaagaataatgaaacatgcctatttgattatagctcataatgagtttgaaattctgaaacgactgatacaggctcttgatgatgaacgaaatgatatctatatccattttgaccgaaagctgaatcactatccggattgccggacatcgtatgctaaacttacttttttagaggaacgtatggatgtccgttggggagatataagtgtagtagatgcagaatttgcattgttcgatgaagcttatcgacgtggggaatatagttattatcatttgttatcgggtgttgatatgcctcttaaaacacagaactatattcatcgtttttttgaaaaaaatgcgggaaaagagtttgttggctactatcagggaaatatatccaaagaaattgaccgtaaagtttgtagatggcatttgttccccaaaagttttaaggaaactgaaggcggcttggctgtaacaaagcgtgttttacgtgcaggatgtgtccggctgcagtctttactcgggattcggcggaataaggatattaatttcagaaaaggtactcaatggctaagtattagtaacgagcttgttggttatttgttgcagcagcaaaaagaggtacgaagagtttatacccatactttttgtgcggacgaaatatttgtgcagactatttgctggaattcttcttttcgcgacagagtctacgatatgcacgatgaaggacacggttgtttgcggatgattgggtggaaagataaccagctggaagagtggaaagaaaaagactttgaaatattgatgaattcggaagcattgtttgcccggaaatttagtatacggcatatcgaagttgttgatcaaattctgaatgaaatcagtaaatgaaagaaaaccttgagaaaagacaatcggaagtgattgcagctatgagatttccgttgatggtattgttgctttttgcccatgtgcttcccatgacatcaatccctatagagatgaatttctcagaaatgaatgtatatcatcttttttcagaaggcatatctcataatttgtcccggatacgcaatcctttattctttttcttctctggtttcttcttctttcgcaaactagagaaatggagtcttgatttttatcatcttcaattaaaaaagagagtaataagccttttgcttccttatttattatggaatatacttatgatattggctgtctatataaagaattatgcgtttatttttcttttttcaatggaaccgggggaggaactacaggaagtcaggaataattctttgtatatgttgttttggcatactcctgtgaactatcctttgtggtttttgcgtgatttgatttgtatgtctgcgttgtctccattattctatgctttcttcaagtatctgaaaatatatggattacttattctgctcgctctgtatttatctgtttgggaaacaaatattgcaggactgagtatgacagctattatgtttttcggagcaggttcctatatgggaatttataaaaagaatgttctggcgttttgttcgaagttccggtatgtgacagcaataatcactctcatgtttttatgttgcgctatcatttgtaatgggagggagcttcatgcgtatattgttagaatatatatattgtttggcataataacagctttcaatttgatggactggttaatagataaggaaagttggaagaatctgttttgtaaattatcggctacagtcttttttatttatgcagcccacgaaatatacatcattaactggacaaagggcttcttctcccgtacttctcttgcagactccggaggaggattaatgcttagttatttactaataccttttattactttaggtgtttgtctcggtctctattattttttgaatagaatggcccccaatatgcttgctttgctggttggaggacgaatgaaaactcaaattataagaaacagcaaatgaatattggaaatataactatttcagtgatcattcctgtatacaatgcgtcagtaactttgcctcattgtctggaatccttgcataaacagacttatagaaatttggagcttttatttgtggatgattgtagtacagatgaaagtttgtatatactaacatcttatgcggaacaatttgcagagatcgattttacaatcagaatattacaacatgaacgaaaccgaggtgtagcggcggcacgtaatacggccctgaagtgtgctaccggagattatatttattatgtagatgcggatgattctatagaaccgcacacattggaatgtctggtcaatgaaatcaatcacaaaggactggatatagtggggcacgagtggtacttgactttcaattccaatgcacgctatatgaagcagccggcatatactacttccgttgaggcattacgaaaaatgatgggtggggtaatgcggtggaatttatggctttttctggttcgtcgttctctttatgtagagaatgatattcgttttacagaaggtttgaatatgggtgaagatatgatggtgatgatgaaattgtttatctgtgccgggaaggttggcattgttcatcgtcctttttaccattatagacaaagtaatccggaatcactgacaaagatttattcacaagagcatataatacaagtagcaaataacgtatatgaggtggaaaaatatgtaaatgcttccgcatatgcggattcattaatagagtttattccttttcttaagttgaatataaagttgcctcttcttataacagatgataaatcgcattatgaacaatggctggaatgttttcctgaggcaaactgctatgtcatgaataacaaacttcttcctttaagaacacggattatacagtggatggcggtaaaacgatatttcattttgttgaggttatattatcggacggtatttaagctggtttatggtattatttataaataatatagttggagaatggtgcgtttattgactatgttattgatatcaatggttgtgagtggctattattttccattcagtttttctgtcttaccgcaactgaacactaaaatggcattagcgatgttaggtattgctttggtagcttatcagggatttcaaaaacatcggattactttttcgagagatttgctgggtgctattgtctttgcttttattttctcatttatctgctttgttgctgctgactataatcatacagatgattattcttatgtcacttacttcgtgtccttttttacgtggttgggaggtgcatatgtggtttgttatgttattcgcgcatttcacggtaaggcgacattaaatttgctcatagcctattcggcttttgtatgcgtgtctcagtgtatattggcaattttaatcgatagattctcggcattccgggctttggtagatacctatatctctcaagggcaagagttttttcaggaagtgggaagattgtatggtatcggtgcggcattggatcctgccggtgtaaggttttctattgtgcttcttttgatagtctatcttctctgtgaggatgagggtgtaaagcaggttaggtggaaaacttttgcctgtttattcgcttttttcgtgattgctgttatcggtaatatgatttctcgtactacatctgtcggattattcctgggaatagtatatttaatatgctctacaggtattttccgtttggtaatcaagggtcgttatatcaggctttattctattttaggaggaatgttaatcgtatttacgatgttatcggtctatttatataataacgatccttttttctacaagaatatcagatttgcctttgaagctttctttaactgggtggaaacgggagaactaagaacggattcaacggacaaattaaatacaatgatgtgggtttggccggaagatgttaaaagttggataattggcacaggcttgtttgctaattttgtgtatagcacagatattggctattgccgttttattttgtattgcggtttaattggcttcggaacttttgttttgttttttgtgtataatgcctgtgtgtttgcatggaagttcccttctttccggcttttttctttcgttcttttatcattgagtttcattatctggatgaaagtagctactgatctattttttatttatgctttattttattgtctggactggaaaatggaaccagttcttatagaagaatgaaaatcgtttactgtatagccggaacctacaattccggaggaatggaacgggtattggcaaataaagccaattatctggtcagtcatggatatgaagttgttattattactacagatcaacgtgaaaagcaatcctttttcgaactggaccaacgtatcaactgctgtgacttgagaatcaactatgaagaaaataacgggaagtcatttcttaataagttagccaattatcctttcaaacagtggaaacatcggaagaggctgacggcttgtctgaaacaacttaaggctgacattgtggtttctatgttctgcaatgatgcttcttttctatggaagattgatgatggcagtaagaaagtacttgaaattcatttttcccgttataagcgtttgcaatatggacgtaagggagtctggaaaattgcagaccgatggagaagccggatggatgaaagaaccgtgaggaaatacgatcgttttgtagtactgactgccgaggataaggcatattggggaaatctgtccaatatgatagtgatccccaatgcattgagtcattctacaacagaacttcatctttctccccttacagcccgaaaagtgattgcaatagggcgatatgggtatcagaaagggtttgactatttgatagaagcatgggaaattattcattgtgcccaacctgcttggacactggatataattggtgatggagaatggacggaccgtctgcaacgacaaattaagagaaaaaggctgaatcattgtgtctttttgaaaccaccgaccggacagatagaagaagagtaccgacaagcctctttgctggtactgtcttctcgttatgaggggttgcctatggtattattagaagcacagtcgttcggattacccattgtttcttttgcctgtaaatgtggccctggagatgtaataactgatggtaaaaatggttttttggtatcggtaggaaatcttccgatgttagccgacaggataatgagactgatggaagatgaaggtttgcgtaaacgtatgggaatgaatgcgtaccataattcaaaaacattctcggaggaacgaattatgcaatgttggattgatatgttcgataagttagtatcacaaagatgagtagcaagcgaaagacgattgttgtctcagcggttagtttacgtaagggaggtacattaacgatattgcaagattgcttatgttatctttctgctttggcagccgacggcaattatcgggttattgcattggtacataaaagagaattggctgactatccgcacattgaatatattgaaatgccggacgttatcaaagggtggggacgacgtttgtggtgtgaatatgtgacaatgtataaattgtcacaaaaaataatgcctgtatatttatggctgtctcttcatgatgcgactccaagggtggtggctgaacgtcgggttgtctattgccagacttctttccctttttataaatggagttggagggattttctgtttgactataagattgttctatttgctttatttacccgttggatttatcggatcaatgtgcatcggaatacttacctgattgtacaacaggaatggttacgttccggattgagccggatgttgggggtaaaaaaagaaaagttcatagtagctcctccggaacgtaaagagaatgatgtgattgcagaaatagtagaactttcctgttttacattcttttatgctgccacaccagattgccataagaattttgagctgctatgcgacgctgcttctctgttggaacaagagcttggaaaaggaaggttcaaagtggtcttgactattagcggacaagaaaataaatatgcacagtggttatataaaaagttcggttcggtaagttcgatagagttcgcaggattcatgagcagagaaaaactttttggttattatcatgcagttgattgccttgtgtttccgtcaaaggtggaaacatggggattacccgtatctgaatttatggcaacgggtaagccgatgcttctagccgaccttccgtatgctcacgagactgccgctggaagtatgcaaactgcattttttaaattgtcggacccggttcaattaatgaatctgatgaaacggttatgtgaagatgactttacttttctaacgagtatcggtacttctgataaacgtttctcattcgcttcatcctggcgggaattattcgattctatattaaattaattttttcagtccggtactatatatgcggtaagtgacaaactaaacttatgaagagtaagaaatagatattttattaaaaatgagaatactacaaataggcaaattctatccgataaggggagggatagagaaagtgatgtatgacatcacaatgggactgtcacagagacaggtttattgtgatatgctatgcgcctcggccgaaaaacagaaacctgagaatctattattgaatgattatgcacgtatactatgtgtgtccacctggaaaaaagtggcggctactatgttatctccggctatgattttccggttgcgtaaaataaacaaagaatatgatatcattcatatccatcatccggatccaatggcatgtctggcattattcctgtctggttacaaaggtccggtagtcctgcactggcatagtgatatactgaaacagaaaatgttgttgaagctctattcaccattacaaaattggttgcttcgaagagcaaaagtaattgttggcaccacccccgtttatgtacaggaatctccgtttttggaaaacatacagcgcaaagttatcagtgttcctatcggaatagatgaaatgaagccggttcccgggcgggtggcacaaataaaagaaagatatgccggaaagaaaatcatattctctttgggacgtctggtagagtacaaaggctatgaatatctgataaaggcttctcaaaagttgaatgacgactatattatattgataggtggcaaaggtccccttcaagagtatttgcaatccttgattgatgaactgggagtgaggaaaaaagtaaaactgctgggatttatagatgacaaagatctgccggattatttcggtgcctgtgatctgttttgtttaagttcgatttggaaaacggaggcttttggtattgtacagattgaagcaatgtcctgtggaaagcctgtgattgctatgaatatcccggagtccggagtcagttgggtgaatataaacaggttctccggaattaacgtaaaacctgaagatgcagatgcattggcagaggcgattactgctgttctgacagatgaatgcctgtatgaagagttagcaagaggagcgcgaagacgttatgagactatgtttactaaagagctaatgacagaactatgtctgaatctttattcgggagtattggacagttctgaaaccgattatccggccaacaaaaaagaatgaattccgaaaagttgtaatcaaagaaaaacaagctatatgaaaagaaatgtgtatgtgggagtacttttgacagcgttattgatgacttcttgcatcaatacgaaaagaatcgtttatctggaggatatgaaagaatcgttatcttatccgatgaatgcccaaccggaaatgaagattcaacgggatgaccggcttagtattgttgtcagttcacggaatcccgaactgacggttcctttcaatatatcgaccggaggaaactttcaggtaacttccagtggagatgtagctaccggtaccgatatgcaaaaatgtgaaaaagggtatatggtagatttgaatggatatatcgaatttccggttttaggaaaactgaaagtggtagatttatcatgtaagcaagtagctgagctaattaaaaagcggctgattgatgaaaatctgatcaatgatcctttggtatttatcgatattttgaatataaagattactgtgatgggagaagttgaaagtcctcaggttttaaagatagatgatagccggattactttgctcgaagcaatcacccgaacaggcggagtgacttccaatgctcttttggacagggtagcggtcattcgcgaagaagggaacgaacgcagaatgtatatgcatgatatccgttcgtcggacattttctactctccttgttattatttacagcagaatgacatggtatatgtacatcctaagtttgcagaagccaatacgaaggaaagacgtacattaagtttttattcgttcggtctgactcttttaagtttgattactacaataactgtcttattaaaataatagccgattactgcatatggaaaaacaaaagaagatggctttgacagaggaggaaaagtctattaatatcgttgacctttttatatacctgatagctcattggaaatggtttgtcctttctattctgctgtttgggggatatttctggtatagctactgtgagaccccgtttgtatatagccgcacggcaatagtaatgattaaaacaccagccaattcgcggtcggcaatgcagttgaataacgctgatttcataggccaagtcaatgtggcgagtgaaattctgcaattcaagtcgaaggaattgatgcggaaagtgatagatcgtctgcatgcggatgtcagttacatggtgcgtgatggcctgcgtcccagagaactctatacggactctcctgtacgggttgcctttctggaggctgggctggatgaagtgtgttctttgtctgttatacctaaaaataaacagcaggtggagttggcagacttttcgctcgatgaactcgaacaacgaaagactgtgaatctgaatgacactgttgatacgccattaggaaaactgattgtatttactgctgaaaattatagtgaatcctattttgacagaccaatcaaggtgaccagtaagtcccgggaagggatggtcgctttctggctctctaatctgacaatcagacagatgagtggtgatgccgctttgctgagtatgactatgaatgacctgtcacctacacgggcagccgatattcttgatatgttgattaccgtttataacgaagaagccataaaggataaaaaccgtatttccgtgaatacggcagaatttatcaaagagcgtcttcagattattgagcatgaattagggagtgtggaaactgatattgaggatctgaaaagagcgaataacggcgttgatattaatacagttgcaggtatgtatatacaagatagcaggcaatatgaatcatcaatcaaggaactggatactcagcttcagttggtatcatttattaaacagtatttgcaggattcaaacaaggatgacgaactgatccccagtaatatcggactgtctgatcttagtattgagagccagatttctcgctataatgaaacgttgctgcgtcgtaaccgtttggtaagtggcagtagcagcaataatcctgttgttcaggagttgaatcgtatcatgcagacgatgaaacaaaatatttatatggcagtagataatttatctaaaagcttgagactgaagaaacaagattatatgcgtcaggagagccatgtgcgtcaaaaagtgcaagccgttcctgggaagcaaagggaaatgttatctatagaacggcaacagaaagtaaaggaatctttgtacatattcctactgaataaacgggaggagaacgctttaagccaggcgatggtggataataatgcaagaatccttgatccggtttcgggaagtaacttgccgatctctcccaataaatataaaaagatgatactcggagtaggatgtggtatcattgtaccttctgtcattctgttattgattttaatgctggacacccgggtgcataatagaaaagaagttgaggctgttgtcagtgctccattccttgcggatatcccacagacagccaaagcgtctgtggatgcacacgaagttgtagtgcgtgcacggggacttgatccgttgtccgaagcttttcgtatccttcgcaccaatttagggtttatgctgtcacaggcgcaagaccataaaattatcacattgacttcttttaatataggggctggcaaaacttttgtttctgttaatctggctgccagtttggtgcagaccaaaaagaaagttcttatacttgatctggaccttagaaaagggaaaatgagtgagatggcgcatagcaagcatgtcaaaggagtagcacactatttatccaatccatccattgttgtagacgatcttattctgcgggatgctttcggtgaagggcttgatttaattcctattggagtcattgcgcctaatcctacagaattgttgttgagtaggcgactggatgaattaatggatagactcagagaattatatgactatatcattgtagataatgtgccgataggattagtggcagatgcttccgttgtcaatcgtatttcggacttgacattgtttattgtgcgtgtcggaaaaatcgaccggcggcaactgcctgagttggaacgattgtatcaggaacacaaactcactaatatggcggttgttctcaatggtacgaaaaaaggcagtagcggctatggttatggttacggttatggacagggttatggttataagaatgcggaaaagaagaagggattatttggacggaagaaaaagaaatcccggaaataatgctatcatttctctctgacagatgttccgtaatgtctatattgaaaattaaacggtcttttaatctgattccgtataaagtgagaaggttatcggattttatgtgaacgataaactgaaaaaaaagacccaactttgcagttggaacttggtatattgaattttaatgaaaagaatcacttatgagaaaagtaattgttctatcggccttgttgctgataacaggaatgagtgtttatgcacaagaggactactctaaatctttaaaaacgacaactacaatcgtagaaaatgctgataaatataaagtagaaaccaatcgcttttggagcaactggtttgtaactgccggtggtggcggactgatctttttcggtgaccataatatgcagatgaaatttggcgaccgtctgagtccggcattggacatcggttttggaaagtggtttacccccggcatcggtatacgcttcatgtatagcggactgactatcaaaggtgctacacagaacggcagtcactctaccggaaaagtgtacgatgcttcacaatggctggacgaacagaaattcgactttatgaatattcatggagacgtgctgttcaatgcctcgaatctgctttgtggttataatgaaaaacgtttttggtctgtaactccctatgtcggtttaggctggatactcacatgggaaagtccgcgtgcacgtaacttcaatgccagtatcggtctgatcaactcgtttcgtctgagttctgcgttcgacttgaatctggatgtgcgtggtactgcgacaaaggatgagtttgacggtgaacgtggcgggcgtaaagaagaaggattattgtccgtaacagtaggagttacttataaattcccacggcgtacatgggggcgcagcactgtcaagaccattacctttagtgatgaagaactacgtctgatgcgcgaacaactgaaagcgatgaatgacgagaacaatcgtctgaaagacgaattagcaacttccaataaggttacggaaagagtggtggaaacgaatatcctctctgctccttatctggtcactttccagatatcaaggtatgctcttagcaatgaagctcgtgtaaatatcggatttcaggctaagataatgaaggaaaacaagaatgctgtctatacgattatcggttatgccgataagggtacagggactaaggagtttaaccagtttttgagcaaggctcgtgcggaagcagtctacaactgtctggtcaatgagttcggagtaccggcatcgcaactgaaaataacttatgaaggtggtgtggacaatatgttctatgatgatccgagagtaagccgtgcagtgataacggtgattaaataaacccttttacataaatatggatgagatgagataaaaaacacacttataaaacaatttgtaattagttgaaagatgcataagcatctataaatctcatggggcataacttcggtaacggagtgcctcgaaaaatagtcatctgtgaagatggtcgctattgcttgtttgaaagcatctttttccagtgggggagaggtgctttctcatggcttatccgttaaacacttgacaaacgctttttattgttgtatatttgtagttccaaacctgaactgaataatataagaacgataaataaaatgagaaaattagtatggaatcatcggctgtggtggtataatatagtaacaaatagtacttatctctctgacgtatagccgaggataggatgcttcgatataggaaaaggctgcaaactttgtgaggtttgcagccttttttgtattataaattcaatcctgattctacaaatttctattttaaagtttataataaacgagggggacgtttataataaacgatcacagtatttattataaacccggttgccgtttatgcagtactctgttgctatttttgtatagttagaatgtgcgttctccgattatagctaattacgataattatagttgacaatggttgcgggtaatctaactatacaaagctcttgaataccttacgttacttatgcgtgaagttccagtataaaccggcatcccttggtgtagcttgtgtccaatgtcagactgccattcattttggtggcgatgagtgagcagataggtaatcccaagccatcacctgtagtcaggtctttgacctgggtgaaaggtttgaagagattttcctgttgttctgccgggatacctgttcccgtatcggttatgatgaactgatgggtgtgcgcgccacgtttcttgaagtcgaggctgatacgtccttgctccgtatagaaagcggcatttttcagcaagtagagcaggatacgttccagctgttctttattcgtttttacttggagtttgggggcgtttacagaaggggtgacgtccggcttcataaattctttagccttctccatgacgctttcgcagaaagtacccgcattgacttctcccatttcataaggttcggtcagtgagttctccaaagaggaaagctcttgaatattgtcgctgaattgctttaaggctgctacttgtgcctgcatctgctctgcataccttggagcttgggcggaaagctctttggcggaagtccctaaagtgttcagagtcggctccatttgtgaggatatattccggatgaactttgttttcagctcgttgtgctcattggctatgaccacgctctttttgagtttgcggttgccggtgataaatttcagcagtaagatggcaagtacaatgattgtggctacaaggatagctacaagcgtacaaagtcctatgatgatgtattgcttggcggatagtgtgctgtctttgtcctgtatggtctggaggctttcgtcatattttcgtttcaggacattcagctcatcctgggcagtcagggcttttacagagtcggtccatacaatatagctttcgtacgtacgttccatcaacggggcattgttggctttgcgggcgatgccgataagagtcttgtagcagtcgctcactttatcgtagtccttcttttccttgtattggctgatgagtttgcggaaacaggcgtctccttgtgtattctgattgaaagtatagtaatagttggctttcgtatagagcagcacttccattaaagaatcatttttggcgagactggcaatctcttccaatttgtccagctggttttttgcctgtgcaggattcttcagtgaaatgtacatctgcaaccgttccttgctgatgggaaagcgtaagtcataaaagactttgttttgcttctgttcgcctgtccagatgagttgttccatattacggcataattcgaaaccttctttgtagaagttttctctgacatatagagcattggcttgaataccacattctatagcttgtggatagttctctcgcacggcaaatgcttcatacgctttcttaaacagataacgggctttgatgtaatctttctgcttcaggctgcttaaagcctgttcttttagttctgtggctttatcctgaggtgcttgtgcataaactgacagataaaaacaaaatgtgattaaaagagttacaatggacgttttcatactattgcttttattatttactacaaatgtaaaacaaatatatgaataaaaaagatatagccagtaaaaaaaatatcgctgtttatacgaagctaagcgggaacaatatgtagaatacttaaaaaatcatttgtcgaatgtataaatagttctgtggcgatactcttcccccggcatgagcaggcaggacggaaaatgcggatgcgaaggggtatccggaaagtattgtgtctccagacatacaccgatatccggtgtgggagcgagatagccggcggtatataataagacaccgggtaagtcagtcctgacagtcagccttctgccggagaaagggtcggataatacggcggctgtcaataacgtgtcggacgactcttctttcaggatatagcaatgattgtatcccttgttccagtgcaactgctcgttatcgtcgtaaagatgtgctccgatgctgcgactggtgctgaaatcaaacggactgtctttgacatcctgtgcttgtccggtaggaataaattgtgaggttgtctctaatattcgtgcagcaggtatcatgagctcatgctccgttatttttcgtttgtcgccggacaggttgaagtaagcatgattggtgagattcagataagtagggcggtctgtggttccgtgatagctgattgtcagttcgttggtttccgtgaattgatattccacttccgcctgtacatttcccggatatcctcctttcatgtccggagagtggagaaggaaacggatgccggaatctgtccgtttccattgccatatcttcttgtgaaagccggatagtccgccgtgattggtgttctctccgtcgtttctctccagcagataggtagtgccttcgatagaaaaggatgcctgatgaatgcggttggcaaaccggccgacagtggctcccatataataggtgtctttgagatatccttctgcatggtcatatcccagcagaatgttttcaaagacgtcgtatcggttcggcatattggccgaaacccaggtggctcccaggtttgtaagctcgatggaggctccggtagcgttggtcaaccggaacagatagatggaatctcccgatggagtacatccccaatgtgtaattgtaaactgcatgatctgcttattttatatgaatcttttgctttgcaaaggaaggcaaaatcaaagaatcagaaaatagagaaaatcagtttaaagatggacaattataagaattgtgtctgtgtttttctatcgaaaggaaatggggatgtgctctctcaacggaatgccggaaggtgtgttaaaatcggtagtatcttaaatctcctccttcaggaaggaggagtacccgcagggggaggtggtaggtgaatacgcaattctttcattcatagtaaattttagacaaccccattttagttactactgacttttgaaacaccctctggctttctgatagttatttcttcattttagcgagtagaatgacgttgttgccttcttcatccagtgaatttatcaatgtttgtgcacgtttctttgcctccgccggaatatcttttcgggctatttctttttccagtgtttcttttagctgggcaggttccatgttggcaacataataaccattgccgaatgagggccatatctgcatctttttcgttcccaggaaatcattgtacaggcggaagtagctgccatgcagtgttttcttatctatgatatacttggcaggtttgctgccgctccaagtgttttctgatacttgtatcggcacggaaacgtctccaataaagtgacgtgggtattcggaatagccgtgccaggggattttctccttgttcggatattccacggtgaatctggcttcgagtcgattttgggctgcgttatagtggtacagactgtccgttcgtggggcaggcatgatcaccattaacataacgccgtaatcattagtattattatccataaatacttcgttgctaaagtcgcgcggaacggtcagatgtcccggtgcgataaagttcttgcgtttacctttgaaatcttgtgtccacacgacagccggccagccttcgaaaggcagagttgtcagagtgacttccgacttttccgtatctactctgaatttgcctttgggcacgcgcatacataaaggaatgggaggctgaggattgccttgtaaatcgaatacgagcagcttgtcactctgccagggcagtatgtagatacggttgtgggcttcgtccaactggtcggcgtatgtgtttccatattcgttgggcccttgtccgtaggcaccgatagtggtgatgaatttgccgtcgcgggtaaaaagtttgtagggagtctgtttgttattgctcaccaggatgtatttttctcccactgtggtgcgtatccagcctcctactagtgcttcgtcccggttgtctagtttgacaacttgaagttcttctgtcaaatagctgagtggaatgtctactgtgtctttcaaagcctttaaattacatgagactagtgtgccggtaggtgtcgtgactcgttttgctacaataggggagagtgccagtgggtcggtctttgtttcactgttgtatacaaaagcaacaattgcaagtagacaactagcacataaacttaaaataataattctgttcttcatacggttctgtatttggttagtactgtttttctgattatcactgaggcaaaagtagaccgaagtgagtagaaaaacaaaaaaacaggcggacaaaaaggtacgatgtgactagatgtatgttattgattattaataatataatgtatatatgcgtttgttttcaggcggacaaagacttcaactaccctggggcgacagctaaaaaactttgagaaaactgtctaaacttatattctcatcagtaattcccagcttatcagtctttatccgatatttccgtttggtaatggcagctttgctcacacaatagatatcagataaatcctgtatgttgacattgattttgacgaggcagcagaagccgatttctttatctcccaactgtggataagcctgtcgtaaccggacgacaaaattgtcgaacgcatcgttcactactgaagtgacttctgcccattctgcatctgtcactactatcttgtgactggtgcccggttcgtcctgattgttgttggcatggagtgagggcagcttatggaagaatggcattctccggaaaagcgcttcacggagttcagcctctttattccttagccggatttctttctcccgtagtccacttacttcggcttctttgtacagtaactggttttcccgcagcagtcgcttctttttctctctctgataaaagaaaaatgcgatgaatccgatactcagcagagctgtaacgattcccagcatccatagttccctttgctgctgttgcagatgcagctggtataattcattctgtaatttgagttggttgaattctctttcccgtatccctgtactgatattgtttagtatattgtcccttatcgtgctttccttctgcttggtataaaagacttgttccggatattctttttcattgatcagattgaataagcgtgcattggcttccatggcaataaagctggaagatgagattgcggcttgccgatagtaatattgggcggagtcaatctgattcaaggcggcatgggttcttccgcatagcagcagatagtgtggtacttcatttcttccgcggcgttggctcgataattgttgaagatatatgactgcttgccggaaatcctttctttgcagactggtgttcaacagactttccagcgcataataattcaaagactggtatttgggcgaatccataagttctttcattagctgcagatagctttgggtgtatctgtcatgatcttgcattttgtttataatttgcagatatagctggctggtagaaaaatagaaaagtgtatctttcatcttaagagccagttgtctgctgctgtctgccatcaccaatgcctgcggataatcctgctttctgctgtatgctgcccttcgtagcccgtacagccttgtttttagcgtatcatttagctggtatcctttcaggatttgttcgctcatcagtaatgtggaatcgggcagattacgatataaataggaggcgctttgctcaatgcgtgcccgtacatactgggtttgctgctcgttttgtttatattgccggatggcgatctgcaataatgaatcatcaggtgttcctgttttccacagagttgccttgtagagcaacaggtaataatctccttgatcattgagaggtaatttgtcgggttcttctatttgttgcaggtagaaaaagatactgtcggttgatacattctccatctgcatcgctttttccagaagatgagatggggcaggttgacaactactcagcatgataagccatccgatgagtagaaatagggggtaatatgggttgtcgtgtttattcatatactagattctatcttgcgaaaatagtattttatatgagacgaagactttttctttatggtattttattgatttactgtcaagcgcttttatcccgcccagttttctctgtccagattgcgataactgatggcttcagccaaatgggagggctgtatcagttccgcaccctcaaggtcggcaatggtacgtgccacctttaatatacggtcgtatgcgcgtgcggaaagattgaggcgttccattgcatttcgcagcagggaaagtcctttgtcatccggccgagcataaatggataataacttgctgctcatctgtgcattgcagtagataccgggatgatcggcatagcgctgttcctgtatacggcgtgcctgaatgactctgttccgaataacactgcttgcttctccctgtcgctgatcggatatcttgtcgaacggaacaggaacaatctctatctgaatatcaatacggtccagcaacggaccggatatcttgttcagatacttttgtacctgaccaggactgcatacacatgccttggtcggatgattatagtatccgcaagggcatggattcatggatgcaatgagcatcagattggcgggataactgattgtgctctttatgcgggagatggtaatctgccggtcttccagtggctggcgcaggacttctaatacccctctgttgaattcgggtaattcgtccaaaaataaaactccgttatgcgccaggcttatttctcccggttggggaaaacttccgcctcccaccattgcaacttgcgatatcgtatgatggggatcacggaatggccgttgggaaatcagtgaagagccccggtttagttttcctgcaacggaatgtattttggtcgtttccaggctttcacccagggagaggggaggaaggatggaaggtaaccgtttagccatcattgatttaccactgccgggagcgccgatcatgatgagattatgtcctccggcggcagcaacttccaacgcccttttcacattctcctgtccttttacgtctgcaaagtccaggtcaaaggctgtttgctgttgataaaactcttcccgcgtgttgacaacggtctgttccagctcccgctcaccattgaagaactggataacttctttgatattactgacgccatataccttcagttgattgacaactgctgcttcccgcgcattctgttgaggaataatgagtccctcaaagttttcttcacgggctttgatagcaataggcagtgctcctttgataggctgaatgctcccgtcaagactaagttctcccatcatcagatagcgggataacttttcggaagatatggtttcgctggcacccagcaagccgatggcaagaggcaaatcataagccgagccttctttgcggatatcggccggtgccatatttacaaccaggttactggtcggcattttatagccattgacttgcagtgcggagataatacgttggtgactttccttcactgcggaatccggaagaccgacgagatagaacatacagccacgtgagctgttgacttcgattgtgatgagtgttgcatcaatcccttgaacagccgctccgaaaactttaattagcacgtttgattaccgtttatttcttctgtttgtttttcttttctttttctgtcgcttcctcaacgatgttttctattttctttttcagctcttctccccgaaggttcttagctaaaatctttccgtccgacgagagaagtatgttggcaggtattttatagatagaatattgcttggctacttcagaattgagtccgccgaaatcgcatacctgttcccagtccagcgtatcgcgtttgatggcgtctttccattgctgcttgtctacatccagtgagatgccgagcattcctatatatttgttcttcttatactttttgtagatttctcttagctcgctgttgctctgcttctgagagatgctgtcgttccaggaagcccaaaagttgatcagcaggcttttctgcttgaaggcgtctgatgaacgggtaatcttttctcctttcgcattgggcaggctgaagaaaggtgcatatttgccaatctccgatttttctgcctgagtgattgtttcattcaaacgttcgatatacggtttgtcctgtaatacacctgtcattacttcaactagctttttaattttactgaagtcaggcgtttctttctgaacgaagtatttgtctaataagtaaaggcttacataggaggagtgatgttgcagtatgaactcttccgccatttcttcggcagtgtttgctttctctacagttattcttttatccactgtttcttcgccggctttttctgaaggatcagccggatcttccagtgctttttggaagtctgtaaactcctcattgtatatatttccactgatagtcaggaaattcagattgatcgtatctccttttattttgatcttgttacccttatcaagaaagacaggatattcaatccggttcttgagtaacagataggcagaagtgatcgtatctacgctggtagtgtaggagaacttatcgttttctacataaatggtgtctatccggtcgtacagttcgtccatgccgtacaaataaagtgtatctgttccgagtcctttgatctctccggtgatggttgtctcattggagcccttcttgcatccgaccagacagataatgatgaggattaaaatactactctttttcattgctttgatttcttttctgcgaaagtacggttttttacagataaaaaaaagaattgcccgtcatttgtaatgacgagcaattctcaatatctaaaatagagtggtaattctcttatttgatgatgctcatgaagtctgcatttgtgaagaacttagagaattccaagtctgttgcagctttcttagccaacgcaggttctttagcaacagcgctcttcaagctgctggttaccatagaagaattgttagttctagcacctagaactgccatcaggtagtctgtgtaagcatctggtttttctacgcctgccagtgtgtttttagctttgttgtagtccttagcaaggatctgagccaaagcagcactgttagtcttagcgtcaccgaatgagttaactgctctttcgtactggccttgagcgatgtacaggttacccatagattcgccaagttcttttgtacctgcagctttaccgaagtaagcttcagcagcagctttgtcacccttgatcaaagagatcaaacctaagttcatgtttacttcaggagcagcgtttacgctggcagctttcttcaggtaagattcagctttgtcaacgttaccagcttgataagcaagcttaccaaggttgttgtatgcgcggtaatcgttagggaactgttttgttgcctgagtatagatagcttcctgttttgcaggatcgttagtcagtgtagcagcatacagcaattcttcgatgttcagttcagaaggattagaagaagcaagcttagtgatttcttcgtcagacttaccgatgatctcgtagttcaaagtcaaacgagaacgacgcagttgaggaaggatatcgtcagccaggttcttgtatacagaagagatgttcttgatttcttgttctctctgtgcaggatcctgatacatagacaatacgcgaaggatcagttctttatcctggatgttagatttagaaaccagttcctggaaaccttcccagtcctgtgcagtatatttagcgtcaaccggagcgtcgatcttagctttcttcaagtctttgttcagcatcttggtagtgttgctttcgcggttttctgctagagttgtattcaggcttacaccaccatcaggagaagcataagcagaaacttcgatgttgctgatcttcttgttggcagcttcgtttatgttagcaacttccttgttgaattctttagcagttttcaactcgcttgaacggatgttagcctgttggatcaagaacatgatgttagcatcgtgtttttccttgatgatacgttggaaagcatcttcgcccagagccgggttagcgctgcccaatgtgttatttaccaattcagaagtagagattacaccatcagctactttcacagcggggataacgacttcctttttaccaactttagctttgaattcaagccacagttcagattttgccatttcaggaacatagtcgaaagatgttttcatcgtatagctaccacctactttgtaagagatagtctgatcgtttccttctactttttctccttggaacacagcactttgtcctttagcttcaccgccattccatttcaaaaccggagtaacttctactacagcttttttcttgaaatacttttcagggaatttaccattaatggtagcaggaactttaccacctactgcttccaacacttgtggagtaacagtgaagtagtccgctgacaggggacccattttcttgcacgaagagaaaagtgcaacaacaattgccatgagtaaaggcaagtacaacttctttgtcattttaggtataaattaaatgtttgtaattgaaatatcgtcatatttataaccccttttcaatcctaataaaggaaaaacatcgcaaagatattaattcttaatataattatgtagttagcaggaggtttttatcataatttaatgaaaacccgactctttttctcgccgatacttgatatttcggggatgatgctcgataatctcgctgcgaagcatgtttcggtcgatatgggtataaatttcggtcgtcgcaatcgattcgtggccgagcatgcactggatggcccgtaaattggcgccaccttccagtaaatgagtggcaaaggagtgtcggaaagtgtgcggactgatgtttttggtgatacccgcattttgtgctaattcttttatcatatgaaagatcataatccgggaaagtgatttgcctctccgctggctgacaaacacaaaatcttcatagtcttttttaacttctatccggttgcggtccaagaaataaagtttgatctcgttaatggcacggggggaaatgggaacaagacgttgcttgcttcctttgccttctactttgatgaagccttcatcaaaatagagatcggataatttgaggctgacaagttcggatacacggagtccgcagctgtataatgtttccagaatagctctgttgcgctgtccttcggctttgctgcggtctacggaggagatgatgttgtcgatctcttctacggtcagcacttcggggagttttaatcctatcttgggaccttccagcagttcgctgggatcagcctccagataatccgccataatcaggaaacggaagaaggacttgatgccggataaaatgcgtgcctgagaacgaggatgaatgccgatgtcatgcaatcccgcagcgaaacgctggagatcggacaggcatacttcaagaacatctatcccttccagagtcagaaaactcatcagtttatccagatcggtcagataagcgtccaatgtattgggggataaagacttttccagcttgaggtactgctggtactttctgattatcagtgcttgttgctccttcttcttgtttttttcgttgatttccatttcttttttctacctttgtagcctgaaatattgttctttggatacaaaggtattaaaaaagcaggactacggcgatgagaatacaaattattaatggcccgaacatcaatctgttgggcaaacgtgaaccttccatatacggaagtgttacatttgaagactatctggctgagcttcgtaaaagatatgctgatttggagatcgactattttcaatcgaacattgagggagaaatgattgactgcattcagcaggtaggttttgaggtagacggtatcattctgaatgccggcgcttatacacatacctccatcgctctgcaggatgccattcgttctgtgacttctccggtgatcgaggtacatatttctaatgtacatagccgtgagtctttccggcatgtatctatgatcgcctgcgcatgcaaaggagtgatctgtggcttcgggctgaactcgtatcggttggctctggaggctttgttaggtaataaataaggtattaatatattaaataggtaaaaaggctatgttactgaaacagacaaaaatcgtcgcatccatttcggacagacgttgcgatgtggactttataaaacagctgtttgaagctgggatgaatgtggtacgtatgaatacggctcacgctagccgtgaaggttttgaagcgttgattgccaatgtacgttccgtatccaaccggattgcaatcctcatggataccaaaggaccggaagtacgtacaactgccaatgcggaaccgattccatatcagataggtgataaagtaaagattgtcggcaatcctgatcaggagacgactcgtgaatgtatcgctgtttcgtatcctaactttgtgaacgatttgaatatcggaggtctggttctgattgacgatggtgatcttgaactggaagtaatcgataagacagccgattatctgctttgcgaagtgaaaaacgatgcaacgttgggaagccgcaagagcgtgaacgtcccgggtgttcgtatcaatcttccttcattgacagagaaagaccgtaacaatatactttacgcgattgaaaaggatatcgatttcatcgctcactctttcgtgcgcaaccgtcaggacgtacttgatatccgtgaaattctggatgctcacaatagtgatatccggattattgccaagattgagaatcaggaaggggtggacaacatcgacgagattcttgaagtggcggacggcgtgatggtagcccgtggtgacctgggtatcgaagtgccgcaggaacgtattccgggtatccagcgtgtgctgatccgcaaatgtatcctggcaaagaaaccggtgatcgttgcgactcagatgcttcataccatgatcaacaatcctcgtccgacccgcgcggaagtgaccgatatcgcgaatgcaatctactatcgtacggatgctctgatgttgagcggtgagactgcttatggcaaatatccggtagatgcagtcaagacaatgaccaagatcgcggcccaggctgaaaaagataaactggaagagaatgatatccgtatcccgttgaacgaaaacagtaacgatgtaacggccttccttgctaaacaggcagtgaaagctacatcgaaactgaagatacgtgccatcatcacagacagctatagcggacggaccgcccgtaatctggcagctttccgtggtaagttcccggtattggctatctgctataaagaaaagaccatgcgtcatctggcactttcttatggagtggaagcaatctatatgccggagctggccaacggacaggaatattattttgccgctttgcgccgcctgttgaaggaaggacgtttgcagccgactgatatggtaggatatctgagtagcggtaaggcaggtacacaaacttcattcctcgaaatcaatgtcgtggaagatgcgttgaaacatgcgggagaaactgtattgcctaacaacaatcgttatctctaactgttacatctaaaataaggtttttatgcaggagactgaatctattgatgaatatattttgcagcatatcgatgcggaaagtgactatctgaaagcactctaccgggatacgcatgtgaaactgcttcgtccccgtatggcttccgggcatttacaggggcggatgctgaaaatgtttgtggagatgattcgcccccggcatatactggagatcggaacatatagcggttattctgccctttgtctggcggaaggcttgtcggagggcggaatgttgcatacgtttgaaattaatgatgaacaagaggactttacccgtccctggctggagaattctccttttgcggacaagattcgcttttatataggagatgccttggagcttgttcctcatttgggcgttacgttcgatctggccttcattgacggtgataaacgtaaatatatcgattattacgagatggttttaaagcatctttccacaggtgggtatatcattgccgacaatacattgtgggatggtcatgtgttggaacaacctcgtagtgcggatacgcagaccattggcatcaaagcattcaatgacgcccttgtgacggacgaccgggtggagaaagtaatcctgcctttgcgtgatgggttaactataataagaaaaaagtaagataaggagtaaatttatggaaacaaccagacagaataagatatcccgcctgttacagaaggagctgagcgagatattcctgcttcagacaaaggcaatgccgggtatattaatatcggtcagcgcagttcgtatcagtcctgatatgagtattgcgcgcgtgtacctgagcgttttcccgtcagagaaagcagaagaaatggtgaagaatatcaatgagaacatgaagtccattcgctttgagctcggaacccgtgtgcgtcatcaattacggattattcccgaattgaagttcttcgtggacgactcactggattatattgagaagattgattctttgctgaagtgaattttcccttctacatagctcggcgttatcttttctcgaaaaagaagcataatgctatcaatattatttccggcatatcagtatgcggggtggcacttgctacgttggcactggtctgcacgctttccgtattcaacggatttcaggatatggtagccagctttttcacagcttttgatcctcagttgaagattaccatccgcgagggaaaagtcttcgacggacaggatgaaaggattcgtgcggtctgtgcgcttccggaggtctcggtatctacagagacgctggaagagaatgcgatggtgcaatataaagaccgtcaggctatggttgtgttgaaaggcgtggaagataactttgaggatttaaccgaaatagataacattctttacggagccggcgagtttattcttcatgattcgatagtgaattatggggtgatgggcgtggaactggtttcgactttgggtaccggactggcgttcgtagatcctttgcaggtgtatcttcccaagcgtaatgccaaagtgaatatggcgaatcccggggcttctttcaatcgcgactatctttattcaccgggtgttgtgttcgtggtcaaccaacagaagtatgatgaaagctatattctcacttcccttgatttccttcgtaacttattggactatacgacagaggtttctggcattgagttgaaactgaaaccgaataccaatatatcatccgtacagtctaaaatagaaaaaatgctgggtgatgactttgtggtacagaaccgttatcagcagcaagcagatgttttccgtatcatggaaatagagaagctgatctcttatctgtttcttacttttattctgatgattgcctgttttaatgtgatcggttctctttctatgttgattctggataagaaagacgatgtcataaccttgcgcagtttgggagccagtgataaactgatatcccgtatctttttatttgagggacggctcatctctctctttggtgctatctccggtattatactggggttgatattatgttttattcagcagaagtttggcatcattacccttggcggaggtggtggaacttttgtggtggacgcttatccggtaagtgtccatgcatgggatgtagtgcttatttttattactgttttagcagtgggattcctgtcagtatggtatccagtgcgttacttaagcaagcggcttctgtaattggctgaagaagaaaaaggctataacctttgaatacagaagtgtaggtgctttgtagaggagtttgctaaaatggaacagagtgtttcatgtatttatgtagaaactatataaacaaaaagcgcaggcaggagacgaactcctttacctgcgcttttctattttttctcagtaaaatgaattacttcacttcccaagtatcgttcgtcatcagcaactcctggaaattatgatatttcttcttgcctttgacttcttcaatctgttctgctacagcgtcattgtaggtaggtgcctctacttcacgaatcacaccgagtgcaatcgggaaatcggggccttccatcaaagccagcttcaactgaagagtattgtcctggcaatgagcatcgtgaatcagaatatctttttctgtgatgccattctcgccaagttttaccactttcagtccgaaaccttcctgcatcagtccgaactctttgttttcaccgaacaacatcggtttgccgtgctccagatagatcgcattctttgcgcgtccttccttcgttgcaacagaagcgtgagttccgtcattaaagattacacagttttgcagaacttccacaacagatgcacccttatggttggctgctgctttcagaacctctacagaagcggcgccgtctacagcgatacaacgtgcaaagaaacgtccgcgtgcaccgaatgccagttctgccggatggaaagggtcttctaccgttccgtaaggagatgatttgctgacgaatccgcgttcggaagtcggtgaatactgtcctttggtcagtccatagatacggttgttcaacagaatcatgttcaggtcgatgttacgacgaacagcgtggatgaagtggttaccaccgatagccagaccgtcaccgtcaccggaaatctgccagatagtcaaatccggattagccactttagcacccgttgcaacggcagcggcacgtccgtggatggtatggaagccatacgtatttacataataaggcagacgggaagagcaaccgataccggaaattacggcgatattgtgcggagctactcccagttcggccattgccttgtgcagtgagttcaggaaagcgtggtcaccgcatcccggacaccagcgaggctgacctgatttataatcttgtacggtatatactttatcgctcatctcttattcctccaataatttagtaaatgcatctatcaattctctcgtaacgaaaggctgtcctttcacttggttgaactggctgatattcagtccgggtactttcatacgcaggtaaccggcaaattgtcccagattctgttcggctactacgatcttcttatatttacgtaatacgtcggctgtattcttcggtagcgggttgatgtactggaagtgtgcgaatgcaaccttctttccatgttcgcgcatgaagtccatagccagacggagatgtccgtaggtaccgccccagcctacaatcagtaagtctgcgtcttcgtcgcccagcacttcaagttcggggatgtagtctgcaatcttgtccacttttgcctgacgcaggtgaaccatcttgttgtggttttcgggttcggtagagatggctccggtttcgttactcttttcaagcccaccgatgcggtgcataaaaccttctgttccaggagtcgcccagtagcgtgcgcttgtttcttcgttacgttggtacggggtccagttgcccgccatgtccggagttacatacggagggttgatggcagggtagtcattcagatcgggaagtttccatgcggcagagccgttggcaacgaaagcatctgtcagcaatacgaccggagtcatgtgttccaaagcaattttggctgccatgtaggcggcatcgaaacagttggtcggtgaagtggcggcgataaccggcattgggctttcaccgttacgaccgtagagtgcttgcagcaagtcggtctgttccgatttggtaggcagacccgtagacggaccaccacgctgtacgttgacaatcaccaacggaagttcgccgataacggccaagttcatcgcctcacttttcaggcagatgcccggaccggaagttgtcgttactgccagcgcacctgcaaaagctgcaccaacggcagaagcacaaccggcgatttcgtcttcgcactgtacggtttttactcccagtgatttatgcttggccaattcatgcagaatgtcggtagccggagtgatcgggtacgaacccagatacagttccaaaccggctttttcggctgcggcaatcaatccgtaagatgttgccttgttaccattaatatctgtataaagcccttttgatttcggagctttgctttcaatcttataagtagaggtagaagcgtgtgtgttggcaccgtagttgtagccatcgttcaataccttaatatttgcttctgcgatttccggtttcttggcgaacttctcgcgcagcatcttttccgctgctgccagattgcggttgaacagccagcaaaccagtccgagcgcaaacatattcttgcaacggagaatcgttttattgtccagtccggaatctttcagactttctttgcacatagaagagatgggcacttccagcacttcttgtttaacgcctaattcttcaaaaggattgttggtcttaaattgtgctttttccaggtctctggcttcgaacgagtcggagtcggtaatgataagtccttgcggtttacagaatttgatttgtgttttcagtgcggaggggttcatcgctactaatacgtggcaacggtctcctggagtgtacacctgtcctgcgcctacgtggatctgaaaaccggaaacaccggtcagtgaaccttgcggggcacggatgtctgccggatagtcggggaatgtacagatgtcatttcctaccgtagccgacacgttcgagaagatgttgcctgccagctgcataccatcgccggagtcgccggagaaacgtactacgacttcctccaattctttaaccatcatttcgtctgccataactttaattactatatttaatttaaaaactgattttactttcaatttgtgagcgcaaaggtcggaaagttaatcgaattatcaaaataaatcgaactttattgtcctattgacgccaaataattggatttactgaaaggaacctgcatttttattcttgttaaatcaacagaaaccgttatctttgcaaccaaaataaaagcggccttgtagttcaacggatagaatagaagtttcctaaactttagataggggttcgattcccctcggggctactaagagaaatctgcgggaggcggtgttgttttgcttcatactgtattgagttttaagtattacaatggcttcttttaagattaacgtcttatagcttctatttgttttaataatcaatagaaaaagcctcttccgaatgttcggaagaggctttttctatttctggaatttattattcttccgtagctgctaccactacttttttgttcttcatcatgttgtatgcaatcggagatgcaatgaacaacgaagataaagtaccgataacaacaccgaggatcattgcgaatgcgaagctgcggattgaatcaccaccgaggatgaagatacacagcaatacgatcaacgtactcaatgaagtattgatggtacgagccagtgtagtgttcagagagtcgttgaacaactgacgcttgtcacgtttcggatacaagccgaagaactcacgtacacggtcgaagattaccaccttatcattaatagagtaaccgatagccgtcaggatagcaccgatgaatgtctggtcgatttccagtgagaacggaacgataccccacaacaatgagtaagcaccgataatcatgatcgtatcacaagtcagagctacgatagaaccgatactgtaagcgatgttgcggaaacggatcaagatatacagaccgatagcgatcagagccagaacaactgaccatacggcacctgtcttgatatcgtctgcgatactcggacccactttctgtgaactaacgatactaccgcctgtgtgattgtcacggtcgatgaaagtagccagtgtgatgttctgtgtcagcaacggcttcagtgtttcgtataagtatgattcgatctcagagtctacattgttaccttcgtctgcgatacggtagttggtactgatacgtactgtcttcttgtctgtaccgatagcgatcacatttacatttacatcttcaccaaacttgtcagcgatcagttcacgaacttgttccggttctaccggattctcgaattgtaccttgaagttacgtccaccggtgaagtcaatactttgacttaaaccacgcaatgcaaacgaaccgatacaaacaaggataatagcgcttacgatgatcagtgatttcttattggttcccatgaagtcgaaacgggtatttaccagcaagtttctggaaatcttggaagtaaatgtcaggttcagccacttgtctttattcatgaagtgttcgtaaaccagacgagtcatgaacacagcagtgaagaaggatacaaggataccgataatcaatgtagtggcaaaaccacggataggacctgtaccgaagttgaacaggatgataccggtgatgatagatgtcaggttggagtcgaaaatagcagagaaggcatttgaataaccgtcagccaatgctttcttcacacccttgccggcacgaagctcttcttttgtacgttcatagataagtacgttcgcatccaccgccataccgagtgacaacaccataccggcaataccggacatggtcagtgccgcctggaaggatgaaaggatacccagcgtgaagaagaagttcaggaacaatgcgcagttggcaaccatacccgggatgaagccatacatggaacacatgtagatcatcaacaggatcaaagctacaacgaatgagaaaatacctgcgttaatagattcctgacccagagacggacctacgatatcttcctgtacgatgtgggccggagccggcatcttacctgatttcaatacgttagctaagtcctttgcctgttccggggtgaagtgacctgtaatctgtgaacgtccgcctgtgatttcagagtttacgttcggagcagaatatacatagttatcaagaacgatagcgatagaacgaccgatgttctgcttggtcaactgtgcccagcggcgtgcaccgtcagagttcatggtcatgcttacagccggtttgctgtattggtcgaattcgtcttttgcatctgttactacgtcaccttccaacggagctttgccgttacgttcggtagatttgatagcatacaattcgaatgtctgtcctttcttatcgaattcagaaggagaaacaccccatttcagacgaaggtctttcggaagttctgactggatttcaggcatgctcagatatctgttgatatcggctgtatccttatagttagcatagccgatcaccggaccctgaccgcttgaattcaactgaagaacagctagcaacggatattgctttttgatttcttccatgtttgctcccgccttttcgtctttggcatctcctttcagagtagctgcgagactgtcggcaacgcttacggctttctttgccggagtagcttctgccagcttggctgcggggattgtgtctgcagttgcgttagtggctgtagaatcagcggcagtttcctgtgacaggatagcacgcaattttgagtcagccgactgcatagccggaagaatctcttttgcagtatatgtttcccagaattcgaggttggccgaaccttgaagaagttttctcacacgttccggctccttgatacccggaagttccaccatgatacggcccatcttatcttcgaggctttggatgttcggctgaacaacaccgaagcggtcgatacgggtacgaagcacgttgtatgagttttcaacggcagcctttacttctgctctcaatactttttctacttcggcatctgatgatttctggttaactttatctttcaactgttgtgttgcgaaaagttcggaaagttttgcgcccggagcagtcttctggtattctctgacgaacaaggtaatgatatcgtcctggctgttgacagcttgttttgcagcttcattcagcgctttattgaagttttcatccggcttgttgtcagccaatgctctgataacatcaggcacagaaacttcaaggataacattcataccaccttttaggtccaaacctaaactgatctccatttcacgacaatctttcagcgtccagttccacagcattactttctcattggagagagagtcaaggtagtcttgttctactttcgggtcgccgttcgcaatctctttcgccttattagtgtaatggcgggttacgaaggagaaggagaggtagaacacgcataccagcgtgagtagtaccgcaaaaacctttacaaatcctttgttttgcattttacttttaatttatgatgattacttttttaatttaattttcagttaaattctgtcgtatacaagtccattttgccgcatacaaggctgcaaatatagtttttttttcacattcatatgtaataagccctcaaatatttgatgtttaagggcttttttgccgttttatttcattcctctgtttttcagtaacggctccaggcttggttctgcaccgcggaaattcttataaagtatcatcggatcttcgctgtctcccttttccaatacgttgtagcggaagaggtcggcagtgtttttatcaaagattccatgttctttgaaggcttcaaaggcatcattgtcaagtacattcgcccaaaggtaactgtagtatccggcagcgtatccgccaatgatatgattgaagtaagtgacgcggtagcggggggcaatttcggggatcaggccgagcttgtccatggcttctttttcgaaagcaagcatatccagattctttacatctgttatcatgtgaaggttcatgtcgaggatggcggcagccagtaactcggtggtcatgaatccttggttgaacgttttctgtttcagaatcttttcgatgatttcatcggggattacttctcctgtctgatagtgtttggcatacattttcagcacttccggttcggtagcccaatgttcgttgatctgagaaggaagttcaacaaaatcgcgtacgacattggtgccggaagtccctttgtattcgcactttgtcagtaagccatgcagagcgtgcccgaattcgtggaacagagtttctacttcgtccatagtcagcagagaaggggtgtcgccgaccggtttggtgaaactgcatacgttgcataccaaggggcgggttgctccctgctgttcgcggtaattgctcatccatgcgccaccgctttttcctgaacgcgggaaatagtctacatagaatatgcccagttgggagccgtcagcgtctttcacttcgaagacttctacatccggatgataagtcgggataccttccagtttgttcagagtgataccatatagtttgttggcgactgcgaaagctccttcacgtacattctccagtttgaagtaaggtttggtgtcttcttcggagaggttgtatttctctttgcggagtttttctgtgtagtaccaccagtcccaggcttccagtttctctcctttgccttctttgtccattaactgttgaagttctgcggcttcggctttcgctttcgggagggcatagctccaaaggttgttcagcagactcattacgttgctgtcattctttgacattgtctcatccagtacgaagttggcgtagttgttgaagcccaatagccttgctttttccaggcggagggagacgatcttgcggatcgtttctttgttgtcattcttgtcattgttattgccgcggttgatgtatgctttgtacattttctcacggagagggcggttctcagcgtattgcaggaacggaaggcggctggcgttgtgcagggtgaacagccatttccccggttgtccggcagctttggcttcttcggctgcgctttggcagaaccattcgggcaatccggctaaatcttctttcttgtctacgaaaagctggaaagcattgttttcattcagtatattattgctgaatgtgatgccgagagtggaaagttctttgttgatttcacgcagacgtgcctgtttctctgcatccagattagcacctgaacggacaaatcctttgtaagttttgtccagcagacgtttctgttccgtggtcagattcatggaatctttctgttgatatacaacgtttacacgtttgaaaagctcctgattcagggagatgttatcttcgtgctcggaaaggaccggtgccattttgatagagagctcggtcagttcatcggttgtttccgcatccgtcatattgaagaaaatggcgcttacacggtccagaatgggtgcgctgctgtccaaagctacaatcgtattgtcgaaagtaggcacttccgggcttgcgataatggcttggatattctgattctgctcttcaatacctttcagaaaggcgggttcgtaatgttccagtttgattttatcgaaggaaggaacaccatactctgtttgaaattcagtgaagaaagggttgctttctgtttttgttccacaggagtacatcatacaacttactgctaaaatggttaaagtttttctaatcatcatggtatttatttaagtttttctgctttattgcttgcctatatagcaccagatcgggtaatggtccgaatctttgatcgaacggtctacggtgcagttgtaggctttctggttggggctgatcagaatattgtctatccggaaatagaatttattcagattataggagatgcccagtcccctgccggattgtgtaaaggcgtcatccagctgttgagtcaggatgcgatgggtatatgaaatggaagcgtcgttgaaatcgccacaggcaataatagtcgggtatttgctgtttgcgatggcgacggctaccgaatccgcttgcgaagaacggatggccgatgcttccgccagtttctttattaattgccggagacccgtttttaccttctttgcgttcgggtctttaatcatatcttcataaatcaccttgtcttctttcgtcagtttattggattccagatggttgtttatgagggtgatagtgtcctcgttaactttgagggtgtactgcatcgaaccgttgtaggtgctttcatacttgatgggacgtgccgaaagtatggggaatttggagaaacaggccaactgactgcctcctttttccggattgtgaatggaacggtagggatatgctttcaatgcttttctgatgtcttcgtctgtcagatatttcttgtttttggttgaattgtactcctgaagacagattatgtcagcttcactgtcagccagataggataatatcggattctttccttcctttttctccagattgttaaatcccatcacattgtaagagaggaatttgatgctgccatccggtatcgtttctactgtagaattgatgggaatataggtgcgtatctgtggaatacataccagaaaaccgatgaccggtaataaggcatagcggtagctgatgattacccagaatagggtgaaacagatgttgacagcaaggaagatggggaaggcaagccccaggcaagaagctatcgggtgtattttcggttgaagatacgggctataggcactcaaaatcaacatccctacaaagagtgcgttgactgccaatatcaaataaaggacaaatttgccaatgtgttccattctttatcttttgcttgcgtcgaacaagctctttttctcttccgtcgtcaggctttcataaccggattttttcagcttttccaaaatgcggtctacttcatccgattgtgctttcttacgggcgttataatcgtaatctttctcgcgacttgtgtcgcttccataatgtactttcatttttggtttgcgtttccatgtctttttctgaaacagggaagcgaagccgtcaaggaaccagttgatccagtaagtcacgtctttgcctttgctcagactggctgcaaaccaaagtccggcaagtgcgccgcctaagtgggcgatgtgtcctccggcattgttggatgtaataaagagcaggtctgttccgataacgatcagtgcgaggtatttcaaacggacggcgccgaaaaggaaaagttgtacccggtagttcggttctctgtaggcggtggcagctacgatggccagcacggaagcggaagccccgaccagtgtggagaacggcaatgtctggctgaaataagggaagatgttatacgctatcatgtagaacaatcctccgcagatgcctcccaatacatacaatccccgtaaatgctttcccgaaaagaaatagagaaacagacttccgaaccagtacagccagagcatattgaacaggatatgcaggaagcctgcatgcatgaacatgtagctgagcaatgaccatggctgaagaataaaccggtgaagggaagccggaagggcgaataaatcgaatattcccgttgcactcaggttgaacagctgcaatatgacactgattaacgtaccgataacaaagatgcctacgttaatgtaaatcagtcggatgaaagtgtttcctcttctgaacgtttcttttaaatcagttataatatgtcccattgtttctacttttttttctccaatacataatcaggataaatccgaatatcatacctcccaagtgggcgaaatgcgcgacattatctccgggattattggcaaagccggcatacagttcaatcaaagcataaccgataacaaagaatttagctttgatagggaagggcagcggaaagatgaatagctggttgttggggaacaacataccgaatgcgagcaaaatggcatatacagctcccgaagcgcccacggtggtcagcatgttcaaaaactctcccataggaataattcccgttcctatatccacttgtgaatagtggctgtagtctactatatatttgatgtattgcactccttcctggataagtcctgcaccgataccacaggcgatataataaaaaaggaaacgtttcggtccccaggtccgttcaagaacagttccaaacatgaaaacagcaaacatattgaaaaaaatgtggctgaacccgccatgcatgaacatataagtgataagctgtgccggattgaagtcactggcgaggaaaaaatgcaatcccagataattagtcagatcgataccgtatcgttgggcgacaagtgtcccgaaaaagactagtacattgataattatcaggtttttagttacagttggcataattttatattctgaatatttaagtaatgaacgcaaaagtacgaataaattctgttttaaagcatggaaaagcttccctattagctctttttcaataatttgctgcgttttttttatgtttttatttgatatgttgttttgttcatctatatttgtaaagtcgtaatgggaaatcttttgtgtaacatatatattaattaatcattttacgtatcatgaataagtctgaacttattagtgcaatggctgctgaagctcaaatgagtaaagccgatgcgaagaaagctcttgatgctttcatttcttcagttactaacgctatgaaagctggtgataaggtagctttggttggttttggaacgttctctgtaagtgaaagagcagcaagaaccggtattaatccttctacaaaggcagctattactattcctgctaagaaagtagctaaatttaaagctggtgctgaattgtctgcagctgttgaataaacatatagttgaaagaaattagaagagggaggcgcgtgcgtctcctttttttgtatctttgcgcgcaagaaacaacttgattatgaagatagaagataaacttgtagcgtccgtcatcaacggactaaaagcactttacggtcaggaagtccctgagaagatggtgcagttgcaaaaaacgaagaaagaatttgaaggacatttgacactggtcgtgttcccttttctgaaaatgtcaagaaaaggaccggaacagacagcgcaggaaattggcgaatatctgaaggcgaacgaaccggctgtagctgctttcaatgtaataaaaggctttttgaatctgactattgcatcggctacctggattgagttgctgaatgagattcagtcggatgaagagtacggcctggtgaaagctaccgaaacttctccgttggtgatgattgagtattcttcaccgaataccaacaagccgcttcacttaggtcatgtgcgcaacaatcttttgggaaatgcgctggctaacattgtggctgcaaacggaaacagagtagtaaagacgaatatagtaaacgaccgtggtatccatatctgcaaatccatgctggcatggaagaaatacggaaacggcgaaactcctgaaagcaccggcaagaaaggtgatcatctggtaggcgactactatgtgtctttcgacaagcattataaagcggaacttgccgaactgatggaaaaaggcatgacgaaagaggaagcggaagctgcttctccgttgatgcaggaagcccgcgaaatgttggtgaaatgggaagccggtgatccggaagtacgtgccctgtgggagatgatgaacaactgggtgtatgccggatttgatgagacttaccggaagatgggggtcggcttcgataagatatattatgaatccaatacttatcttgaaggaaaagagaaagtaatggagggactggaaaaaggctttttcttcaaaaaagaagacggctctgtctgggttgacctgactgccgaggggctggatcataagctgcttcttcgtggcgatggaacctctgtttatatgacgcaggatattggcacggccaaacttcgtttcgctgattatccgattgataaaatgatttatgtcgttggtaacgaacagaattatcacttccaggtactttctattctgttggataaactcggttttgaatggggtaaaggccttgtacatttctcttatggtatggtagaattgccggaaggtaagatgaaatctcgtgaaggaacagtcgttgatgccgatgacctgatggaagagatggtatcgactgcaaaagaaacttcgcaggaactcggaaaactggatggtctgacgcaggaagaagcagatgatattgcccgtattgtcggtctgggtgctttgaagtactttattctcaaagtagatgcccgtaagaatatgactttcaatccgaaagagtctatcgacttcaatggtaatacaggaccgttcattcaatatacgtatgcccgtattcagtctgtgcttcgtaaagcggctgagtctggaattgtgatacctgaacagattcctgctggtatcgaactgagcgagaaggaagaaggattgattcagttggttgctgactttgcggcagttgtaaaacaggccggagaagactacagtccgtctattatcgcgaattatacctatgatctggtgaaagaatataatcagttctaccatgatttcagcattctgcgtgaagagaatgaggcggtaaaagtattccgtattgctctgtctgccaatgtagcaaaagtggttcgtttaggaatgggcttgttgggcattgaggtaccttccagaatgtaatacctgccctgaacaaaatatatttatgtgttccggaacgggactgggatgttgttgaatagaaaaagactgtccgaaaaggaattgtactctatctttaagaaagactttgggtaaagttaatgatagggattacatacttttcagacagtcttttttattattgggtaattactttcgaattatcagggtctttccaccaatatggattggaagcgccgaagctggatgcccagtcaccaaatttaggatacgcttccaaaatgcttgtcgtttctactggtacaaggaaatcggtaccacgtttagttcctacactgataccgctaatctgcagtcccgttggcatattctcattatttacataatataatccctcatcaggcctggatacatcactacctgtgccgaaataagagaaattcattttacttgttggagggaatttcacaatatgtgcttctttatcacgtcctgtattggcagaaatgatgataaaggggttcatattaaatttgctgtatgtttgttcccaaaatttgttattaaagaaaggagtaaatgctgtttctgtaaatctttcttgggcgacgtctatcgttacagtaaacgttttgtttatagctgctttttgattgtcaaaaaggataatagtgggataattttgaccaggttcccggtcttgcccttccatgaattgtgagacgattccgccggattctacggttattttctttatatcactatttgctatacctgtgagctggtaaccaaaaccgttttgccagtttgcgccatcatgtttaggcacaaatgtatctataacttttacgactttacttgtgagaacactcttataaatttcgcgcttatattcgacaatcatatcattcatgtcataatctcctttggatggccaaaaatcttcaaatgataatacacctttaaaggagttataaatctctttgttgtcaatggatttgtctgggagttcttctacaccaccagtctcaatggctgatccatctgagaaatcaagatagaatacggcatcgccaaagtttccttttctggtattatctcctgtcggttcaaagttggttgcatcctccataccaaatgcaacgacttctcctgatttgttctttagggcaatggtacggtgttctttgctcttattcagatcacgaatagaatagaaagtacgtttattattcataatctcctttgtgccttggttgtaggaagactcaataagaaaccatgctatgcttactcccgcagggaactcgttcacgaactttgtgccatcccaatatttcagttctactctgtcgccggtatacatactacctgctgtactgctggaattacacacggcagtcgatatgcgcggataggcaatgatcggtgtaacttgacttatatcagtcggcttctgatcggtagggtaggtgaaataaccgactgtgttttgtttggtacctgtactgctgagcataaccagtcctatttctgttggtttcttaacattgatttctatatttacattatcacctatatattcaggataataatcttccatcgctgcacttccacccggcttaataaaaacttcacggatattatacatgagctgcccatctatttccgttggagtagaagaaagataagtaggacatcctatctcattccattcacctaaaacctggaaaccttccggatatttgtagccgctattggtaacccctctactcgtacccttcgcatttctcttactttgtataaaagcttgctgatcaaaagatacttttccgtttgtaatttgtagctgaatcgggctgacagttccaagatagtctgaataaaggtaaagttctgtaagataagacggaatagatatgaaatcattaaagattccttttttatccgtagccccgcgatagacaggctcttcttttgtcttgataatgtttccatccttatcttccgatagcggattttcggcatataactcaaaaacaacctgataatttaaaccatagtttaaatcaactgtgcaactggaggatgttgtaaagccaaagtattcatctgcagttttttcttctggagcctgatataagtccttttccatacaactggctaacgagagtgcgcatagtacccccattgagagagatttgaaattgtttgtttgcataactgtgttctgataatttgattgtgacccgcaaatgtatgcatttaatatatcaaaacaaagagttaggaaataaatcgtttaaaaagaaatatatagcatggtaaatacaacaaaagtccggtaaccagttgatataggttaccggactttgatgtctcattggatgcaaatattatttcttttttgcggttcgtttacctttggcagaagtgccaggacctttctcatcttgtattttgattagatcgaagcaactcttcaaactcagatcttgaggaacaatgtctttagggatcttgtaattattacctttgtatgcaatgtaaggtccgtaccgaccattcagaatctccagttccggttcttcatcaaattttttgatatggcgttctgcttctttcgtccgtttttccagaatcagctgctctgcttcttccagagtaactttcatcggatcaagtgttttcggcagtgatacatataccttgttatgctggatgtaaggaccaaagcgacctatacctacagtgacagtctttccttcatactcacctaaagtacgcggtagcttgaacagttccagcgcttcctctagggtaatggtctccatggactgccctttcttcatctgggcaaagcgaggcttctcttcatcatctgcggcaccgatctgtactacagggccgaaacgaccgattttcacagatacaggcttgcctgtttccggttcttctcccagcatacgttcgccgactttatgttctgtctttatggataatgtcttctctactgccggatggaactgatcatagaaagtcttcatgatcgaagtccattttacttctccttccgctatttcgtcaaattccttttctacactggcggtaaagttgtaatccagaatatccgggaagtattcggtaaggaagtcattcaccacagttcctgtatctgtaggaaagagtttcgacttttctgctcccgtcacttcattgtgactttcatctttaatctgattgtctttcagtgtcagcacattaaatgtacgctcttcaccgtctttatttcctttttccacatattcgcgttgctgaatagtagaaatcgtaggagcgtatgtggacggacgaccgatacccagctcttccagtttacgtacaaggcttgcttccgtatagcgtggcgggcgttgagtgaaacgttcagtggcaacgataggtccatattccagtttctggcctttttttaaaggaggcaacagacggctctcatcttcctgttcattctcatcgtcgtaagactcacggtatacacgtaggaaaccatcgaacttgataacttcgccgatggcagtgaatgcatcaccgcttttgcttatagagatagtagcagtagtcttttccagttccgcatccgccatttgtgatgcgatggtgcgcttccagatcagatcatacagtttcttttcctgtgctgtgccttctatggattgattttccatgtaagtcggacgaatggcttcgtgcgcttcctgtgctcccttcgtctttgtttcgaagtggcgcggatgtacatagcgttcgcccatcatctgtatgatagcgtctttgctgctggctgttgcatattccgacaggttgacggagtccgtacgcatataagtgataaatccggattcgtacaaacgttgtgcgatcatcatcgtttgtgctacggtatatcccagtttgcgtgccgcttcctgttgcagggtggaagttgtgaatggagccggcggtgttttctttaccggacgggtggttatatcttcaatcgtaaaagtcgctcccttacatgcgtcaaggaatgcttttgcttcttctttcgtcttgatacggcgtgacagttccgctttcatttctaccagcttgccgtctgtatcgggaaccaggaatatggcaataacccggtaagcggcttctgatttgaacgcatgaatttcgcgttcacgttctacaatcaggcggacagctaccgactgtacgcgtcctgccgacagagatggtttaacttttctccaaagtacaggagacaattcaaaacctacaattctatccaggattcgtcgtgcctgctgtgcatttacgaggttgaggtcgatattgcgtggttgctcgattgcttttaaaatagcacctttggtaatttcgtgaaatacgattcgctttgtgttttccggttttagttttaatacttcatacagatgccaggcaatagcttctccctcgcggtcctcatcggatgcgagccatacggtttctgcctctttagcttctgctttcagcgtgctgaccaaagcctttttgtctgccggaatttcataatcgggtttaaaattcttatctacgtcgatactgaattctttcttcttcagatcacgtatatgtccgtaactagaaaggactttgaaatctttcccgagaaatttttcaatcgtttttgcttttgccggagactcgacaatgacaaggtttttttgcataattctttcttttataatggcttgtaccataatatttcggggcaaaagtaaaaaaaaagattcgccctaccttataatataaggagaaactaatatttttttggaaaaaaataggttttgagtaaatctgcatttcttttgtatgtgcaagtattattaaagaaatgttctataattaaggggaaattaatataaaacagttttatttaaatagaatttcctatatttacacctttgtacagtattatgtggctatttatgagaaagattctatttaaaatatatctattgtttttctttgtaggtattgcacaacctatattgagccagtctccttattattattacaaacaactcggaataaaggaaggactctcacagtcgaaagtacaatgtgttctgaatgatcatcgggggtatctttggattggtacggaatccggtttgaattgttatgaccgtgaccatctgaagcaatatctgcatcggccgggagatgaaagaacactgccttccaacaatatcacttttatcgccgaggactctttatgcaatctatgggtagctacgatgaacggcatttgcctttacgacagagggagtgatagtttcagaactttatcgaataatggtaaaccgatctatgttgcttcctatttattggttgaaggaggaatcttactgggaggatcaggagctatatacaaatatgtctatgccactaataagctggaacctttgtattatgcgcaagaccctgtttattacaatcccttttggcagatgatacgttatgatgaagagaatatcctgctcaattcacgttggcacggcatatattccttcaatatgaagacgtatgaagtgaagaaaatagagtcgtttacagaaaataactataccagtatctatctggactcctacaagcgtctgtgggtaagtgtttatggtaacggactgtattgctatcagggagaccagttgataaaacactttacggcgtcaaattctcctttgacgtatgatgtcattcatgatatcatggagagagataatcagctttgggtagccactgatggtggtggaatcaatataatctctttagatgatttctcatttactaatattcaacaaaaacaggatgatgttcattcctttccagccaatactatataccgcctctatctggacccggccaataatatgtgggcaggcagtatcagaagagggttgattggtataaagaatgtgtatgcctgttcttatcagaacgttccttttggcaatctgtacggattaagcaaccagactattaatagtttctttcaggatagtgacggaatagtctgggtgggaactgatgggggaggtatcaaccggtttgatccggtatcgggtaccttcaaacattatcctgccaccaaatatgagaaagttgtctccattgtggaatatactcctgacgaactgttgttcttctcctttaataaaggactctttatctttcataagaaaacggggcagatacgtccctttgtgctgattgacaaggaaatgaatgatcagacctgtatcaatggtttttctgtcaatatccagcggataacgaagactaaaattcttttcagtgcccagcatatttttatatatgatatggtcacccgtaaatttgatatagtggctactatgggagaagagtacgagcgtcattctccactgataatagctacgaaaggtgcaaagacatacctttccgatctgaagaatatttgtgagtatgattcttcggaagggactttccggacgatttatcaaggacaatacactatcaatgacgcctctatggatcaggatggtattttttggctggcttctaccgaaggtttggtacgttatgatccacggacagggaagagtgaactgataaatacaagcctgtttcaggatgtagcttctgttgttgccgataatcaatatcgaatctggataggaacgagacgtcatttatttgtttattcttcccgtacccataattttactaccttggaggaagtagatggagttttgcctaacgaattcatctttcatgctactcttctggccaaaaacggagatgtttttgtcggtggaactacaggcatgacggtgataaactctgccgttcattttgatacagatgaggattatacggtcgaactgctggatgtattattaaacggtctgcctgtctcgttatccgaagagccgcaggaagcggctgaaataattcagattccctggaacttttcttccctgcaactgaaagttctgctgaatgaaagcgatgtgttccgcaagaatttctttcgtttcaatatagaggggctcgatcaggaattggcgagttccaattcaaactctttggttatcaattatctgccgataggggagtatacgattaccgcttcttattatacccgtgacggagggtggagtatgaaacaacccattctgcatgttgtggttactccgccttggtggaagaccggttggttctatgtgggattatatatattgttgggagcagtggcttatagcattgtctactacttctatcgcaagaagaaagccaaacagaagcgggagattatgcgtctgaaaaataagatgtatgaagaaaagattaatttcctgacgaatatcagtcatgaacttcgcactcctcttacactgatttgcgcaccattaaagcgtattatcaatcaggagtcggacaagcaggatgtggaaaagttgttggtcccgatctataagcaggcataccagatgaagagtatcatcgatatggtactcgatgtaaggaagctggaagaaggaaaagatatgctgcatatattgccgcatcctttgaatgagtgggtgcgctctgtcggagataagttcatcaatgagtttcatgtgaaaggtatcagactcgaatatgagttggacgaacagataaaagaggtacctttcgatcagaataagtgcgagttcgttctttctaacttcctgatgaatgcgttgaagtttagcgaatcgggcaccactactacactgattaccaccttgtcacaagagaaagactgggttcggatctctgtcagggatgaagggatgggactgaatatggtagacacagactctcttttctccagtttctatcaggggggacatgaaaaaggaggaagcggcatcggattatcctatgcgaagagtctcatcacacaccataaaggaagagtgggcgcttcgaatgcagcgggaaaaggggccatcttttattttgaactacccttattcacggatacttgcggacagctggaaccggcttctgtggaagcagctacaggcgtggaagtgaatgaaccggatagaatcgattataccttcctgaaaaaatattcagtgatggtggtcgaagatactcccgaactgcgaagttatctgaaagaaacgctgagtaattattttgcccgtgtatatgttgccaaggatgggaaagagggattggaacagatcaaagaccgattgccggatattatcatcagtgatgtcatgatgccccggatgaatgggtttgaactttgccgggaagtgaagactaatctggatatcagccatattccttttgtcttattgaccgcctatcataattctcagaatatgtataccggttataagactggagcggacgcctttttgccgaaacctttcgaaatagacggtttgctggcattgattcataatcagttgaggcagcgcgaacagatacgggcaagatataaagatgataagctcttgacgcataaggaagtgagctttagtaatgcggatgagactttcctgctgaaattgaatacattgattgcggataatatgagtaatccggatctggatgttgcgtttatagctactaatatgtgtatcagtcgttcgttattattcaataaagtgaaggccatcacgggtatggggattgtagactatgtgaataagcagcgcattgagcagtcaatcgtgttacttactactactaccatgaacattactgaaatctccgaagtggtcggcttctcttctttgcgttatttcagtaaggttttcaagtctattaaaggagagattccttccgcttataggaagcaggataagtaaatcgcattgataacttggacttaggaacatatactagaaataaaaaaataaatattagtctcatactctcattctatatgaggtaaatagcatataatcagtgtgatatacaatgagagatacttcttctataaggtatctctcattgttttctacgcaaaatgccttcaatttagcttatctctcctccttttttgctcatctctcattccctttccttgcgtaagtaggtaaaactgtctgccttttgagggttaatatctcatatatcagtttcaaataataggtactttgtagctcggataccttatatctttgccatatcaagcctatatacttatgttttcttaccgacatcttcatcgttccacccgggtgaaacgatcttgccactagagtggagaaatctgttcactctagtgatgagatcagatcactcgagtggaacgatgaagatctcctattaaaaatctgataacaataggtgaaaagcacaacaggatagggtcttctgcataagagaaagcggtatatctcgtctattccatcatttctctgcctacaacgtttatgagctttaagtcatagttatcattgtgggcatcttggaataattgccagatcatcacgccggcatagtcgttttctttgatgaacttacatttgttggctatagtagggcggccgttataataagtcttgcctatattatccttgtccgctgcttcatttccaagatgtttgagtatgccgctatagcggattccacgaacgtcatccactgcgccttgcagactttcctcccaggaatatccataaaaaggaagtcctcccactattttacttttggatgcccgacattgttcattccagtatttgaggtctttcacaaagtcatcgtatgaagcatgctggaccggtttatcggtaaacgctccccggtcataactcatcaggttgatatagtcgaagtattgctcccattcggttccgtaattaagccagcggctgttgacggcacaggtcatcagcatatttttctcttttgccaggtataaacctctggcaaaaaccaataatgaggggaaattcttatcccagttgtcatattcctcataatcgatgtcgaagccgtccagtttatattctttagtgaatgcaataatctgctgtatcagttcttttctggctttcggatcattgatggcggtagtgaattctcccggactgttcttagccaaagatatcagaatcttgacattatgcttgtgagccgtttcacgtacactttcaattctcttccggacaggattaatgtttagagtgccgtctgcttttactcttgcaaagctggcattgatatgcgtcagatatttccattctatcgtaggaaataaactttcaaactcccagtcgtcaagcgcaaggtagccgataactactttctgggtgacttccggttggggctgaggctgcggttgaggcacattgggcacctgtgggttgttggtattagaagagggtccgcaactagtgaataaaatgcttacagccgttaataatgcgtataatacatgtttcatgtttaataagtaaaaaagatttaatacccgaaaacaaatagaggaatgaaagttttgaatagtctctatacttccattcctccttctttagaagttcctaaaaaccttggctcctaccttaaaacctatttatctaacttggttatttttacccagtcaatttccatgatggcaggtaagttggcatcatcgataggacctgcccatgagcccggtctgtctcctcctaatcccatgttcaggatgagatagaatgaagaatcttttgtgaacggccattgcttcatttctgcttcattctccagtttcaggtttgagtaagagaaagtctcctgtccattgacgaagaaagtcagtttgtcttcgctccattctaaagcgtagatgttccaatcctgataattgcaagttacttgtgcggtgttggacggatctttgatgttcaaatcatacgtgtagtgagtatgtatcgtatgatggatcgcggattcctgtttcacatgttccatgatatcgatttctccgcaattcggccatccgtcatagatatatttcttcggcatcatccagatagcggggaatgcgccattggggtaactggtgattttggcttttacttccacccgtccgaaggtgaagtcaaacttaccttgcgtttcgataccgccggctttgtattcatcacctattttttcggctttcagtataagtctgccgtcttttacgtaagcctggtcataactttcggacatttcgtcgttccagtcggagcctgctttctggcagagtacccatttggtcgggtccggattgccgtccacatcgaactcgtccatgaagagaacgtccttcatggtgtcgtcaaacttggtcagtacgatagtataggtcgttgtttgattgtcttcggtggtgacggtcactgtctgctcttttttccagttgtgtacaaatgttgccgggtccggtgagatggtggctccatcgctcattagcgtatagtctacgccggtgatggtattggcatcctcgatcgtaccgatttccactctgtgggttgtctggtctatcttcccatgataataggaagtcgtattcgctgacacattatttactgctacggcaaaatcagtgagcggatatttcttttccggagtgatgtaattggtctcatcatccgaacaggcagcagtggaaaatccgatgattgccatgttcagtataagtaatatttttcttttcatcataacttttttggttcgttcattattttacgttggtagtaaagtacctgccagtttgtacaggcaggtactttttctttgtcaatgttacgttggctattcgccccacttcagcggttcgatgtattcccatttgcgtagcggcagtgtgccatcgttgcagcgcaccatgatctgtccacctttctcaacaagaatatttcctggtactttccagtcctgggtaccatcggagatagtggaaatgataaactcatcgttgaggtaccattctaccctaatccatgtaccggtttcattttcttcttgcaggatattccatcccaacttattgtcagcattcgtatccagtgttttcaccgttccggctgcaccgctaaatactttctggctccatggagtagtgctgaggtcactctttccgcctgccacgtgccaacggaattcggtccacggagtggcattaatcatgaagaacatattcatgttgccgttgaacggtccgatgtagatattatatcgtccaggcatcagttggctgccaaagtaataatctccgctcacctctctgttttcttcgttcacggtagttcttgatgattctgaactggcttgtttgattcgtatggtagtagtcaccggttctattccttcttcatcactgagggaagagagaatgatggttccgttgcgtaccgaagagctagtgctgtattctgctacattgataaccaaatcggcacttccattaaattcggtttgctcaaattcataccatgtttcgtctgacggaatctctttcgtaactccccagcgtgaattggctactacgtgaatagtcagctttccgcccacagcttccacttcataccacttgccgttttcgggctgtgcgggttcaatctgtacaccatcttgggtgatgttcacttcctgttgtttgtcaccattgcggtcatataaagttaccactccgtaacgcatggcaccggtattgggggttgctttcagttccactgtaccgttttccattccggaagctccttgactgatggaaagccactcttctccatcagtcaccttggctgtccacttttgattgctaagcacactgaacacttcgggcacatttccgtttttttcaatcatatccactccttcgtactctaagtaggcagtacctttttgagtcagtgtgaattttttaccggtccaataatcgctcttgatgttaatgacctcagtacgatcgtccaagctggtattttcctcacatttgatggttacatcgtatgtcttttccgggttatcacccgtggctggtgaaatggcataccagtcacctttgttttctccgaatatttcccatggatcggttgatttcacctggaaagtgacgctcagttcatcggttgtgccgtcggcgggtagtagatatgagtcttctacacggtagcgcaggtcgacagccttttgcttctcatcgtcatcacagctttgcaacacaggaactgctgccagtagtgtgaaaagtcctaagaaggctattttatgtaatttatcagatttcataaacacttcaagttattgtttacacatttattcataaacttcatagtctaacgacttaaagacgatggtacattccggtgagaatggaccgctgaatccggaatagaatattacgcctttatgtccatccaagtcaaaggcattgtgtttcttaccggaatagtatacttttccgttgatagagaatgttacgtttacttttgtcgcgtcttccggatcaactttggtatctaactcaatggttttgatgtcgttcatgctttcttccagcgtaaattcttcagctgtccagtcgtagtgaagtttaaaactggattttgttgttgaatcttgcggataaattctgatttgtatccaacctgcaccgtttgctgcaccattccagtgccatgtgtcaccattcaggtaaaggaatccatccgttccggcaggcatattgacgctttcaaagttccaaacgattttcccctttccataagagaagttgggcacatatctattttgcgcattgcttcgtatggttgcatatcctgtttccgggtcaatatcttcggctccgtctgcccacatatttctaggctgtctcacttcaacgggtacaccttcaaatcccggaacattgctcttgggataaagcaacacatgtcccactcttgtaataaacaaattgttgtatcctgctttaagcgtcagattattaccatcagcttcggcacttagccattccttaaattcggcaggaacctctactttccactctacgctggagttgatttcgatgtttttctctccgcccatgccattcagttggttggttttttcttcttcattcttgggctcgatgatgataccgtcttgtgtaatggtgaatgatttctcctgaaactctgtcttgacagtgatttcagctgttcttacacctcctgtattttctggtattgtgatggttatgggaattttgttgccatcttcattaccatcgcccgaagccggagagatttgttctacaaactgtgtggaaggaattatttggaatggcttgtttgacacaatattgaaagagatggttccacctactgtcggcacaatctggtcgtaaggaattactactaaatcttctttcgaagcctgctcgatagtaactaccttggtgccttcaacgccttctgccttgatagtcagtttggctgtacgtgctttctttcctgtattgttttccattgtcaccacaatctccgacacaagtgagctggctgcactcatcgaaggagtcggcttgcaccactgctggtcactttcgatcgtccagggagtgttggagctgatgttgaacactacattgcttggagaagttgccaaagcagtataagactccaaagcatctatctggatattgagaggaccttccggctgtgagtcgatgtcaaactcctggcatgctacaaaactgaatgtgcacagtgcaagaatcagttgcattaacgtgttgctatataactttttcatatatcttttaaatattagattagacaattaattaccatcctgtgttttgaggatttaagtttgtattcttgtatagttcgctttgagggatcggatacagatacatgcaatctctccagttacgggtttcgtaaaggttcttgtagaagttgaacgtaccgtccgcttgcttctcgatctttactccgtatagttcccgttgggtagtatcggcaatcttccatctccgtacatcccagaaacgatgatcttcgaaagcaaactctacacgccattcattgtacaggcgttccatgaattcatcttttcccatggaaggaatcaacggcatatcggcattctttctcacttcattgatagcccacagagcagaatacttataagtctcatctgtgtaattgacatcattgaaagcgttgaccatagattccgcatacgttagtaatgtttccgcatagcggtaaatcacccaatgatgcttgctgacagcttctttacccggttcaaagctagtagcttcctgaatgtacttgcgcaggaagtatcctgtcggtgaaccgccttgtgatacgattccgtcgtcggcgccacctttgaaggtttcaatggtgtagtctttaaacgacattccgttggcaagaatagcgcggtagaaacgtttgtcacgattctcataaggtgattgcgggtcaaatgcagggtcttcgcaaacccatcctgtgttttctagggttactttgtaaccgttgactgtctcgaatgcgtccacaaggttttgtgatgggtaattgctgtatgggataagactggaagtgcgtgttcccgcagtcatgcgaagcgggagattaaacatttcgaagtccgagtcatcaccattgatcctcatcagtacaacttcttttgagtcgaggttgttggcactctcctgggggtcgagagagtaaagccctgtgttgataatatctattgctgctttggcagactttttccacaattcggtatccatagaaggattatgtagcttactggcagcatatagcagtgcttttgactttactgccattgcaaagcctttggtcactctgccgatttctgctcccggttcgtttacatagctgtccggcaagttattggcagcgtcgtcgcattcactgacaatgaagctgataacttcgctgaatggtgtcttgccgattgtattggcttcctcttcagtcagtacttccaatggcatggcgatgtcaccgtagcggcgtgccagttcaaagaagtagtgtgcccgcagcactctggcttcgtaagggaaatatttcagctgcttcatccagtttgtatattgtccgtcgtgctcgtagcgtgtgaagtccacttgggcaatctctgctataaagctgttggcagcacgtataccgcgatacagggtccatgaatcgtcataagttttaataggcgaccagttaccgttattggtattctggatattatctgcataggctccgaattcgccgtcatcactggcacagtcgcgcatggaatatctgtcttcggtgaaaattccgccggaggtcgcaaacagttggtagccttgtggcatgtatgagtatacgtgggtaagcattgatttgcttgtaccgaaatacttgtacatgtcttcttttgtcttcaggttgttcgtttcatcaaagtcaaggtagttgcacgaagcaaagaccaacgaagacaaaatggttaagagtatgtatttggttctcataatgttcatttgttactttgcattaaaaattaagtttgatacctgcccaataacttcttgtcgacggataagcgatgccaagttgttccggatcggcaaaatggatattgtctaatgagaacagattggtgccttgtacgaatactttcaggtcggcaaagcgagtctgcgatttcgggaaagtataagctaccaataggttacgcagtttcaggaatgaaccgtcacggtaccacagtgagctggcgcgatagttattcaagttttcttgagtagtcagtctcggcatggttgcattggtcttattctccggtgtccagcttatttcttcattcaggaatgtatttgaaatgttgccattgcttacaagtggactataaagcggactgttgagcaatgaaacagtgactccggtcattccctggaaatcagcggaaagctccagtctcttgtatgagaagttcagattgaatccgaaatagaagcgtggaacagatgaaccgaacattttcacaatgtctttctcgtcgatgcggttgtcaccgttctgatctttgtatttcacgtcaccgggagctacgtccgagaaggtttgttgcggactgttgttgatttcctgctggctgttgaagaagccgatagcttccaggccgtacatctgtccgatacggttgcccttggtatacaggtagtcgtattcctgatatgcctggtttacattgactacctctgtattcagatatgacatgctagcaccaataccataatggaaatcaccgatcttatcattccaactcaaagaagcatccactcctttgtatttatagattccttcgttcacctgacctactgtgataccgataataccggaagtagaattggcacctgacacaagtatatccgaacgtttttcgtagaaaccttctactgttgcattcaaacgattatcaaaagcagcgagatcaaatccgaaagtcgctttctgtgatttttccgctaccaggccgataaccggcagatcgccttcactgccaccggactgtcctccggcattcactccgaagttataaccggcaccgccgctgccataagactgacgccatagttcgtggctcagattgccgtcccatccggacagaccgtaagaggcgcgaatcttaaagagattgatcggtgtcaccttttccataaatgcttcgttggaaacgatccatgcagcggaaacggcaggatagttcgagtatttgtctccgtcgggcaggtaagctgatcccgaacggttaaatacggcattgaggctgtaacggttgtcgtaagtatatgtggcgttcaccagcacagactgattcttctgagagttgtttctgccgtttttgacaacagactgcatatcataaatcaatgctcctcccacctgatgtttgccaaaagtgcggttataatccacctttgcctggaaatcgctgcgtagcatcagcctttcgaaaggctgtgtatgtcccagtgtttcggagtctgtaccataaatggcaggagttgtcaccagtgtaccatcgctggtgatacttgcattgctgttcatgtaacgatactctttattggtggtttcattcattcctccgatattatcgaaagagacggatgcttcggctgccagccctttggtcaatgcacttaaatcctgacggatgcttaggtcggcgagtagtgttccgtatacgttacggatgtgtccgtagtctttcaacagagctaccggattaccggttccgtacacagaactacctccataaatgccattctcataacgaatggggaatgcagcggatggaatgccatagattttgttgaaaatagcgctgcgtccatagcgggtacctctgaattctttcagtctgcctacaatgccggctttcagcaatgtgctttccgtcacttttacgtccagattggtacgtacggtcagacgtgtgtctgtaggtgtagtgtcgaaacgtgtatcttccgtgtttttcttcaacatggagcgatcccggtaatagtcaactaccgtgtaaaaacggaatttgtcactacctccgctgaaagacattttcaggttgtgggtcaatcctgtgttgttcagcgtttcattccaccagtctacattcggataatcatacggatagattcctgtccggaaagcatccagttcctgcgcattgtagcgtgcaggcagaccgtctccgcttaatgcggtgttaagagcgttcgcatacgtataggcatctgcgaagtccggagaacggaattgggtattgacaccgaaattatagtccacatttaccttcagaccattgcttattccgcgtttagtcgtgatcagtactactccattcgcaccacgcataccgtagagagcagcggctgccgcatctttcagaacgtagcatgattcgatttccatcgaagtgatgtcactgatatcacgtgggaaaccatcaattaatactagcggggcatttccgtgtatagagagggtggatacgttatcggctgacgagcctgtaccctgatatacattcagacctgccacttttccatacaaagctttgctgatatctatgtacggggatttttcgaatgcggaagcattgactccgttgatagagtaactgctggtccgggaagatacgttcatctggtagccgatgctcagtgtatctgccagctgcatttccgaagcagctttcgatgtctgtgcattcagggataccgaacctcccaggagcagagtgattaatatataatttattttattcattgttcaaacgatattagttaacgtgtcatttaccagcccgggttttgggtcattccatattgcttgttgatttcctcctgaggaatcggagccagataccacttggtatcccagttggtagcccagtaatggtctcccagttcgatcttctcgaaggtgaactcagtcggattgttcaggtcgttacctctgcttctgagtccgtacaacttcttcttgaagtcgctctgacggtctctgcgaacgaggtcgaaccagcgtacttcttcaaatcctaattcgagtgctctttctctcagtactgcttcgaggaactgatcgtgattcatcgtcttggaaagttccggcagacctactctctttcgtacatcgtttaccattttgtaagcctcgtcggtagggcgtccgttgacttcgttgagtacttccgcatatcccagcatgatttccgccagacgggtgtgtgaccattgtaccggaccttcgcgatcgttgttttcctgtaagatgtacttcatgatcaggaatccgctaccgtctttgtagtcggcatggttgatataaacaggagctgttgttccgttgcagtaggtgtctccgggacaagctacattttcatacagacgtgggtcgcgggtgggcaccatttcgccttttgtaaagaacggttgcttggagggtgacttccagtcgaaatttgccggaaaatcagttccgtcttcccacggaaacatatctacatagttcaatgtagggccgctgtaataacgttggccgataaagctgctgtgaacatcggagccatatccttgacgggtagagattaatatttctgttccgccgcggttgtagtaggcctgacgataggccagacgtcttgcccggtgcgtctcttccgtaggttgaatcagttcgtattcgtgccgtttttgtaattctgtgaaaaaggctgcgcctgcttcggcggcatctttccatcgttggtcgctgtaatttccgtaacaggtatattcgtctgcttccggatgccatttagtgtttgagttgaaagtcggactggctgcccattgcaataccttgaactttaatgccatcgctcctgccagggtcatacgtccgtcatctgctttctcggctttccaggccagattggagttgatggcttcgttgagcaatcctacgatcttctctaccgtttcggcaaaagtgatacgggggaaattcattgtctcgtttacgtctacatagtggtccagccatgtcacaccgcctacatatctcagcatttcgaaatagcagagggagatcaaaactttggcttccgcgatccgctcgcttttctcgctggctgtcatgtcgggcactttttctacgttctcaatgtacaaccaggcataacggattgtagtccagtcggatttgcttccataacggtaagcggaatttttgggaacattgttggcgctgagtgctccgttgtaatagagcttgacaggaccgtcactgatattatcacggaaactataacataagtctgtgattgattcaagtatgttcacacccaatttgtagtcagagccggtcggtagcccataaggtaatccggtatatgctttggtcagcaccttttcggcatttattttcgaagagaacatttcttcggtagtcgctccggaactctcaggctggtcgcccagaaatttatccccgaagctgatttcagaacaggaggaggctatcagtacgcaacccaatgctattccgagtccttttattattctattcatacagtcgttttttagaagttaagatttaaaccgaagctatatactttgatcagcggataatctccgaatcggttaggatcactttccggatcaagatatttaagcggtgagaaggtcagcaggttgtagccgctgaagtttaatccgagtgagctgaggcccagtttcttcaggaatttctttccggtgatggtataaccgaagctcaggctcttcaagcggagataggaagcatccaccaaccagagggtagagggttcggagttccagctttccgattcttccgacggacgcggataagtagctcccagttggttttccggagtccagcaaccgtcgtagaagtaggtcagcaaaccacgctttccggcattcgtataagggatacggtattcgatgtcatacattctgttaacgttcttggaacccacccattgcatggtgaagttgaatcctttccagtcgaatcccatgttcataccgaaaacgtattccggacgggtagcataacctgctacgctcttgtcattaccgtccacgatgtggtctccgttgaggtcggcgtacatggcgtcacccggatataccttctgataaggctgaggcagttccggctttaaggtcagttcgccgtcggctccggtgatgaagtcgctgtactgatagagacggatgtagttgtatactccggtctggcgtccggtagagccaccggtctggttcatataagagaattgcttgggcacttcgtccatatagaggattttgttgcgtgcgaaagagacgttggcatccacattataggtgaaatcctttccgatcttatcgcgccagccgagagaaacttcgtaaccgtggttgtctaccttaccaatgttcaggttaggcagtgcagttgcgatgatgcttggggtcgattccggagagatcagaatacctgtgcggtgttcgataaagtagtcgaaggtagcggacaggcggctgttgaagaacttaagatcaataccgtagttctgcttgtcggctgtttcccaggttactgccgggttacccatacgtgagatggctgctgccgattgggaaatcggattgtccacaccgaagctgtaactgcccgatgatccccatacggcaggcatgtacataaagcgtgagtctactcccttgtcgttacctacacgtccccaggatgctctgagttttaggtagtctacgattttctggttttccataaacttctcggcagttgcgatccatccggcagagaaggaagggaatacaccgaaacgtgtgctgcccggagcaaagttctccgaaccgttgtagccgacgtttacgtcgagcagatatttactttgataggcgtaagtagcacgtcctaccaatcctacgtagttacggggcagataagtgtagctgtccggataatagttacgcgactgattgtaaaggaacagaccggatattctgtggtcgccgaatgtacggtcatagttgatacgtccttccagataccagttctgtccgcgtccgctgctttccgagtaagtgagcggagtatcgctgccgctgggtacatagataagtgatttatcgtagtcgggatcggtctgtgacatcgtaccgttggtgtcaaagtatgatttgtagtacacagtctgcgcttcgatggcgcctcccgtacgtactttttccagtttgaatttattgtcgtaagcacctttcacggaaacgctcagtcccggagtgataaagtccagtttctgtgtgatgtccaaatccagattcaatgtcgtgtcatacgtttgattgtaaccttgtccgtagaatacgaacataccgtcacgcatcacttctcccagcggaaccatatctttaggaatcagtgtacgtactccgttgataaatcccggtccggcaaacggatgtgaccagatctgtgcgattacccaaggattctggtcttcacctgtgcccgaaacgacgctgcgcggttcctgtatcttgcctaaaacaccaccgacaccgagtttcatcgaagtagtctttgtcagattagcatcgatattggcacggtagttatagcggttgtaacgatagttattgtcgtacatctgtccgggaagttctttcagaagtccgttctgataagtataacctacagagatgaagtatcgcacattatcgctaccgccggagatatttaggttgttttggctttgaagatagatattattaaaaatatacttcttccaatccatactgggatacatgatcgggtctgagccggtacgataggcttctacctgttccggggtgaagtataatttaggattcgttacgtggtccatctcctgcttcatgttccagaagcgtgcgaactcgtaacttccagtctgttctaccagtgagatgggttgttgcagacccagtttggtgctggcggaaatctgcgttttgcctgctttacctcttcgggtggtgatcaatacaacgccattagcacctcttactccgaatacagcggtggaagaggcgtctttcaatactgaaatactttcgatttcgttcgggtcgatttgtgaaaactcacgttctattccgtctactaaaaccaagggcttggattgtgaatcatttaatgaaccgacgccacgtacgtagatggcagcagcatctttacctggttgtccggtagtctgtacggaagatacacccggcaatgctcctgcgaggaggttcgtgatacttgttgccggagatttgatcaactctttgttgtcaatggaggagacggcactggtaagcatgcgcttgtcctgattaccgtaggcgatagctacaacttccacttcaccgaggttctgtgcatcttcttttaaggaaacattgatgattgtcctgtctccgaccacgatctcctgggttacatacccgataaaggaaatgttcaatacggattttttgcttggggcgacgatcgtaaagttaccgtcaaagtctgtgattgtcccaatgctcgtgcctttcacagtcacattagctccgggaacgccttctttgagtgtttcatccgttactctacccttaattgtgataccttccgggggcaaggcatacatcaacggtatgaataaaagaaacgtaacaagaaagcagaatcttaaattgagcgcgtttctcatactgtttaatttgataggttaataatatatttagtttatagttaggtcaaccgggttgggggtgacttttattctctttattctctcttcagtttctaaatatatcctttgcttatgtgcaataaggttaacttcatttatcttttaatgatgatgcaaaattaggggtgatgtgaaaaatggacgtgcaatattcaccaaattaggtgcacaaatagctagaaacactatctgtaacaaatgggtagaccttgatacaaaattatagacggaatggaaaaggaggctttgtaaggaacaataaaaaagcccatcctgttatgttgcacataggcaataacaggatgggcatctgattggttcttctctttggagaatatgtcttgtctagaagctgaagcttaatcctcccaggaagttaagaccttctgtaggatagcccagataatactggtatttcttattgaggatattattaatccgggcatacacggatactcctttgaacacattatagctggctccggcatgcaggtcgctgactgctgcggctttaatgccttctacctttgtgcgtccgatataatcgtaaccgagattgatattcagtcctgtgatcgggcggaagtctgcgctgaaattaatttcgcaggcgggtttcatatacaggctgtatttttctttcgcatcccagttacggtaagttccagcagcgaacaatgcaatgaggtctttgtattcatagctgatcttcataccagcgtagaagttgttggcattgctaaattccagattcagatattgatgtgctgtgaccggggacgaggaattcccttcctgagcatcaccggcaagtgagggatcatagttgacaaatgtttcttcctgcacctcaaagaaatcgtctttcaaatcctgataaccgccatacagattaatccataatccgggataaggactcgctttaaatcctattgctgcattcagctgttcgtacgtatcgagaatagggcctgccggcaaggcataaggacagatcgtttccagtctgcggaaatcgttgaccagcttgcctccggtagcttgcgcatagagtacgtagctgtcggagaagatatactgtgctattacatccggagacacgcggaatgatttaccgctgccgaatgagatatccacattggctcctgcacgcaggttccagctgtcgctgctgagtttataatgcggattcagtgccagagcggtacggttctcgtatacctggaggtcgtcagcaagtttcaggtctttattgtagatgagattacgcatgtccaatccgatgttgatgctctgttcgtcgctgatagcgccgctgatcaatcctttggtatgcacttgtgtttctctgactttgtcattgaaaaagaaagtgttattgttctgacggttgtacatcatcagattggtttccgcttcgaactgtatgggataattttcatctgtcgattttactcccagatggaagtctcctgaagtaaacttctgcttgccgggctgaaccggagaaaggttgaaattgctgagtccgaaattagcggcgatgttgaaatctaccttgttgaactgatggatataatcgatattcgcacgggtacggtaataataagcattccatttcgtgtctgtttccggcatagtcagtttgccatccattccgtccatctgaaagcggacgttcagcttgtccctgtccgacagacggaacaggtaattggcaaggagatccagattaccgtagtttccatatccggcgcgtatatatccgggcttgctgccgggctgcacttccgttcctacatagggacgcatcaggtcggcagggatagaggtagccgggaagaaagtagtggcatattccacttcctttttgctgacggtaggttcttccactttgggtagcacattcactttggaagcatccagaatgtcgggattatattcctgttctacgacgaccgtgcggttcatggtcgtatctttcggctgagtattctgtgcctggaggttgaacggcatcagaaatgccagtgtaaagcctcctgctatataaagagttcgtttcatacttttcaatctttacttgtttagtttctttagtctgtcttcaatcatgctctcgatatcgtcattgccctggtaattctgttgcagactcagcagatactggcgtgcgtcgaggtctttacccatagcgacatatacgtccgacaggaggacaaagctgcgtgccagccaataagcgtgtggcgtactctgttcgatgtagttgagcagctctttttctgccgccgcatattctttggcatcgtaaagtgcttgggcaacctggtatttagcttcggcaccataagaattacgggtatccttggccagttcgcggaaatcatccaatgctttcttgtccgctttctgattcttataagcttttgcgcgataataaagagcttcgtttttcagttccggactaagcttggcttcagccagcacctcggtagccgcgtgaatcgtttctacgtcgtctctcagcaggaaggcacagcgcaggatgccggtttcggcaagctggcggcgttctacattggtcgctttttctttcagcatcttgtagcttgccagagcttctgccatctgttgctggttgaactgtacttccgcacgcatgatcagcgcttcttctgcgaatggattattcggatattcaagcaattttccggagtggaggagcaccatatcataattcttctgctcatttccaatctggcagaggtaataatgtgcattcaggctaaatgctccttctgggaaagtttgcagatatttattaaggctgctcttggcttcttctgttctgccacgtgcataaatcttttcggcagccgcatacgtaagtgagtcctgttcgctggcgtcaaagcggatgtgtcccggcatcgcattggctaaagccgcaaattcatcgatacggtttaaatctacatagatagatttcatatcgcgcattgccaggcgggcttcttcgctgcccggatatttctcaatcacttgtttgtacgcattgattgcctggtcgaagttgccgttctgataatacagcaaaccgatttcagccgcagctttccggctgacggggctttcgggatatttctccagcaattccttgaaagaagtaatagcctgactgttgttatccatcagtacatatgaacgccctttttcgtagatggcattcactgcgtatggagaagaaggatatttgccgaccagcctgttcagaagagtgatcttaccggtatagtctttctgtaaaccggataccagtgccagctgatagaatgagtaatcgccggaaggagtattcatttgttcggcttgcgagtagtagtgcttggcttcttcaaagttgcgcacattcagatgacagtctccgatacggttgtaggcatctgcaagcgctgttctgttttcgcctttttccagttggatatatttttggaaataattgcttgcctgtgtatagtccttgcggtggaaagcaatgtatcctaagttgtagttggcgagcgcatacatttcattatttggctgcgtggtcagttgcaggtaagcgttgaaatcgcgggcggcttccatcatccggttgaggcggtagtaagattctccgcaccagtagtaagcgtccgcctttgtctggcggttgtactgcccgatggtgatggactggttcagatattggagagcctgttcgaaattggcattggcaaacgactgtgtacccagttggaagagaatcttttgtttggcttccatgatctgtgcactcggcttggcaatccgttcgattgactttaaagcagcttcgtagctgcgggtatttatatagacttctaccagatagttgcttactttctcggcatacggagaagtcgggaattcattgagaaatttctcaaaagcagtaaccgattcaccgaaagcggagtaggacgtttcgtgcaggcaaagtgcatagttataagcggcctgttccttaatctgcaggttggcgttggaggcggctgcctgttcgaaagccatacgtgccttgttcttttctgccagttgcaggtaagagagtcccatgtgcaggtaagcattctgggtcagggcatcgttggcggtcgtcacttgtcccagcatttcggctgctttggagtagacttttgtctggtaataggagagtcccagcatataaagtgcatcccggcggggagcagagtgatctctgtccagatagccggtgaatgcttccactgcctggtgatattgtccgaaatggtagtaagcgtctcccagaatgcggtacatctcggcagcgtgctcgttgttcggataggccgacaggtagttttgtgctacgatctgcgccttatcatagttctttttgatagcatagatttctgctatgtagtaaggtacgagttctttgtacttcgggtcgtcctgcaaagggaggaagtctttcaacgcttcatcatagcgcttctgagtgtagcggatataagcgagatagtaactgcagtcctttgcatatttgggactgctggcacgtaacgtttcgaaccagatggcggcttctttcagattatcagtcttcatgtagcaggttgccagttggtaggtgcggtcgtcgcgctcctcatttcccagtagatcgagccgtgtagaattaaagagtgccagggcctcatcatatttcccttcatagaagtagcaggaagccagtagtgaatagattcggttggcgtagggagtatccggataacagtcgaggtacttgcgcagtaactcgatgcggtttttgtctttcagttcataagccgaactgactaacatatattctgcgtcctgaaggagacttgctgttggcttttgctttacaaatgctttcaatgcaggtatggcagctgcataatttttttcctggaaaagttctttcccttctttataaaggttgacaggagaggttatcttttcgcttgtctgtgcggagatggcaattggtgcacaacacaacaaggtgcagataattcgtgatattcttttcttcataatctagtgttttgacaaaaatacgactatatcttccaacgaaaaccctttgaaagttattttataatcatttaaatctttatgtaaattatctctcatccattttgaatccgaaatacttattctttttggactcttttttatcttcctgatgagagtaattaagtctgatgttgaatttcatgtgattgttgttttataattattggtggttacaaagataatacgaatcttagtattttcctcatttaaaacgttttctgatacccaaaagtttagtgccccttttagttaattgtgttgagccagaaactgtacaagtccccgccgaatggaatccagcccgaaatcttccggacgtatctctgataatggcaggaagaaagaatctgccacgtcatccattgccgagaaatggctcatgtcttttacggtacagagaaagaacatatcgagcgtatgaacggaaaagccggaatagatataaatgttcggcagggagaactgataggtcgctttttctaccttcaatcctgtttcctcccatacttccctgcctactccttcttctcctgtttcgttcatgtcgataaatcctccgggaaggtcgagtgtccctttggccggttctttggcacggcggcagaccagcagttccttcttttcattcagaatcagtgccacggtagcggaagacggattgaaataataaacaaagccgcagtctgtgcatttcttagacttctcgttgttcacttcgaagtgcggagaaccgcattcgggacagtacaggaattgggcaagaggatgtttcatcataactgattttatataatagattgtttgccgacaaaaatataaaatcttttcttcagatatggaataatgtgattacaaaatgctaaataccccgtcttattagtatcattaataacaatcatatacaaattaaaagaatcagactatgaataacaaaatgaatattcctttatcaggaattattcctccgttggtaactcccttgttggacgatgatgtgttggatgtggaaggtttgcaaagattgatcgaacatctgatagcagggggagtacatgctctttttgtgttgggaactaccggtgaatcacagagcctcagttataaattgaggatggaaatgattaaaaatacctgccgtatagcgaaaggacggttgccggtattggtatgtatttccgatacttcgattgtggagagtgtgaaccttgcctgccttgcggcagatcatggagccgatgccgtcgtttccgctcctccttactactttgcgacaggtcagcccgaactgatcgagttttatgagcatctgctgcctcagttgccgttaccattattcttgtataatatgccgactcatacaaaggtgaactttgcaccggctacgattcagcggatagcggagaatcccggcgtaatcggttttaaagacagttcggcaaatacggtttatttccagtcggtgatgtatgccatgaaagataatccggatttctcgatgctggtgggaccggaagaaattatggcggaatccgtactgctgggggctcatggcggcgtaaacggtggtgcgaatatgttccccgaattgtatgtgagcttatacaacgctgcgaagaatgcagatatggaagaagtgagacgtttgcaggaaaaagtaatgcaaatcagtgctacgatatatacggtagggcaacatgggtccagttacctgaaaggtctgaaatgtgctctcagtctactcggaatatgcagcgattatgtggctgcgcctttccataagttcgaacaacgggaaagaggaaaaatatggaaggcacttcaaaatttgggagttgatgtagtgctcaggtaattaatcaagaaaaaatgaacggctatgtctattctcgacattattatctttttattcttcacggggggagttgttgtcttcggctgctctttcttcaacaagaaacgttcgtcggaggaatttacttcggcaggacgttcccttccgggttgggttgtgggaatgtctattttcgcaacgtatgtaagtagtatcagttatctggcttatccgggcaaggcctatatgtccgattggaatgcttttgtattcagcttgtccattccgatagcctcgtattttgctgctaaatactttgtacccttttatcgttctatcggaagcgtatcggcttacagttttctggaagaacgctttggtccctgggcgcgtgtatatgcgtcatcgtgttatcttttgacgcaggttgcccggatggggtctattctgtatctgctcgcattgcctatgaatgccctgctgggatgggatattaagatgattatcgcagtaaccagcgttgccattattgcctattcaatgctgggtggtctgaaagctgtgatatggacggaggcgattcagggatttattctgattggtggtgcgatagcctgcctttgtgtgctgatgtttaaaatgcccgaagggcctgcgcaggtatttcagatagccattactgaccagaaattcagtttgggaagtttcggcagcagtctgaccgagtctactttctgggtatgccttatttacggtatatttatcaatctacagaattatggtattgatcagaactacgtacagcgttatttgacggcaaagagtgataaacaggctaagttctccgctctcttcggaggttatttgtttattccggtttctgcagtgttctttatgataggtacggcattgtatgcatattacaagacgtttccggaactgcttccggcaggggtcgagggggacgcggtctttccctattttattgtacatgcgcttccgaccggacttaccggattattgattgcctccattttcgcggcgggaatgagtacggtggctacaagcattacaagttcggctactatcattctgacggactattatgcccgttatataaataagagaccgacagaaaaacaatcggtgagagccttgtatgtttcgaatgtactgatcggaataatcggtattttcgtagcgctggcatttctgaacgtagagagtgcgctggatgcctggtgggctttgtcctccatcttcagcggtggtatgctgggactcttcctgctggggtatatttcaaagaaggcgcggaatgttgacgccgttttgggagtgatctgtggcattatcgttgtcgtctggatgagcttgtctcctatcttctttaaagatggttttatgagcgaatatgcaagcccgtttcatgctaacctgactattgtcttcggaaccattgttatctttttggcaggctttctcagtatgcgtttactgaaaacaaagaagtagaagaaggcagcttcactggcaggcatattggtttcatctattatccgatagaattattcgattggactttttttgcaaaggcggggtttccgcctttatctttgcatcagaaacaaaaaacaaaacgatgtttctgatgttataagtcaaatcaattaataacaataaaagcaataaagagtatggaaccaattttaaattctcaacttcctgaattcagtgttcaggcttttcaaaacggagctttcaagacagtaaccaacaacgacctgaaaggtaaatgggcaatccttttcttctaccctgccgactttacatttgtatgtccgacagaattggtagacatggctgacaaatatgctcagttccaggaaatgggtgtggaaatctactcggtaagtactgactcgcatttcgtacacaaagcctggcatgatgcttccgaaagtatccgtaagatcaaatacccgatgctggcagacccgacaggcgctttgagccgtgcactgggtgtatatatcgaagaagaaggtatggcttaccgcggaacattcgtcgtaaacccggaaggaaagattaaagtggtggaactgaatgataacaatattggtcgtgacgccagcgaattacttcgcaaagtagaagccgcacagtttgtggctactcacgacggagaagtttgcccggctaaatggaagaagggcgaatctactctgaagccaagcattgaccttgtcggtaagatttgatagatcttgataatgtgtgtgaagggccggtaacggagacgctgccggcccttcttttaaaagaatgaaaggagaaagagagatgttagaacctgcattaaaagaacaactgaagggtatttttgccggactggaggctgactttacctttgatatatccgtatcagccagtcatgaaagccgtgccgaattgctggaattgctgagcgatgtagccgaatgttccgatcacatcacttgtatggtaaatgaaggaagcggacttaaatttacgataggaaagaatggtaaacctacagaaattactttccgtgctatccccaacggacatgagtttacttctttattactcgccatcctgaatctggacggtaagggaaagaattttccggatgaggctgtctgcaaccgtgtgaaagccttgaagggtccgatacacttagtgacctatgtctcactgacttgcaccaactgtccggatgtagttcaggcattgaatgcaatgaccacactgaatccttccattactcatgaaatggttgacggtgcactgtatcaggatgaagtggatgccttgaagatacaaggcgtgccttctgtatttgccgatgggaaactgcttcatgtaggtcgtggcgaatttggcgaattgcttgctaaactggaagcgcaatacggtattgatgaaaccaaggtggagacggaagtgaaggaatacgatgttatcgtagccggtggcggtcctgccggagtatcagcagccatctattctgcccgtaaaggcttgcgcgtggcgattgttgccgagcgtgtcggcggacaggtgaaagagacggtaggcattgagaatctgatttcggttcccgaaacaacaggaagcgaacttgccgataatctgaaaacgcatcttctgcgttatcctgttgatttgttggaacagcgtaagatagaaaaggtagaacttgccggaaaagataaactggtaactacttccgtaggagagaaattcattgctcctgcattgattatcgctacaggtgcaagctggcgaaaactgaatgttcccggcgagaacgattatatcgggcgtggagtcgctttctgtcctcattgcgacggtcctttctataaaggaaagcaggttgcggtagtgggcggtggaaactccggcatcgaggcagccattgacttggcaggtatctgttctaaagtcaccgtctttgaatttatggatgaactgaaagcggataatgtccttcaggaaagacttaaatctctgccgaatgtggaagtattcgtgagttcgcaaacgacagaagtaattggtaatggcgataaactgacagccttgcgcatcaaagaccgtaagacggaagaagaacgtttggtagaactggacggagtattcgtgcagatcggactttccgccaatagcagcgttttccgtgatattgtggaaacaaaccgaccgggtgaaatcgttatcgatgcgcattgccgtaccaatgtgacgggaatctatgcagccggagacgtatcgaccgtaccttacaaacagattattatttctatgggcgaaggtgccaaagccgccctttctgcctttgatgaccgcgtgcgggggctgattgtataagtaatggccacagagattgtaaaaagtctcttgtggcttttatttttttcttacctttgtgattctaatatttaacccccaatgagaaacatgaaaaagatattcttactgatttccgcgatcttgttaattgttccggtgcaggctcagcatacgttgagactgatgacctataacatcaaaaatgcaacaggcatggatggtgtctgtgacttccagcgtattgcaaatgtgattaataacgcttctcctgatgtggtagccgtgcaggaagtagatagcgtgaccaatcggagtaatcagaaatatgtattaggtgagatagccgagcggacgcagatgtatgcctgctttgctccggctatagattatgatggcggaaaatacggaatcggtctgctgtcaaagaaagctccggttcatttgcagactatagctctgcccggcagggaagaagcccgtgcattgatcttagcggagtttgaagattatatttactgttgcactcatttatcccttacggaagaagaccggatgaagtcattggagattctgaaaacttttgcagcttcctataaaaagcctctttttctggcgggagacatgaatgcggagccggaatcggactttattaaagagttgcagaaagaatttcggatactctctaatcccagacaacacacttttcctgctcccgccccaaaggagactatcgattacgtggcggcttttaagcagaatgataaaggatttgccgtcgtctcttcggaagtggtgaatgaacctgtagcatccgatcatcgccctattgttgtggaactgcgcactgccgaaaaggcggataagatattccgtactaaaccctatttgcagaatccggttggaaatggaatgaccgtgatgtgggaaaccactgttcctgcttattgttgggtagaatacggtacggatacgactcaattaaagcgtgcgcgtactattgttgacggacaggtagtctgcaataacaagttacataaaatacggctggatgatttgcagcccggtcaaaagtattattatcgtgtctgttcacaagaaatgttgctttatcaggcatataagaaagttttcggaaatactgcccgttctgctttcagtgaatttactctgcctgtaaccggtacggattcttttactgctgttgtgttcaatgatctgcatcagcatacccataccttccgggctttgtgcaggcaaattcaggatattgactatgattttgttgttttcaacggtgactgtgtagacgacccggcaagtcatgatcaggcaactgcctttatcagtgaactgaccgaaggagtgcgcggtgattgtatcccgactttctttatgcgggggaatcacgaaatccggaacgcttattctatcggtttgcgtgaccatttcgattatgtaggtgacaagacttatggctctttcaactggggagatacccgtattgtcatgctggactgtggagaagacaaaacagacgatcattgggtctattatgatttgaatgatttcacccagttacgtaacgaacaggtcggttttctgaagaaagaactggctgccaaagaatttaagaaagcgaaaaaacgtatcctcctgcatcatatccctctttatggtaatgatggaaagaatctttgtactgaactatggactaagctgctggaaaaagctccttttgatatctgtctgaatgctcatactcataagtatgcttatcacccgaaaggtgaattggggaatcattttccggttgttataggtggaggatataagatggagggtgctaccgtgatgattcttgagaagaggaaagaagaactcagagtcagggtgttggatgcaaagggagaaactttgctggatataacggtctgaataatgtatatgatagtttgaatcatagaattgaatttcaccccaaaagtttagtttctaacttttggggtgattctttttatattgataatacctaatagttcctttacctcttttttattttagcttcctcctgagatgacaatgaatgtcaggcccaaaatgaataatataaacatgactcccaaaagtctgtttgtcgctttggagctaccggtaaattctttccagatgaaaacaccccaaagggcagcaatcatcggtgctccttgtccaagtgcataagaaatggctgctcccgcttttcctgcggcaatgtagcttaatgccgtacctaatccccagatgcatcctccgagaattccgaccatgtgtgtacttgcttttccggcaaagtattccttgtaagtgacgggtagaccaacgaacggacgcttcatcacaagtgtattgaagaggaagttgcttaggaagattccgatagcaaagatgaagaatgcagtataaggagttgccattccggttgtcggtgattcaaagttgttcaaatccatggcagcggcgacaaaccggtaaaagaatgacatcagtataccggcaatagcagcaagaataattccctttttgctgttattggttcccgccttttgattcttaccggctgcaataccgttgcaaatgatggcgataacaatcagcacgactcctgtgaatagccagaacggatctcctttgggggagctgaaataattaatgaatactcccaataccaatgccagtcctactcccaatggaaaagctactgccattccggcaatggatactgaggcggaaaggagaatattggaagcattgaaaatagctcctccgataagtgcactggcaatatatgccgcttccacttgttggatgtcttccagaaaacctcttcccgaatctccgaaacttcctagtgtgaataccagaagtagggcgaacagcaagatgccgatggtgtagtcccaataataaagttcataacgccaattcttactggccagtttttgggtatttccccacgatccccagcatatcattgtgataaagcagaagataatagctaaggtgtaactattgactatatacataatgattttttttaagatttcaattctcttttcctgtcacttgtcttataagtgcgttgcgggttgcccgaatattttcttccccttgaatagtgagatattggtgtttaccgctttcagaaggagaaaaaatactttgtccgatactgtctatggtgattgttcccttctcggataaattgaaataattattccccggttctatggcttgtagcacggatgtcaaatcccatgtttctctgtcatatggcatttcctgatatattttatatgatacgcacagaggatgtttataactgccggcaaaatcatttaatatactttgatgaggatatcgaattttgtttcctagttcccatccgctggcaataattggagtaggccattctttgaaagtaatttgggctgcattcagatcattaacaatgttccattcagggaagtcgaattcattaccatagagtcctcccatgacagatagtaattttaccttttgtgctaccaaggcttttccatccagctcgctgtattcatctgcttccgagataagcaaacgggctagatttgtttccgggcctaaggctataaataccacagaatgatcttcttgctctgccagcaatttacgcaacagtttatatccttccagaatatgatcttttaggcttctttttggatgtaatattttattgttgtcaataatagtatccagcgtttggcggagataatgtccgtcgtctgtattcatcccattataagcataacctaaaggtatgtcgtatttgtcgttgaaacgacaataagcgtcaatatattccagtgaataaggattacacttgcttatagtgatacctagcaaatcaatttttccttttttctcataattaagcagcatttgcatggctaaaacatcatcgatatcatttccaacatccgtgtcgagtatgacaggaattgcagaagtagtctctttctgttgtgcacaggaacagaataaagagacggttattagaatgattgctatatatttgaacatatcttgggtttttataagttatttccaatattctcaattgtattgctggttaatgattgttgcgaggaataatttactttataaagtacgcctcctttagcatggagagtctgattttctaaagttgcagttccttctttggtaaatgtgccatttacatcatatcttccggaaatggtttctccaaatttaccattctctagtttgaattgagagtcattcaaactataaatcagtaaataattgtgcatatctaatacgaaacctaaagaagcattatttgtctggaatgtgatttgtgctccagtagtacatattagttgttctaatttgtcttttggctgattatcgttaatattaaatgctgcaaagttctccggttttactttggcaacatctatataagctgccgccaagccttttatgagactacgagtaggaggtgtaaaatctttttcttgtaaatcccatgtataaattccgtggtcaatttggtccggttcggtggtgttgttgataaagaagttactggtagccaaatcgtaaatatcatagcctcctcctaatgcgaaagatgtcaagataagactcggactgtttgcataactacctttgttctcggcaaccagcgcataatttcctgcaattgatgcgtatgccatgacttcatttttgagatgtttaacattatctttataagcatcaacgccaatgaaatcaatgccttgaagatcgaatacatctttggggcgagcattagtagcctctggaaatggattaataccatcaccgtaaattagattgacacgagttactactctgtaagaactgttttttacagcttttcctacagtatttaatgcatttgtgatcattgtccaggccttctctttgcttagagggggcccatcccgatattttaaatctttttggtcgattctccagcgcattaacgcatcaggttcattatggatctgagctgatataacggggtgcttgtctccattttgagaatcccagtatcggatgtggttaaataaggcggtgatggctttggtttctctctccagtatccattcatcatcaagaatcatggtgtattgataaccataatagttccaaaaatttccttcatcattccggctgagccttttgttatattcttgaagcacatattgaggtatcaggtaggagaatgaatctcctaccatattcgtactgaaccaaagtaattccattttcaaattatacttgttgacgaactgcaagattgagtttacgatactataatcgtacttgttttctttaggctctaccatattccatgaaattggaatttgtacacaatttagtcccagttcctgagctttcttgaagtagttttccacttcattaatagtcatcttgtcacaattgagaagggcatcaaggcgtatttgtgcaccaagaaacggaaaaggtttaccgtcaacagaaacatatgttttgttgttttcagtcactagtttacttacttctatttgagaaagtattggttcgacgtatgtttcattattattgtcagaacaagctgttgcgaataatgaaaagaaaaccagtgcgtaagttagtattatcattcttttatacataattggtctttgttaaattagtagattattggattattgcggggttcctcctcctgtcataggccagcccggattctgatagataggagaagaatccaaatcacctccggatgaagtaaccagaaaatgttctgctgctatcggatcgagatagtgtgccatattccatttatagccgttgtaaacaatgttattggctgtgatgtgataaggagcaagataagtactgaagctacgtggtgaaacattttctccttctttaagaatggagttgccgttagaatctttataccagtcccagccatacatttcctgccataaattcattcctaggatatggtagggtttggtaatcatctggtccattgaacgccatctatgtaagtccatgctacgtaaaccttccgccatcaactcacatcttcgttcacggcggatattataacgtgtggcatcaataatttctccgccggaatatgccccccaatcagtttctgcttcttttgacatatctgtaagcctgattgttttggtatagtcctcatcaatgccggctctgcgacgaatcgctttccagtacttttctgcataggagtcgagtgaaccatgcaattcataataagcttctatatagttgagataggcttcggctgtacggaatatgatagaaccgacaatactttgagtgttatttgtgtatttcccgtcagggtttaatcctttgcgtaaggcatagcctgtattgtacttttctgtaacagaagaggcggttatattgggtccccattcttctactaccccatgatctcctgcctgagtatgcaaatttttctgtcctggctttttgatgaagatgtctgcacgggtatccctgtttttagtgatatgaatgatattattatctccccaataagatgagttttcatctgcccacatcggggatgcataaataggttctccatttttaagaataaaggcgtcaatcatgcttttagtagtgcctactccattgttgccgacacatccgtattgacaaacttcatttgccactcctaatcctgtgttgtagcgcctccataaaagtacttcattgtatttctccatgtcaatatcgcagaacatactgaaataaggattttcaggttccgaagaagtttgtgggaatactcctgtattggcagttaatatattatatttttctgctatgatttgtgccgctttaatagcttcatcaaagaagaactctgattctttttcaatacttccggatttaaatgagtaattagcattataatctttatttgctcccggccatcccggtccattgggtacaaaagctgttcctttaaaattcttcagccatgagccttcgtaaagtgcgacccttgacttgagaaggatagcgcagtctttgcttagccggttcttacctccggaaggagctatgttttgcatcatttctatagctttgtccagatcagataagataaatctggctacttcatttcggggggctcgtttgctgatttctatcagagcttcacgttcattaggataagttttagtaataataggaaagtcgcctaatgattttaatctttcaaaatacatgaaagctctgaagaaatacatttctccgatatagtgtttgatattggtcgtgtttccgacaatggcattgttttcatacgatggaagcacattttcaaagaaataattgcatcggtaaatatcagcgaaataccatgagcctccttcttgtcctactttccagtatccgggtgcatacattacgttaggttgcataccggccatattatctgtgttattgtcaatttcaaaagttccatatccataggtgccatgagtaggtagcacttgatattgatcagtagcaaaagctgcaatattactttctgttgtcagatattcatttggagaaagttgatcaagaggttcttgatttaggaaatcattgcaacttgtcaaaaagagcactccgctcaataaggttgatatcgtaagtcttttcataatatcctgtttttagaatgtgacatttaatccaaaagagaatgttcgggatagtgggtaaacgtttccgtgtccccaactaccgccttcgattgattcggggtcgaagaagtcaataaggctcgtaatggtgaacaagttttcaccggatgcgaatatcctaaggtgctgcattcccattttttgtacgatgttgtgtggcaagctatatcctatctgcagattcttcagacgtagataagatgcatcttgtaaatatttagtttgtgattgctggtttttatcggtgttgaataagggtcttggatagtaggaattcagattcgttcccaatggactggcttcgtcatttcggaaataatcatcgtgtccttttagtgctgtggaaaaccagggcccttgtctaccgtttgcaccccagaagtagtaactaccctgaaaataatctcttttcaatgttccttgccagaacattctgatatcgaatcctttccaatcggcggctaattccagtcctacattatatcggggcgtggagttacctattctttttaaatcaccgtgatcttgtaaggtgcggcttccggcatcaatttttccgtcttcattcagatctttatacataatgtctccggctttccagtcttgtccgagattactttgtccaccgttgattaatcttccgatgtgttcggccatttcctggtcagattgtgcaatgcctatcgtttcatatccccatatttcacccacgtattttccggcataaaatccatctatcagtccggaaggatttgaataacgagtaatcttggtacgactgtcggcaagtgtaaagcgggcactataattcaatccattatttaaccggtctttccacattagttccagttcccatccgaatgttttaagatttgtattattggaactgggaacggctgttccaaggactacaggcaatttctccgaagggccgaccatatcgtcagttttacgaatgtaataatcaaaagagccggttagccgattgttaaacaggccaaagtcaactccggcattccatgtacggattttctcccaggagagattatagctgacgagtgaaggtgcccaggcaatattggctaatgttccgtcaatgatccatgatcctgttcctgtaccgattgtagaataagtcggatataaagaagatgtattttggttacccaaactaccataagaggctctgaccttaaatgtgttgacaactttgctgacaggcaggaagaatttttctctggctatgttccagcctactgatgcggaagggaaaaatccccaacgactgtcactacgaaatcgtgaggaaccgtcatagcgtagatttacttccagaagatatttttccaggtaatcataattcaatctgccgaagaatccggcggtagcccatctgttgtgtccacctgctacattcggagcaactttttggttatttgaatccattccggtagaagtgttgatagtcggttttcccggataaatgactcctagcttctcagcagctatatctttataattattttgttcggcttgaaacccgaaaagaactttcatattatgtgattttgcaaaggtctttgcataatctgtatagagatttacattaaaataatcgctggcataagtgccttcatgtacttgggaatcgttattccatgtattgcccttagtctttccgtcaacacctgtctgatgaacagttaagtaatcccagtgtgaatattgtgtattgtatcgatagcttaaatctccaatcagtcgccaccctttgataggttctaccgttatattcagttgttggtagagccaagtgtttcgttcttgtttttcacctccgttttgcatttggagcacatggtcgtcatatagaataccatttgggtcatagagaggtttggtaggccaacattggcgtccgatttcggcaaaaaaactttcattaagatgtgtcggctgtacatagtcacttctgataaagcgagtattgaatccgactgatactatttttgataattgtgcgttgatttttgcagatgcagtatatctgtttgagtattcatctccgattctgagctctccatcctgacctaaatagttcgctgataaatagtattgtattttgtctgtcccgccagtaacgctgatattgtgctcgtgtgcaaagacattgtctttgaaaaaatagtcataataatcaatattatcatttccttgtgaatatccgtctgcccataacgaaggattattgggcacggggatggtagaatcggtaatcttgccggccatatagtctttgatgcggtttatcctttcttccgagacccagttgtaaggtccccatccggaattggcagctgcatcattatagtataaggagaacgtgtaagagtctaatgaagaaggcatgttgatagggctacttacacgaaaactgttgttgtagttaacttgcgctttaccggcctttcctttcttggtcgttactaagattactccgaatggcgctctggaaccataaatagaagaagctgccgcatctttcagaactgaaatagattctatatcctgcggattaatggaataaatatctccttccataccatctatcaagactagggcacttcctgtagaaccttctccgatagttccgactccacgtacattgatcgattgtttctgattgagacctcctccctgattgctataaatattcaaaccgggaacctgtccttgtaatgcctggactgcattggatacagggattgcttcgaaggctttcgagtcaatgactccgacagaaccggttaaattaatcttcttttgggtaccataacctacaacgatcacttcatccaataaattgtcgtcaactcccagtgttacgtttatcatttttctatcacctactgtaaactggactgttttaaatccgatgtaactgaattcaatagttgaacttggatccgctttcacttggtagtgtccgttaaagtcagtgacggttccggatactatattcccatcttttacttttatggaaactcccagtagaggttctccattattatcttttactgttccggatacataattctgagcatatgtattcattgaacataaaagtaggtagcccagcaggcagataagcttatgacttgagttataagttatcaggtggacagctttctttaagagagtagagtgtcgattagttttcataatccatgaaatttaaaagttgaatgataaggctaattctttttctaacatgaagtgttttacttcatcgagagtaggaatagacggttgggcaccagaacgtgtaacagcgatagctgccgcggcattcgcaaaactcaatgcatctcggtctatttccctttgggcacaaattacagccaatgcaccacagaacgtgtcacctgctgcaatagtatcaatcgcatttactttgtatccgggaagctgaatgatttctttgtcgtttttcatatatacaccttgacttcctaatgtgatcacagcattgcgtgcacctgcctgtaataagcttagagcgatttcttcaagattatttcctgtatattcaattcctgagatgaaggctgcttccagttcattgacgactagtatatcaatggctttcatcagctcctcatcaatcaggcaggcgggtgcgggattaaacaatacctttttacctttttgtttagccagaagagctattcttttaatcgtttcgtaaggaatctcggcttgcataactatgatatctgcttcgtcaattacctttgaaaaatgaataattgaaccgggtaataaagaatagttagctccgggagctactgctatgcagttttcaccactgtcggcaacaaaaatgagtgcagtccctgtgggctgattaacatcatctatgatataatcagtagtgataccttctttcttaaagtgtttttttagaatttctgcatacatatcatttcccaaagaggtaatgaacgttacagatcccccgagtcttgctgctgctacagcctgattggcgcctttccccccgagggattgcatgaaactggcatctccgactgtttcgccaggcgccgggagatggttgacttgtgcaaccatgtcgatgtttgaacttccaataactactactttcatttgaacagatttatgtgtttaacctaggtcttatctcgtttatagcacaacttctcttttataaggaatcgcactctgtgcaccgattcgcgtgactgctatagctgccgccgcattggcaaatttcacagatttagcgagtgaatgcccttcagacaggcagacgctgaatgctccgcaaaatacatctccggcacctgttgtgtcaatcgtctctacttcctttgcgggaatcatggtatattcatctttctcttttacgtaagccccgtctttacctaaagtaatgacaacattctctatacctttctctccgatagcctgagcggcacgatgagcgctttctatattcatcactttgattccggataacatttccgcttcaatgcggttggggagtatggtgtgcacgttcattaagaatgagttgctcaggctggacgcgggagccggattgaggattacctttttcccatatttgcaagcaatagtagctgcatattccactgtgtctatgggaatctcaagttgcatgagaataatatcagcttccttgattttttcttcggctttattgatatcctcaatagaaagcgaacggcttgctcccggtgctacgataatgctattttcaccgaaagaatctacggagataagtgcaactccggacggacttttctggtcggtaaatatatattccgtattaattttctctgatctgtatatttccaatgcttgcaggccgaacaaatcatatccgattttggatatgaaggtgacttcagctcccagtcgggcggctgcaatcgcctgattagctcctttgccaccgggattcatgtagaaggttccgcctagtatggtttctccgggaacaggtagtctgttggctttcacgaccatatcggtattgcaactaccgatgactacaattttgggtctatgaattgatatagtttccatagtattaaaaattaagactatgcaaatgaaagcaataatcatgcatagttttctacattaataattggtttatataatctcaaaaatgatatcttatattggattttccttgtatagaggagagaatatagaggtaatgtgaagcgaatttatataattacaaagagaaaatggagatttgaaaagagtgtttttatcgtctgaaatacgaatcaaacaccttactctttaacattcttttgcgctagcacgtgctctgaggacttcagacagtttttctttccgaattttggattccatccacgccgtaaagtcaaagaggcgtaaaagctgactttcatatttattattatataattcatgaatctcaggagacaacttttcccaaaatgcttctctgtcttttttcaggatgggaatatttcttttattcagaaaccataaaatgatacgttctgttttaaaagtctgctctttgggcgaagatagacttcgggtgatggaacgggattcatactggattagctcatgctcctgcacttcataaaagacgatgaggcggaccagacgaatagttctcattaaaggcagatactttatgttatggtctatgatagcgttgctgatatactttttagcagttttatattcttggttaccaatgtgtacgagtgtggtgtaaagcaataattcactttttcgaatagggcctaaccaggcttctttatcataaagtatttcctggtagtctgccataagttgggtacatttcgaaaaatctcctttatccagatagggaaatagttcgtattggaagagaaggcaagttgcatttactttaaattcgagcgaagtgctgtctgatataagctttcttaatttatcaaggaagtaggggatttcgtcatagttgctcacagaccgcaggctaccgagtactccttcgagtacagataaatagtatataggaggatttgaccagaactgctgattctgctcaaataatgagtctagttctttgtatgaatttaaggcagctctgtaatcgcctgctcccatcaggtaattagcctgaaaaagtttatggtttcgtgttaattcaaaattaccttcggagtctgaagaagcggctatataaagttcgttgaccataaggtcattcatatcctgtttttgctttactgttctgatggagccaatatgagataaacgatatttcaataagttgtgtaatgaagattgctctgtgattttccgaatctttttcaaagcttcattttggatgaagtgtttgtgaaaaagctcctgttctgtcatgttgggaaagttcagacggagcagatattccagttccagcttcaaagctatcgtcagaatttcgttgttctcatagaattgtgcttgttctattgtattggatagtatttcgaaacactcttcaaacagagaacgttcataaagcattcgggctttgcacaaattattcagcagatcgtaatagatatctttctttttacgcagggtgagtaacgtatccgtcagcttttcatataagtattgaatggatacttcaaatgagccattgggcttgcgtctgtaaaattcctcttttacagtatttccattcggttgtttactctttatgataatatcataaatcaccagatagtctttttcctccttgtccttgataacctgtagggagaagtgcttcttttctgatttagataacgagtatatcagggatataacggaatctactcttttcatagggaactctttgcattagtattagattgcaatattcgggaatttttatgtaaaaagcaaatctggcattctgtcactttgtgttttctgtagctctttgttgcgtatatttgtgggaagaggccgggcctgttctgaaaattgcagggaattctcatttcctcagatcagaaaaatatattataatgtgattgaatgtttttctgccttgaaaattgaatgtttgatagtctatctgaaaataatactcattttggatggtttttcataagaaaagctataccttcgatgtactttttaataataaagatgaaatgttggatttaaagcaacttacagttgaagtatgccgcatagctaccgaagctgggcattttctgaaagaagagcggaaaaacttccgtcgtgagcgtgttatggaaaaacatgcgcatgattatgtgtcgtatgtggataaagagtctgaagtacggttggtaaaagcgctttctgccttgttgcccgaagcaggatttattacggaagaaggctctgctacttatcaggacgaaccttactgctgggtcattgatccgttggacggaactacgaattatattcatgatgaggctccttattgtgtatgcatcgctctgcgcagtcgtaccgaattgcttttgggagttgtgtatgaagtctgccggaatgaatgtttctatgcctggaaaggaggaaaggctttcatgaatggtgaggaaattcatgtttcggatgtccgggatatcaagaatgcatttgtgtttactgaattaccttataattatgatcagtataaaccgacggctctccatctgattgataacctttatggagccgtgggaggcattcgcatgaacggttcggctgcggctgcaatctgttatatagctaatggtcgttttgatgcatgggccgaagcgtttatcggtaagtgggattattcggcggctgccctgattgtgttggaagcaggcggtcgcgtgactaatttctatggtgacgaccattttatagaaggtcatcatattattgcaaccaatggatacctgcatcctttatttttgaaactcttagcagaagttcctccgttggatatgtaagactgctgcgattgtataaatagctactactatgaaacacacattacttataaaagattggctttattcttttttgtccctttggtttccccgttgctgcgtcgtttgtggcggatcgttggctaaaggagaagagtgtatttgcaccatgtgcaatataaacttgcctcgtaccgattatcatcttcggaaagacaatccggtagaaaaactcttttggggtaagtttcctctggaacgtgccacttcttttttcttttatcgcaaaggaagtgattttcggcaagttctccaccaactcaaatatggaggacaaaaagaaattggtgctattatgggacgatatatggcatccgaattgcaggcttccgacttctttcatggagttgatgtaatcattcccatccctttgcataagaagaaacagcagatacgtggctacaatcaaagtgaatggatatcgcgcgggattatggccgtaacaggtattccggtggataccgaagcaatcatacgccggaagaatacggaaacgcaaacacaaaagtcagctttagaacgttgggagaatgtagatggaatcttcgaattgcatcgttcggagtatttggcaggaaagcatatattaatagtagatgatgtgttgacgactggagcgactaccgtagcgtgcgcttctcggctggcagagattgaaggagtacggattagtgtgttgacgttggctatggcagaatagggtagcttgtcgtcttcccgaagactctctttaatatataaactataatgaatgccaatgcttacattatgttgttgctgttctacaaataagtactttctcttcataaattaattcgtccgcctatgggcaaacgcaacgttgcctataggcaaactttcgtccggctataggcggacgaaagaatgcctatagccggacgaattaattcatgtacccaaagaacttactttattcagatggaaagtttattgttaacctttgaatctttaaagttttatagaccatcaaaagacaagaatgtttttgtgaataaaagaaggggatgagagtttcggttttcggactgaccctctattttcgaagcaggggggagaagagcagaaacaaaaaagaggtctatctttcgatacacctctttttgctcttcctcttggacttgaaccaaggaccctctgattaacagtcagatgctctaaccgactgagctaaggaagaatgttgcaatcaagaatttcagttttgctcttcctcttggacttgaaccaaggaccctctgattaacagtcagatgctctaaccgactgagctaaggaagaatgtttttctcaattgcgatgcaaaagtagtaggtttttttgaaatatgcaatatctttgcaaaaaaaatattgagaatggacaaaataataggattgggcaacgccctgatagacgtacttgcaaccctgaaagacgatacactcttggatgaactggaattacccaagggaagcatgcaactcatcgatgacgctaagttacagcagattaacacaaaattttcacaaatgaaaacgcatctggcaacaggcggatcggcaggaaatgccatacttggactcgcttgtctgggtgccggaacaggttttatcggaaaagtaggaaatgatcattatggcgatttttttcggaaaaatctgcagaaaaataatattgaagacaatttattgacctccgaacagcttccttcgggagtggcatccacttttatttctcaggatggagagcgtacttttggtacttatctgggagcggccgcttctttgaaagctgaagatctgacattggagatgttcaaaggatatgcatacttatttatagaaggataccttgttcaggatcacgaaatgattcttcatgccatcgaactggctaaagaggctggcctgcaaatctgtctcgacatggcaagttataatatcgtggagaatgatctggaatttttctccttattaataaataagtatgtggatatcgtttttgcaaacgaggaagaagcgaaagcatttaccggcgaagaaccggaggaagctctgagagtgatagccaagaaatgcagcattgctattgtgaaagttggagcaaacggatcttatatccgtaaaggtacggaagaaattaaagtgtcggctattcctgtagaaaaagttctggataccaccggcgcaggcgattatttcgctgccggatttctgtatggtctgacgtgcggatactcgctcgaaaaatgtgcaaaaattggttctattctctcgggaaatgttattcaggtgattggaacaacaatctctccggagcgctgggatgaaattaagttaaatattaacaaggttctggcggaataaccaaggtttgagttacttttacgtctcattttaatgaaagatatatgaaaaaattgctgaataggcggatagctcttgttttggtggctgtaatagctactgtagctttctttagttttaagagtggagacgaccgcaatttccagattgccaagaatctggatacatttaatgcgattgtgaaagaactggatatgttctacgtggataccattgatccgaacaagaccattcgcgaaggaatcgacaatatgcttttctcgctggatccttatacagaatattacccggaggaagatcaaagcgaactggaacagatggtgaaaggaagctttggaggtatcggttctcttattacctataatacgaagctgaaacgttccatgattgccgaaccgttcgagggaactccggcggccaaagcgggactgaaggcgggagatatcctgatggaaatagacggaaaagatctccttggaaagaataattcggaagtcagccagatgttgcgcggacaggcgggtacgagctttaaactgaaagtggagcgtcctaatgagaaaggcggacaaaccccgatggagtttactatcgtacgtgaatctattcagacccctgccatcccatatgctaccgtgatggataataaagtgggatatatcagcctgagcacattctccggcaacccttccaaggatttcaaaaaagcattgctggatctgaagaaacagggagctacttctctggtcatcgacctccgtaataacggtggcggtctgttggatgaagcagtggaaatagccaattatttcctgccccgtggaaaagtaatcgtaaccaccaagggaaagacgaaacaggcaagcaacacatacaagactttgcgtgaaccgctggatctggatattccgattgccgtattggtaaacagtggtacggcttctgcttcagaaatcctgtcgggctcattgcaagaccttgatcgtgccgttattgttggtaaccgtacatttggaaagggacttgtacaggttccccgttctttaccttatggaggaatgatgaaagtgactacttccaaatattatatcccaagcggacgttgtgtgcaggcgatcgactataagcaccggaacgaagatggaagtgtgggaacgattcccgacagtctgactaacgtattctatactgctgccggacgtgaagtacgtgacggaggtggtgtaatgcctgatattactgtcaagcaggaaaaactcccgaatatcttgttctatctcgtacgtgataatctgatttttgactatgcaactcaatactgcttgaagcatcctactgtagctgctcctgaaaagtttgtagtgacggatgctgattacaatgatttcaaggaactggtgaagaaggccgatttcaaatatgaccagcagagtgagaagattctgaaaacactgaaagaggctgctgaatttgaaggctatatgacagatgctgccgaagagttcaaggcactggaaaagaagttgaatcataatcttgaccgtgacctggattatttctctaaggatatcaagagaatgattgctaatgaaattatcaagcgttattatttccagagaggtggtattatcgagcaactgaaggatgatgatgatttgcaggaagcaataaaggtattgaatgatcctgcgaagtataaggaaatgctgagcgcgccgataacgaaagctgaaaagaagtaacgttgattgtcatatataaaatgcggtggacattagtaagatgttcaccgcattttatatatgcatattatattggttagccaatgggagcccggtgtaagtgttttttttataaaaaagaaggatagcttttgccctactaatcagaatgttctatctttgcatcaattacattttaaatgatttacaatatgtctacagaattattctctactctgccttataaagtggcagatattacacttgctgatttcggacgcaaggaaatcgatttggcagaaaaagaaatgcccggcctgatggctctacgcgaaaagtatggagaatccaaaccgttaaaaggtgcccgtatcatgggatcattacatatgaccatccagaccgccgtactgattgaaacactggttgcattgggagctgaagtccgctggtgctcttgtaatatatattcaacgcaggatcatgctgctgctgcgattgctgcttccggtgttgcggtatttgcatggaaaggcgagaatcttgccgactactggtggtgcacattgcaggcattgaacttccccggcggaaaaggtccgaatgtgattgtagacgatggtggtgacgctacaatgatgattcatgtcggttatgatgccgagaatgatgctgccgtattggacaaggaagtgcatgcggaggatgaaatcgaactgaatgccattctgaaaaaagtattggctgaggataagactcgctggcatcgtgtggctgaggaaatgcgcggcgtatcggaagagacaacgaccggtgtacaccgtttgtatcagatgcaggaagaaggcaaattgctgttcccggcatttaatgtgaacgattcggttaccaagtctaagtttgataatctctacggatgtcgtgagtcactggctgacggtatcaagagagcgaccgatgtgatgattgccggtaaggtagtggtggtatgtggttacggtgatgtgggcaagggatgttcgcattcaatgcgctcttatggtgcgcgtgtgcttgtgacggaagtcgatccgatttgtgcgttgcaggctgctatggaaggtttcgaagtcgtaacgatggaagatgcctgcaccgaaggtaatatcttcgtgactactacggggaatatcgatatcattcgcattgaccacatggagaaaatgaaagatcaggcgatcgtatgtaacatcggccactttgataatgaaatccaggtggatgcgttgaaacattattcgggcatcaaatgtgtaaacatcaagccgcaggtagaccgctattatttcccggatggtcacagcattcttttgctggctgacggtcgtctggtgaatttgggatgtgcgacaggccatccgtcattcgtgatgagtaactcatttaccaatcagacgctggcccagatcgagttgttcaacaagaaatacgaagtaaatgtataccgcttgccgaagcacctggatgaagaagtggctcgcctgcatctcgaaaagatcggggtgaaactgacgaagctgactccggaacaggccgcttatatcggtgtatcggtagacggaccttataaggctgaacattatagatactaatttaattgacaattgacagttgacaaatgacaatgaacagctatatggaacgagtgatctgccgggctgttattgttgaccatcaattgtcaattgtcaattgtcaattgtcaattttatgaagaagttccttcccgacttaattgctattttagcttttatcatcctttcttttgcttatttttttccggctgatatcgaaagtcgtattctgtttcagcacgatacggtggctggagtgggagccggtcaagaagctcaggaatatcttgaacgtacaggagaacgtacccgctggacaaactctctttttggtggtatgcctacctatcagatgtctccgagttatgattctaccaaaccgctgaagtggatagaaaacatctatcacttgtatcttccatcttatgtggtgctgaccttcatcatgatgctcgggttttatatccttttgcgggcattcgggttgtctgtctggttatctgctttaggggggattatctgggctttctcctcctatttctttattttgatatcggcagggcatatctggaaatttgtcacattggcttatattccgcctacgattgccggtattgtactggcttatcggaagaaatatctgttgggagggattgtgactgctttgtttatcgcgcttcagattcagtcgaaccatattcagatgagctactacttcatgtttgtcatcctgttttttgtaggagcttactttgaagatgcttataagaagaaggagttgccgcattttttcaaggcaagtgccgttctggcattggctgcgatgataggagtgtgtgcgaacctctccaatctataccatacttatgagtatagtaaggagactatgcgcggaaagagtgaactgaaacaggaaggacctgctgccaatcagaccagcagcggactggaccgtaactatataacgaactggagttatggaattggtgaaacgcttactttgctggttccgaatgtaaagggaggggcatcggttcctttatccaagaatgagactgccatggcaaaggcgaatccgatgtatagtaacatctattcgcagctgacacagtattttggcgatcagcccatgacttccggaccggtctatgtgggagcttttgttttatttctgtttatattggggtgctttattgttaaaggaccgctgaaatgggctttactgggagctactatcttctctattctactttcgtggggaaagaattttatgggacttacggacttttttatcgattatgtaccgatgtataacaagttccgtgccgtatcttctatcctagttatagctgaatttacgatacctttattagcggtctttgccttaaaagaagtgctggctaaaccggaaatattaaagttgaaagaaaatcggacaggagtaattatcactttggtattaacagccggtgtttcactgattctggctgttgccccgggagttttcttctctagttatattccggcacaagagatggcagctctgcagcaaggactgcctgccgagtatttatctccgatcattacgaatctggccgaaatgcgcaaggcaatgctgacttcggatgcatggcgcagtttctttattatagtagtaggatgcttcttattattcctttatcagcagaaaaagttgaaggcttcttttactatgacaggtatcgtgcttctgtgtctgattgatatgtggactgtcaataagcgctatttgaatgatgaacaatttgtatcgaagtcaaaccagacaggagcattcgttaaaactcagacggatgagataattcttcaggatacggctttgaattatagggtgttgaatttcgtaggatttcccggtaatactttcaatgaaaataatacctcatattggcataagagtgtgggtggttatcatgcggccaagttgcgtcgttatcaggaaatgatcgatcatcatataactccggaaatgaaggatgcctatcaggaagttgccggcgcaggcggtgcgatggatagtgtggacgcttccaaattccgtgtgctgaatatgctgaatacgaagtactttattttccctgccggacagcaaggacagacggttcctgttgaaaacccttatgcgtatggtaacgcttggtttgtggataaggtgcagtatgtcaataatgcaaatgaagagattgatgcgctgaatgatattcttccaacggaaacagcagtggttgatgcgaaatttaaagatcagttgaagggtgtgacgaaaggttacaaagactccttatctaccattcgtctgaccagctatgaaccgaatcgcctggtatatgaaacttcttctgctaaagatggagtggctgttttctctgagatttattatccgggctggcaggccaagattgacggacagccggtggacattgcccgtgctgactatatcttgcgtgtgatgaatgttcccgcaggccagcatacgattgagatgtggtttgacccgcagagcttgcatgttacggaaagcatagcttatgcgtcactggctttattgctgatcggggtgatgattctgatttggttcagcaagaagaagttaataactccgaaaaaaaaggaggctgagaactcttaaacttttttctgatcttgtactatattgtactctatataccttaagcggctctcttcatcccgaagagagccgcttatgcattcactaaaaaattatgaaaaacaaacgctgttttgctgttaattgattttatattccaaagttaagtggttctttaaacagaagaaaaggaaatcgacaaagggcgaagatttgtctattaaatatagtgatattataataattaaggtggatatcaggactgaaaaaggaaaatatgaacataaacagtcgatatatggatagtcccattttgtcgcaacccattaaatttgtgcctgaatatagagcgattattatgaaaagactattgttcatttttacctttttttgcctccttgccattcatggaggcgcacagaatattctgactctggagaactgccttcgtatagggattgagaacaatctctctttacagggaaaacgaaaagcgatgcagaaaagtaagtatggcatttcggagaatcgggtgaagctgttgccgcaaatcaatggctttgccaactttaatgataatatcgatccgcctgtctcagtaactgacggttcttcctatggagtaccttataatattacccgaacgttgcaatatagtgccaatgccgggatagaattgcagatgccactttataatcagactctctatacttcgatttccatagcagagattgtggatgagatgagccggctttcgtatgaaaaggcacgggaagatttgatcttgcagatcagtaaaatgtactatctgggacaggttactgcggaacagattgcattgataaaagccaatatcacccgattggaagaactgagagatatcacacaggctttctttgataatggaatggcaatggaagttgacttgaagcgggtgaatatcaatctggaaaatctgaaagtacagtatgacaatgcgcaggcgatgatgacgcagcagcttaatatgctgaagtacatcatggattatccggcagaaaaagaaatcggcctgttgccggtcaatacggatagtatcgctacggttgctttgaccgggttgtcggaaaacctctatgagcttcagttgcttcaatcacaggtgcagctggcagagcggcagaaacgattgataagtaatggctatattccttctctcaatctgacgggaaactggaggtttgccgcttatactgatgaggcttatcattggtttcattccggtccgtccaatcattggttccgttcttatggggtgggactgactttgcgtattcctatttttgatggtttggataagaagtataagatccggaaagcaatgatcgatatcgaaaccatgaaactttcacggttggatacacggaagaatctgcaaacacagtatttgaatgctgtaaatgacttgatgaataaccagcggaactttaaaaaacagaaagacaattatctgcttgccgaagaagtgtatacggttactaccgaccgctatcgggaaggaatcacttcaatgactgaagttctgcaggatgaaatgcggatgagcgaggcacagaacaactacattagtgcacattataattatcgggtgaccaacctgatgttactgaaactaaccggacagatctcatccttgttcaaataacagataactaattgaatcattcatatggaaacaatggacaataatacaatctccagtacgcatcaggagaaagctaagaaaatgagaaaattacgccgctggcagattatagtaagtctgtttggagttgctgtgattgtttggggagtaattgaaattgtttttctctttctgggctataagcagacggaaaccagcaatgatgcgcagatagagcaatatgtgtcacctgtcaatctgcgtgcatcgggctatattaataagatttattttacggaacatcagcaggtacgtaaaggtgataccttgctggtgctggacgaccgcgaatataaaatccgggtgatggaagctgaggctgcattgaaggatgcgcaggcaggcgccactgtgataaatgctaccttgcagactacacaaacgactgcatctgtgtatgatgcgtctatagctgaaatagaaatccggctagcaaaactggagaaagaccgtcagcggtatgaaaatttggtcaaacgaaatgcggcgacacctatccagttggaacagattacaacagagtatgaagctacctttaagaagctggaagcaaccaggcgccagcgggaggcggctctttcgggagtgaatgaagtatctcaccgtcgtgagaatacggaagctgccatccagcgtgctacggctgcgcttgaaatggcacggctgaatctttcgtatacggttgtactggctccttgcgatggcaagttaggcagacgttctctggaagaagggcagttcattacagcagggcaatgcattacatatattctgcccgatacacaaaaatggattattgctaattataaagaaacgcagatagagaatctccgcatcgggcaggaggtggctatcacggtagatgctatcagtaagaaagagtttacaggcaaagtgactgctatttccggagcgacaggttctaaatattcgttggtgccgactgacaattctgccggaaactttgtgaaaatacagcagcgtatccctgtccgtattgattttacggatttatcgaaggaagataatgataagctggcggcgggtatgatggtagtagtaaaagctaaactctgatagccatgccttcgtgtcctagaaattatcctttttacaattgggtgcccaaaccgataggtattattattctgctgttctttttcctgccgattctttcggtgggcggggtatactccgtgaacagtaccgagatgatgagcggcttgggtattatttccgagcatattcagtttgccaattttgtgacttccatcggtatggcggcatttgctcccttcttgtatgaactagtttgtatacgacgggagaaactgatgtgtatcgcaggttttgcactgatgtatgtattcagctatgtatgtgccaaaaccgacagtatctttttgctggcactctgcagcctgctgacagggttcctgcgtatggtactgatgatggtcaatctgtttacgctgatcaaatatgcttttggcatggaggcaacgcgtaatattactcccggcatggaaccgaaagacgcgacgggatggaataaactggatatcgaaaaatgtatcagccagccggtagtttatctgttttttatgatcctggggcaaatgggtacggcgctaacggcttggctggctttcgaatacgaatggaaatatgtatattattttatgatgggtattctgctgctgtccattctgatactgttcattacgatgcctaatcatggttttgccggacgtttccctatcaacttccgcaaattcggcaatgtgaccgcattttgcatatcattgacgtgcatcacttatgtgctggtttatggcaaggtgctggattggtatgatgatccatctatttgctgggcaacggcgatcagtatcctttttgccgggatttttctttatatggatgttacccggcggtcttcctactttattttgggggcgttgaggctgcgtaccattcgtatgggggctttgctttatttattgctgatgattatcaattccagcgcaatgtttgtcaatgtgtatgcaggagtcgggatgcacctggataatttgcagaatgcatcgctggcaaactggtgtatggtcggttattttatcggtgccttgatttccattgtattggggtctaaaggggtgcatctgaaatatctttttgctcttggctttttctttctggcattgtcggcaggattcatgtacttcgaagtgcagacagccggactttacgaacgaatgaagtatcccgtaattattcgtaccatcggaatgatgattttatatgcattgacggcagcatatgccaatcagcggatgcctttcaaatatctttcgacctggatttgcatcatgcttaccgtccgtatggtactgggaccgggtatcggaggggctatttattcaaatgtactgcaggagcgccagcaacattatattacccgttatgcacaaaatgttgatctggtaaaccccgaagcttctgcttcgtataccaataccgtgcagggaatgcaatatcagggaaagagtgaaacggaagcgcataacatggctgccatgtccgtcaaggggcggatacaggtgcaggctacgctctctgctgtgaaagaaatggcagggtggactatttatgcaggcgttatttgtatgatttttgtgctcgtagtgccttatcccaaacgaaaattgctaacttagtatcgtttttcaatagtaatttatcagtgagtcagtgttatggatactcagcaggaacgtttattacagcttgaccgcgatctgaaaagcgggaagaatatatgcagttcgggaggtgtgctcagttgttttccatcttctttaaaagaaccttttctgatgcaggggcttggtttgattgtctgccggcaaggtagtttccagttttctcttgataataagtgcgcttctgccaaggcgggtgagaccttgtttattcatgaggaatcttgggttcaagtgcttcaggagaccgaagatgtggaaattcttattcttgcctatcagatagaaccgatacgtgacattatcggcaactccgtggtttccatgtatatgtattcgaaacttactccggaactctcttgtgtatggaataccggcgaggaagatgagattatgaagtatatgtctttgatagacagtgtgctggaaatggaggagagtgtgtttagcctttatgagcagaaactccttctgctggcactgacctatcgtatttgttcggtctataaccgtaaattgattagtgccggacaggaaacgggcgggcggaaaaatgagatatttgtccgtctcatccagttgatagagcaatattatatgcaggaaaggagtgtggaattctatgcggataaactctgtttgtctccgaaatacctttcggctctttccaaaagcatctgtgggtatacggtgcaggaacttgtattcaaggcgattatccgtaagtgtatctctttgttgaagaatacgcaaaaaaatattcaggagatttccaatgaattcggcttccccaatgcttcttattttggcacattcttcaagaagcaaatggggatgtcgccgcagcaatatcgaaggaatctttaatcgatattactctttttctccataagccagatcgcctgcgtcgcccagccccggtacaatataggaatgttcattgatttcaggatcgatggcagcacaccaaatggttgttttgtcttcgggaaatatgctcttgatatgatcgattgcatgttggctggcaatgatcgaagctacgtgaatttcggcgggatggcctttggtaagcatggcctgataactcagttccatactgccgcctgtagccagcatcggatcggtgataatcagcgttttgtcgtcaatacgcggagatgcgatatattctatatgtatatcaaatttcagggtatctttatattttcgataggcggacacaaatgcattttctgctccgtcgaaatagcttaggaagccttggtgaaaaggaaggccggcgcggagaatggtgctgatgacaagctggttgtccggtgtgctgacgggagcaatgcccagtggtgtccggatgttttttactgagtatcggaactctttgctcatttcgtaagccatgatttctccgatccgttcaatgttacggcggaaacgtaggcggtcattctgaacttctacatttctgatttcggatatgtactggtttagaatcgaatttgtttggctaaaatcaattactttcatattatagtttaatcataatttaatctcattttcatcgtattgagaacgttctggcttgcaaagtaaacgataatctttcaaattgcaatattcagtttgcagatattgttaggaatttataaaagagattcaattagggaaaaatttctctaatcccttcttccttttcaaagaaagtattacttttgtacccggatttacaaggaggcacccaaagctcctcatgttcaggtgaaaagagataataaaacgaaataccaattttaattaattcaaaaaaaatggcaaatttagatttaagcaagtacggtatcacaggtgtgaccgagattgtgcacaatccgtcttatgacgttttgttcgctgaagaaacaaaaccaggtttggaaggttttgaaaaaggccaggtaactaacatgggcgctgtaaacgtaatgactggcgtttatacaggacgttctcctaaagataaattcttcgtaaaagacgaaaccagcgaaaatacagtatggtggacttctgaagaatacaaaaacgacaacaaaccagttgacgctaaatgttgggcagctgtgaaagatttggcaactaaagaactttctaacaaaagactgttcgttgttgacgctttctgcggagctaacgaaaactctcgcttgaaactgcgcttcatcatggaagtggcatggcaagctcacttcgtaacaaacatgttcatccgtccgacagctgaagaactggctaacttcggtgaacctgatttcgttatcatgaacgcttctaaagctaaagttgaaaactacaaagaactgggcttgaactcggaaactgcagttgtattcaacttgactgaaaagatccaggttatcctgaatacttggtacggtggtgaaatgaagaaaggtatgttctcttacatgaactacttattgcctttgaacggtatggcttctatgcactgctctgctaacactgataaagaaggcaagagctcagctatcttcttcggtctgtcaggtacaggtaagactactttgtctactgacccgaaacgtttgttgatcggtgatgacgaacacggatgggatgacgaaggtgtattcaacttcgaaggtggttgctacgctaaagttatcaacttggataaagaaagcgaaccggacatctggaatgctatcaaacgcgatgctttgttggaaaactgtacagttaacgctgaaggcgaaatcaacttcgctgacaagtcagtaactgaaaacactcgtgtttcttatcctatctatcacatcgaaaacatcgttaaaccggtgtctaaaggtcctcatgctaaacaagttatcttcttgtcagctgacgcattcggtgtattgcctccggtatctatcctgaacgcagaacaaactaaatattacttcttgtctggttttacagctaaattggctggtacagaacgtggtatcactgaaccgactccgacattctcggcttgtttcggtgctgctttcttgtcactgcacccaactaaatacggtgaagaactggtgaagaagatggaaaaaactggtgctaaggcatacttggttaacactggttggaatggtactggcaaacgtatctctatcaaagatactcgtggtatcatcgacgctatccttgacggttctatcgacaaagctcctactaaggttatgccttacttcgactttgttgttcctacagaacttccgggtgttgatccgaagatccttgacccacgcgacacttacgaatgtgcttgccaatgggaagaaaaagcaaaagatttggctggacgtttcatcaagaacttcgctaaatttacaggtaacgaagctggtaaggctttagttgctgctggtccgaaactctaagccttttaggcaatagatatgtaatgcaaaatgtgggcggttccgaaaggagccgcctttttttgtttatatgaaggtgattttgtatctttgttaatctgaattatgttcgataaaacgctgacaaatacatgattattacttatttgaaactcttttgtacattcgcaaaaatcggcatgtttaccattggcggaggatatgccatgattcccttgatagagcgggaaatagtcaagagaaaatggatgagcaaggaagaatttatggaaatgtttgccttgactcaatcgttgcccggagtttttgcggtaaatatatccattttcgtgggatataaacttcataaggtcagcggaagtctggtttgtgcgttggcgactattctcccttcattcgtcattatgatgttgattgccatgttctttgcccgttttcaggacaatgaggtgatgattcgtatctttaacgggatacgtccggctgtagtggcgctgattttgtttccttgtatatctgcggtcagagctttgcatttgaagtatgtgcaactgatagctcctgtgattgccacagtactgatctggcaattcgggctttctcctatttatgtggtattggcggggatttccggtggattagtgtatactctgtggttgaaaaataagattaaagatataaaggcatgatatatttacagttactttgggtgtatctgaagataggtacgtttggtttcggaggtggttatgcgatgctttcgttgattcagcatgaaattgtagatctccaccattggctgactccccaacaatttacggatgtggtggcaatttcgcagatgactccggggccgattggaattaatagtgctacttatgtgggctatgcagtgacacacagtgtatggggagcggtacttgctaccgtagcggtgtgtctgccctcttttattctcgtattgctcatttcctatttctttgcgaaatgcaaggataataaatacataaaagcagcgatgtccggcttgcttcccatgtcagtggcattgattgcctcggctgccttgttgatgatgaacagggagaattttattgattataaaagtataggaatctttgctggggcattccttatcacctggaaatgggatttgcatcctattctgctgatttgtctggcaggtctggtgggggtgatcttgtattaaaaaaactttttataaagctagggttggctactggatcgtaaagaagttgcttaatatgcatgaactggaaatagaaaaagcccgctaaataaaatccggcgggctttctgcattatctcgggctattgcttatgatttgttcgcgcgtttacgctcgatttcgtccagaatgactttgcgcatacgcattgctttcggagttacctctacgtattcatcttctttgatgtattccaatgcctcttcgagtgagaactgaacaggcggaatcaaacgaactttgtcatcagatccggaagcacgcatgttggtaagctttttggattttgtaacgttgataaccagatcgttgtcatgggagtgttctcctactacctggcctgcatatacttcgtcctgcgggaagatgaagaacttaccgcgatcctgcaatttatcgatggcataggcaaaagcagttccgctttccattgcgatcatggaaccattggtacggtgttcgatttctcccttgtgcggctgatattctttaaaacggtgtgccatgatagcttcaccggcagaagcagtcagtacgttggtacgaagaccgatgataccacgtgaaggcatgtcaaattcaaggttgatacgttcgcccgtattttccatcttcaccatttcacctttgcggcgggtaaccatatcgataatcttgcttgaatattcttccggtacgttgattgtcagttcttcgatcggttcgcacttgacgccgtcgatttctttaaagataacctgtggctgacctacctgcagttcgtatccttcacgacgcatggtctcgatcaatacagaaaggtgaagtacgccacggccggaaacaatccatttgccgtcttcctcactctttcttacacggagtgccagattcttatcaagttctttcatcagacggtcgtggatgtggcgtgaagtcacgaacttaccgtcttttccgaagaatggagagtcattgatggcaaatagcatgctcatcgtcggctcgtcgatagcgattggcggtaatgcttccggattttcgaaatcgcagaccgtatctccgatctcaaaaccctcgatacctaccaatgcacagatatctcctgatgaaacttcgtttgtttttacacgtcccaaaccttcaaatacatgaagctctttaattttagatttgaacatatcgccattacgttttaccagcgtgatgttcattccttctttcaaggtaccgcgatgtacgcgacctacggcaatacgaccggtataagaagaataatccagagaagtaatcagcatctgcggagtaccttccagttgttcgggagcaggaatattttcaataatacaatccagtagcggggtaatggtatctgtcggcttttgccagtctgtgctcatccagttatttttggcggaaccgtaaataacggggaagtccagttggtcttctgttgcgttgaggctgaacatcaggtcgaaaaccatttcgtaaacttcttcagggcggcagttaggcttatctaccttatttactaccacgattggtttcaaaccgatttccagtgccttctgaagtacgaaacgtgtttggggcatcggaccttcgaaagcgtcgactaacagaatgcagccatctgccatattcaatacgcgttctacttcaccaccgaagtcgctgtgtcccggagtatcaatgatgttaattttagtaccgttgtaattgatggatacatttttagaaaggatcgttataccacgttcacgttccaggtcgttgttatccaggataagttcaccactattttgattgctgcggaatagatttccggccagcaacatcttgtcaaccagcgttgttttcccatggtcaacatgggcaatgattgcaatgtttcgaatattttgcatataatacctattatttggctgcaaaggtacgaaaataggattagaaataaatgcaatagccccattttttcttgtaaaacgttgtgagatataaagataatgtctatctttgcacgctcaaaagaataatttactatatcaaaattctaaaaattatgtatttagacgcagctgaaaagcaagaaatctttggaaagtacgggaagtctaactctgatactggctcaactgaagcgcagatagctttgttttcctaccgtatttctcacctgactgagcacatgaagctcaacagaaaagattatagtacagagagagctttaacaatgttggtagctaaacgtcgccgtttgctgaattacctgaaggacaaagatatcacaagatatcgttctattgttaaagaacttggtttgcgtaagtaatctacttgccgcgaaaagattaaaaaccgtttctcacattgagaacggtttttttattggctttcaatgaaggattagtattttatgctgtgcatattgattgcagccggctgtccgttgtatagtgcttcacaactaattgtcaggaatgtagacgagttcgcattattacagcgaatgatggctactccattttcgtcggtggtaactttagggttccaatagattgtacggcggtggtcattgccttgtcctttactgatatccgggtaatagggtgaataaaattcaatgggctgggagtaaccttggatctgtgtgtttcggataccacgtgattggtacttcttttccgggtcccaattgtcgatggtagtgatatagcaaattgcaaattgatttcccggttgattattgggagttgtgttgttcagataacttttgagagctttttcttcaaagggagagagtctggaagtttccatgtgattttttagactttcgtcgctcaggtgataagcgctgtcgtcatcaattccggcacttgctgtcgtgccgtcgcaaatcataacagattttatcgcatcgatatttttatctataaaaagctcccgatcaaatgttgagtaaagaactccatttatgacgcatagtatataatgattcttgtatttcatggttataaatggtggatctcccttccacttagacttcacttgaatattgggatttaatgtggtcattagccaagggaaatagtccatgaattttccttcatcgcgcattcgatccagttccttagggatatcataataagctcttacagattgctcgaaagctagaatttttttgtatttcgtacgtttggctttaatcgttacctgatccaacaaatgagtatcgtgtcccataattgaatctagataaagagagtcggagagactgctccaccaactgagtccgctaatatcttcccatttaggatgtagctcttcgtaagcgtatttgcgtagttcgggtgtaaagttgcggaaaagtgatatgtttgttttccggttcagcttttttcctttacggcgagtttgaatagccgcactcatggaaccattgaaggcatccattggaatttggaagaatcccaaagagtctgtgaccgtagtacctgctgctgatatcgtatctctccgggcaatgacgcttacagagatctctttttgttctttgtttctcagaaaagatgttacctgtccatgtagagtcagtctcgtttccggcagatagattggtgtttctggagtggcactgatggcttggcttatatcatattttctccatccgtgaatcatcaacagaatatctaatgccactcttcgtctgggagaattgtttgcgaaataatatccaggttgatgaatgtatcctttcagatctgatgtaagtaaaaggtctgtgtaaattgtctgatcgaaccgttggaagtctgattttaaagcatcccgaaccgctacggagaaatgtccttgtattggttgacctgtatggtttttcattgagatatgatactcaattggttcaaaaggatagtataatgcattggtggatgtggctgttaactgtaaagatggagaaggcatcacatagcaaaaacgctcgcataacgttgccccattgctattcattaaagagagttgtatgactcctcccggcaatccctgagtggataacgggagatgatatactgtttgatctttaaaatcaagggtctgatacatgagcggacgtccttgatgtgatatgaataaagccagtgtatctttgagacttgtcgaatttctgagaactttgatgactaatgctttttctttagacgtcacatttagcacatatccttggggtaaagccttcggtagctgaaatgagtattttttatcttgataggtcactacagctttggcttgtttgtctgtaggggtgtatgtaaagcatcccataccgtcgtggagagttgtaaattgtgcaagttctacatcatccggcccataaacagttcctgaaatgcctactgtaccttcttctttacttgtcgcttcgaatgcaacgactgaaggtactccctctactaattgtccaccttccgggaagaatcgaatcatgaaatctttttcttttgaacgcggacgttgcttcatagattcatccattcggtaagtgatgatgctccggttttcgtctacttcgcttctccgttttctatatacagggatcgtacgcgagaaatattgcttttcactgaatgccaacatccatttcgtataagccctgatctcgtaaaaaccggagaataaggcttttgtcagtatgaattgtccttctccttctccatcccgcaactgtatgatttgccgttcactagtatttcccagttggtctaatagctcaacataaaggggggtactaattgggctaggttggttttgctcggccgttactacgtatgccttataccatatcgtgtctccgatgtagtaactggtgttgtccaagtgcagataggctttctcgcgtggatatgcatcggcgtaggcttgagaacgggcaaagtaagttgcgaatatagaatccgcaacttgctggctatggatttgcacggctatacttgataggaggcagaaagtgatgattatggagcgtattctcattacattttgaatgatcagtaacttgaaggttggggaacgtcaagtgttagcataactatacttgtttgattactaactgttgcgaaatgaacagttgagccatcgtaatgactggagttggaataatttgtgcgataagcaaatgatacttcatctccttttgtatcataagaaaagtatccccattgaataggggagtctttattccaaggatcatagactgcagagaccgtaatgggttcccaataaccactgcctgtaatgagtacatcgcatgccatagggaaaggtatatcgggtggaaaacgaaaacaaatagaaccatacattgaattaactttagagaaagtgtactcttgcttatcaaaatcatatccgacgaagtttgcatagggattccatgggcctttatcaggatatggtcgatcatacactaactctgagcaggtagcacgaaccgcaatatatcctcctccttcgggaagttgtagatcggttacaggtatttggattgtttcataggttccttcttgaaccaaaacttcacggacaggaaagaaggaatattcaactggattaggatcaaaatcacgacttgctcctaattgaatctgatcatatttcccttgaccttgtcgtatctgaatatttagcaaaggtggaaatggaatatattgactccattctattttaataatctgaggtaattttgcatgctcaaaatactcgtcctggctcgttcttgttgttaccactttactggtcgcttctatactaacagggctgtcttccttcgtacaactgcaaaaaatgattgagaggaataatactaatagtaaatggattctttccttactacttgtgaattgattgtgtgtgttcataagctatatattttagaggcttaacaataactacttatgatctatgattatgcaagaaaggaaaaaataatgaaaatatgaaaattccgagtttaattagtgttaatctccagtctatatattacttaatccattttcaaggcaggtaggtgaaaagagatatattatgggagatattttaggattataattgtgttcatctaaagattttgctatttttgcaacctaattattctaatttatcacctttgctaactaaaaaactttcaatatggatacgagtaagattgttggagagaaaattaaagcgctccgggaagataaatcaataagtatagaggaattggcacagcgttcgggtttggctatcgagcagatcgaacgaattgaaaataacatcgatataccgtctcttgcaccgctgattaaaatagcgcgtgtgctgggggtacgtctgggcactttcctggatgatcaggatgaaatcgggcctgtggtatgccgtaaaaaagaggctaaagatgccatcagcttttccaataatgcgattcattcacgcaagcacatggaatatcattcattgtctaaatcgaaagcggatcgtcacatggagccgtttatcattgacgtgatgccgacagaggacagcgactttgtgctttcttcgcatgaaggagaagagtttatcatggttatggaaggggttatggaaatcagctatggtaagaatacctatttgctggaagaaggtgatagtatttactatgactccatcgttcctcatcatgtacatgcttacgaagggcaggctgctaaaatattggctgtagtctacactccgatttaataaaatctgataccaaatattaagaataatcgcatgcaattatttgaacgtactcttgggcaatggctggaacattgggctgaagagactcccgataaggaatatatcgtttattccgaccgtaatcttcgttttacatggagccagcttaaccagcgtgtggatgatatggcgaaaggactgatcgctgttggtgtggaacgtggtactcatgtcggtatttgggcggcgaacgtgcccgattggctgacattgctgtatgcttgtgccaagattggtgcggtatacgtcacggtgaatacgaattataagcaggccgagctggagtatctctgccagaattccgatatgcatacactttgtatcgtcaatggtgaaaaggacagtgattttgtgcaaatgacgtatacgatgcttcctgaactgaaaacctgcgaacgcggtcatttgaagagtgaacgctttccgtatatgaagaatgtgatatacgtcggtcaggagaaacatcggggaatgtataatactgcggaaatcttgctgctggggaataatgtggaagatgaccgcctgactgaacttaaaagtaaagtggactgtcatgatgtggtaaatatgcaatatacatcaggaactaccggtttcccgaaaggagtgatgctgactcattataatattgccaacaacggttttctgaccggcgaacacatgaagtttacggcggatgacaaactctgttgttgtgtgccgctattccattgttttggagtggtgttggctacgatgaactgtctgactcatgggtgtacacaggtgatggtagagcggtttgatccgttggtcgtgttggcttccattcataaagaacgctgtacggctctttacggagtgcctacgatgtttattgccgagttgcatcatccgatgttcgacttgtttgatatgtcttgtctgcgtaccggtataatggcaggttcgttgtgtccggttgaactgatgaaacaggtagaagaaaagatgtacatgaaggttaccagtgtatacggactgactgaagccgctcccggtatgaccgctacccgcatcgatgattcgtttgatgtacgttgtaatacggtaggacgcgactttgaatttacagaagtcagagtgattgatcctgaaaccggcgaagaatgtccggtaggcgtacaaggcgaaatgtgcaatcgtggatataatacgatgaaagggtattataagaatccggaagctacggctgaagtgattgataaagataacttcctgcattcgggcgacttaggcattaaagatgaggacggaaattaccggatcacagggcgtatcaaggatatgattattcgtggtggtgaaaatatctatccacgtgaaatcgaagaattcctttataaacttgatggagtaaaggatgttcaggtagcagggattccctctaagaaatatggtgaagcggttggtgcttttatcatcttgcaggaaggggtggaaatgcatgagtcggacgttcgtgacttctgtaagaataagatttcccgttataagataccgaaatatgtcttttttgtgaaggagttcccgatgacaggcagtggtaaaattcagaaattcagactgaaagatcttggattgcagctttgtaaggagcagggaatagaaattatttaaataaagaattaaaaaagaagaatgaagaattagctgcgctgtatgctgcatagcaattcttcattcttctttttttagttcttcattcttaaatgaaatcgtctcccagttgcatctgggcatcattcacgtatttgcggatagaatgttcttcgtctttacggcagattagcaggacattgtccgattcggctatcagatagccttccaagccatcgatcacggcgagctttcctttggggagtacgatcatattatcttttccattatagatcaaagaatgactttttaaggtcacattgccttcccggtctctttctgataagtcgtagagtgatccccatgtgcccaggtcagaccagccaaaatcgcctaaagatacatatacattgtccgctttttccatgatgccgaagtcaatggatacattgggacatgcgggaaagttttcttcaatgaatgctttctctttatctgtagcatagatattttttcccggtgccagtttggatactaattcgggaagcaggatttctgcagctttaataatggtattgacgttccacataaataatccggagttccagtaaaattcaccgctttctacgaatactttggctaattccagttccggtttttcggtgaatgtctttactttgtagaagccatcaccggttggttcgtcaatttgtatatagccatatccggtctcaggacggttgggcttgatgcctagtgtcagtaacttttcagagtgagaaacgaattccagtcctttaatgattgcggcacggaattcttcttctttcaaaatcagatgatctgagggagcaacgacgatattcgcattcgggtttaaagcgcggatgtgataggcagcccatgcgatgcatggagcggtatttcttcttgcgggttccaataaaatctgtttctcatccaattcgggaagttgttccttcaccagatcggcgtacattgcattggtgacaataagaatattttcggttgggattaccttttgaaagcggtcgaaggtctgttgtaggagtgaacgaccggttccgaagaagtcaagaaattgtttgggcaatgttttgcggctaaacggccagaagcggctaccgataccaccacccataatcacgcaataattatccatgtttgtcatgatagtgactctatttttaaatgtttttgctaatgtacggtttattctctaaatacagaagcctttgggacatgttttattattttttgctccttttttttctcaaactattgtggaatcaaaatattgtcgtatctttgcaccgcaattgagaaatcaagcatgcccagatggcggaatcggtagacgcgctggtctcaaacaccagtggattcacttccatcccggttcgaccccgggtctgggtacaagaaagaaagctaagtatttgataatccaatacttagctttttcttttgcttgaattttccccacattttccccacacgtgcaaaaaatatagcagtaagtcattatttcttttggttgaacgtagtaaataagttacctttgaaaagaaataaagcctattaaataaaagtaatggaacaaggtgtttggcaagaaatagaactgttgtaccagaagtttcaaaaacttggtatcagtgaagcggtggactatgacaagtactacctttattctctcattacccattccacagccatagaaggctcaacgttgaccgaacttgatacgcagcttctctttgacgagggagtaacagcgaaagggaaaccgcttgtgcatcatctgatgaatgaagatttgaagcaagcgtatgaacttgccaaaactgaatcaggcagtcttgtacctataactcctgcttttctgaaaaggttgaatgcaatgttgatgcgtactactggcagcgttcacagtgtgttgggcggctcttttgattcttctaaaggagagttccgtctatgtggtgttacggctggtgttggtggacattcttatatgaactatttgaaagttcctgctaaggtggatgaactttgtgcgattcttcaagagaagcaaaaaaaaatgggaacacttcgagaacaatacgaattgagctttaatgcccaccttaatttagtaactattcatccgtgggtggatggcaacggaagaacggctcgattactgatgaactacatccaattttgctatcacctttttccgaccaaaatatttaaagaagatagagaagaatatattctttccctgcgccaatgtcagaatgaagaaactaatcagccgtttttggactttatggcaaggcagttgaagaaatcactttctatagaaattgaacgattcaatgtatcacgaaagaaagggtttagttttatgttctgatactatataaaacaaggattgctatttatgagtttatggtaaacttgcatgtgggaaagtttgaacatccatagaaagtgccgtacttgcctttcctcaaaatgagatgtcctccgcattgaggacaaacaccttgatttattaggcgtgaacttctgtattgccgagcctttgcgttatgcttatgctgttttagtttctctttatcagcgattatgcgattctggttaattgtctgtattatccaatttatggtctcctgattaagaacagcagttctgtattgtaatatagcacgttttagattatatctgtttacaactatgttattgtcagcatgcacttttaattccgcactgttattgaaaacgacaattggaataaaaagtatatccgttgaacatttgagcaaatgatgcaaaaatcttacatgtccagcgttttgttttatcggattgtaaaattgatgtttacttttatagatggtttgcgtccagtattcaccgttctctctgcccaaaatccaacctttatatccctttgtttcaattacaaagacaccataaggtgaaactacaatatggtcaatttgtgttgaatatccgttactttcgaatagtaaatcattaaaaacaacatactcttctggtaactcttgaatcttgttattcacaagtttttcagaatacttgcctttccacattggcatcttcaatttaataaagattaccactgcaaaaaagataacggtgatggcaatatgcatattactgatttaatagattctttttatccatcttttacttgattcaaatccccattgaacatgccatcttcttcctgttactttatctaacaaaagaaattgatatatattttttgttggatataattcaaatgttccacagcctgtaccaagagataggtcttcgttattaagggttgcagaaccttctttatcatcatccaaagaccattgtacaatttctattttccctgtcattgtatctaattgcagaaaattatatatattttctgttggatatagtttgtatctatcaagtccatgcatacgaaaatctatatcttctacaatagcatgtattttaatcaaagtagaatcattaactgttttggtatgtgaaatggaactttcattttgtgcaaaaacacataatggaattaaaaataaataaaaaataatcgtaagtttcttcataggt

SEQ ID NO: 34 - DNA, 113329 bp, Bacteroides thetaiotaomicron
gagtataatagaacgtatgttaataaaaggagagtgcgtttcaacacaaagcaaagcttgaaagattccccgtactcgataatgaagctattaactatgcagcccggagggaggagggaggcaaactaaaaaaatgactgatatgaaaaaaggtttgatttttgtgctgtttgcacttgtttctatcgtttcttattctcagatttcctggaatgctaaggtaggtatgaacatgagtaatttcacaggagacgctgatacggacatgagagtaggttttaatgttggagtgggaatggaatatcagtttactgatatgtggtctattcagccttcgttgatgtttactcagaaaggtgcaaaactgggtgatatcaaggctaatccgatgtacctggaactgccggtaatggctgctgcaagatttgctgtggtagacggacaaaatgtagttgtaaaagccggtccgtatctggcatgcggtattgccggtaaatacaagatgaatggcgttaaggaagatttctttggtgacaacagcggaggtaaaagatttgacttcggacttggagtgggtgttgcttacgaaatcaacagattctttgtcgacctgaccggagaatttggtttgactaaagtgtatgatgccagtggctctcctaagaacatcaacttctctatcggagtaggttacaaattctaattgaattatattctctttataataccattcataaagtcctctgcccaatagatggagcggaggactttttcatttcctcccataaagaattttctcttcctataaagaaaaacgatgtatacttccgaagaagcacacatcgtactaaactctctcccttttaattgtctcaatcggtcatctgtttggccagattctctttttctttcagttctttatatctctctatggcgtgtttccggctcatcagtatttgccagcggtatacccagcaagtggtgaggaaataaacgcctgcttgtatccacagtgccttgtattcaaaggcgacttcgcttaaagtagctcccatattattgatcttcacaaagccgttgatgccgaatgtggacgggaaaatgtaagaaacatatttccagaacggaggaatggcggctcccggccacgagataccggaaataaacagcagcggtacggaagtgaatacaaaaatcagcatacaggtttcccggttgcgaatggcgatggaggtggtcattgcaaagaaaatgcaggctgccagatagggggcgacaaataataccagtgaaccgggttgcccgatttggttgaggctgaatagtcttggcacgatatgcagcacgtaaaatgataccagtacgtacacaaggaagtaacttagccccttgccaagtacaattcgcaacgttccgttataatgccggttgatggggacaaggtctttaaaccggttgttttcccgggcagttcctgctgccagtccgattccgagcaatagcgtttgctgtatgatcagcaccaatacggcaggaatcaggaaagcggcaaaaccggctgtaggattaaagatggaaatctcttcatattctatcggataaccggtgatttcgtcctgtcgctcggtcgtgttcccgctacgcgcgatctttatatctttattcatatccagtgatacggccgtattggcgatcagcatggatttatagtacagcaatccgctcatgtcgcaatagatgctgacttgcgtctgtttccctttggcgatgttgtcgctgaaatcagatgggatatagatgatgccgtatgcaagccggttcttcagcatttgcttggcttcttccatatcggcacaataggcaacaatctgaatgtccggtgtggcatccaccttccggagatattcgcggctcagggatgaatgagagtcatcgactacaacggccggaacttctcgtactacttcattgtcatagataaagctgtacagtaacggatagcccagtgggacgaggataaagaaaatcagtaccccctggtcgcggaaagttgtctgaaactcgcgcttccagatataaaacaggtcgttgatgccttgggctatcttgtctttaaattttatatctttcatcagggtatgtatttatagtaaaccaatgcttctttcaagcggtgaaccacaaagaagggaagcatcatgaatattaataatgccatatagttggaccatgagtaagccatgctgtatccgttgagcgcctgatctacataaatcaggaaataatgacgtaacggaaacaggttgctcaaggcctgcaaaacaggattcattgccatcaccggaaaagaaaaaccggagatggagaatgaaatcactccccacaaggaggcaaaacttaatccgaggcggagtgtaggcagtgtacctatcatgacgatgccgcaacactgggatgccaatacaaggcagagcgtggcgaatatcatcgggaagatgccactgttgcaggggaaatgcagaaaaccgtacaggtatacattatagaatatccccattatgaaaaagaccaccgtatgcggaagcagtttgcctgccaaagcaatgtaaatggaattgttactcattcgcaaccattcacgggcagtgcggtctttgatttctacaccgatagaataaacggtaaccatgaagatgagcaacatgagtactcccggtatcagtgtattgcacaggtataccgaatagttcagccacggattgttcagtggatgtgtgtcaatcacgatcggttgcaggaagcccattgcctgatcttccgtagcccctttggcgtacagtacgctccttgccgcagagccggcagtgagttctcccatcattttcatgtctctgaatagtaaagaacctgcaatcagataggagtaattggtgtagaaagagattttgggctgccgttggctttgtgcctctgccgacaagcctttcgggatatagaagaaaccgtagatcttgccttcctgcacagcgatacgcgcgtccgtcacattgctgtaatgagctacgacacctgtttgcgagaaagcatccagattgcggacaatgttgcgtgaagtagacgagtcatccatgtctaccacgccggccggaagattctgcggaaggcccgaatccatcagggttgtgaaaaataggtagcagaataatggagcgatgaccatgcaaaagagatagagcgggcgtgatactaaccgcctgcactccctctgcatgacctgccataaggctacatatttcttctttctctctttcatgattatttgttaatgatgacggacatacccggacggaggttctccactttttccatcggagaagctttgacttcaaatgtcttcaggtcgaactgaccggtagtcttggttgccttccaggcagcgtaagtacctaagtctttcagatagtatactttgagtttgactgttttattatccagtgcgggaacaacggcttcaaattctgctcccatagtcaggtttttgagcaagtcttcgcgtacgttgaaagtcacccacatatcattgagttcggctatgttcatgataggggcacctgtacctaccaattcgcctactttcgggaaaatctcggaaacttctccggcagccggagcaatcagataggtttccttaatgtaagattctacttcggcaacagctccttttgcacggttcaccaacgcttcggcagccatcttgtcttcacgttccgcaccgttctttgccattgtatattgtgctttggcagctttctcggtagcgatggcagcgtcgcgttgtgcggtaacctcgtccagcttttgtgcgggcatcactccttgttcatacaggttcttgactctcttgtatgatttctcggcaattgtaacacctgcctgagctttctgccacatttcataggctgcctgaatctgttcttcgcgtgcacctttgattgctttttcgttttgtgcctgagcggcagcttcggcggcacgtgcctgctccattttagccactacatcgggggcttccagaatagccagtgtatctccggcatttacgctttgtccttctttcacgcgaaattccagtatacgtcccggaactttgcttgaaacgcggtattcggtaacttcagcctgcccctgaataatctcaggacctttgcggagcatgaaaaagccaacgactgcaacgattgcaataactcccagtaaagtaagaaatgcaagcagcatattgctgttttgtgattttataggtgccatattattgatgaattttaaattacgaataataaattgattgaatacctcagtctttaattgtcaattgtccattgtccattatttcagcgttcccaaagacttcttcagataaatctccgtcagcttcacgtcgatttgtgcgtcaatcttttccgattgggcggacagccatgccgtttgtgcttccaggacattgctggtggcaatgaccccttctttgaagcctaaggtggcataacggagattttcgtcagccttttccatattcttggttgccattaccagttttttgctggcttcctttactttaaaagcggattggttaacttgcaattcgatcttttctctcgcatcctgaagctgatattgtgcgattcgtgcttctgccttggcggctttggtcttgtaaatgccttccccccaatgccagataggtatctgtaccataacgcccacattccacattcctttgaatttattctcaaagctgttgaatacggaaggattggtcaccatataatttcccatcaacgcaatggacggaagatgttcggcgcgggtaacatttattttctgtttataaatctgagtagccagttcaaggctgcgtatctccggacggttggcgtaagcggtggacatgtcgaagtgggtctccggtgtgagcagtggaatgtcctccatattttcgtctgccaacgtgataggagagctgagatcaatgccacatagttgacacaacaacattcgggccaggcttaatccgtcttccactttagtcagtgtcatttccgcttcgttgactttcacacgcacggacaaaccgtcggcttttgtggcaactccttcggcaatcatcttttccacatcgctgtccagctgctgcaaaagtttgagatagccttcggccagtttcttcttgttcactaaggatatgacttgccagtaagcctggtcagtgctcatgataacctcctgcatgcctccttgatgttgctgttgcgctaattcttcggcatactttgtgattttattatatgcacggattttgccgcccatgtataatggctgtgtcagcgtgatggcacctgcatatacatttcttgtatctgtgcggagcgcatccaccagtgagtttcctgcctggtcgagggcgggtaaggcagctcctaacttttcacttaaagaagcgataagcggtctcaactccgggtgtgcggtagcaatctctgtagccgtctgttgtatcggaccggccaaattggtccccaatcccgaaagcgccgctttctggtcattgttcaataatgaaaattctttttgatttctcatgtaagttcccgtagccgagaaactgggcaggtagttggtaaatgcagctttgtgctgataatgagcggcatttattttttcattgcttatcaacagatctttgttgttggcaagagctaatgcgcggcaactatctaggcttaggaagctttgcgcttttactataaaagtcaggctcaacagaattgtcagaagaaatagttttttcatcgcatcttacatattaataaggtgatacttcttttttaaataaccccgttatcatataaattgtttattgagatagttcatttttttatacttgttgacttaaacaataattgcataaacaacgatgcaaatgtatgtgctttctgtgaaaacgcaaaatgaattagctttttttaaatgcttctctttggaaaatatgctatacttgcattttgaaacatgataaacatactataatgttattaaatctgacagaagaacaaatcgctcaactcgctccggacgctgcgtctgtcaaagcaggaaaagggctggcgaaccggactaagtgggtacttctggagcatagtgaccgcgccatctggggacactgccaaggaagtggaaaaacgccttatcaaacagtagttgatacaaagaatattgcattcaaatgttcttgtcccagccgtaagtttccgtgtaaacatgggttggggcttttatttatgtatgcttcccatgctgatcttttcaaggaagcggaggaaccggactgggtaacggcatggctctccaaacgtgaagagaaggcggagaagaaagagcagaaagagaaatcggaaactccggtggatgaagcggcacaggccaagaggcaggccgtgcgtcatcagaaggtattggccggaattgatgatcttcagatctggatgaaagacttgctccgcaacgggctgctgaatatcccggaaagagcacatacactatttgaacccatatcccgcaggatgattgatgcacaggccggcggattggcgggcaggttacgatcgctacaggaaatcaattactatacagacagttggaaatatgagcttaccgacaaattgagtaaactgtatcttctgacagaaagttataagaatctggattctctttctgctgagtggcaaacggaaatccgtattcaggttggatatccgcaggcgaaggaagaagtgatgtccggcgtaccggtgacagaccaatggatcgttttgcataccagaagccgaaaaataaatgagctgcggacagaaactttctggttgtacgggaagtccagtcaccgtatggccctctatttaaactttctggctcccggagcgttgccggaatttaatctggttcccggcggtgtctatgaaggagagttgtatttttatcagggtgttggtgccttgcgtgccttgcccaaaaacatgaaatggctggataataccttcctgccttcattgtgtgccgatataccggttgccatgcaatcttacagagcagttatacagactcatccgtttgcggaggaagttcctctcttggtggacaatgtcagactggtaacaagcggaaatacgcactatctacaggatgccggaggcgtggctgttccggtgcatattgaagagactgcacgtgttgatatactggctataacaggcggaaaacccttctcggcttttttgctggcagacgccgtttcctgtgaattgaaaacaatctggtatcaatctgaattttatttttggaaagatgaacttaactgatcatatcatcaatgtggcattgcttggcactgccacccgtgaactgataacgactgattttccggaagagttgcaagaaactctccgcgacattcaggcgaaagcagaggatgcggaagctctcttctatcagcagtccgctttgggctttgcctttgcacgtgccggagtggaagcgcaatccattgcaggagttgtcaatgtgacagaagctccggaagaagacaaatcttacttcctccgtgaagtgggagagttgcttacttccctgtatctcaataaaaatcagtatcttttgctgtatgcttaccggaaagctgccgataaaggaaaattgatccctcctgcctatctgcaaactttattgcgaagagcttttgaccggaataatccctacaggtatgaggaacagcactggctgtctctgctgacagggcaaagaggacgttggcttcttccgcaaatgggatttcctgtatggggagaatccggcaacgaaacttgggaaaccgcctctcacgaagaacggaaacgaatgttgtccaatctgcggaaaaatagtccgaagcaggggcttgccttattgcagaccgaactgaagaatgagtcggctgcccatcgggatgaactgattcagtgtttgcggtgggggttgagtaaatcagacgaagcattcctgcaagagatcgtggcgaccgaccggagcagtaatgtcaaagaaacggcccggcgattattgtgtagcctgccggactccgaactggtgaaaatatacgaagaattattgcgggggaaattacatttcaatttccttttgggatggtcgtatgataagattgaatttacccctgaaatgaagaaactgggacttgaagaggtgagttccaataaaaacgagaaggatgatcgtttcttgttacgccagttggcggaacgtgttccattaagtttctggagtgagttttatgactgtccgccggagaaggctgccggcaaactggcgaagaaccctccttttcagaaactgttcgacctgtcaaaaccgatcctgaatttcagcgactccggttgggcatatcataccttgaaggagaatgcggatgaaaaaatggcggacgcgttgatggggttattgccttcctcccaacgggaggaaatagcttttcagtcggagagaggcggctatattccggatagctggttcaacgaagacggcatcggatggggaatgaaattctccactcgtgtattccagcggatgcttcggaataattactatcttcctaaggagacagccgaacaactggcattatacttcccgtccgagatgagaaaacccatcgaacagacagcgcttgcaatggccgcacaggataataatacctccactcgtttttgccggttgatgatggaatacatggatttgaagcagagaatagataccttattaaataatgattaataaaaacagaaaaaagatatgagcactttattaagacaacatgctgaacagcaatttgcagaagaacttcacgagttgaaacagaatgaaacaaatcccgttccggagaattgggagatgtctccgcagtcagtggttacctacctgatgggcggtaaattgaaaaacggatttgaagtttctcctaaatatataggtaaccgtcgtctgatggaaatagctgtggcaacccttgtcaccgaccgtgcgctactactttacggactgcccggaactgcaaaaagctgggtgagcgagcatattgccgctgctatttccggtgattccactttgatagtgcaggggacggccggcaccggtgaagaagcgatccgttatgggtggaactatgcccgtttgctggcggaaggtccgagtgtgggggcattggtgcaaactccggtaatgaaagctatgcaggaaggtaagataggccgtattgaggagctgacacgcatcggttccgatgtgcaggatacactgatcaccattctttctgaaaagacattgcccatcccggagctgaatacagaagtacaggcaatccgcggtttcaatatcatcgctactgctaataatcgggataagggagtcaatgatctgtcaagcgccttgaagcgccgtttcaatacggtcattcttcccttgccggattctattgatgaagaaatagatattgtgcgccgacgggtagagagctttgagaaagtaatgcagctcccggctgagaagcctgctctggaggagattcgccgtgtcgttactatcttccgtgaacttcgtcagggtgctactgctgacggtaagacgaaactgaagactccgagcggaacgcttagcacggcagaggctatttcggtggtaaacaatggactggcgatggcaggttatttcggtgacggagaaattcatgccgaagatctcgtatccggtattttgggggcagtggtcaaagaccccgtacaggataaagtcgtttggcaggaatatatggaaacggtcgtgaagaatcgggatggctggaaagatatttaccgtgcttcaagggatatgatttaaaaagaaaggaagaaatggctattcatttactaggcatcaggcatcacggtcccggctcgtgccgcaatgtgctgaactacttgcaggaactgcaaccggatctgattctggtagaaggtccggcagaagctgaagcgctgctgccctgtgtggaaaatccgcagatgacgcctccggtagctttgctggcataccagccggacgagcctcagaatgcagtgttctacccttttgcggagttctcgcccgagtggcaggcgatacgttatgccgtacagaaccggatacctttccgctttttcgacttgcctctgatctattcgctggctcttcggacacaaaagacctctgaacaggagacggaaacgaccgctgaagtcgcagaagccggcgacccgttcgactggctggctcatgccgcaggatttaccgatggtgaatcctggtgggaaactatgattgaacaccggcaagaacctgccgatatctttcaggcggtacaagaggctgtgactgctcttcgggaagaacttccggggcacacctctccgcgtgacctgatacgtgaagcgtggatgcgtaaaatgatacgtgcggcacagaaggagaatttcgaacgcattgtcgtcgtctgtggtgcatggcatgtacccgctctggacgatatgcccaaagtaaaggacgataatgaactactgaagggacttcccaaagtcaaggtagaatgtacatggattccgtggacgtatgaccggcttgctttccgcagcgggtacggtgcgggaatcgaatctccgggctggtatcattatctctggcatcatccggaggatgatggcacgctttgggtgagccggatcgcctctctgttgcggcagaagaatatggatatctcggtagcccatgttattgaaaccgtccgtctggcacaggtgacggctgctttgagagatctgccttatccttctctgaatgaatataacgaagccgtcactacggtgatgggtttcggagatgatatattgttgcagattatcaaagaagaactgatcatcagcaaccgcttgggaagtgtacctgatgacgttcccaaagtgcctctgctggtagacgtggagaaaatacaaaaacgtctgcgtgttccgttcaccgccgagatcaaagaactgatattagacctccgcaagccgaacgatctggagcgaagtatcttcttccatcgcctgcaactgctgggcattgactggactatcctcggacggatagacgggaaaggtactttcaaggaaaaatggaccttgtatcacaaaccggaacagatcatccaaatcattgaacgggctatctggggaaacacggtgatggaagctacgcagaaatatctgttgaaacagatggcggagattcagcatatcccggaactgacagctttgttgagtacggtcctccctgccgatcttccggcgctggtggaagcgatgaccgtacagttggaccgtctttcggctgcttccaccgatattctggaaatgatggaagcggtccccgatctggtgaatattgtccgttacggaaacgtgcgtaaccttgatttctcgaaggtcggtgatatgctcgaagccatgattgcccgtattcttgcgggtggtgtattggtgtgtatcaatatcgatgaagaggctgcgggtgatcttttgaataaattggttgccacggactatgcgctctccattctgaatcgggaagaactgaacctgatgtggcgcaatttcatcggtcaggtacgttcttctgccaatgtgcatccgttgttgtccggttatgctacccgtctgctgaatgacaaaggggaaatctccgcagaggagatggagacgacactcagtttttattcttccgttggcaatgctccggcagatatggcatactggttcgaaggctttttgcgttcatccggttcgatcctgttgctggacgaccgtctctggaatttggtgaataactgggtatgttcgcaggacaaagaaacatttatggaactgttgcctgtattgaggcgtactttcagcgaatttacctctgccgaacgtcgtaagctgggtgagaaagcccgtcgtacggattctacgggcacatcatctgccgtaggagcttcggtaacggagaatgagtgtctgaatcgggaagaagcaaagaaggtaatccccgtgattcgtcaattattgggactggaaacaaagtaaaggaaagaagatggaagaagaattactgaaaaggtggcgtctgatactgggcggcgatgaggctgacggtacaggcgtgacattgaatctggaagaacagcggatagatcattctctggaagctgtatatgatagtgacagaagaggagggctgggttcctcggctcccaaagtaagccgatggcttggagatatccgtgagttctttccgcagacggtggtacaagtgattcagcgggatgccataaaacgtctgaatctgaccagtctgcttaccgaaaaagaaatgctggaaacggtcgtccccgatgttcatctggttgccaccctgatgtcgttaagccgggtgattcccgaaaagaataaggagatggcacgtcaggtagtccgcaaggtggttgaggagttgcttcgcaaactgtcggctcctacgcaacaggcggtaaccggtgctttgaaccgttccagccgtcgcaggaacccgcgttacaatgagatagattggaaaacgaccattaccaagaacctgaaaaactaccaaccggactataagacgattattcccgaaatccgtattggctacgggcgtaaacggaaagcgatgaaagatattatcctgtgtctggatcaaagcggttctatggggacgtcggtcatttattccggcatattcggttctgtgttggcatccattccggcggtatctacccgtatggtggtttttgatacggcagtcgttgatctgacggatgatttgcaagatcccgtggatctgcttttcggggtacagctcgggggaggaaccgatatagcccgtgcgctgacttattgtcagggagtcattacccgtccgcaggacacggtgatggtgttggtgactgacctttacgaaggaggagactccagagaaatgagaaagaaatttgtctcgttggtcaatagcggtgtgcagttgattgtccttccggcgttgaacgatgacggtgctccgtcctatgacaaggggcatgctgagtttctcgcttccataggagtgccgacatttgcctgtactccggataagtttccggaccttatggcggctgctttgagtaaacaggacattggaatgtgggtttctcagaatgtaaagagtgaatgacagctattggatagaaaagaaagaaggctgtccctcatagcggaggacagcctttcttagcttatataaatgtaaggggattgctaattacagagcacctacttctttcaaagcagcgtttgttccgtgaacagcttttgcgctggcagcgaacttagctttttcgtcagcgttcagatccagttcgacgatcttttcgataccgttcttgccaaggattacaggaacaccgatgcaaatgtctgattcaccgtattctccttccagatatactgaacaagggatcatcttcttttggtcgtgaaggatagattcaactacgaatgctcctgctgcacccggtgcataccatgcagaagtgcccagtaacttagtcagagtagcaccacctaccatagtagcagcagccacttcgttcagtttttcttcagagatgaagttagttacaggcatacctttgtaagtagcgaagcgagtcaaaggaatcatagtagtatcaccgtgaccaccgataaccataccttctacttcgttggcgttgcagcccaaagcctgagacaagaaatatttgaaacgagagctgtccagtgcgccacccataccgatgatgcggttcttcggcaagcccagagctttcaatgacaggtaagtcattgtatccatcgggttagagataacaacaaggattgcattgggagaatatttcaagatgttttctgccactgatttaacgataccagcgtttacaccgatcagttcttcgcgagtcatacccggtttacgaggaatacctgaagtaattacaacaacgtcagagttagcagtctgagcatagtcgttagtgcagcctactacagttgtgtcgaaacccaacagttgagctgtctgcatcatatccattgctttaccttctgaaacgccttctttaacgtccagcattactacttcgtctgctacttcattgaaagcaagtacatttgcacatgtagcacctacgttacctgcgcctactacggttacttttgacataatactatatatttaaaaagttgataatttatttcatgctttttagcgcgacaaaattacaacgataatcctaattaaagaaatttttccgtaataattttcgttaaagaaaatgcccaagactatgttactctgttacgaaatgattacttttgtgcccgttatcgattaacaattggaactatgaacaaaaaaagccttcttattgcagctgtagctgttttggtgatagcgattatcggcatcacttatttgttgtttactgaaaagaaagccaatcgcgagctggtacaggaatttcagttggataaggaagatttggagaatgagtatagccagtttgtgcaaaagtatgatgagttaaagtttacggtaactaatgactctctcgcactgttgctggagcaggaacaattgaaaactcaacgattgctcgaagaactccgtaccgtgaaaagctcgaatgcaacggaaatccgtcgtttgaaaaaggagcttgccactttgcgtaagatattggtaggctacgtcaatcagatagactcactggacagaatcaataagcgccagcaacaggtgattgcagacgttactcagaaatacaacactgcttcacagcaaatcagtacactttccaaagaaaaggagaatctggataagaaggtgacactggctgcccagctcgatgtgaccaatatccgtatcgaaccgcgcaataaacgggggaaggttgcaaagaaagtgaaagacatcgtgaagctggctatcagctttacagtcgtgaagaatattacggcagagaatggcgaacgtaccatctatatacgtatcaccaaaccggataatgacgcactgaccaagagtgcatccaacactttctcttacgaaaaccgtacactgacttactccatcaaaaagtatatcgaatacaacggtgaggaacaaaacgtgaatgtattctgggatgtagaagagtttttgtatgccggaaactatcgtttggatatcttcgagggcggtaatctgatcggctctcagaagtttacgctggactaaccgatataaattcaagaaaaaaatgcgccaacaagcagtaaaaggctttttggcgcatttttctattagaaaaaggttaactttgtgaaaactaatagaataatgcgtatgaaaaagcacttgactcagctactactatcattactgtttctggtggtgacagccatgacttgcgatgaacaggatttggctgaaccgatagacatctcctgcattttgaaagaagtggagttatatcattgggataatgcaggtgagaaacctaaggaggctcttgataacaaagttctcaaagaagcttatatgatggagattcgtttgctgacagatgcgggggaaaaagatccggaatcttatgacaccgatcattatcttcgccatgtattatcggatggcatcaaaaagattcagatatttacggaaacagcttttaatgaagaatttcccgcaggagcagaagtcacttcctgcttttatgactatccaaagacgtttgttaaagatcagcagacagattatactgttaatggaggggttatatccatgatagatgaagtaaacaagatatataaggcgttattgaccattccccaatcaggcggagagttccgttttcgtgtagtgctgacaatggaaagcggtgaaacggttgaacggctgagcgatccggttactttctattaaatctgctgtctatgaagaaagtacatttattagccatgctattgtttactgcatgtgttgtgcctgtatcgcaggcgcaggaaagcctgtttcttaaagatccatctaccaagaataagttgctacagttagacttggatgtgggaacctgttttgacctggcttatcgggggaagggaaatatgtacactgcaatgtcggaccggaaatctgtgtttcctgctatcaaccttcgtttgcaacatttcttttcgcgtaaatggggatggtatacgaatatccgtttggggattcccgtgaaatataggcgggattgttatactgaattagtccatgcagtcgaagcggattactatgtgaataatctcataccgggaacgcaaaaaccggacgttaatccctgtctggattttggtgttgcttatcgctttgaaaattcccattgggctttttatcctcgtttggggattggtgtgaatagcatttcctatcagcgtgtttgtgcggaactaaagaaaaaaggaggaaatgaattatataagatagagtatagaggggatgatgaaagtaactatggtagtgagagtatcgatgcttttattctttcggcaggtattaccgccaactataagctcagtcgaaattgttttttactgttgaatgtcaattatatacagccattggggagatttacttatcgtaaatatgtaacagacctttatacgggagaaaaggtggagagaggagtctataaaagttctacattcgcccgtgatctgaatgtaagtgtcggattcggattccctttttatctgggaagaaagactaatagaaaatcatcgcatagagaaagaaccaggcagctgatggaacagaaacggaaaacatacgggttgtttccgggaaataagtagccatttaatcatttctttgcaatgatgagcgaatagaatttagcctttatacaaagtttgaaaaagaaaaaactctgccattcacaacaattggattaacattcttatgatatacttacgtgtcagctagtctctctataaaaataaaaactataaattgctgtcatctgtcactttgttgggtataatatcttgaatatgagtgattaatgaggtgacggcagtaggtgacggcagtgtgacggcaaattttgctgtcacactgccttgttttcaatggttccttatggtctgtttgtagttctatatagagctttttagtttctcccgtttgaaacttttgtttcttcagcttggaactaaagtttcatcggcttgaaactaaagtttcaaagccttgaaaccaaagtttcggacgcttgaaaacattggttccagcgtatggaaactagttatactagagtgtatgatgtcaaaagtcaatagtagcgagttcagtgtagtcgatgtgcgtgtgacggcaatagttgtcatcaccgtgccgtcacctgttgccgtcacagcgttaagccttgactatgagtgtgttatttatgtttttgtgatgggtgacagcagtaattggataaacaatacatagagagaggagccggttgatacatctattataatgagatttgtcagattgataatcgtttaagagctttttaggtgccttaacgacaaaacaagtggctgattgtgttatattccctaagtaaccaaataaaaataacaagattatgaaacagaaaagagctaaaattggatttaccggatgtgccaaagcgtatatccggagtttgcaggaagaagggcgctattctacggcacatgtgtataagaatgcggttctttcatttacgagatttcatggcagtacgtatattgcattcgagcagatcactcgcgagtctttgcgacgttacggacaatacctgtacgattgcaaactgaaactcaatacgatctctacctatatgcgaatgctgcgctgtatttacaatcgtggtgtggaagctggtatcgcccgttttatcccccgattgtttcgtgatgtatataccggtgtggatgtccggcagaaaaaggcaatgcccgtaaaggaactgcatacacttctttataaaacaccccagtctaagcacttgcggcgtactcaggagattgcccgactgatgttccagttctgcggaatgccttttgcggattttgcgcatttggaaaagtcggcattggcacaaggggtattgagatataaccgtatcaagacaggcacttctgtaagtcttgaggtgctggagtcatctctgcccacgatcagtaaacttcgcaataatgaccctgttcgggaagatggaacgaattatttattcagtattctgagagggaataaaagcccaaaaggtgaaagcatgtataaagaataccagtcggcgcttcgtcggttcaataatcagctgaaaagtctttcaagggaacttcacttaaagtcggctgtcacctcatataccatccgccattcttgggcaacgaatgccaaataccagggtatacctattgaaatgatcagtgaatcattgggacacaaatctattaagacgactcaaatctacctgaaaggttttgaactagaaaagagaacagaagcaaatcggttgaattgtttttacgttgaaaactgcaataattagaatagaatataatcagagtgctggctattagtgtgttatcatgtctattacttcttgggtaacggaaataaatacgacgcaaagatatataaaaagaatctcatatcccaaacttattatacattattttatttctctgacttaagaaaataaaataacactatgagaacacgaataccactgacttcatgttccgaacccttattgtttgtcatccgacaaaatctccttcataacccttttatacagtgcttctcgcaaaggccgctgcctttttcgcttcttttcccctatgtgtaaagtccggtaatggacttccgttacccaagaagtaatagataaatgtaagtagtaaattgtgacacgcaattcaaacaacaagctcattttgcatgccttctatttactttggttctgaatttatccattgggatatatgcttgcaaaggtacacacacagtgacaaaataaagagaatgaacattgcttcgatgtgggcaatgtcttaaaaagggtttttagtttacttatttaaaagtaaaagaagaaatggaaagtttatggaaagtctggttctccagaaggagaaaggtgtatgttcggatagcccgtcaatatggttccactccgtggcgggtgtattatttaggacatggaggcaggtgcaggtcgctcaaagacatgcagatattggaagcgttacagcggcagggagttatttcgcatatttacccttggtgataattgactgaaaaatacttgaacatatttaattatgtgtccgacagaaatatgaataattataaaatatggggtgagatgtttttctaaaaaggttactgtgaagtacccgaacggggataaaccctttatagcatgtgtatgtttcccacaacatgcttattgcttatataaacggagtctcttggatgcccgttttatataattgtttgtttttgtttaagtacattctgtcctggtgaggaaggatgtacttttttatgcccgaaggtccggaatcagatagttacgaaggtccggtcggaagatcagcgccttccgtccgctccccacatcatcttgctgcggagggtatcgaagaaaatatgattgaaccgtttcactacttttatactgtagtctgcccggcgaatggtcagctgagttgtctccttgcacgtttcgctgctgccgtcgatggcaacgaggaagttatggctgcggctttccacgtccagcgtgatttcccagtcgtcacgaatgacgataggacggacgttgaggctgtgcggagctaccggggtaatggcgatcgtattggaatgaggaacgatgatcgggccgcctacgcttaatgaatacgcagtagaaccggtaggagtggcaatcaccagtccgtctgcctgataagtattcagataagcaccgttgatcgcagtgcggatgctgatcatggaagaactgtcccgcttgagcaccgcaatttcgttgagggcataaggcgactcctggagatttctgtcattgcagataagctgcaatacacttcgttcctccacactgtatctgccagcctgaatctcttcgaaagtcacctccatctcttcgggtgaaacatcggcaagaaatcccagccgccctgtgttgatgcctagaatggggatttgttttctacccacccggcgggcagctttcagaaatgtgccgtcacctccgatgctgataaccatatcggctgtgaagtcgttgccttcgagcagggcgtcgacaggcacttccatttttaaatctgccgtcaggaactggtaaaactcccggcacatacagatttccgctccctgcttcttgagaagctcgaacagtctgagtgcatgcaaagactttttaggctgatacgtatttccgaaaatggcaaatttcataagctgtttcattagtttcggttgcaaaattggcattttttcttggatttctactttaaataaccaaaaaagaactgagaatgcgtttcgtattattaggcaactaataataatatttgtatttttgcggcaaatattgcgtaaaactatgactaaattaagtgtaaacataaacaaggttgctacattgagaaatgcacgcggaggggatacccccaatgtggtgaaggtagcacttgattgtgaagctttcggggctgacggtattactgttcatccccgtcccgacgaacgccacatccgccgggcagatgtatatgatctgcgtccgttgttgcggactgaattcaatatcgagggctacccgtcgccggagtttatagacctggtattgaaagtgaaacctcatcaggtgacgctggttcctgacgatccttcgcagattacttccaactccggttgggatacaaaagcaaatctggaatttctgtcggaagttctcgatcagttcaacagcgcaggcatccgtacttccgtctttgttgccgccgatccggagatggtggaatatgcggcaaaagcaggtgccgaccgtgtggaactttatacggaaccctatgctacggcatatccgaagaatccggaagcggctgttgccccatttgtggaagcagccaaaacagcccgcaaactgggtatcggcttgaacgccggacacgacttgagtcttgtgaatttaaactatttctataaaaacattccttgggtggacgaagtatccataggtcatgccttgatcagcgacgcattgtatctgggactggaacgtactattcaggaatataaaaactgtctacgctaatgaatgtattgatgttattggcccagggtgccatgaatatggccgactcgctggcaactgccaacccggtgctgactccggtcagcgctcccgagatgaatatgcttgatatggctatcaagggtggttggattatgattgtactgggtgtactgtctgtagtctgtttctacatcttatttgaacgtaactatatgatccgtaaagcgggaaaagaagacccgatgttcatggaacggatcaaggattatatccatagcggtgaaatcaaagcggctatccagtattgccgcacgatgaacactccttcggcacgcatgattgaaaaaggaatcagccgtctgggacgtcccatcaacgatgtgcaggttgccattgaaaatgtcggtaatctggaagtagccaaactggaaaaaggcctgaccgtcatggcaacaatctccggtggtgctccgatgctcggattcctcggtacggtgaccggtatggtacgcgcattctacgaaatggcgaatgcgggaagcggaaacatcgatataaccttgctttccggcggtatctacgaagccatgatcaccaccgtaggcggtctgatcgtgggtatcattgccatgtttgcttacaactacctggtgatgctggtagaccgtgtagtaaacaaaatggaagctcgtacgatggaatttatggatctcttgaacgagcctgcccaaaagtaaccctgagacgttaatcactatcattaaccactaatcaataataaagtgggattaaaaagaagaaatagagtatcgcccaatttcagtatggcatccatgacggacgtcatcttcctgctgctgatattctttatgattacctctacggtggtgtcgcccaatgccataaaggtgttgttgccgcaaggcaaacagcagacttcggccaaaccgctgacaagagtcgtgatcgataaagacctgaacttctacgctgctttcggcaatgagaaggaaaagccgctgtcgttggacgaactgactccgttcctgcaaggttgcgcggagaaagaaccggagatgtatgtggcattgtatgcagatgagtcggtgccttaccgtgaaatcgtgcgggtgctgaacattgcgaatgagaatcattttaaaatggtgctggctacacgcccgccggaaaacaaataaagtaagtagttgctacttaactactaaaaaaaagaaacaattatggacgacagaagaaaaaagggtgaattcgtcggcgcgctgggtgcactgttggtacacgtggcagtgatagctcttttgattctggtgagctttacggttccccagccggatgaagacgcaggcggcgtacctgtgatgctgggaaatgtggagtctgcccgaggctttgacgacccttcgctggtggacgtggatatactgcccgaagaaccggaagcacctgcacctgcggaaacgcagccggaactgccctcggaacaggatctgctgacacagaccgaagaagaaacggtagtgctgaaaccgaaaacggaacctaaaaaggagaccgtgaaacccaaagaggtagtgaagcccaaagaaccggtgaagaaacccgaaaagacagaggcggagaaagctgccgaagcgaaacgtcttgccgaagaaaaagcggaacgtgaacggaaagccgccgaagaagctgcgaagaaaaaggttgccaacgctttcggaaagggagcgcagatgggaggcagcaaaggtacttccgccagcggcacgggaacagaaggcagcaaggacggcaattcatccaccggagcgaagaccggaaccggaggttacggaacatttgacctcggcggacgttctttaggtacgggcagtctgccaaagcctgcctataatgtgcccgaagaaggacgtgtggtagtcaatatcaccgtgaatccggcgggagtagtcattggaaccagtatcaatcctcaaacgaacaccgtgaactccaccctgcggaaggcagcggaagacgcggcgaagaaggctcgcttcaacaccgtggaaggaccgaacaaccagactggaaccatcacttattattttaacctgagatagtatcactaatcaaaaatataggattatgggaactgtatatgctttttttgcagatggctttgaagaaatagaagcctttactgctgtcgacactttgagacgtgccggactgaatgtagaaatcgtatctgtcactccggatgaaattgtaatgggcgctcacgatgtgtcattgctctgtgatataaactttgataactgcgatttttttgatgccgatctgctgttgttgccgggaggaatgccgggagcagctacgctcgacaagcatgaaggactgcgtaaactgcttcttgactttgctgccaaaggaaaaccgatcgcagcgatctgcgcggctccgatggtattgggcaaattaggtttgctgaaaggccggaaagccacttgttatcccagcttcgagcaatacctggaaggtgcggaatgtgtcagtgaacccgtagttcgggacggaaatatcatcacaggtatgggaccgggcgctgctatggaatttgctttggccatcgtagatctgttggtcggcaaagataaagtagacgaactggtagaagcgatgtgcgtaaaacgctaagctgtctatgaaacaatctgtgattattgtcgccggtggaaagggcttgcgaatgggaagcgatcttcccaaacaatttcttcctgtcggtggcaaacctgtgctgatgcatacgctggaagcattccgcaagtacgatgcgatgcttcagattattctggtacttccccgtgaacagcaggacttctggaaacagctttgcgaagaacatcatttttcggtggaacatcttgtggcagatggcggcgagacccgttttcattcggtgaagaacgggctggcacttgtgcaggctcccggtctggtaggagtgcacgacggagttcgtccgtttgtaacccttgaagtgattcgccggtgttacgagctggcggaacagcataaagctgtgattccggtggtggatgtagtcgaaacgctgcgccatctgacggatgccggaagcgaaacggtgagccgtactgaatataagttagtgcagactcctcaggtttttgaggtggagctgctgaaacaggcttatggacaggagtttactccgttctttacggacgatgcttcggtggtcgaagcaatgggcgtacccgtacatctggcagaaggtaatcgtgaaaacataaaaataacaactccctttgacctgaagatcgggagtgctctcttgtaaatgttcgatttaaccacacgcgacatcaaatttatctccggtgtagggcctcagaaggccgcagtattgaacaaggagttggaaatctactcgttgtacgatctgatttattattttccttataaatatgttgaccggagccgcatctattacattcacgaaatagatggcaatatgccgtatatccagctgaaaggagagattctcggcttcgagacgataggcgaagggcggcaacggcggctgacggcccatttctccgacggtacgggaatcgtcgacctggtgtggtttcaaggtatcaaatatatattaggcaagtataaacttcacgaagaatacatcatcttcggtaagcctaccgtgtttaacgggcgtatcaatgtggcgcatcccgacatcgacaagccggatgatctgaaactttcttccgtcggactgcaaccttattataatacgacggagaaaatgaaacggagctttctcaattcgcatgcgattgagaagatgatggctacggtgatccagcagatacaggaaccgctgccggaaacgctttctcccaaaatcctgtcggaccatcatctgatgcctctgacagaggcactccggaatatccatttcccgacgaatcccgattcgctgcgcagggctcagtatcgtcttaaattcgaagaactgttctacgtgcagttgaatatcctctgctatgcgaaggaccgccaaagacgatatcgtggatatatctttgaacgggtaggggatgttttcaatactttctattcgcagaaccttcctttccagttgacgggtgcacagaaacgggtactgaaagaaataaggaatgatgtgggaagcggccggcagatgaaccgtctgcttcaaggagacgtgggtagtggtaaaaccctggtagcattgatgagcatgctgcttgcactggacaacggttttcaagcgtgcatgatggctcccaccgaaattttggcgaaccagcattacgagacaatcaaggaactgcttttcggtatggatatccgtgtcgaactgctgaccggatctatcaaaggaaagaagagggaagcgatcctgaccggactgctgacgggagacgtgaaaatcctgataggtacgcacgcggtcattgaagacacggtgaacttctcttctttgggactggtcgttattgacgaacaacaccgcttcggagtggcacagcgtgcccgcctctggacgaaaaatatacagccgcctcacgtgctggtgatgaccgccacacctattccgcgtacactggcgatgacgttgtatggcgatctggatgtttctgtcattgacgagctgccgccgggacggaaaccgataaccaccattcatcagtttgacaaccgtcgggaaagtatgtaccgcgccgtacgcaagcagatagaagaaggacggcaggtgtacatcgtctatcctttaataaaggaaagcgagaagatcgacctcaagaacctggaagaaggttaccagcatatcttggaagagtttcccggctgtaccgttgccaaagttcacggcaagatgaagtctgcggagaaagatgagcagatgcagctctttatttccggacaagctcagattatggttgccactaccgtcatcgaagtcggggtgaatgtccccaatgcttctgtgatgatcattgagaatgccgaacgcttcggactttcgcaactccatcagttgcgcggtcgggtgggacgtggcgctgaacagtcttattgtatccttgtgacgaactacaaactgactgaagacacgcggaaacggctggaaataatggtgcgcaccaatgacggctttgaaatagcggaagcggacttgaaactgcgtggtcccggtgatttggaggggacgcagcaaagcggcattgccttcgatctgaagattgcgaaccttgcccgtgacggtcagctgttgcagtacgtccgttcgatagccgaagatatcgtagataacgacccgtcggcccaaagtccggagaacgagattctgtggcggcaactgaaatctctccggaaaacgaatgttaactgggcggctataagttgaaaaacggttaaacatgcagtttatttgcgggaatgtgttgcaaaacatgtttcttttctattcctcctatttatagggctttaacgccgcttttcctgttctttttatctccgtacttctgaaaaatagttaatgacttacttgccctttcatcggaaaatactatctttgggggaattttttatagtaaatgtatagtttaatcttttgaaagtcacacatcatgatcgaaaaaacgctggttattttgaagccgtgtacccttcaacggggattggttggtgagatcactcatctctttgaacgtaaaggactacggttggccggcatgaaaatgatgcaactgacggatgaattattaagcgagcattatgcccacctgagcagcaagcctttctttcagcgcgtgaaagattcgatgatggcaactcctgtcattgtttgttgttacgaaggtgtggatgctattcaagcagtccgtacgttggcgggaccaactaatggacgtctggctgcgccgggaaccattcgtggggattatagtatgagttttcaagaaaacatcgttcatacttccgattctccggaaactgcggctatcgaattaacgagattttttaaacctgaagagatattcgactacaaacaggcgacttttgactacctgtatgcgaacgacgaatattaattgaattgacaagaacgaatgaatttcaattgcattattaaaacaggattggtagctgtagcagctatggtcagcctgagctctttctctcaagacctgattgcccgccaagctccgatagacaagaaattaaaaaccgtagactctttggcacttcagaaacagatccgtgccgaacagtcggaatatcccgccttaagtctttatccaaactggaacaaccagtatgcacatgcttacggcaatgctatcatccccgacacttataccatcgacctcacaggcttctgtatgccgactccgagtacgaagattacttcgcctttcggtccccgctggagaagaatgcacaatggtctggacctgaaggtgaacatcggtgacacgattgtagctgcctttgacggtaaagtacgtatcgtgaagtatgaacgcagaggatatggtaaatatgtagtgattcgtcatgacaatggattggaaaccatatacggacacttgtccaaacaactcgttgaagaaaatcaattggtaaaagccggcgaagtgatcggtctgggtggtaacaccggacgttctaccggttctcatctccactttgaaacccgcttcctgggaatcgccatcaacccgatttatatgttcgacttcccgaaacaggatatcgtagccgatacttatactttccgcaagacgaaaggtgtgcgtagtgccggttctcacgacactcaggtagccgacggaacgatccgttatcataaagtgaagagcggagatacattgtcacgtatcgctaaagtgcgtggagtatcggtcagtacgctttgtaagctgaaccgtatcaagccgacgaccaccttgcgtatcggacaagttttacgttgttcgtaaagatgtaatacaataatagctttggaagagggcactttaatataatttagagtgccctctttctgtttttacttaattattgttacctttgcgcactatttggaagaagatgaaagataccaagcaacaatttgaacatgtcattgccttgtgccgtgacttattctccaagaagctgcacgattacgggcctgcatggcgtatcctgcgtccggcttcggttactgatcagatttttatcaaagctaacaggattcgcagtatcgaaaccaaaggggtgactctggttaacgaaggaatccgttcggaatttattgcgatagtcaattatggcattatcggtctgatccagctggaactgggctacgccgaatctgccgacatcagcaatgaggaggctttggctttatatgacaagcatgcaaaggaagcgctggagctgatgcttgccaaaaatcatgactatgatgaggcttggcgcagtatgcgtgtgagttcctacacagacttgattctgatgaagatataccgtaccaagcagattgaaagtctggcagggaacacgttggtgtcggaaggtatcgatgctaactatatggatatgattaattattcagtattcggattgattaagatagaatttgaaggataagaacttacatatcatccagaagacaggagcgaatgtctgccgtttccttttagcggcatcgttcatcttttccggttttgtgaaggctgtcgacccgctgggcttccagtataagatacaggactatctgaccgccttcggggtgatttcatggtttccttctttcttcccgttgttgggaggcataatattatccgccatcgaattttcaatcggtatcttcctgttcttcggtatcaagaaaacaatctccaccacattggcgttggtgctgatgatcttcatgacaccgctgacgctgtatctggcgattttcgatccggtgtcggactgcggttgtttcggcgatgcctgggtattgactaactgggagacatttgcaaagaacatcgtactgctgcttgccgcgattgctacattccagtggaggaaaatgctgatcagattcgtgacccgaaagatggaatggctgatttctctgtacacgatattctttgtatttacactgtcgttctattgtctggaccgtctgcctgtgctggacttccgtccttacaagatcggacagaatatcatgaaaggcatgagtatccccgaaggagcgaagccgagtgtatatgaaagtgtctttatcctggaaaagaacggggaaaagaaagagtttacactggacaattatccggacagcacatggacctttgtcgatacgcgtaccattctgaaagaaaaaggatacgaaccttcgattcacgacttctccatgatggatctgagcacgggtgatgatatcacggaagacgtgctgacggatatgggatataccttcctgctggtggcacatcgtattgaagaggcggacgacagtaacattgatttgattaatgagatatatgactactcggtagagcatggttacagattctactgccttacttcctcaccggaagagcagatagaattgtggaaggacaagaccggtgcggaatatcctttctgccagatggacgacattacgctgaagacgatgattcgctccaatccgggactgatgctgataaagaacggtacgattctgaacaaatggagtgatgaagacattccggatgaatatgtactgactgacaaactggagaatctggaactcggtcagcagaaggtccggagtgacgtacatacgattggatacgtattcctgtggtttgtcattccgctgttgctggtgttgggagtggacattctgattgtccgccgacgcgaacggaagaacgaaaagcggaagcagcaacaggaagtaaaagaacaataaatttattaaccctttaaataaagaacaaaatgagaaagaacattgttgcaggaaactggaaaatgaacaaaacccttcaagagggtatcgctttggcaaaagaactgaacgaagcattggctaacgaaaagcccaactgtgatgtaatcatctgtactccgtttatccacttggcatctgttactccgttggtagacgctgctaagatcggtgtaggtgctgaaaactgtgcagacaaggcatccggtgcatatacaggtgaagtttctgctgaaatggtagcttctacaggtgcaaaatatgtaatcctgggtcactcagaacgtcgtgcttactacggtgaaactgttgctatcctcgaagaaaaagtaaaattggctctggctaacggtctgactccgatcttctgtatcggtgaagtgctggaagaacgcgaagctaacaagcagaacgaagtagtagctgctcagatggaatctgtattctctctgtctgctgaagacttctctaagatcatccttgcttacgaaccggtttgggctatcggtacaggtaaaacagcttctcccgagcaagctcaggaaatccacgctttcatccgttcaatcgtggctgacaagtatggcaaggaaatcgctgacaacacttctatcctttacggtggtagctgcaagccttctaacgctaaagaactgttctctaaccccgacgtagacggtggactgattggtggtgctgctctgaaagtttctgacttcaagggtatcatcgatgcgttcaatgcataattagaatatctttcgggaactgactaaaaagtagatagtaactctaaactctcctccttccagaaggaggggaattgcagatagtatcgactttttagccacttcctgaaattaaacttttatcgaatgagaaaactaggtttacttttatggatgctggcttttaccgctgttggtgcacaggcgcagaacatcatcaagagtctggaacgtacagtgccgggacagggaaaggtgacgattcatcaagaccctaagatagaggcattgataggcgtggaacgtccttctatgggcgaacagaaagtgttgaaggcagccggattcagaatacaggcgtatgccggtaataatacccgtgaggcaaagaatgatgcttatcgtgtagcttcccgcatcaaagagtatttccccgaactgacgatttacacttcgttcaatcctccccgctggctttgtcgtgtgggtgatttccggagcattgaagaggcggacgcgatgatgcgtaaactcaaggcaaccggtgtattcaaagaggtctctatcgtcaaagaccagatcaatattcctttataattgtatcatgttagaaaaagaagaaattgtctctccgaatctggaggagttgaaaagtcattatcacagtattattactttgttgggtgaagatgccggaagggaaggtttgctgaagacccccgaacgtgttgcgaaggctatgctgagtctgacaaaaggttatcacatggaccctcatgaagtgttgcgttcggctaagtttcaggaagaatacagtcagatggtgatagtgaaagacattgatttcttctctctctgcgaacaccatatgttgccgttctacggaaaagcacatgtggcatatatccctaacggctatatcacgggattgagcaagattgcccgggtagtcgatatcttttcccatcgcctgcaagtgcaggaacgcatgacgctgcaaatcaaagattgtatccaggagacactgaacccattgggagtgatggtggtagtggaggcaaagcatatgtgtatgcagatgcgcggcgtagaaaaacaaaattctattactactacttcagactttacaggagctttcaatcaagccaagactcgcgaagagtttatgaatctgattcagcacggcagggtgtaatacgctttacaaaatgtggacgatgtagttccccgtcaatgaggattgcctccggtaccgatgaaggggtgtctcggcaccgatgagaaatttagcgtaatacaacgcggtcgcccaggcgcttcgccatcagactttgcacttcccgcatctcattataacgctgcatcagcgaattacatttctcattgtcatgagcgagtgccggatcttgcagggcataaagcatatgtttcagttcttccgtgacaatcgcatacttgaagttgatcatcaacatagggacgagttcgtacagccgttcttcatctgtcacgatcttctgtgatttcgagtgatatttacttagctgataacgtacattgatcaagtccacgctcaaccggctgatggtctggtcgggatgtgccaggaaatagcgttccgcgataaaaccggcatcgtgtatatgcgtggcggcttctgtcagaatctgtcggtgcaacggattatggaaagccaggtcgtcttccttcagatcattcaccacatattcgataacggttaccggaatttcatttccttcttcgtcggtaaggttgcacatcactttttcaccataacggactactgcctgcaggatcaatcgctcaaacttatagaactcctgaccttcttttccttcctgcggaataaaggaggtataagaatctccgggaacagtggtatccgtagtggaggcaggtgcattgccgggaggaaatcctgctgcacctcctgtagcagcggacatcggatctgcgaaagatacgatattgccatcgtcatcatattcgggttccggtggcattcctgcattggcgtagggacttgatggagtagaataagtcggagcaccggaataagccggtgtgccggaagcggcagctgtaccggaagtatctccggttgttgaagatgaatgattatagctgggacgattggctttttcagcctgcgcctctcttaatttggcgacttccgctaccagcagtttttcttcgatgcgcagatgttggctgcattctttgatgtagacatcccgtataatggcttccggtatgacggaaatgcttcgtacgatattcgaaatcagttccgcgcgtttgatcggatctcttcccgcgtcttccatcagaaggtcggtcttgaagcggatgaaatctttctcgtgctcacggatgaatgcctggaattcttccgaattatgtttgcgggcgaaggagtccgggtcgtctccgtccggaagcaggcatactttgatgttcatgccttcttccagcagcatatcgattccgcggatagaggctttgataccggctacgtcaccgtcatagagtacggtaatgttattggtgaaacggtggatcagacgaatctgtcccggcgtcaatgcggtgcccgatgaagcgactacgttttctatgcccgactggtgcatggagataacgtccgtgtatccttccacaaggaaacatctgtcctgcctgacaatcgcctgtttggcaaaatagattccgtatagctcgttactcttgtggtaaatttccgactcgggagagttgacatatttcacctttacccctttggtggcggtgctgagcacacgtccgccgaaggcgaccacctttccggaaagggtatggacggggaaaatcacacgtccccagaagcggtcacgaagacggtggtcatccgtttcgtagcagattcccgttttcaccaggaattctttcttgtagcctttgcgcaatgcttcttgtgacatggcatcatggctttccgtacagtaacccaactggaatttctcaatgatgtcatcacgaaatccacgctgacggaaataagccagaccgatgctgcgcccgtccacatgattctttaagatattctgaaagtaatcgcgggcgaagttgttgacaatgaacatactttcgcgcgttgtctgcgcctgtttctcttcattggtcagctcccgttctttgatttcgatgttgtatttcttggcgagatatttcagtgcctcgtaatacgacatctgttcgtgctccatgatgaagtggaccgagtttccgcccttaccgcagctgaaacacttgcaaagtcctttggcaggggagacgctgaatgacggagtcttttcgttgtggaacgggcacagacctacatagttcactccgcgtttgcgcagggtgacaaactcagacactacatctacaatctgtgcggcatctaaaattcggtctatggtaacttgatctatcattcttcttttctcctgtgattccgtttttgcggatacaaaggtacatataaaaaaatcccctgcaaagaactttcttgcaggggatggttaaatcttatcgaaggagaggatgatttacttgatcttttcccgaatcttggtgaggtaggctttcataccttccgcatctttcttttcgatgatttcgagaagattcttcagctctgtacggatattggccacttgtcccggggtgcgtgggttgaacaggatttcctgcagcaggtagtcatcttcgctcagcagcccctttgcgatagccatgtgcttcttgaaagttgttcccggagcttcctgatgcttcatcacggcagcaaatacgaaagtcgaaacgaatgggatggagagcgagtatgccaccgtttcatcatgttcgtcgaacgtatattcgaagatgttcaggcgcagcgtctggtaaaggtctttgaagaaaatctttcccaaatgatctccttcgctgatgataatcgcattctcgctgctcagattgctgagactggcaaacgtcggtccgaacatagggtgactggaaacgtagcggaatccgctttcttcgtagaacttcttcagtcctgtctttacggaagcgatgtcactgatgatacagtctttgggcagcacaggcaataccttgcggaaagcatccagcgtgtattttacggtgacggcattgatgaccagttcgggttcgaattctttgatttcctccagtgtggtgaaacgatacgtgttatacacgaaacgcaactggtgcgggttgacgtcaaacacggccgtctcgtgctgaaaactcagtatatccgtaaagaaggaacccattttaccggctccgaggattaatattctcatatctattattattggggagtttctcaaaagtcaatagtctctctaaaagttaatagtatctcacattggggtgactaaaaagtcgattctatctctattctcctccttccagaaggaggagagttaagatactaccgactttctagtcggtctcagttgtgttactgctgacttatttgttagtttccatttgatttttgagttcttttgggctttttatttattaataatctctatctgctggcggacagactcttcgtggattgcttcgaagatcagcttcataaagtctgcgctcataccgcattgttctccttgcgcaccgcgcttttccaggatttcattgtagcgtcctgcttgaagaacggtgattccgtgttcttttttgtaagtaccgatctcacgtgctacgcgcattctcttagccagttcctggatgatgttatcgtcgcattcgtcgatttgcttacgcagttggcttaggctttctgtcgtctgggtttcggtacggatcaccaataagttgaggatgtagtcgagtacatcgggcgttacctgttgagaagcgtcgctccacgcacagtccggattgcagtgactttccacgatcagaccatcgaagttcaggtccattgcctgctggcagagcggggcaaccagttcgcgttttcctccgatgtgactcgggtcacagaaaatcggcaggttaggcagacggcgacgcagttcgataggaatgtgccattgcggaaggttgcggtatatttttttgtcgtagctgctgaaaccacggtggatagctcccaaacgcttcaagcctgcgttgtggatacgttccagtgcaccgatccacaattccaggtctgggtttaccggattttttaccagcacggggatgtcgacccctttcaatgcgtcggcaatttcctgtacggcgaaaggattggctgtggtacgtgcgcctacccaaaggatgtcgattcctgctttcagacattcgtaaacgtgtttggcagtcgctacttcggtagaaacatacatacctgtttctttcttcacttccttcagccaggcaagtccttccacaccgattccttcgaaacctcccggtttggtacgcggtttccagataccggcacggtatatcttttgtcctttggctgccagttgtttggcggtttccattacttgttcttcagtctctgcgctacacgggccggcgataacaatcggtcttttggcttcgatgcccggtaataaaattgattcgagttccatattcttattgtttttattttattcttgttcttactctttcgggcaggcgtttcctggtctgccgctgatttacttttatcggtcttttctttttaagaaagcttcttgattctttccaatgcttccgccagtttggcatccttgcaacaaagggaaatacggataaaccttgctccgttgctgccaaagatgaatcccggcgtgataaatacccttgcctggtgcaatactttttcggtcagttcttctacatccttgcacgaagcgggaatctttccccaaaggaacatacccacctggttttcgtcgtaggtacaccccagtgttttcatgatttcgccggccagatggcgacggccgcgatagttgtggttgttaccttcgtaccagtccgcttcggcttccagagctgtggcggctgccagttgcatggcacggaacataccgctgtcgatattgctttttactttcagtatccattgtacgaattcggcattcgaagccagcattccgatacgccatcccggcatattgtggctcttgctcatggagttgaattcgatgcagcactctttggctcccggtacgctgagaatactgatcggcttttcgttcaggataaagctgtacgggttgtcattcacgatgacgatattcttgcggcgtgcgaagtctaccagacgttcgtagagttccggagtagcgttggctcctgtcggcatattcggatagttggtccacattagtttcacgcggttcaggtccatcttttccaatgcttcgaaatcgggcatccagccgtcttcttctttcaggtcgtagctgattacttccgcaccgagtattttactcagagaagtataggtggggtatcccggattcggcaccagtacctgttcgcccggattgacaaaagccagcgtgacgtgaaggataccttctttggaaccgatcagcggctgtatttccgtattcggattcagttccactccataccagcgttgataccaggctgcgaaacctttacgaagttccggtatgcccacatacggttggtaaccgtgtccgttgggatcgtgagcattgttgcacaatgtttcgatggtaacctttgaaggaggcatatcgggacttccgatacccagactgataacgtcttttccttctgcattcatttgtgctacctctttcagcttctttgagaagtagtattcgctgacacttgccagtctttcggcaggagcgattttatacgtttgactttccttctgcatattcgcctaatattttaagttctttggttaatggagtaattgctgctatagattgtttatatctcagataatcattgaaagatacatcgacgtaaaactgatattcccattcccgtccgatgatcggcagcgattgtatctttgtcagattgatgttgtagaacgaaagaatggataatacttgcgacaggcttccttctgtgtgtggcaatgtgaataccatgcttgccttgttggtcgcctttgcgtgatgctggcggagttcgtccacttgccacggatcggcaactaccagaaaacgggtgaagttgtgcttgttggtttcgatgccttcttggagcactttcattccgtagcgttctgccgccgttttcgagcaaatggctgcatgccctttcaggttttctttcttgatgatttccgcgctgcgtgccgtatcttctccttccactactttgagttgcggatgctgattcagaaaatcacggcattgcatcagggcgatagggtgggagttgacttctgtcaggtcttcccagctttcttcgggcaggcagacgaagctatgtgagatgcgcagcttgtattcgccgataatctgcgtaccgctttgtctcaacagttcattgttgtgcagcaggcttcccgctatcgtattttcgatggctagcattccgatgacctggctgtctttccgtatcgaagtaaacacgtcttcgaagttggcagaacagattaactctatttcttctccctcgaagtacttgtgtgcggcgatatcgtgatatgagccgagtgttccttgaattgctatctttttcattgttctaatagggttatataaaaaaatcccgcgtccatatggaagcgggatttatatgattaatttcttcatctcagtccttaagcatcatgtcacttgatacatacaaactcccgctctactttctggctaaagtaaaagtaaaaaaagaagtaatatgcataagaaaatgatttcatacgaatctttgtttctgctttggtttctaattctggggcaaaagtaataattttctgttagatgcgaacaaaaagcgatactttttttgttttcttctctaaaaaagatgaaaaggtcacctgatatgacagtaatgtttcagttaaaaatgagtatataccgccgtctgcctagaagattcccgggagtgcttccggtttcggtcccaggttcttgaattctccgttcagactagcttcgtcttttggattcagctccagtgacttcttcatgtcttctacggaaccgtctttatcaccgttcagtagtttggcgcgtccgcgttctttataggcttcggcgaagttcgggttcaactcgatggcttcgtcaaacagggcgattgcttccgccagtttcttctgattgatataaagctgtcctagatagagataggcttgttcgttgaatgggtttatttccgttacgaacttgtagtccgtttccgcttcttcttcctgtccgttggcttctttcaccttgccacgcagcaggatggcggtctcttcttccggattctgggcgagtacggcgtctatgtcttccattgtttccttgtattgcttcattttcagcagagcttccgcacgcatcagacgggcttcgatgaagtcgtctttcagagtgatggctttcgtcagatgagcgatggtcatgatttcgtcatcctgtcctttgcgggcttttccgaggagaaagtgtgcgactgcatttccctcttcgatggcgattgctttgccggcagcctcttccattgctttgtaatcttcttggatgtagcagacattggccagtgtgaggaatgtgctggtcacatgaggttccattactgccattttctccagaagttcgcgggctttttcggtttctcccatcgggatgtaaagttggctgagatagcccatcgtttcgaaatcctcttcgatggcaagcgcctcggtaaagcactttatggcataatccggacgtcccatgcgttgtgcacgcaaaccgtcatatttgaatatctcgaagtttttctgatcgtttttctgtttttcactctccggagtttcggacttaccggagaaaaaagacttaaaaaagttcggcatgatagtgttgttttagagtttatctgcaaatgtaataacttattttgaaatatgtagcattccgtcctgcatcttcagctcgccttcgtccaataaatatcggattacttgtccgatatcctctttttccgcctttatctgatcggctgtttcggcaggagtgagagggctgtggctgagtaagtcgagtatttgccttttcacttcttcgtaagattcctcggataagttgtcggtggcacgcttgctgaggcagacatcgcattgcccgcagttgtgttcgtttttctctccgaagtagcggagaagcatccggctccggcatatgttttcggtggtgacgtattcttccattgccttgatgcgtgcttcatagcgggctttgcgctcttcgtagacgctggcgggaatatgcaggaagcgtaattccagtcgttcgcgcgtatatataatataaggtgtctttttgcggggaatgtagtccacgatacggcgtttggttaacgtcaccaatatattatagatttgctggcgtgtcagtccggtgcggacggcaagagactcttcgctgatgtaggcataatcggtgaaaactcctgtgtatgagcgaagaatactctgtatcagagcttccgcctcctttcccatctcccgcaacttgtatagttcgtcccgacggatggtaaagagaatccgtgatgaattatcctgttcgtccgtgtattccagatagcctgcctgagtcagtattttcaaggcactgtctaccggcaccggaaagtatttgaacttccggcagaactcttccagattgaattcacggatacattgaaaaccgtcgcccatcgccatttggtaatagtactggagatgttcgtagacattcagaatgtactctttgtcggggaaggtgtcgaccactcgtttatggagtgttgtcttgtccgatttggagtacaggatgacggcataggctttctctccgtctcttccggcacgtccggcttcctgaaagtaggcttcgggagagtcaggcaggtcgagatgcagcacgatgcggacatccggcttgtcgatacccatgccgaaggcattggttgccaccatgacgcggacttctccgctttgccagcgtttctgccggaggtctttgacggcgttatccagtccggcatgatagaagtcggcggttataccttcgttcatcagcagttcagtgatttctttggtacggcgtctgttgcggacatagatgatggcactgcctgatattcgttgcaggatatataggagttctttcgttttgttgtcggttttgcgcacgatatatgccagattcttccgttcaaagctcattcggaagacatttccttcccggaatttcagacgggcctgaatatctgttacgacttccggagtggccgtagctgtcagtgccagtaccggaacttccggcaatagttcccgtatctctgcaattttcagatatgccgggcggaagtcgtatccccattgtgagatacagtggctttcgtctaccgtaatcatggagactttcatcgaacgcaacttggtgcggaatatttccgtatccagccgttccggagaaatataaaggaatttgtaattgccgaagatgcagttttcgagtgcggtaagtatttcctgccgcgtcatgcccgaatagatggcaagagctttgatttcccgcttccgcagattctgcacctgatctttcatcagggcgataagcggggtgatgacgatacaaatgccctcttgggcgagagcgggcacttgaaatgtaatagacttaccgcctccggtaggcatcagtcccagtgtgtctttgccttcgccgatactggtgatgatctcctcctgcaagtcgcggaaggagtcataaccccagtattgttttaatatctcctgatacttattcaatcggctttatatcctcgatttgaagttggacttcgccacgcttgtgcgtgttctcctcgatcgtatagcagatgtcgaatgaacgcttcgtcttgatatagcgcacatgagaactctgtccgaatgcgatgccgttcatgacgttattcgacttgttgtcaaccagttccagcttgatatgttcctgatcgcgtcccactactttgctggttccgtagtcatagacgtgatgcgtacagaagatcggtttgatattgtccggaccgaaagggttgaatttcttcaggtcattgaagaatttcgatgtgatgtctctgaagtcgatctccgcatctatattgatgacggcgctggtttgttccggcagaatatgttgtgacacatattcttcaaatcgtcgggtaaaggcttccacattctccactttcatggataaccccgctgcataggtatgtccgccgaagttctccaacaggtcgcggcaatgttcaatcgctttgtacacatcaaatccggagacggaacgtgcggaaccggtggccatatcatccgtccgtgtgagtactactgccgggcggtagtaaacttctgtcagacgggatgctacgatgccgatgacacctttgtgccattcctcattataaagcacgatggaacggcgttcggacagcccttccagattggccacaatattgttagcttcttctgtcatgctcttgtcgaggtctttccgggtttcgttgtactgattgatctgtcccgctttctccagtgcggcagaaaagtccttctctgtgaggaggtccaccgcttccttaccgttctggatgcgtcccgatgcgttgatacgtggtccgattttgaacacgatatcgctgacggtgatctccttttcggagagtccgcatacatcgatgatggctttcatgccgacgctggggttgctgttcagttgcttcaggccgtgataggcgagaatacggttttcgcccatgatcgggacgatgtccgatgcaatgctcaccgctacgaggtcgagcaatggaatcagatgatgaaattcaataccattgttgatagcaaatgcctgcataaacttaaaaccaactccgcaaccggaaaggtgggtgtatggataagtgttgtccaggcgtttggcattcaggattgcgacggcaggggggaggatatcgtccggcacatgatggtcgcagatgataaagtcgattcccttttctttcgcatacgttatttcctccactgctttgattccgcagtcgagtacgatgattaatcctacgccagtctctgaggcatagtcaactccttttttagaaatgccatacccttcgttgtagcggtcgggtatgtaatagtcaatgttcgaatagaactgttgaataaacttgtagaccaatgctacggcagtagtaccgtctacatcataatctccataaatcagaatacgctctttctttcccatcgccttgttcagacgttctactgcaatgtccatgtccttcatcaggaacggatcgtgcaggtcgggcaattgcgggcggaaaaacttcttggcatctcctgccttcgttattccccgctgcaccaaaagttgtccaagtatcgggctaatgcctaattcctgggccaatgtctggcttgtctctgcctgttcgggtgtaatgggttgataattccatttgtgattcattttatatattgttttttctttttctgttctcaggggtcagaaaggcgctactttccaacaaggggtaaaagtacgaaaaaaagcggaagggtatagtagatatgacgaaaatatttcaaaacctgtggaattagctccttacgggcttggtattcaaatggagcaaatgcatacagatttgaatcaaccgctgattcgcattaatagctaataaagcgaaaatgaaaattaagtccgaagattattctcctcataacatcataaggtattcagttatatgacacaaaaagagaaaggtagtattgtagcaataattcatcgatttacctagaaaataaagaacttttcaaaatcagcaccaacatctatacgaaagactttgactaattatgcagtaacctccaatcatttattaataaattctttcatcgtttattataaacgtcctccaagtttattataaactcggatttcgttattcctgcaataaatatcaatattaagcaacaaaaagggccgcaattcccataaagaatcgcagcccttagcttgtatcagactatccaacaagcattacccggagtgggaatgcctgtaatctgttattatataatacttattattgctcatatttcgtctatattatcaatgttatcgaatttacttccggttttcacttacaaagatacaacattaaaagcggtttgtcaagtcctccatgcttctttcatacatctgattacaaatcacatataaatgaattaatttatatccgaatatattagttatatgacgggagaagtatatctttgtgtgattagttgctacacgaaatatgaatccaaaacttacagactgtttatgagaagaaatcttgttggtatcattgttctaatcttgttgtccgttagggtcgtaaatgcacagactgttgctgactctatagcaatagtgacagctccttgggaagtggtgaccgtagaaaatggaattgtacataagcgggcttccatcccttttctttatcaaggcactcagtccattaatatattggagataaatccgaagactggcaaaaagatcggcattgcctttaccggacaattggaaaaaataagccggattgcccggaaacatcaggccatcggagccatcaacggttcctattttgatatgacgaaaggaaactccgtctgttttctgaaggtgggaagtcaggttgtggacactacttcgttggatgaattgaagttgcgggtgacaggagcagtttatgagaagaaaggaaaagtgaagctcattccttgggacaggcagatcgagaagaactacaagaaaaataaaggttctgtgttagcttctggcccgttgatgctgaaagacggggaatactatgactggagtcagtgcaatgccaattttatagaaaccaaacatccgcgtagtgctatttgtctgactgaagaaggaaagattctgtttgttactgtcgatgggcgatctccggaaaatgctgtcggaatcaacattccggaactggcacatctgcttcatgtattgggtggaaaagatgcgctgaatctggatggaggaggttctaccgccttatggctgtccggtgcaccggaagagggaattgtgaactttccctgtgataacagaaactatgatcatcaaggagagcgtaaagtggcaaacttcctttatgttcattaagagagtattcacatggttgctgttcacttttggagagaggaattatatataatataatgtataagcaagtaatttctattatatagcggacatgattcagtataaaacttttcttatcgctcaggttttggctctccgaagtcaggcagcgatgaggaatggtcctggcaccgggaaggcttatttctttcagtttttcttcttgcgtacgtccttcccttcgaatttgcagattgcctctatccagtcttcggttagcggcatcgactcatgtttttccaggtcgaaagttaccatgatcgatttgcagatacatttcacctctagggtttccgtgtcgatcacccgttggatgagatgaaagcttttggttccaatttcagaaacggcggtttgtacggcaatatgatcggatgcgaaaatctgctttacaaaattggcttcgatatgaacgaccactatgccgatcttttcccagtccactcccggacatacggaggcgaaatattcagtcttccccaagtcatagaaagaaaagtagacagtgttgttgacgtgaccgaatttatctacgtcgttgaagcgcaactggataggcagtgcatgatgaaatacgatttcttccattgttttcccttaatcttttttatttcgacgcaaaagtactacttttgcgtgttattctcaacagaaatagttcaagaaatgatagaagatattaaaaaagcctgtcaggtgatgaatgaaggaggtgtcatcctttatcccaccgataccgtatggggcataggctgcgacgctactaacgaagaggctgtacaccgggtgtatgagataaaaaaacgtgccgatagcaaggctatgctggtactggtagactctcctgtgaaggtggatttttatgtacaggatgtccccgatgtggcatgggacctgatagaagtagccgacaaaccattgactattatttattccggtgcacggaatttggccccgaacctgctggcggaagatggcagcgtgggtatccgggtgaccaatgaagaattctccagacgactttgtcagcaatttcgtaaagccattgtttccacttctgccaatatcagcggacagccgggagcggccaactttactgagatcagcgaagaagtcaagtcggcagtggactatatagtcagtttccgacaggatgatatgagccgtcccaagccctcaagtattataaagttagataaaggcggagtgatcaagataattcgtgaatagatgaaaagagaggagagacagagtttactacagcgttgcatcaaatggcgggaagctaatattaaggaaaagcagtttatcctgatattgagctttctggtcgggatcttcactgcgattgccgctttatttttgaagttccttattcatcagatacagaattttctgacaaacaactttaatgcgacatcggccaactatttgtatttggtatatccggtgatcggtattttcctggcgggatggtttgtgcgtaatatcgtgaaggatgacatcagtcatggtgttaccaagatcctgtatgcgatttcgcgtcgtcagggacgtatcaaacgacataatatctggtcgtctacaattgccagtgccatcacgatcggcttcggtggatcggttggagcggaggcaccgattgtgttgacgggttcggccatcggctccaatctgggaagtgttttcaagatggaacaccgcacgttgatgctgctcgtcggctgtggcgcggcaggggcgattgcgggaatctttaaggccccgattgccggactggtatttacgctggaagtgctgatgatcgaccttacgatgtcttctctgcttcctttgctgatttccgccgtgactgcggcaactgtttcctatatcacaaccggaacggaggctatgttcaagttcaacctcgaccaggctttcgaactggaacgtatcccttacgtgatcttgctgggaatcttctgcggactgatttctctctacttcacacgggcgatgaactccatagaaggggtattcggaaaactcaagaacccttatcagaaacttgcttttggcggtgtgatgctgagtgtgctgattttcctttttcctccgctctacggtgaaggctatgatacaatcgaacttctgctgaacggaacttcggcagcggaatgggacacggttatgaacaactctatgttctacggctatggtaatctgttgcaggtttatctgatgctgattatcttgctgaaagtgtttgcttccagtgcgacgaacggtggcggcgggtgtggtggtattttcgctccttcgctttatctggggtgtattgccggattcgtgttttctcatttcagcaatgactttgccttttccgcctatctgcccgaaaagaatttcgccttgatgggaatggcgggtgttatgagtggggttatgcacgctccgttgacaggagtgttcctgatagccgagctgactggaggttacgatttgttcctgccgttgatgattgtgtctgtcagttcttatttaacgattatagctttcgagcctcatagtatttactccatgcgtcttgccaagcgcggtcaactcctcacacatcataaggataaggcagtgctgaccttgatgaagatggagaatgtggtggagaaagattttgtagccgtgcatccggaaatggacttgggagagttggtaaaagccattgccgcttcccaccgtaatatgtttccggtgacggataaaaagaccggcgaattgttgggaattgtcctgctcgacgatatccgcaacatcatgttccggcaagaactttatcaccgttttactgttaataaattaatgacatctgctcctgccaagatattcgatacggatggaatggaacaagtgatgcagacgtttgatgataccaaagcatggaatctgccggtagtggacgaagaaggacgatatcagggatttgtctccaaatcaaagatatttaactcataccgccaagtactggtacatttttctgaagattgattatgaagaaagaagatttaaggatagtttatatgggtactcccgattttgcggtggaggccctgcgtcagttggtagagggtggttataacgtggtaggcgtgataacgatgcccgataaaccggccggacgcggacacaaaattcaatattctcctgtcaagcaatatgcactcgaacagaacttgccgttgctgcaaccggagaaactgaaggatgaggcttttgtgcaggcacttcgtgagtggaaagctgatcttcagattgtggttgcttttcgtatgttgccggaggtggtctggaatatgccgcggttgggtactttcaacctgcacgcttcgttgcttcctcagtatcggggtgctgctcctatcaattgggcggttatcaacggcgatacggagactggtatcactaccttcttcctgcaacacgagattgataccggaaaagtgattcagcaagtacgtgtccccattgccgacacggataatgtggaagtggtgcacgataaactgatgatcctcggtggtaagctggtgctcgaaaccgtggatgcgatcttgaatgatacggtgaaaccaattgctcaggaagatatggcagtggtgggcgaactacgtcccgctccgaagatatttaaggagacttgccggattgactggaattctccggtgaaaaaggtgtatgatttcattcgtggtctgtcgccttatcctgctgcatggagtgagttggtcagtccggaaggagaagcggtggtgatgaagatttttgagagcgagaagatttatgaggcacatcagttgcctgtcggaacagttgtgacggatggcaagaaatatataaaggtggctgtgcccgatggatttgtttctgtcctctctttgcagcttcccggcaagaaacgtctgaagaccgatgaattgcttcgtggattccgcttgtcggatggatataaaatgaattgatagaatgaactgaccacggtcaagctaacttagaacttaaaacaatagaatgatgaaaccgattatttctccttccatcctttctgccgactttggttatctggcgagagatattgaaatgataaaccgcagcgaagcggagtgggtacatattgatataatggatggagtatttgttcctaatatttcattcggcttcccggtgttgaagtatgtagcaaagttgacggacaaaccgttggatgtacatctgatgatagtcaatccggagaagtttatccctgaagtgaaagcgttgggcgcacatacgatgaatgttcactatgaggcttgtacgcatcttcatcgggtgattcagcaaatcaaagaagctggaatgcagccggcagtgacaatcaatccggcaactcctgttgctttattgcaggatatcattcaggatgtgtatatggtacttatcatgagtgtgaatccgggttttggcgggcagaagttcattgagcattctgtagagaaagtccgtgaattgcgtgctttaatagaacgggccggttcaaaagcattgattgaagtggatggaggtgtgaatttggaaacgggtgcccgactggtggaagctggagcggatgtgctggtagccggcaatgctgtcttcggagcaccggacccggaagagatgatccgccagttacacaagttgtaacggacacattgaatactgcctctttacatcagtatccttatatacgcctgattatcccgtggatagcaggcgttttttgtggagattggttctttgatcaatcgacggaactgttttggagtattctgaactttggtctctttgccggactgtgcattgccctctattttctgaaacggcgttcacttcggtggtgttttggaatatctgtctttgcactttgtttcgcaggcgggtggctaggcattacttgtcaattaaaacgaacggtatatgactttccggagaaggaagcggtttatcgggtacgactaacggatactccggagactaaagaacggacgttgctctgtagggtattgcttaaagagctgcgagattcgtcaggggtatgtccgatagggcgaaaggctattctttatttgcagaaagattcattgtttactttattgaaactgggggataaacaattaaagataggagatgaactgctggtatctgcccgcattgctccacccgctaacggaggaaactttgatgagtttgattatgcccgctatttgatgcgtcatggcattagtggaacggggtacgtagcatccgggaaatgggcgttatggtcaccatctatcaggtatactgcgatgttttgtcaggaaaaggtgataaacctttatcggaagctgggatttgaaggagatgaactggctgtgctttcagcgttgaccgtgggtgagaagaccgatttaagtgactctatccgtgaaagttattcagtatccggtgccagtcatgtcttggctctatccggcctgcatatagggcttttgtatgctttgcttttcctccttttgaaacctctaacaaggaagtggcaggcagggcgatatttccgttccgttctgctccttgttttattatggtcttttgccttttttactggtctgtcgccgtctgtagtccgttcggtaagtatgttctcggttttggcaatagcggaactgttcggacgccaatcattgactctgaatacactggctgctaccgcatgggtaatgctgtttgtcaatccggcttggttgttcgatgttggttttcaattatcttttctagctgtactttctattttgatgattcagaaaccggtctatcagttgttgcctgtgaagagcaggataggaaaatatgtttggggattgatgagtgtatcgatagctgcgcaaataggaactgctccgcttgtaatgctgtatttctcccgtttctccactcattttctgctgactaatttagtagtcatacctttggtgactgtaactttgtatgctgccgttcttatgcttcttctgactccactgcctgccgttcagtttgttatggcgggagcagtcagattcctgttgaaagtgctgaatgattttgtccggtgggttgagcaacttccttatgcttccttggatggtatctggctttatcgtctggaggtgttgggcatctacattttcttgttgcttttcctttattatttgaagacccgaaggttcaggaatcttgttgtttgcttttcctgcctgttgtgtctgggcatttatcacacggtcatgcgctggtatgaccgtccttgtccgagccttgtattttacaatgtccgtggttgtccggcgattcattgtattgctgaggatgggacttcttggctgaactatgccgataccctttctgataagcgccgtttgcaggctgtagcggctaattattggagacgtcatcaacttctgcctccaatagaagtaacggctgattgtcagaacgttgacttctgtcgtcatcagcagattgtattttatcatggctaccgtatttgtatggtgaccgataatcgatggcggaacaaatctgccgcttcgccgttatttattaattatatgtacttatgcaaaggctataacggtcgtctggaagaacttaccggactcttttctccatcttgtatcctgttggatgcttccctttccgatgatcgcaaacagttcttccgggaggaatgtaagagactgcatctgcattttatcactctgtctgaagaaggttctgtgcggtttttgctctaagtacgaagaattatcgtacatttgcaactcgaaaaagaatatggtatgttgactaaagtaatagaacaggcaaaaatcgaccactttaccaagtggtttgagcgcgctgacaaaatagtaatcgtttctcatgtgtcgcccgacggtgatgctatcggctcttcactggggctttatcacttcctggattcacaggagaagacagtaaatgtaattgttcctaacgctttccccgatttcctccgctggatgccgggcagcaaggatatccttttgtatgaccgctataaggactttgcggacaaattgattgccgaagctgatgtgatttgctgtctggactttaatgccttaaagcgtattgatgagatggcggatgccgtggcagcttctccggcacgcaaagtgatgatcgaccatcatctttatcccgaagaattctgtaagattaccatgtcttatcctaagatatcttccacttcagaattgatatttcgtctgatttgccgtatggggtactttagtgatatctcaaaggaaggagcagaatgtatctataccggtatgatgacggatacaggtggctttacctacaattccaacaatcgcgagatttattttatcatcagcgaactcctttccaaagggattgataaagatgatatctaccgtaaagtatacaatacatattcagagagccgcctgcgtctgatggggtatgtgttgtcaaatatggtggtttactcagattacaatgccgcattgatatcgctgacaaaggaagaacaaagtaagtttgactatataaaaggtgacagcgaagggtttgtgaatattccccttaccattaagaacgtatgtttctcctgtttcttgcgggaagatacggaaaagccgatgattaagatttcgctccgttcggtcggtactttcccatgcaatcagcttgcagctgaattctttaacggaggcggtcatctgaatgcttcgggcggtgaatttttcggaacgatagaggaggcgaaagccgttttcgaacaggcactggagaaatataaacctttgttgacagccaaaagctaagaatggaaggttaaaagtagacagagaaaggttaaaagttaccaactttcaactttcccctttcatctttcaatgaatttgagatacatttgtgcagaatatagctaaataacagataatgaagaaacttgtatttttatttctctctttgttggcagccggaggtatattccaggcgtgcgacgattcaaagacttatgctgaaatgttggaggacgaaaagaatgcggtgaataaattcatcaaagataaaggaatccggatcatttcacaggacgaatttgagaagaatgatactgtcaccaatttggaacggaatgaatacgttgccctctccgatggtgtatatatgcagattgtagatcgtggaagtgctgagaacaaaacggatactttcgctaacaacaatgaaatctgcgtccgttatatcgaagaagatataatgacacgcgacactacctgtttcaatgttttcctcgaagagtggggagatgcaaatcagctttacacgaatcctgctgtattccgttatgtagccgaaggcagctatgtgtacggtactttcatacaaatggactattattgggcaagttattatcaatcaacagcagtacctgcaggctggctgcttgcactaccttttgtgcgcaactatgcccatgtacgtttgatcgttccttccaaggtaggacattcatcagcacaacaatacgtcaatccatactattatgatatttggacattcagcaaagcactgaattaacccccatataaatcttagttaaaagacctatgactctaatcaaatctatctctggaatccgcggaactattggcggaggagcgggtgagggactaaatccgcttgacattgtaaaattcacctcggcttatgctactttgattcgtaagacctgtaaggcacaaagcaacaaaattgtagtgggacgcgacgcccgcatctcaggtgaaatggtaaaaaacgtagttgtcggcacactgatgggaatgggctgggatgttgtagacatcgatctggcttctaccccgactaccgagctggctgtgacgatggaaggcgcctgtggcggtatcatcctgacagcttctcacaaccccaaacagtggaacgcactgaaactactcaatgaacatggagaattcctgaatgcggaagaaggcaatgaagtacttcgtattgctgaggctgaggaattcgactatgccgatgtagaccacttgggctcttatcgcaaagacctgacttacaatcaaaaacatattgatagcgtactggctctcgacctggtagatgtggaagctatcaagaaagcgaatttccgtgtagctatcgactgtgtaaactctgtaggaggtattatccttccggaacttctggaacgtctgggtgtgaaacatgtagagaaactctattgcgaacctaccggaaacttccagcacaaccccgaaccacttgaaaagaacctgggtgacatcatgaacctgatgaaaggtggaaaagcggatgttgcatttgttgtagacccggatgttgatcgtttggctatgatctgcgagaacggtgtcatgtacggtgaagaatatacattggttactgtagctgattatgtattgaagcatactccgggcaatacggtttctaatttgagctctacccgtgctttgcgtgatgtaacccgcaaatacggtatggaatatagcgcctctgctgtaggagaagtaaatgtagtcaccaagatgaaagcaacgaatgctgtaattggcggtgaaggaaacggtggagtgatctatcctgccagccattacggacgtgacgctttggtaggtatcgctttattcctcagccatctggctcacgaagggaagaaggtgagcgagcttcgtgctacttatcctccttatttcatagccaagaatcgggtagatctgataccggaaatcgatgtggatgctatcctggctaaagtaaaggaaatctataagaacgaggaaatcaatgacatcgacggtgtgaagattgacttcgctgataagtgggtgcacctgcgcaagagcaatacggaaccgattattcgtgtgtacagcgaggcttcgaccatgggagctgctgaagagatcggtcagaaaattatggatgtaatcaatgaactagccaagtaacagcaatcaactagctttgagcataataagagagggaggactaataaacgagtcctcccttttttcatgcctttctgagatacctatttgttaatgtgaggtttgtaaccgctgaaggcgaaaaaaacttttggtaatttgctaccgaaaatatacctttgtgcatattattatctgattactttccaaaatgctatgagaatacgcctgattctagtttttatcacattgatttgtccattgattagcatagctgacaatgtaaaggatgcctatcttttccaaaaggtggactaccagcagggattgtccaatagcgccgtactttgtctttttcaggataatgagggattgatgtggtttggtacctatgatggggtaaattgttacgatgggaaaagtatggaagtatttcgttcagacttttcggaacaaaagacgctgagcaataacattattcattctattcagcaggcagacagcagttgcttatggataactacacatttgggagccaatcgtttttcgaaggattcacggcaggtaatctgcaattatgaatttgacactgatttcgtgattcattccaaccatgcaggtaatacatgggcgttgagttatgactggattgcctattacaatacccaccatcgccgttttgtgcggattccgatgcccgatattaaaatgctgaaagtagatgttcgcgcgtttgttaccgacgaaggtgaattataccttttcccttatgaaagcggtgacctgtatcgtttctctttaaactctttcgatcaggataccttgtctacgcgtctcactactactccctcacattttcactccaagcagatacagtatgtctgctatcagaatggtgtattctgtttctatgattcggattatgatctttttgtgtatgatatatcaagaaagtctaagatttacatccgtaacattggtgagatggttcataaatatgggcaaataacgggaattgtacctttctatgaggatattgttatcgcattccagacgaatggtctgattcgcttgcgtctttctcaaaagtatgcagaggagattatcgatcagaatatgcgtatctatggtatttataatgactcccggcaaggggtactgtgggtaggaaccgacgggcaaggagccattatgtattccaagaagtattctattgccactaatctgatgttaaacagtttctcacctaatttgacccgtcaggtaaggtcgataatgaccgacaaatacgggggactttggtttggaacaaagggagacgggctgctgcatgtgaaaaactatcgggacggggtacacgcatccaacacagaggtttactcgctggataaaaagcagaatgcgatgtcgtatgtcaagcagaacagggaatttcaggtatactccatgttggagagccgttataggaatggattctgggttggaaccggctcttcgggcttgtgctattattcttttgataatggaaagttgcatgaactttcaaatagggaaacaggaactggaagagaagtggcagaagtgcattccatctttgaggaaagcgatagtgtcctttatctggcgacttcgggtaaaggtttttataaagtaatagtagataacagtaagcaggacgttcaaatcaaatcgtggaagaattatcgtttttaccatgagcaacaagagcttaaccttttttatagtatggtgccacaaggagattccctgttgtggctgggaagcaggcaaaagggattgatacgttttgaccggaaaacggaagagtatcagatctattccctgaatgagattctgcataaatctgtagacgatattctctgtttgcactggcatggagagcaattgtatgtgggcactacctccggcttggtgcgcgttacttttaaagaacgcaaactggaagcggattatatcggtcgtgaacaagggttgcttaatgacatgattcatagtattctggaagatgccaacgggctgctgtggctgggtacgaatcgcggactgatcaaattcaatccggaaaattcattttctcatgcctattattacagcggaggcattcagataggagagtttagcgatgatgcatattaccgttgtccatataccggttgtcttttcttcggaggaatcaacggattgctctaccttgataagaaggtgtcggcagcaccggaatattatccggaaatattattgcgtaagctgatcatagaaaagacatttgtcaatttgcaagaccattatttgccggacaggaaagggctgcggatgcagggagccaatctttcgttttctttattctttgttgtacctgattatgccagtggtggcgatgtggaatactcgtatatgctcgaaggttatgataaggactggggagctttcagcagtgtgaatgaagcatcctatttcagcgtcccgtccggagattatctgtttaaggttcgctataagaaagatgtgtttgctacagaatacaagaccttcacgattcccgtacacattctgcccccttggtatcgcacagtgtatgcgtacattgtttatatactattgggtatcgtattggtaatgtatgtgattcatcttttccgcaagtattttcgtcatgaacggatgatgaagaaactgctggagtcggaaaatcgaaatatatctctggcggcggatagttatcaggcgcgtgaggtgctcaatacttgtactctcatttatcaggcttgtgatcagctaaacgacaagaatatctcctctgaaggacatgcagagaaaataggtcagattcgtgaatccgtgatgtccttgctctttgggtgtgggttgggtgatgaatgtttccgtttgttgtcgtcgctgcatttttcggtttcggggcgtttgtctcttttgaagatggcggaagaggtgcttcaagtacttgaaaaagaaggccatgatgtctcttcgatacagttagacattccggaaaatttcacttatcccgcctataagaatgcgttacgttgtatcctttatttcagttacctttatatttccagttgtaagacagagaaggtatcggtgacggtgacagaagaagcaggttgtatgatgctgacatttgtttctccggatgaaacagtgaaaggattgaaggatgtattgtccggagaagaactcttgtctatcagggcgaaagattcggatgatatgtttaggatacggaccatgcaacgtttcgtgttttctgcattgaagcagcagaatagtgtgatgcgttatataacccctgtagggcaggataatcagttgactatcacattcgatccggttgttgtggcagagcagaatgaagtgagaaaaacagttttgttgttggaagacagggaagagatcgtctggttgatcagtgcgttactttccgatgagtatgaagtccgttcagtgcggagtgtgcagttggcatttgacgagatgcataagtccgcaccgactttatttctggtggatatgcttatgtatgccgatgcggaaagtacctttataaagtatgtcaataagaatcgttctatgttgtcgaagacagcgtttattccgatgttgacatggaaagtcagtgcgtctatgcagcgggagttgattctatgggcagattcttatattgttcttccttatgatataccattcctgaaagaaacgatccataaagtgatttatggcaagcgggaagccagacagatttatatggaagacctggaaggctgggcagattctattgtttgtaccactacggaacaggcggattttgtcaggaagttcttgcaggtcgtggagcagaatctggatcgtgaagatttgggctccacgtttgtggcagaacaaatgttgatgagttcccgtcagttctaccggaggtttaaggagatttcgggtatgtcacccagcgatttgattaaagattaccggatggagaaggccgcccgtttgttgcagaacgaggaactgtctattcaggatgtaatttccgatgtaggtatatccagtcgtgcttacttctacaaagagtttacccgtaagtttggcgtaactcctaaggtatatagagagaagcttttagggaatgacactcataaaaatcaggagtgaacagccaggaagcggtctggtattagttgccaagaaataaattcccatgctgatctgtgctgctttttaaggttggtctcctttgtactctcttttgttttccattatttattattctgatatatagggtattatccagtactctattttaccatctgtactttaaacagacattttttctcttctctgttttttggcgcacaggagtatctcatttctttggctattcctttaatttgcgtcaacgtattaaacgtatttggtaaccttattattattaattaaaaacaagtagtatgaatttgtttggaatgaaaaaacatcgcatcaggtcattatggctactactattgttacttacgtgtagtgtaacagtatgggcgcaaggaagttccgtcacaggccgtgtctctgatgaaaaaggagaactgctcataggggtgagtgttcaggaaaaaggtacaacgaatggtaccattaccgatatgaatggtcagtataccttgaagctttcaacagggaatcctattctgctcatatcttatataggatataagccgcaagaggtaaaggtagcaaagcaaaaaatcgtagatgtcgttttggtggaagatgtgtcgtcactggatgaagtggtagtagtgggttacggcaatcagcgtaaagtatccgtggtaggcgctcagtctacgatggatgtgaaagacattaagatgcctgctgcaagtctgtcttctgctatttccggacgcattgccggggtggttgccgttcagcgtagcggcgaacccggtcacgatgaatcggatatctggattcgtggtttatcttccttgctcggacagagttccagtccccttgtgctcgttgatggggtagaacgtagtttcaacaatatcgaccctgaagatatcgaatcgtttacagtgctgaaagacgcttccgcaactgcagtatatggtgtacgtggtgccaacggagtcgtgattgtgaaaaccaaacccggtaaagtaggcaaaccgcagtttagtgtggactattacgaaagttttacccgcctgaccaagaaagtagatatggcagatgcctacacttacatggatgcacgcaacgaggcgcagatgaatacaagcggtacacttaaatattcggctgcttatatcgaagcgacaaagaaggccaacggtttattgccgaatgacaatccccgattgtataatccttacctgtatccggccatcgactgggcagataacctgttcaatgactggggacacaaccgtcgcgggaatattaatatccgtggtggtgtacctaatgcaaactattatgcttcattgagttactacggagaaaccggtatgacccgcaacttcaagctggagaactacaatactcagatgaagtacgaccgttataacttcacctccaatctgaatctgaagccgacttccaagacgacggttgatctgggtttttccggttatctgggacagggacactatccgcagagcagcaccagttcgctgtacgcagcctgtatggatgtgaatccggttatttatcctttgttgctgcccaacggtaccgtgtccggtatcaactcacagcaaaagttcaacccttacggtctgctggctcgcggaggttattatgatgaattttccagccagttaaattctaatatccgcgtgaagcaggacttggatttctggaagtggagcaaaggactttccgcttctgccatggtagctttcgatacttacaattcacgtaagagaaagtataaccggaatgaaccgatgtacacctttgccggtaaaacggatgaaaacggaatctggatagaagacaccttgtttgatgaagaaacaggcgattacctctactcggtgctgaaagaagcggatggtagcctgtcacttcagacaccggagcaatggagcagccgcacggtgtatacagaagcatccttgaactatgatcgtagtttcggtgctcatcgggtaggaggtctgttgctttacaatcagaaagtatattgggatttgaatgcgacggatgtcattggcggtatgccttacaagcaacgcggttttgccggacgtgctacttattcatggaacgaccgttacttcgcagaattcaatctcggtatcaatggttcggagaacttcagtccgggcaagcgttatggtgttttccctgcttttggtctgagatgggcagtctccaatgaatctttctggaatccggttcgcaaatacatttccttcctcaaattccgctatacggacggatgggtcggcagtgataccgcaacaggcagacgcttcatgtatcagggggtgttcaccggtctgacaggaaccatgttcggaaccaattatacaagtgccaacgggtatggagaagaaaagtacggtgtaaatgtcacttggtctaaatccagaaagcaagatttgggtatcgatatcaagtttctgaatgataatctgtcctttgtagtcgactttttcaaggaacgtcgcgacaacatcttcctgcaacgcagtacaatccccagctacgcaggatggatcgaaaacccttatgctaatctgggtgtcgtagaaaacaaaggtatagagctggcgatggactatacacaacggctgggtaagaagacattccttacggtacgtggcaatctgactttcaataaagacaagattatagagaatgacgaaccgccggtagactatccttggatggagacacgcggtacgaatgtaaatgcgacttggggattcatagccgatgggctctttaccagtcaggcggagattgaagaccatgctacccagttcggaacagtacatgtaggcgatatcaaataccgtgacttgaacggagacggtgtgatcgacaactatgacaagaccgtcatcggacgcggtgatgtccctagaatctattacggattcggtgccgacctacagatcggagacttttctatcagtgccctgtttcagggaaccggacaggctgaccgctatctggacggcatttgtatcaagcctttctgggatgacgaaggccgtgacaatgtctttgccaacatccacgaccgctggagtcccgacgatccgaccaatcaggatgtgttctatccacgcatgtatgtcggcagtgacgccaacacgaacaatgttcagaaaagttcgtggtgggtgaaagacgtcagcttcctgcgtctgaaacaactgaacatatcctataatataccgaaaaaactgctggacagatgtttcctcaaaagtgcaagcgtctaccttatgggtacgaatctgcttaccttctctaatttcaagctgtgggacccggaactgaatacgagcaacggaacagcttatccgaatgtatccagctattcggtcggagtcaagtttagtttttaaccctaaagtcaaataatcgttatgaagaatagaataaaacaatacctgttggctgcatcgatgtgtgtcggactgactgcttgcagtgatttctttgaaccgattcccggtgtgcagtttggactggacgaaacgtttgcctccaagcaaaggacggaagaatatctgaacaatgtatacagctacgtgcgtgaagtgacagatgccattcatccgaacacctacggaggtatctttacagaagcatcgttggacggagcaaaccgctggaacaaaacgtatgcggaatggaccaacggttcctttaactccgcttctgcacaggcaagtgagtacttctcaaagtactatcaggcaatagctaaagcaagtacgttcatccagaacgtagataaatgtacagaagccgccgcctctacacgtggaaagtggaaatcggaagcacgtgcattgcgggcatactattattttgaattgctgcgcctttacggtcccattccgttgattggcgaagatcccattcctttggacgcttccttggaagaactgattaaagaacgtaattcagtagacgaatgcgtaaacttcatcgctacggaattgcagagcgccattgattccggcgatttgctccagagagccgggaaggcaaacctgggacgtatggatgtcgccacttgtatggcactcaaggcaaagctgtacctctattgggcaagtccgcttttcaacggaaatacggatcaggcatcagtcaagaataaagacggcaaacaacttttccctcagactgaagataactccaaatgggctcaggcacgtgatgcgtatgaacggtttatgaccttcgcaaccggacagggatataagctgaccgaggtctatacgaatggaaaactagacccttatgcttcgtgcagggctgcgggcgagtttttcaccacaacctgggaagctgttgatgaactgatttttgtgaagctgagagatttgtacgactatacctactgggtatgtcctaagtttaccgacttccaggataccgacgtgactggcggcggtggctattatacaacccaggaaacggtagacctgttctttacgaaagacggactgaccatcgaagaagaccccggctatgacaaattcgagggtataccgggcgccaacaacttcacatccggaagatattatgaccccaacaacccttcccgtctttactttgacgccgataagtccaaagtgctgaaacagtggaaagaccgtgaaccgcgcttttatgtgaatattacctatagcggctctatctggctgaacgaaggtaagtacaatgaggaaatgcgcacagacttcaccaacggtgcaaacggaacctgcggcaagtccaaagcctccggcgactgtccggattcgggatacttgatccgtcggggtgcgaaagcttctaacaacaacggctcgaaacacttctctccggtacttcggctggcagatatgtatttgggatatgctgaggcgctttgtatgtgcagcgatctcgacaatgccctgacttatctgaataaaatccgtgtccgtgcaggcattcccgaatatacgtttaccgcaacagccggcaagataacctgtccaaagacacagaccgatctgctgaaccgtatccgccgcgaacgtctggttgaacttgtcttcgaatggaaccgctatttcgatgtgcgtcgctggaaagtggcggaaggacagaatgatcccgaacattggatctatccggcatatcacaccggaggcgaaggaggcaaagtatacggtatgaatatggataaggattatccggcattcttcgaaagaacctcttttgagactcgtgtagcatttacgaaaaagcaatatttcatgccgataccttatgatgacctccgtcgtatcccgtcgctggtacaaaacttaggatggtaatacaatattcgaacaataacgcttaaacaagaagattatgaaacattggaaagatatagctttcgggttgtttgtctcgctgacgctggctgcctgctacggtgaggaagacagctttgcaactcctgacatctataaagattatcagcctgtactgaaagacgggaataccgtagccggatatgcggctgcccctctcaaagaggcgaaatatgatgaggtgctgaatgaactttacctcacgtgggacggcagtaactccggctgggaaaagagagacgaatatgtgggagtggaagtagaattcaactccctgctctcaggcaaaaagataaagcgcgtcatgataccgaatgtcggtgattttggcaacctgactgtgaaaaggcgggattatggcaacgagccgaccactctgcgtctgagtaaatatcgtacagtagtggttacagaccgttacggtgtagaggaacttcgtttccgttctatctacaaagatgccgacggtgcccggcagacaagtgactggacgaatctgagcgatcaggcggataagtatgaacttcaagtggatatgaactatgctgtctggcagtattttaaaaccagccaggcgacacaagttcagatttcctttgagagtgattcggagatacgtcccgtttctgcattgtataatctgataggtaacggagatgaggctgctactcaggaagagttccggaaatggtattatatggattgtgcggctatgtcattcgatccctataatctggcttttgacccttacagcaaactgcgtgtctttatcaagaaagaccagaccggaggagcgtatgcgatagattaccccacccataacgaaggaagaggcattgtttatccggcttcggaaagcaatccgaacgatgcgtggtggaaattgccggacatgcagcatgtgtttatgcacgagatgggacactgcgtgcagtggatgcccaaacaaggaaaatatatcatggacggtgtgcaggattgtgaccgacaggggtatcaggaaggatggccggacgctgtgaaagtagcgagcaaaggatatattctggctacgcaaaaagaagagtatcaggccgctatcgccaagtcttaccggaatccgcagagtgataaatactttgtctggcaggttgactataatacttccggtgcttttatgagctggctgcgtctctataatggcgacttcgtacgtatgttgccatggacggtgctgatggacgaactgaccaaccagtggagcctggaggatgcggtgaagtatatcctgaaggagagctacccggaccttacgatggaagaactctggaacgaatacaagacagaggtggaagtgttcctgcaaaataactaatagagcaacctttaaaaaacaactatgatgaagaaagtattatttgcattagctgtgctgtgcacgagcttttggagttgcaataccttggatttgaatgacgtgggctacggagatggtgaccgtctgaaggcttcctccgttaaagaaatattgtatggcacagctgatggctgttggaaagctgactatcaggggcacgagttttacttccagtttcatgaagacggaacagtgacactggattcggactttctggagatggcggtagaaggaaaaacatcattctctgccaaaggcaaggaagtggcactggatattgagaattgcgatgtccatctgcaaaacctgggtagtgaatttgcagataccaagtttgtcgtatcagagattccggcagaaggagaggcgccacaactgaacttatacggtgaatctaccggcaataccattgaactgcagccgactacacaggcatacatcgatggtaaagttgcttcaaaagcggactttaccgaactctttgagaaaaacttattggataatcagtccatctgtgacgcttccggcaattttatcggttattatggcttggtactgaatggtgtcaatgatctttctgtcaaggtaataacgattgaaaacaaggatggaagcgatgcgaacggccatacgcaatattatgaatctaaactgacgaaagaagggcaaatcttcaaactggacacgccggtagaacagattaaatcggtgaacggagccacttatgccttcaaagccattgattgcaccggtgatgcggtggcggtagacggtatgtcaaatgtaaccctgacctccaacaagggagcggtcaatgacttcgactatgtgacttccggaggaaaattcacactcggaaaagcgcaggatcatggtgccgcttgcgatgaaatatgggcgggaacaggcggacaggctacaagctccggtggaacaatcgccgatataaatgccatgagctatgatttcggatggagtggaagcgcgaagcaaagaccgctcgttatctggacatggtggtttgcaaacctcgctttcccgagcagtgaagaaggagcaagcatcctgatgaataattccgataaagaccgtgtcttgtttaagaacatatccggcagcggacagacttgcggcggcggtactcttaacgcgactgaagtagctgagataaatgcctactgtaaagacctgatagatacctggttcaatgagaaagggctttttgttgttcgtcacgaccgtcagagtgcaggagataaattctacatctatcttttgtgtcccgatacggaagccacttcgaaaggtggaatgtggatgaagtatcagagagactgagaatgaatgtgaataagatagtataagctaatgatgctaacgtacttaactaattaataattaataaatgaatagatgatgaaaagactgtttttactgatgatcctgggtgtaacttcggtgttatgcctgaatgctcaaactaagtcgttgcaccagctgcaacaggaattcgttgatttacgctgtggtatgttcattcatttcaacatgccgaccttctttaatgaggactggccggacccggatgctgctcccgagcttttcaaccctgtcaggatggactgcaaacaatgggcaaaagcggcaaaatcagccaacatgacctacggatgtctgacaacgaaacatcatagcggtttctgtatatgggatactaaaacgaccgattatagtgtaatgagcagcccgttcaaacgtgacgtggtaaaagaatatgccgacgcattccgtgccgaagggatgaaagtgatgctctattattcgatcctcgatacgcatgcccggctgcgtcccaagtgtataactccgcagcatatcgaaatgatcaaggagcaacttcgcgaactgttgaccaactatggtgaaataacagctttgatcattgacggttgggatgccccgtggtcacgtatctcttacgatgacgtaccttttgaagatatttatcgtctggtcaaatcaatccagcccaactgtctggtgatggatttgaatgcagcgaaatatcctgccgaggctttgttttacacggacatcaagtcttacgaacaaggagccggacagcatatctcgaaagataccaaccgtctgcctgccttgtcttgcctgccgttacagcagaactggttctggaaagaaagtttcccgactacccctgtgaagtctccggcacaaatggtcaatgataatatcatcccgatgggcaaatcctactgtaactttatcctgaacgtagctcccaacagagacggcttgatggatgccaacgccttgaaagctctgaaggaaataggtaaactgtggaagaacgacggtcgtgtagcaacggttcccgaagcggatgctcctattatatcttccaacattgccaaatatcagcctgccgaaggtacatggagcagtgactatgctatcatggactttgccaatgacgatgatttcgggacctgctggaattctaatcctgaagtgaaagtgccctggtattcggttacttttgagcgcgagaaatctttcaatatggtggttattacggatcgtaacaatgaccgtttgcaggaataccgtctggaataccgtgcgggtggtacatggaaacccctttacgaaggtaaggctcctaccggtctgcgtgtgaaaatccaccgtttcgatacggtttggggagatgcggtacgaatgactgtcttaaactctaatggtactacctccattgcagagttcggggtatattgtgagagaagatgatgaatttatcttagagttaaatcattgattttatatagaatcaccatcaggtaaagtcgtgttttttgatggtgattctatttcatccaactctttatcgtacgtccgtacttccctttttgtgggaattgcgtgtagaataatatttggatttaggccaaacatttgtatcagctttctaatggtctatccgatggcttttgttacttttcttacttattaatgtctcatttatattatatttagtatatttgttcccgctttatctaataagacatgaacaataacacttgctattaatataatgagaagatgtctgatattatgcctttttacatttattggttcgttggtctgttgggctgatgcgggtaaagatgcttatctttttcggaaagtcgattatcaacaagggctttctaatagtgctgtgctttgcctctatcaggataaagcagggctgatgtggtttggcacttatgatggcgtgaattgttatgatgggaaaggtatcgaggtctttcgttctgatttctcaatgaaaaagacgttgagtaacaatgtcattcattctattcagcaggcagatagcagttgtttgtggattactacacatttgggagttaatcgtttttcgcaagattcgcgtcaggtagtgggatattatgattttacaggtgattattatctgcattccaatccgaaaggagatacttgggtagtaagcgatgaaggaatcttttattataatacttatcataaaaagtttgtccatctcaaaaatatagagactcctgtcgagaatatggatcagcgtgcttttgtcacggatgatggtgtcttatggacttttccacggaatacaggtagtctgattcaatgttcattagatggctttgaccgggatacattgtctgtccatcctactgtttcatcttctgattttcatgcaaaacctatcgataatgtattttatcagaatggcattctctgttttgtggatgcagagcgggaactttatgtatatgatatttccagaaggtctaaaatctatattcgtaacctttcttcgttggtgcaacgatatgggaaagttgtgggaattgttcctttttatgaagacattataattgcttttcaaaccaatggtttagtacgtttgcgcacctcgaaaaaatatgaagaagaagtggtggaccgtaatgtacgtatatatgatattttccgcgatcctcatcagaatattctttgggtagcttctgatgggcagggagctgtcatgtacgctaagaagtactcgatagccactaatctgatgcttagcaaactatcatccaatctaagtcggcaggtacgttctgtcatgacagacaaatatggcggattatggtttggtacgaaaggagatggacttttgcatgtacatgattatgaaggtggtatggatgcttctgctactacagtttactctccagtaggcaggcaggatgcctcatcttatacccgttggaatagagagtttcaagcatactcattaaaacaaagccgttatatggatggcttttgggtaggatcgggtaatcccggactgttttattattcttttgcagataaagccttgcattgtgttgaggataagtctgcagatcctgttatcgaaatacatgatatctatgaagagaatgacagcgtactctatgcggttacggctggggtcggatttcgtaaattgatattggagaggaaacaaggggagattcacctcaaatcgcaaaagcgttatcatttcttttatgaacaaaaagagataaccatgttttatcctatgttagctgaaggagattccattctttggttgggaagccgggaaaaagggttaattcgatttgataaacagacagaagaatataaagtcatttctttgaaagaaatattgcataaatctgttgatgatgtacttagcctgcatcgtgctaaagatggtaggatgtatgtaggaacaacatcgggactagtgtgtttgacctttaataaggaacaaatcagtgcctcctatatcggtagagaacaagggttgcttaatgatatgattcatggcatattggaggatgcaaatggttttttatggcttggcactaatcgtggacttattaaatataatcccaaaaacacttcttcgcatgcttattattatgccgccggtgtgcaggtgggcgagtttagtgatgatgcctattatcaatgtccttataccggacgtcttttctttggaggcattgacggtttgctttatctggataaggaagtggcgacagctccggaattctatccgaacatattattgcgtaagctaatgattggacgtaaggaggttaatctgggggattattataccgatggtggcaaagcgttaagttttaaaggagcgaaggcttctttttccctttcttttgttgttccagactttcttactggaggtgatgtggagtactcctatatgctggacggatttgataaagactggacctcgtttagtagtataaatgaagcatcgtatctagaaataccttcgggtagctatgttttaaaggtccgttataagaaagatgtatttaatacggaatataaggtattttctatccctttgtacattcttccgccttggtatctttctacggtagcctatgtcatttacttgctgtttttcatattaatagccggttatctgattcatttattaagaaaatattttctccagaagcgtatgatgcagcggctgttgacagcagaaagcaatgaagctctaccggagtccgccagtcttaatcgtgagttactgaatcgttttacgtccatttatcgctcttgtgatcagttgcgtgcggaaaatctcccttatgaacagcgtctcagaattatggagcaggtacacgagacggttattgcaactcttttccgttcgggaactttggctgtagaggaacttaagtcatttttccctacggaatatgcgattactggttgtatgtgcatgaaagagctctctatagaagtcttgcatgtgttggaaggacagggcgttgatatatcttctgtaaaacttgctataccagaacactttgtttatcctgtttataagaatgctttacgctgtatgctctattggtgttacctttatattggcggagtaaaacataagtcggatattgtagtggatgtgaaggaagaggaaggacggatgttgttgcagttctctgctgtagatgatactctgaaggaattatataagcaactttccggttcggaagaagagggaagaagagatagtaaggaaacagaagaggcgataactacccgccaattactgttttctgtgcaagcggctttgagacagctaaatgttacgcttcactatgccgacagagaaaaggatcatttattgacgttagcctttgaaccggctatcatcaaggagactgaagagcatgggaagaaaacggttcttctgctggaggatagggatgaaatggtatggctgataagtgatctcttagcagatgaatttgttgtttgtccggtgaaaagtgtacaacttgcatttgaagaaatacgtagatcggctcctgctttgttactagttgatatgttgatgtatgcaaaagcagagagtgacttcctggaatatgtgaataagaatcgtactcaactttcgaaaacggcatttattccaatgttaagttggaaagtaagttcgtccattcagcgcgaattgattatgtgggctgattcatatattgtacttccttatgatattatatttttgaaagaagccgtcaataaagctatttacggtactcgggaggcaaagcagatttatatggaagagcttggtgactgggccggacgcattgtttgtactacagaagaacaggcggactttatccggaaactgttgcaagtgatagaacaaaatcttgaccaggaagaattgggatcaaccttaattgccgaccgtatggcgatgagtccgcgtcaattctatcgcaagtttaaagaaatatccaatgcggctcccagtgacttgataaagagttatcggatggagaaggctgcacgattgttgcagaatgaagaactttctattcaggatgttatcgctgaagttggtatttccagccgttcctatttttataaagagtttacccgccgattcggaatgacgccgaaagattatcgggagcaactccgataatgctatccccactatcttattctttactaattgagttttatggatgtattacccgaatccttagatcagtaattccggataattaagtctttcgaggtccttatttattcgttccactatagttgggcgcaagaggaactatagtgcttcttgcgtccaactatagtggaacgaaagggaaactacagtagaacgaatgaatttggactgataagaaattagtttttcaaagtctttcggttaatgattcgggattccttcattccttctgttctttggtcgtttggggtgacagatatatttgaattcatgtctgtatagattttatttattactgcttacgaataaactttttaataaaagtggcgaaaaggcggctattataacttgatacaatgtgcgcaaacttgtgctctgtttgtacgtgaatgaatgctatgtgttgatatatagatgtttataatgtgctttatttctcctttctgttctataaatgagcattttcattttgacataattttgtcacttctgcggaatattcttaatattaaaagtttttaatttgcttccgcttataagaattatataggcgattgataaccttagtattaattaaaaaaaacaaagtaacatgaatttgtttgaaatggaaaaacatcacacaaagacattgtggctattggcattactgctaacatttagtacagtagtgtgggcacaaggtactcctgtaacagggcgtgtgtctgatgaaaaaggcgaattgctcattggagtgagcgttcaggaaaaaggtactacgaatggtaccataacagacaccaatggtcagtataatctgaaactgacgagtaacaatcccattcttatcgtatcctatataggatataaatcacaagaggtaaaagtaggcaaacagaaagtgctggacgtaattcttgcagaagatgtatcgtcactggacgaagtggtagttgtggcttacggacatcaacgtaaagtatcggtagtaggtgcgcagtcatctatgaaaatagaagatataaagatgccgacagctaatttatcttctgctattgctggacgtttgccgggtgtagtagctgtgcaacgttcaggagaaccggggcatgatgattccgatctttggatccgtggtatttctacactggcgggtcagaactctaaaccactggtattggtggatggtgtggaacgtagtttcaataatatcgaccctgaagatattgagtcgtttacggtgctgaaagatgcttctgccacagctgtatatggagtacgcggtgctaatggtgtaattctgattaaaaccaaaccgggtaaggtgggcaagccgcaattctcagtagactactatgaaggttttgtgacattgacaaagaaacctgaaatggcggatgcctttacgtatatggatgctgccaatgaagcgtatatggatactagaggcagtatgttatattctcctcaatatattgaggctacgaagaaagcccatggattactaccgaatgataatccactgatgttcaatccttatttgtatccgaacgttgattggatgaacgaattattcaatgactggggacataatcgtcgtgtaaatgtaagtgtgcgtggtggggtacctaatgccacttactacgtttcattgagttattataatgaaaaaggtctgacacgtaccgctgaaatggagaactatgatgctaacatccgttacgaccgctacaattataccgctaatttgaacttgaagccaacagaaacgactactattgatttgggcttcaatggtttcctttctatgggtaactatccgcagcaatctaccagtgacttgtttgcgtcagctatggagattaatccggtctatttgccgttaatgatgcctgatggttctgtaccaggtatctctaccaatggtgacctccgtaacccgtatgccgatttgactcgtcgtggttacaaaaatgaagcaagaaatcagttgaactccaacattcgtttgacgcaagaccttggtttctggaagtggagtaaagggcttaccgcctctgccatgttggctttcgacgtgcataacagtcgtgacctgaagtataacaagcgtgaagatacttacaattttgccggaactaaagacgaaaacggattgtggaatgatgatgtatttgatgcagatggcaattatcggtatgcactgacctatacaggacataaagatcttgcatttgaccagggcgcttccgactctagaagtacttactttgaagcttctttaaattacgaccgttcgttcggtttgcatcggataggtggtcttttgctttataaccaaaagatttaccgttcgagttctgataatctgatcggttctttgccctataagcaacaaggcttggccgcccgtgctacttactcatggaacgaccgttattttttcgaggcaaaccttgggtataatggttccgagaacttcagtccagaaaaacgtttcggtttcttccctgcatttggtcttggctgggctatctctaatgaggcttggtgggaatctttgcaagaaactgtttcttactttaaagtgcgttatacagatggcttagttggtacggatgctgtaacaggacggcgttttatgtacctagaccagatggcgagcgtagatggttatcgttttggcgaccagaataacggtgttggtggttgggggttcagcaagtacggagccaatgtcggttggtctacttcccgcaagcaagacttaggtgttgacttaaaatttttcaaagacaatctttcgctgacattagatatctttaaagaacatcgtaaagacatctttattacccgacgcgttattcctgattattccgggttcgtagaaatgccttatgctaatttgggagtggtagacaataagggttttgaagctacattggaatatacacagcaactcggtaagaaatgtttcctgactgtccgtggtaacttctcatggaatgaagataaaattatagagaacgatgatccccgggtacagtatccgtggatggaaaaaagaggaacgaacgtgaacggacgttggggatggatcgccgaagggttattcactagtgaagaagagatcatggaccatgccaagcagtttggtgaagggcatccgggacagatttcgaaagtgggtgatatcaaatataaggatttaaatggtgacggagtaattgacgattatgataaatgtctgataggtcagggtgacgtacctaagatttattatggtttcggtgcagatttacaattaggtgatttctctgtcggtgcgctctttgccggaaatgccaaggcagaccgttgtttgggaggaaatgccatgtatccttttaatgatggttcaggtattacgaacttgtttgcaaacattactgacagatggtctgctgacaatccgactaatcaggatgtattctatcctcgtttgcatcatggaaacaatgcgaatcaaaataatatgaaaaccagcacatggtggcagaaagatgtcagtttcctgcgtctgaaacagttgactattgcttaccaactcccgaagaagttgattaatcaaacattcctgaagagtgcgcgtatttatgtgatgggcaccaacctattgacattctctaagttcaaattatgggatccggagttgaataccaataatggtactgcttatcctaatgtacgtacttattcagtaggtgtgaatgtaagtttttaataataatcagttagcaagaaggatatgaaaaatatatttaaaataggaactttggcgctgtgtttggtggtcggacttagttcgtgcaatgatttcttcgatgcaatccccggtgaacaatatgacttggaggatacgtttactaatcgctcgaagacagaacagtttttgaataatgtgtataattatgtgcccgatgaaacattagaacgttctgcaaggaatacgatgtcggggatctggacaaccggttcgttggaatgcaagctttcatgggacggaaataatggtagcgaatgggcttccggagccacctatgcaggttcctcatggataaacttttggtacatcgagtattataaaggaatttctcgtgccagtacatttatcatgaatgtagaccgttgtttggaagcctcggccgcacaacgcaaacagtggaaagcgcaagccagagctttgcgtgctttctattacttcatgattttccgttcctacggcccatttgtgattttgggggaagaaccaattccattggatatttctactgctgaactgctgaaagaacgtaatacggtagatgaatgtgtggcttttatggcgaaggaatttgatgatgcggcaaatgagcttcctgatagatatgacggatccaatttgggacgtatagacagagctgcatgtaaagctttcaaagcgaaaatgttgttgtatgcggcaagtccgctattcaattgtaatcccgattatgccgccatcgttaatccggaaagtggcaagcaactctttccgcaagataaatcgcaggaaaaagcgaaatgggaggctgcacgtgatgcttacaaagaattctttgatgaatacggtaacactttctctttatatacggagaagacagccgatggaaagattgatttctatgaatcttatagaaaagtgacatcgggagttttgtacggtacagagaataaagaacagattttcattcgcttggcagaccatgattaccgggcttacgaaaccacgccttatcacaaggggtacgatgataataatggtgctttgagaggtggtctgggatttggtgtacctcaggaaatggtggacttgtactttatgaaagacggtcgccggattgttgacgatacgaactataaggaatatgagggggtaccttctaatgaatatttgggatggtcgagtgactatactgacgaagtagttccttccagaacctacttcaagagcaattcgaatcaaacattgaaacaatgggctaatcgcgaaccgcgtttttatacgaacattacattccatggttctacttggttgaagacagatactccgcgtggagaaataaccacagaactgacttataacggtaattccggttatgctaatgccaattgggatgccccttacacgggttatggtatgcgtaaaatggcttcaaaagaaggacgtagcggggctaacaggcattgtgcaactttgcttcgtttggcagacatgtacttggggtatgctgaaacgttgagcgcttgtgaccaacgtaatgaagcgattaagtatgtaaataagatacgcgcccgtgccggtattcctggatatggtgcggtaggtactaaggacgataatggatttgcatgcattccttatgaagatacacgtgacggagtggacaaacgtattcatcgtgaacgtttggttgagctgatgttcgaatggaatcatttctttgatgtacgtcgttggaaagtagccgatatggctgtaggcgatgattggatttatcctaaatatcatagaggtggagaaggcggacctattcatggtatggctttccgttcggatgctcctgcattttttgagaaggtagtagtagaaacacgtacatttttgcctaaacattacctcttcccgattcctgacgaagatgtacgtcgtaatccgaagatggtacaaaatctgggatggacaacggagtaatatactccggatgtccgatctgcgaatgaatgaaagaaattaatgaaaagaaaaacaatgaagatacctcaaataagatgtagcgatgtgaatgcagtgaagagaatcatttttcttttggtgctgctaattcccttttgtctggcaggatgttcgtccgacgatgatgaaggagataatggaggagaaggtccgaacgaagatgctccggtttcttatgtacttggttcgggtaacacgaatatgccctccagtggtacaattatagcgcaatatgctgatgctcctgtcggttcggaaatcagacgtttggtagacgataatgctgacacgaagtatgttacttatcatagtagtttcaacatcacttggaatggaaatagtagtaaggctgtcactgcctattcgttgacctcggctgccgatactcccgaaatggacccgaaagattggacactctatggttctaatgataatactacgtggacagaactggatgcgcagacaaaccaactttttgcagcgagaaaagaagagaaaagctatgaagtggataatgcaacttcctatcgttactacagactttctgttgaagcgaacaatggtggtgctgccacgcagatagctgaatggaaactggtggccatgcgttcatatacggagaatatcaacgacttgattgctagtaaaggttccagtacgtttagtgcgataactccgatgggcagacagcatgagaatgacagagaagctacggcagcagacttgaaatggcttgccgatcctgctgaagaacctgaaccatttggagatggtgggacgaagatggcttggaatacattcaatgttgtatccatttatccaaatggaaatcctgtgatgtctgatgtaaatcagcgttgggtaggtgactgctgtgcttgtgcggtgattgcttcgatggcatacctctatccccgtttcgtaaaacacattatcaaggataatatggacaaaacatacacagttactatgtatgacccgaaaggaaaacaaatatcagttggtgtaggtggcgactattttatcggtaatagtggcgatttaggtgccttaggcggcagaaataaagaagtcacttgggctacgattctcgaaaaggctatgattaagtggaatcagatctatcaaggtagttctaatgtcggtggtattggtactgaatatgtttctgctatctttaccggcgacggggaaagtgtaggtttcggtgcaaatgcattgattgccgaagacttacaacgcgcggtggaagtgtcgctcaaacagggtagactggtgatcggtggttttacaagaagcggtgaacaggtagatcaaaattggcagacgaccagtgggcatgcgtttacgtttatcttgccggatgataatactcatcttttcaagatgcggaatccttggggaggtactactgacggtgtgatgaaagtgaaggatgacggacggattccgccgatgattgacttacgtatttgtgcgccgggagcagccaagaattatggagtgggaccggacttgggaggatatatacctaatttctaatttcaaatcttaaaagaaaaacatcatgaagaaacttatttatataatgttgtcgttgtgttgcctggttttttatagttgtggcatgacggaaccttggaaagactgggaacatgaaggtgacatgagtgcagaccgcttgcgtccttcagaggtaaaagaactactgtgtgcggcagacggatggaaaatgatttatcaaggagtaacgttctactttcagtttgatgaagaaggaaatgtagcatcggattcagacgaaacgttgttgaagaatgaggttggaacagattattctctggatttccagggggaaaaagcggtgttgcttaccttgctgaatggaggaatgctacaatatttgaacgaaaactcggagacgacatttgtcattacggggtattctgattcacaaattacagctgtaggacagacgcatggcaaagaaatgatcttgactccggtctcaactgcagctttgcaacaagctaaggagagaaaacgattggccattattgcttataataaagcacaagccatggatttgcttaagggagagttgaataatggtgtatttcgtaggtcatcctcttctttccttgcacactatttgattatttgcgacgagagcaataattggaaagtgaagatttctgcaatagataacggtgtggtaaaacacacagagtatccgatgataattgatacaacgaatgatgaaaatgcagtgttgactttgggtagcaatgtgacggtagatggaataagtttaaataaactctattacaactatttgaatggtgaaattgaaactgacaatgctaatgttgtatgtgatactcggaaagcctctgatattgcagcatggtatgcaaatggttggaagacccatatagtagatcaggatgagattcatgcagactttaagggaatcttccactctggtgtggagtttgatgatcgtaatccgaggaatttgattgcttgtccgtggagtggtatgggatcttatattggctttgcggttactatgacagcagataatgctactggtcgtatattcatcagcttgggcgaaccatatgatttattcggatggaataataatccggctgattataaccgtgtacagcaggattacagtaaattcctctctttctgtgtttcggaagacggcttctattggagttatgatgacaacgacagtatggtgtatgtgctaagtgctacaggcgagcgttggtttagaatgaagaagtaaccagtctttgaaaaaagcaagaaagtaaacagaacataatctcgattactttcttgcttttgtttttgtttgtactctatttgtattttcttatgggcaattatttgattattagtaatttaatttgtgctctgtttgactcctagttctctactctgacattctcgcccggacgtgctttttgtcacgtcagagtatagttattaattttctattgcgttaatttgtaacgtgaataataacactcgctaatctaatattaatagtttaactcttatatcatgaataaacagaaactactgtctatcacaatgactctattgttgggagtctcctctatctttgcgcaaaagcagccggtggattacgtgaatcccctgatgggaaccgactccaagatttcgctctccaacggaaacacctatcctgccattgcactgccttgggggatgaacttttggatgccgcagaccggaaagatgggggacggttgggcttacacgtatgcttctgacaaaatcagaggtttcaagcagacccaccagcccagtccctggatcaatgactacggacagttctccattatgccgatgaccaaacagctgaagattgatcaggatagccgtgcttcctggttttcgcataaggcagagaaagcaactccttattattacagtgtttatctgtcagagtataacatgacaacggagattgccccgacggagcgttgtgcgtatttccgttttactttccccgaagcgtccgatgcttatgtggtagtagatgctttcgaccgtggttcgtatgtgaaggtgattcccgaagaaaataagattgtaggttatacgacacgtaacagtggcggtgttccgcagaatttcaggaactactttgtgatagagttcgacaagccttttacatttaataaagtatgggcggactaccatctggtagagacgcatcttgaactgcaatccaatcacgtaggtgctgccatcggtttttcgacaaagaaaggagaacaggtgcatgccaaagtggcttcctcattcatcagccccgaacaggcggaactgaatctgaaagaaatcggaaacaagacattcgaacagaccaaggaagccggacgtaaagcttggaatgacgtactgggacgtatcaaagtcgaagacgatgatgagaaccggatgcgtaccttctattcttgtctgtatcgttcggtattattcccccgtatgttccacgaagtgaatgcgaagggtgaaacggtacattacagcccttataacggtgaaatccgtccgggatatatgtttaccgataccggtttctgggatacgttccgttgcctgttcccgtttgtcaatttgatatatccttcaatgggagagaagatgcaggaaggactgttgaatacatatcttgaaagcggattcttccccgaatgggcgagtccgggacatcgtggctgtatggtcggaaacaattcggcttccgtagtggcagatgcttttatgaagaatgtgaccaaagcggatgcggagaaaatgtatgaaggtttgctcaaaggagccaacagtgtacatccgagagtttctacaacagggcgccgtggatacgaatattataataaactgggttatgtgccttacgatgtaaagattaacgagaatgcggcgcgtacattagagtatgcatacgatgactggtgcatctaccgaatgggtgaaaagctagggcgtccggcagaagaactggaactctataagagcagaagccagaactaccgcaacctgttcgaccctgaaacaaaactgatgcgtggcaagaacgccgatggcaccttccagactccttttaatccgttcaagtggggggatgcctttaccgaaggaaacagctggcactatacgtggtctgtatttcatgatgtacagggactggccgatttgatgggcggcagaaagatgtttgtcagtatgctcgattctgtgttcaaccttccaccgatatttgatgatagctactacggaggtgtgattcatgaaatccgtgaaatggaaattgccaatatgggtaactatgcgcacggcaaccagcctatccagcacatgatttacttgtataactatgcaggcgagccctggaaagcacagtactggctgcgtgaagtgatgaaccgcctctactttgccactcccgacggttattgtggtgatgaggataacggacagacttctgcctggtatgtgtttaccgctttaggcttctatccggtatgtccgggcagcaatgaatatgtgatgggtgctccttatttcaagaaagcgacgatcacactggagaacggcaagaaactggaaatctccgctcctaaaaatagtgatgccaatcgttacatccgttcgctgaactataacggtaagaactatacaaagaattatctgaatcatttcgacttgctgaaaggcggacgtctggtatttgatatggataataaaccgaataaaggaagaggtattaacgaatccgacttcccctattccttctctcgtgataacaagtaagcaggtatgaataagatgaaaaagaaagtattgatgatgactatggcggcggtaaccttgtccgccgtagctcagcaaccggtagattacgttaatccgattatcggaaccaatggtatggggcatacttttcccggtgcttgcacccctttcggatgggtacagctgagtccggacacagacacaattccacataatgtgaatggagcttatcagaagaatgcgtatgaatattgtgccggttaccagtatcgggataaaaccatcgtaggtttcagtcacacccacctcagcggcacgggacattccgacctgggagatatattgctgatgcctgctgtcggcgatgtaaaattgaatcccggacgggcggaccatccggaagagggttaccgttcgcgcttcgatcatgccacagagaaagcgacacccggatactacgaagtgatgctggacgactatggcattaaagcgcaactgacagctactcaacggacgggtgtacataaatataccttcccgaaaggaaaagacggtcatctgatcctggacctggtgcatggtatctataattatgacggcaaagtattgtgggcaaacctgcgggtggaaaacgatacattgctgacaggataccgcatcaccaacggatgggcacgtacgaattatacctattttgccatttccttgtcacagccgatcaaggattacggatataaggataaggaaaaggtattgtacaatggcttttggcgtcgtttcaagctggagaagaatttcccggaaatcactggtcgaaagatcgtggcttactttaacttcgaaacggccaaagatcccgaactggttgtaaaggtagccttgtcggcagtcagcacggaaggcgctgtaaagaacctgcgtgccgaggcttccggaaagagcttcgaacagttggcggaagctgcacggacagactggaacaatgaactggatcatttcgaaatagaaggtacaccggatcagaaggcgatgttctacacttcgctttatcataccatgattaatccgtccgtgtatatggacgtagacggttcctatcgtggtctggatcataacatacatcaggcgaaaggattcactaactatactatattctcactttgggatacatatcgcgcggaacatccgttccttaacctggtgaaaccggaacgcaatgcggatatggtggaatcaatgatcaaacatgaacagcagagcgtgcatggcatgttgccgatatggagcctgatgggaaatgagaactggtgtatgagcggttatcatgctgtgtctgtgctggcggatgcaataaccaaaggagttttttcaaatgtggatgaggcattatcggcgatggttagcacatctacggtaccttactatgaaggtgtagccgattatatgaagctgggatatatcccgctggacaagagtggtacggcagcttcctctacgttggaatatgcatacgacgactggactatttatcagacagccttgaaagccggtaataaagagatagcggatacttaccgcaaacgtgctctcaactatcgtaacatctatgatacaagcatcggttttgcccgtccccgctacagtgacggcacattcaaaaaagagttcgatgtgttgcaaacttacggcgaaggctttatcgaaggtaattcatggaacttctcctttcatgtaccgcatgatgtgtttggtatgatcgacctgatgggaggagaaaagacattcgtacagaaactggacgaactcttctccatgcatctgccggagaagtactatgaacataatgaggatattacggaagaatgcctggtaggtggatacgtacatggcaatgaaccgagccatcatgtaccttatttgtacgcatggacctcccaaccgtggaaaacacagtactggctgcgtgaaatcctgaacaagatgtataagaatgacatcaacggactgggtggaaatgatgattgcggacagatgtcggcatggtatcttttctctgtgatgggcttctatccggtttgtccgggtacagaccagtatgtccttggtgctccctatctgccctatctgaagctgacacttcccaacggaaagacactggaaatcaaagcgccgggcgtcagcgacaagaagcgttatgtacagtcactgaaactgaacggtgagtcttatgataaaatgtacatcacacacgaggatatcctgaaaggaggcgtattggaatttaaaatgtcggcatcgcccaacaaacgtcgtggagtatcggtgcaggacaaaccttattcattaactaatggaatcaattaacagcatcaataaataatcaagaaaagaatatgaaaaagagacatttggtatatgcaattgccctgattgtgggcatgggagcttgtgcggcaagtgcgaagaagcaagccgaagcaaaaccggacgtatggaaaagctacaatgtaggaactgtcttgttcgaagataaagcttcggaaacaaaaggttcggacatttatcaccggatcattccggatgcggagtcttatatcaaagagcaggcacgcactgtattggctactctttataactcaccggaagacagcataactccggtgaacaagatacattatacactggaagacatcgaaggaatttctgccaaaggcggtggtaatggagacgttactatcttctacagcacacggcatatcgagaaatcatttgcggaaaacgatacggcaaagctgttcttcgaaacgcgtggggtactgttgcacgaactgacacacgcctatcagctggaaccgcaaggcatcggctcttacggaaccaatcgtgtattctgggcatttattgaaggaatggcagatgccgtacgtgtagccaacggcggattcgacggaccgaatgcccgtccgaaaggaggaaactacatggacggttatcggacagcaggttatttcttcgtctggttgcgcgacaataaagatcctgaattcctgcgtaagtttaaccgtagcacactggaggtgattccctggtcgtttgacggagctatcaagcatatcttgggaacggaatatagcatagatgaactatggcatgaatatcaggttgccgtaggtgatatacaggtgtaatatacgattggatatggttaataaagttggtagaaaaaggttgtttttggtttggtcgtgtctggtgagtatcttgccgggcatggctcaaactgaaaagctgacggactacgtgaacccgtttgtcggtacggatggttatggaaatgtttatcccggtgcacagattcctttcgggggaatccagataagccccgatacggacagccgcttctatgatgcagcttccggatacaaatacaatcatctgacattgatgggattcagtttgacgcacttgagcggaacaggtattccggacttgggcgactttctgtttatccccggaacgggagaaatgaaactggaacccggtactcatgaagatcccgatcaaggctatcgttcgcgttattcacatgataaggagtgggcgtcccccaattattatgctgtggaactggcagactatggagtcaaagccgaaatgacttccggtgtgcgtagcggtatgttccgttttacttatccggagtcggacaatgcgttcatcatgattgatatgaaccatacgctctggcaatcctgcgaatggtcgaatctgcgaatgataaacgattcgactatcaccggatacaaactggtgaaagggtgggggccggaacgtcatgtgtacttcacggctactttctcgaagaagttgaccggactgcgctttgtacaagacaaaaagccggttatttataacacttcccgattccgcagttcttacgaagcctggggaaagaatctgatggcttgtatctcctttgatacaaaggcaggagaagaagtgacggtgaaaacagccatctctgcagtcagcacagacggtgcccggaataatatgaaggaactcgacggattaactttcaacgagttaagggcgaaaggggaagccctttgggaaaaggaacttggaaaatatacgttgactgctgaccgaaagacaaaggaaacgttttatacttccgcctatcatgccgctctgcatccgtttatctttcaggattcggacgggcagttccgcggactagacaagaacatagaaaaagcggaaggattcacgaactatacggtgttctccctttgggatacctatcgggctttgcatccctggtttaacttggttcagcaggaggtgaatgcggacattgcaaattctatgttggctcattacgacaagagtgtggagaagatgcttcctatctggtctttctacggcaacgaaacctggtgtatgattggttatcacgccgtatccgtattggcggatatgatcgtgaaagaagtgaaaggctttgattacgagcgtgcatacgaagcgatgaaaaccacagcgatgaattcgaactacgattgccttccggaatatcgtgaaatgggctatgtaccattcgataaggaagcggagtcagtgtcaaagacactggaatatgcttatgatgattattgcatcgcacaggcagccaagaaattaggcaaagaagacgattatcattatttcctcaaccgtgctttgtcttatcagaccttgattgaccccgaaacgaaatatatgcgcggacgcgacagcaaaggtgactggcgcactccgtttactccggttgcctatcagggtccgggatcggtacatggctggggtgatataacggaaggattcacgatgcaatatacctggtatgttccacaagatgtgcagggatatatcaacgaggccggcaaggaactgttccgcaaacgcctggatgagctttttacggtagaactgccggatgatatccccggagcacatgatatacagggacgtatcggagcctattggcatggaaatgagccttgtcatcatgtcgcttacctctacaactacctgaaagaaccgtggaaatgtcagaagtggatacgtaccatcgtcgaccgtttctacggaaatacaccggatgcattgagtggtaacgatgattgcggacagatgtctgcgtggtatatgttcaactgcatcggtttctatccggtggctccgtccagcaatatttataatatcggttcgccatgcgcagaggctattacggtccggatgagtaatggaaaaaacattgaaatgacagcggacaactggtcgccgaagaacctgtacgtgaaggagctttatgtcaacggtaaaaagtacgataagtcctacctgacgtatgatgatatccgtgatggagtgaaacttcgttttgtgatgagcggcaagccgaattacaaacgggcggtgtccgatgaggctgtacctccttcgatttctttaccggagaagacgatgaagtataaatcatcaattgggttttaataaggttaggtattaagataaaaatggaaaggatgaggctgggcttcatcctttttttagaactgatatccgatacttataaagaacgaatgcatataagcgggatttcaatatagtcccgcttgttttactttttgctcgaaaaccattccttaaattccgctacccgtgctttgcttaccaatatcttctctgtcattctggagtgacgcagattaatggacaaccggctgttgaaccataaatcaatatcctttatcgcctcccttgaaatcagaaactgccggttgactctgaagaagagactaggatttaaacaatcgaccaattcatccagcgtaagagaaaaattgtattccatcccgtccgttaagacagcttttacctgacaatctttgatgtagaacagttgaatcatgtcgattgagacaggaagcagcttatcgcctttcatcggtatgaggaaatgtgtcttgtagttctcctgctttttcagcgagtgaatgagatgaagcagttcctcttccttattttcccgcttgcttccgttttcggggatggcatcctgcaagttgtccaatttctcaaacgcatgttcgatgtcctccttgccgataggtttcagcagatagtcgatactgttcactttgaaggcacgcagggcatattcgtcgtaagccgtggtgaagataatggggcaggtgatgctgatatgatcgaatatttcgaaggcagaaccgtctgccagatgaatatccataaaaacgagttccggcatcgggtggatgccgaaccattcgatggtggaattgatgctgtccagtatggcaatgatttcagcttccggtttcacttcgttgagcagtgaagtcagattgcgtacggctgccttttcatcttcaataataactgttttcatggttcattgttcttacttcattgtacttcatcaatgagaggaatgcagacggtgaattctttgtcctctgtgatctgtatgtcctgtttgaataatagccggtagcgcttggcgagattggcaagtccgatgccggttccgggagtagcggtccatttgggctggatgtcgttgctgacggacagataaccttcgctgtcggtcgaaatatggatagtcagcggtttgcggtcgctgatttcattgtgtttcacggcattctctatcagtacttgtactgccatcggaggaagacggtagtcttcgaaagatttccctatctgtatatcaaattgcagattattctcaaagcgcattttcagcaggaagatgtaagcagaagcgaattccatctcttcccgcaggctgacgctttgcgattcgttgctttgtagcgtatacctcagtacccgtgagagttcctgaatataatcctgtgccttgtcctgattttcgcgcaccagtgaacgcagcgtattcagtgagttgaacaacatgtgcggattgagctgattcttcaatacttcatactggttgcggatgttttccgcctgtaactgttcgttctcaatcaataccagttgctggcggcggacaaggtagatgatgcagcaactgctggtgacgaggcaagccatgatgaagtcgcgcaacggatggagatagtggtgcaccatcgcatcgatggcgggaatgtcgaatgtccggtgcaggaagacaaacacttgtcccagcagattgctgagtatccatgtcaggatgaaggaaagcagaatctttgcagccgttattttaatggacgcctggttgaaatggaacaagcgcgtattgatggcaaaaagtatgagtaacgaaacgaaggtaaacagaatctcatttgccacatccataaacttcatccccgggaaaagcgaatggctttcgaaacggtcgaagagagagaccgattccggaaaatgaatgagcacagccaccatcagcgagatgatgaccgtggacaggaaatacttatctttattgatagctttcaataccatgttgcaaagataatggttaattacgaattatgcatgatgaatggctgtcgctgcacggcagattattgtttttggatatgtgccgtgacgtacatccccggtcggaactgcggattcgtctccttgatggaagcgtatacttcgagtgagcggttcacttcgtccactttttgtccgatggagatgaccgtgccgttgaacgtttgtgtacccatgccgttgacacggaattgtacgggactgcctgtttgcatatctgcaaggtctttttcgtaggtagtcaggcagagcatcggtgcgcttttatcgatcacttcgcagagagcttctcccggattgatgtactttcccatgttcatagctacattgaccacatatccgctgataggagcttttacttccagaagcggctggatgccatcccgaagcagtgtttccggattcacgcccaaaagcgaaagttgtgcggcggcagcatcctgacggcttttcatcgaaagataatccgctttgctttgctggaacttcttctgcgaagccgcttgttcggcagagagattcttttgccgttcgtattccatacgcagatattctgtttgtgcgtggctgtccagataagtctgttggagggtgataaactccggattctccaaagtggcgattacagagttcttggtaacgtgttgtccggggagtaaggaagtgtttttgatcactccgccgatagtcagtgcgacggttgcctgccgttggggcggaaggacgatccggccgttgaacgaaacctgattggggcgggaagtggcggaagtgattgcatccacttcgggctgtgcagtggcatcggcgtcgctttgaccattgttttttcccatttccggattcacgctttctgttgcagggtccgccacagactctgaatccgccgtttgttgttgtcccttgcaagctattaaggcgagcagaaggatggggtaaaatatctttctcatacacatttttatattaagtactcttgcaaaataatcttctatattaacaggaaaactgttcattaaaactctccactctccacttattcaaacaattcatgttccagagcggcaatgttatactgatagacggtttcgatataccctcgccggatgtcccgtgccgtcgtgacggactgtatgtattcggcaacgcccgtttcgctctgttgcagttgcaggttggcggctttggtcagttcttccgcttctttgagagcggaagtagtataatagcgcaggctctcgttgtatcgtcggagggaggcttccagttccatcaccttattgcgaagttcgcggatgttggcatccgcctgaatctgtgccgaagcggcagccagtctggcttgcttcaccttgcttttctggggcaggaagtaaacggggaaggagactcccaccatccatgcattcagactcttcaagggaagaatgtcctgacgggtatatcctatgctgatctccggaaagaagtggctgcgttctacatgaagcattgctttcgcttcttctgcctgactccggaagtatccggtatgcgcttcggacagattaccgtccgaaagggtggtataaaagagagacaaggtcgaatctgccggcacaatcgggctgtcggcataacagcaccactggaaacgtgccagtgccgtcttttcctcttcctgtgcctgataccagcggttgtgcaggtcggcggcggtagtcgtcatcatgttcttttcgagcagggtgatttctccttgttgataacgtatttcgccgatacgtttcaactcttccgccatcttgtcctgatcacggtacatggagcagaggttggcggcatattgatagtaagcccatgcccgttttacttccgctatcacttctttttccaccatccggcgataataagtacttgtctttacctgtcggctgaccagtgcattcttgtaaaacggagtcagcagcgaaccgaggctctgttcgaaagcaagttccttgtcttgcttgttttctccgttgagttgtccccatgagtaattgaatgaggtgggagctgcctcgacaatctctccgcgagtggcttttgcctgacggatggcgttggcggctattttcagtctcggatgattttgtttggctatctcgatggcttgttccagactgaccgcttccggttgctgcgctgaggcgaaagaaggaatcagcagcaacaacggcaggatgacgaagaacggcagatgaaacttgcttccgggacgtctccatacagcaaatgagttgacaatcttgtagaataccggaatgataagcaaagtcagcacggtagagataatcagtccgccgatgacgaccgtagccagcgggcgttgtacctcggaaccggcggaagtggcgattgccatcgggacaaatcccagcgaggcgaccagtccggtgaggaatacgggacgcagcagatgcggggtgcccagagtgaggattcggttggtagtcatagcatatttatttcgtttacgaagttcgttgaaatggttcaccatcaggataccgttcagtacagccacaccgaacaaggcgatgaaaccgactcctgccgagatgctgaacgggagtccgcgcagccagagggctacgatacctccgataagtgacagcgggacggtggagaataccatcaatgtataagtaatgttcttgaaagcgaaaaacaagatcagcagaatcagcatcagtgctaccggaatgacgatcatcagcgtattgatggcgttttgcaggttctcaaactgaccgccgtattcgaagtagtagcccggttgcagtttgatgttcttgtccagtgtcttctggatgttggctactacttgctgaatgtccgcgtcgcgtacgttcacaccaatcacgatgcggcgtttggtagcgtcgcggttgatctgcaacggaccgctgacaagttcgatgcttgccacctcgccgaccggaatctgaatgccttcggaagtacgcacaaagagcttgtccagatttaagtctgccactttctcctgatccagacgtacgacaaggtcgaacttccgttcgttttcgaaaaccacaccgctggcttctccggcataggctgtccggataatcgtgttgagttcttcgatattaatgccgtaacgggctatcttgccgcggttgtatttgacaaccagctgaggcaatcccatcgtctgctctacgatgacgtctgctgcccccggcactttctctacatacgtggcggcttcctttgccctctgataaagttcgtgcgtgtcttcgccgtataacttgactgcaatatcggctttcgcacctgtcatcagctcgttgaaccggagctgtatcggctgcgagaagttaaactcggcacgttccgagaggggttcgagcgcttctttcatcttctctaccatttccgctcggctcgttgcgctggtccattccttgaaaggtttcatgatgatcatcacgtcggcgtcttccactgccatcgggtcggtggggacttctgccgtaccgatcttcgccactacgtgcttgatttcgggaaactgatccatcaatgtcttttccgcttcttcggagagtttgatactttccgaaagtgaacttccggcgggtaaggtcatctgcatggcgaagtcgccttcgtccagtgtcgggatgaactcggcacccagacgggtgaagaggaagagggacccgatcagtgcggcaaaagcaatgacgacggtgcgtgctttgtgatgcaggcacgcatgcaggcaacgctggtagagtttgttcagctgctcgaagaatcggtcggcaagtgtcggcttcactacgatggtatgtttcaggaagagcgacgccatcatagggacgtatgtcagcgacaggatcaaggcgccgatgatgcagaacaccagggttttggccattggagtgaagtattttccttcgattccgttcaaagtcagtatcgggaagaacacgatgagaataatcagtacggcgaatgtagccgagcggactacaccggaagcacctttttccacctcttcgtccatctctttgcgggtcagtgtccgtccgcggaactgcttgctgtagatgtgtgccaggataccttccagtatgacaatggaaccatctaccacaataccgaagtcgatggcgccgaggctcatcagattggcggttacgttgaaaagacgcatcatgatgaatgcgaaaagcatagccagcgggatgaccgaagctacaatcagcccggcacggacgttgcccagaaagataataagtacgaggaagacgatgatggctccttcaataaggttgttgacgacggtggagatgttccggttgaccagttccgaacggttcagatacggttcgatgctgatgccttcgggcaataagtgctgtatcttttccacccgcttttccagttcctgcgtcactacattggcgttggcgcctttcagcatcatggcaattccgcctacgcattcgccctttccgtccatcgtcatcgcaccgaaacgtttgggggcgccgaagcggacagcgcctacgtcactgatgtgtacgggaatcccgttccggttggctaccacgatctgctcgatgtctttgatgcgggtgatcatcccttccgaacggatgtaataggcattctttgctttctcgatgtagcttccgcccgtgttctggttgttgctgctcagtgcttcgaacacttcgccgatggtgatgttcagtgaaaacagggcgtcggggtctaccgccacttcgtattgtttcagataacctccgaaactgtttatttccacgatgcccggtatgcccgataactggcgtttcaccatccagtcctgaatggtacggagttccatagcgtcatatttctcttcgtatcccggagctactttcaatatgtattggtagatttcgcccagtccggtggtgatcggcatcatttccggtgttcccagttcgggggagatttcgccggatacggtttgtatctgctcgttgatcagctggcgggcatcgagtgtgggcacgtcttccttgaagacgaccgttaccactgatagcccgaagcgactgacggaacggatatcttctacattcatgatgttgctcatcgctatttcgatgggcatggtgatgagctgctccacttcctgcggcgcaagcgtaggagatacggttacaatctgcacctgattgttggttatgtccggcacggcgtcaatggggagcgtcagcatggcatagattcccccgataaacaggaagagggtggttaaccctacgaatagttttttcctgatcgaaaaacgtacgatagctttaaacatgattttacagtgttattgtttcatgttacaaagttacggactatccttatccgtgattatcgggaaaggatgaagcggaaagattgacaggtgaaatgacgaaatcaaggtctgaacgtgaagggctgttgtctgtcgaatcaaggagtttgaacctcctttggttattcgccacaacgttttatgcagcgtttttattgtcacttgtcacttttgcgacttaatacgttgcaaattagaatggtaagggtgataataagaggtgacaatagggtgataataggcggaacttagttttctattgtcaccgcgaagaactgaagttgagaggtagaatatgctgaaaataaatgaattaaatgctgaagaagaatgtcttagatgacgaagataagtgaatccgatgttgaaaaggagtcgtttcaatgttgaaggtaagtggcttcgatgtcgatactcttaatgggtggaacaaatagtctatatagaacttttggtttctagagtttgaaactagagttccgcccgcttgaaactaaagtttcatcagcttgaaactaaggtttccaaggcatggaactgtagtttcagccgcttgaaactattggttccggcgtaggaaactatctgaaacactgcttgctaatataataataaaagaggatgcctatggggtaatgcggcatcctcttgggagacagtcctgaagaactactttcacaagcggttcttcggtctgcgacctccatatttaatctggttaggattacgaattaaagtcgtgaatattgtaactcatatttgttaaaccttaaagattgctgtttcggtgatcattcaatgcttttatctttgtgcggaatgataaagttctcattatataggcagttcattttcgctctttgtgagtaggcgatcccaccaagatcggcacgtccagcagaagagttcccgtaaagtcagttgttctttgagcggaatcagaatatgtccgcgttcataggttcccagtatgtgcagattcccgttatagcaaagtatgtaaagatactcttcttcgcagattacactatgaatatgtttcatgtataaagggaaagggtggtaagggtcgtcagaagcaaattctacggaatggaaattaagtttccctagcataccggtaaatacggatgctaattcaataaacttctcgcaatcattttgtctgtgcatcttccggatgacgcggcgcaatgtttctttgtctggtctgttcatatctctttgaatatttatgaccgctcgcatcctgttgtatactacgtacgtatataaaagaagccgggcgctgagttcatatttatccgctaagaggtagtaccaatacctactgaacttaataaatatgttcacacgcccgaccctaagtcgcacgtatgaaacagatttattgaagttcagttttttgtttaaatgaaatttggtacttttcttagcgcaaaaaaacgtttcaatatgccgcatttctcttcggctttcaagggacaaaggtacgcgaattgttgaggattgcaaagaaaaaggaatgaaatttcttgctaagtatgtcatctgtgttcaataagagaagattattttgcaagagtacttaagtgcattctctgatctcagttggttgactcaatctttggaagagaaaaagtgatggcaaaatcttgaatttgcttgctatcactttgtcatcactcttgccgtcactcgattaatgaagtgattaacagtgaattaatgattgaaaaacagtaaaagtgacggatgacggcaaaaagtgtatataaactatgtagtaagatttaagtaggcaactcgcatatataacttgaattcaacttttgttgaaccattcgacatcgatacgaagaaacaagcaatcttatgctgcggcagaacatttctttgtataacctcgtttattatataacaaactaaatatatattcagtatgaagtcattcatcttaatggttataacaatggtatgtgcaatctctctggaagcgcagaataagtctttctacgacttcaatgtgaccacgattgatggtaaggaatttccgctttcttctttgaaaggaaagaaagtgctggtagtaaatgtagcctccaaatgcggactgacgccacagtatgccaaactgcaagagctatatgataaatataaggataagaattttgtaatcatcggctttcctgccaacaactttatgggacaggaaccgggaagcaatgaagagatcgctcagttctgctccttaaagtatgacgttacttttccgatgatggccaagatttccgtcaagggcaaaaacatgtcgccactttaccaatggctgacggaaaagaaactgaacggcaaagaagatgcgcccgtccagtggaattttcagaagtttatgattgacgagaacggaaactgggtcggctttgtggcccccaaagagagtccgctctcggaaaaaatcgttacttggatagagcaggagtaggagcagggaaaagagacggaataagggatactttctttaattccccttcgaagttgggggtgaaaataccttttccgaggttttcttctatttcttcgatggtccagaatcgtccgccgtccagttcgtcactggggtgcagttcaccgtcgtaaacagttttgtgaacaaagacaagttctttctcacgatccgattcgaatacatagctggttagcagttcgggagtaaagtccgtgatgcctagttcttcgcggacttcccgtttgagtgcgatttctacgctttcgcccaggtcaatatgtccgccaacggctgtgtcccattttccgggctggatgtctttccattccggacgtttctgcagatataaatctcctttcgaattgaaaacgtgaagatggatgacaggatgaaggagcttgcttccgctatggcattctccgcgtgtggcggctccggtgatgtttccctgttcgtctacgatgggaaacatttcttgattattatcgcttggcatagttgtttttactttttggtttacggtatcagcagagaagaatctccataactcagaaaacggaaatcgtgcgccagcgcataatcataaattgtgcgccagtttcccttcacgaaggcggaaaccaaaagtaacagtgtactttgcggctggtgaaagttggtcaccatcgctttcactatcttatactgatatcccggagctatgataatctgcgtactgctgtgaagggcttccagcccgttcctgtcgaggtaacctaaaatcttttgcagtgcgactacaggcggaatctgatcatacttttcgtatggctgccattgcttgacgtgcagttcttcttccgtagcatcgggattttccgccaatgttactccgatgtgatacaggctttcgagcgtacgcaccgaagtggtgcctacagcaacagcgcaaccgtcatgatcgatcagctttttgatcgtagcccgattgacggagatatactccgtatgcatctcatgcccttctatctcttcgcttttcacgggcttgaaggttcccgcgcctacatgaagtgtcagttcttccagatcgatgcctttttcctgcaatgcttccagtacacggggagtgaagtgcagtccggctgtcggtgcggctaccgagccttttattttggaataaacggtctgataagtttctttatcgctctcttccgtatcccggttcagatatgggggaatcggcagttctccgaacacttcgaggatatcggcaaaggttacttccggattgtcccaggagaaatcaatccagtggctggtgcccctgcattctccacgggtagcggtcagagtgatcgggaaaccttttaccgtcatctcccgtttcagtgctccgtctttccatttcttcaggttaccgatcatgcagagccaggcagcgtgttccgtctgctggaagttcaatacataatcgttgggctgaatcggttccagacagaagacctcgatcagcgcccccgtttctttgcggaagtggaggcgtgcctgaatcaccttcgtgttgttgaataccatcaggcttcctttcgggagatagtccggcaaggatgtgaagacatcttcgcttacttcaccgtggcgatataccaacagttttgactggtctcgtactgctaaaggaaatttggcgattcgttcatccggtagtggatagttgtattcgctgatgtgaatatgtttcgggtcttctttcattctcgtttcaataaaaaaagcatcaataacccatcgattatcaatgctttgtcggtagtcgggatgacaagattcgaacttgcgaccacacgccccccagacgcgtactctaccgggctgagctacatcccgaattgcggttgcaaaagtagtgctttatttttaaatagcaaataaatagcctgtttttttccattagctgattttaggataagtttccgtttgcggaataaaaagtcctttagtccataataattctaaataatataggtggttgcaaactaacataacagggttttgtttatgaaattaagtgaatagatagtgcgtaacttctttaaaatgaaaccatatcggcatacgagacatgagagtagtttaggatagtatatttttgtatttagttttatttaatgagggggtaaatgtgtataataaaaatagagaaacgttagaagcttatgtcttaggtgatgattttaagtattttcagaatttgaagtatcttcccctaagcgtttatccttctaatattcagtctgctttggtcgtgtattgcttcagcggaaaggccaagcttaatgtatatgatgattcgcattggatacagccgcaggaattgattattctgttgccgggacaattcgtttcgttcaccgaggccagtgatgattttctgactactacgttggtggtgtcgcctacaatgttcagcgatgcgctgagcggtgtgcctcgcttttcaccgcatttctttttctatatgaggacccattattggtatcctcagaccgaaaatgatactcggcggttgatgaatttctttggaatggtaaaggataaagtgacgtctaatgatatatacaggcgtgagctgattattcatttattaagatacttatatttggaattgtttaatgcttatgaaaaggaggcatctctgatgactacccgaaaagatactcgtaaagaggaactggctaataaattctttgggttgataatgaagcacttcaaagagaataaggatgttgctttctatgctgataagttgtgtatcacatccaaatacctgacgatggtgatcaaggaagtgagcggcaaatctgccaaagactggattgtagaatacatcgtactcgaaataaaggctttgctgaagaatacgaatatgaatattcaggaaattgccgtgaaaacaaattttgccaatcagtcgtctttgggacgtttcttcaggaaacataccggaatgtcattgtcccaataccggatgagtaacttaggataatatagaagatgcctgtggggaataaaggcatatgtggggagaggagaatgggaaagggaaagaagaaatgggaaaccttttagggaatcccattctccttcattattataataagtttcaagatcagactcccatacattcgcgatagaagtcaagcatttcaaaaattgtgtctttatcagctgtctggttgatgcaaatatctccgatctctttcagtaaagtaaaattgaccgttcctgaggtatttttcttatcatgttgcataaatgcgtagagttgttcgtactgcttacagtcgaatgcgaatgaaccataattctctttgatgaattggatggtctgtcgcatcttgtctttcggaaagccgactttgaggtgtgacaggtaaagctcgcatacgattccccatgctacggcatagccatgcagcacggggcgattctcagccaatgccagactttcgaaggcatgtcctgctgtatgtcccaggttcagtgctttacggatgccatgctcgaaggggtcttgctccacaatgtcttccttcacctgtaccgatcgtcccaccatatttttgagatatgcataatcaatgttattggtattgaaatccagtaattcgacccagtgtgcggtattgctgattaatccgtgctttaacatttcagcataaccggagaagaaattctgtgcatcgaggctgcgcaggaattcagtttcaatcagcacactgtctgccggagcaaacgagcctatctcgtttttcagtccgttgaagttgatacctgtcttaccgccgacggatgcgtcgaccatagccaacagtgtagtgggtatattgatataagaaatcccccgtttgaaggtagcggcggcaaagcctcccaaatctgttaccatgcccccaccaaggttgatgagcaatgagtgacgtgtagccccttgctgactcagtgccatccatacggaggccagagtctccagtgtcttatgcacatcttcggctccgatacagatttcgactgcgtctttcagaaacgatacctctttcaatgagggcagacaaagacgctgggtatgttcgtctgtgaggatgaataacttgtcatgcggacacctttcaatggcacgaccgaggcttgtttccaagctttcgcagagaatgacttcttgtttactcatgattcttttgctttttcttggtgcaaatgtatataaaatatctttttttacttacttttgtctcgttaaaacgttcaattatgaaagcattgtttcctgtattttgccgtcctttgggatatgtggtgttgttagtagctttgtttcttcttccgattttgctaatgcaagggttgataaccgaccataacctgctattttataaggaatgtacgaagctgttgatgatggcaggatgcttgctgatcatctttgccctaagcaagaatgaaagccgcgagacggaacagattcgtaatgcggcagtccggaatgcagtctttctgacttttctgtttgttttcggtggtatgttgtggcgtgttctgcaaggagatgtgatcaatgtagacacttcttcttttctcacctttttaatctttaatgtgctttgtttggagtttggtcttaaaaaagcgcttgttgatcgattcttcaaaagataattttctattaaattaaaccttttacgattctatttgtcaaaaagacattgttattactctactaatcgtaattaaggtaaatgaaaagattatcagtttggtgggtgcttacactgttatgcaccttctctatttttgcacagaataaggtgattaccgtttcggggcgtgttgtcgaatctgactctaaagagccagctgcacaggcaactattcaattgttatcgttgccggatagcgcttatgcagccggtatagcaagtagtaataaggggtggtttacgctccctaaagtgaaagcggggaaatatttgttgaaggtttcttacatcggtttccgtacgaaattcgttcctgtacaattatccaataatgtgactgaaaagaaaatggggacaatctctctggaccctgatgcagtgatgctgagcgaggctgtgattacggcggaagctcctcctgttactgtaaaagctgatactacagagtattctgcagcggcttaccctgtaccggaaggttcaatgttagaagatcttgtgaaaaaaattccaggagctgaagtgagtgatgaaggtaaaattactataaatggtaaggaaataaaaaagataatggttgatggaaaggaatttttttctgatgacccgaaagtctctatgaagaacttacctgctaatatgattgagaaagtaaaggcttatgataaaaaaagtgatatggcacgtatcacaggaattgatgatggagatgaagagcccgtcttggatttgaccgttaagaaaggtatgaaaaaaggatggattggaaatcttattgcagggtatggtagccaggatcggtatgaagggggagtaatgatcagccgctttaaagatgatgcgagtctttcaattataggttctgcaaataatactaataataagggattttctgaatttggtgatgccggacagggactaggtggaggtaatgctggttcaggtattacaactgcacaatcgttgggagtcaacttcgctaaggatactaaaaagttgcagatcggggggaatgtacaatatggacattctgataatgacgctcgtcgcaaaacctcttcagaaacatttttgggggaaacatcttcttttgctcaaagtgagaacttttcaaatcgtaatcgccatgattttcgcgttgatttccgtttggagtggagacctgacacattgactacgattattttccgtcctaacggtagttattcacaaacagaatctagcagtcgttcttggtcaaagacagaaaataactcgcatagtcctgttaatgaaaaagaggcagcttcttcttctaaaagtcataatgcatcttttaatggtagcttgatggcttttcgaagattgaacaataaaggacgaaacttgtctttgggtgcacgtttcggatatagtgacagcgagtccgattcttattctgattcaaagactgaattcttcgaaaaggatagtatttctgatatttcgcgctatacagacagaaatagtgatagtcgtaactggagtgtatcagcttcttatacagaacctgtatttaaaaatcactttttgcagttgcgttatgaatttgctcatcgcaaacagttatcacaatcattagtgtatgatagtattaactactatccgtatcctgaatatatagagcgtgggtatgataatgaactaagtacacgtgtggagaatttctatgatactcatactgctgatgtttctgtacgtggtattcaccctaagatgatgtatagtgtaggagtgggggtgactcctcagtcatccttaagtaaaacgacaattggtccgaactataagaagaatcttccagaacagaatgttttgaattgggctccttcagtaatgttccgttatatgtttaataaacaacatgtattaatgttccgttatcgtggaagaagcagtacacctaacattgaggacctgcaggaggtgattgatataaccgacccgatgaacctaagatatggtaatccgaatttgaaaccatcatttaataataattttactctcgattatagaaagtttgtaccggaatctatgcgtagctattctgctaatttgtattatacaagtacattgaattctgtagcaaatagaatgacatatgatcctcagacgggtgctcgggtttataagaaagaaaatgtaaatggtaactggcaagcaagaggatttttttcattcaatacaccgttgaagaacaagaaatttacaatttcatctaatacaaatgcacgatttagtgatgctgtaagttatacaagtgtcggaagttctaaaaatgcagatcaggaactaagtacaacgcataatttagggttaggagaacggtttaccagtagttatcgtagtgaagtttttgatatatccttaagtggttctgttaattataatttggtcagaaatagtaaacaagaaaatagtaatcgagaaacattcgactactatattggaggtaataccaatgtaaaccttccttggcaagtctcgatttccacagatattaattgtcgatttaaagatggatatacaggtgggcttaataataacgaagtgatgtggaatgcacaaatttcgaagaattttttaaagaataattcgggtacaattcgttttaaaatatatgatatcttaaaacaacaaagtagtttgtcgcgttcgattagcgaaacaatgatgagtgatactgaatataatactttaggaagttatttcatggtacattttgtatatcgctttaatacgttgggtggaaagtcaccaaatcgacgtggaccgggtggtggacctagaggaggacatggctttggcggcggtggcagacctatgcgtttctaaattgtgactagctctgaatgaaaacgggaaagtcccgatggtaatgaacatgactaacatgacttgccatcgggacttttttgtttatccgataatttgctttatatttgttgttcagtatccatataaaaaaggagtatcctatgattgactggaacatactagttagccagatagctacggttgcttttgatatcgtttattttggagccattatcagtacgattgtcgttatcattcttgataaccggaatccggtgaagactatggcatggatactcatattacttttcctcccaattgtcggtcttgttttttatttcttctttggtcggagtcagcgtcgggaacgtatcatcggtcaaaaaagttatgaccgccttttgaagaaacctatggcggaatacatggcgcaagactgttcggatgtacctgaagaatatgcccgccttatccaacttttccagcataccaatcaagcttttccatttgagggaaaccgtattgctgtctatacggaaggctataccaaattgcaatcattgcttcgtgagctccaaaaggcgaaacaacacattcatatagaatactatatctttgaagatgatgctataggacgtttggtaagggatgtactaatcgaaaaagcatctcagggggttgaagtaagagtaatttatgatgatgtggggtgctggcatgtacctaaccgctttttcgaggaaatgcgtaatgcaggtattgaagtcaggagtttcttgaaagtacgcttccctttgtttacaagcagggtcaattatcgtaaccacagaaaaatagtcgtgatagacggacgtatcggttttgtgggaggtatgaacctggcagaacgttatatgcgtggtttctcatgggggatttggcgtgacacccatattctgatagaaggaaaggctgtgcatggtctgcaaacggcctttttgctcgactggtatttcgttgaccgtacattgattacagcttcacgttatttcccaaagatagaatcttgtggaagttcattagttcaggtggttaccagtgaacccattggcccctggaaagaaatcatgcaggggctgactatggcgatcaatggagcgaagaagtatttctatatgcaaaccccttatttcctgccgacagagcaagtacttgccgctatgcagacagctgcactggcaggagtagatgtgcgtttgatgttgccggaacgtgccgacaaccgaatcactcatttgggatcgcattcttacctggcagatgtgatgcaggcaggtgtcaaagtctatttttataagaaagggtttctgcactccaaactgatggtttctgatgatatgctctctacagtagggtctaccaatgttgacttccgtagttttgagcataattttgaagtaaatgcctttatgtatgatgtggaaacggctcttgaaatgaaggagatattccttcaggatcagcgggaaagtacacagatctttctgaaaaactgggtgaaacgttcgtggaggaggagggcagcagagtctgtcgttcgtttgttggctccgctgctttaaaaaggatgcttcctttatctgatatacttttatcttatctgaaaagcgagaaattcacacttccatagactcttctttctatgaaatgcggatgatcttcaaagttattttgcttaccatgctccaatacaaacaaacctccttctttgagcagattatttttgaatattagttccggtatcgattccagctcctttaaagcgtaaggagggtcggcaaagataaaatcaaactgctctcgtccgctgttgataaacttaaatacatcgccacggataggcagacatttgtcagtttgtacttctttcattattttgcagataaacgagtgatgagccggatctttttccacactgatcacacggtcgcagcctcgggataccagttcgatactgatactgcccgtgcctgcaaacaagtcaagtgcagttactccttcttcgaaatcaatataattattaagtacattgaacagattctccttggcgaagtctgttgtagggcgtgctttgaatgtacgtggtacatcaaatcttcttcgtttataaataccgctgattactcgcatgttaataaggcttgcatgtcaatattgttggcaggattcataatgaatacctgcagaatgaattttttcagttcgttcatcaatgtctctttgtccgacagagtgcctgtcagatgtagttcatcccgttcctgattaaattccagttgcttccagacatataatagatagtagatacgatcttcggtttgcatgcactcgaaagagttggccaaaagtagctgcccccgttcgaaacagtaaatgtcaatggcatctttgcgtactgaagcatacattttcttactattccccagtctgcttttgatagaaaaatactcgatgagcggggtagactgagagtagaagcgggcttcgggatattgttcatttaagaatgtataggtgcttttgtctatgccgaagattatgactacattattctttttcagaatattgtacatcactatttcattctcccgtttctgatgattgtgatagaataaaagctctgcctgttcttcctcaaacagttccaatggtatcatggtaaagcgtttgctggctatcatgatgttcacccgtttgtaggagtagcttaaaaagtccgattcgtggaaaacgtttttaagattggctgtcagagacagagaggtgtctacctctttttcgaacagcgactgcgaattgtcgttaatcggattgtagatagaaaaagaaaatccatccgtactaagacggatggataaagtatattgttttgattttgtaaaatcaatcattattcccagttaccagcaccattgttaggattgtcaatagaacctaccatcaaacctgagtatctgcccagtttttcattaaggtctttcaaattgataatttcttgtctgtcaagtccgcccaagtaagtttcatatggagctttcacttcaaacaagtatacaggagcacctgatttagctgtgtcgtttttaacattcatttcaaagatagcaccgttgccataaggaatgtacttcattgaatctgcattgaaaccttttggatagatggtgtccattacagctacccacatggtgtcacgcttaaagttttcaagtccgtttttcttaacttcatcatacttgcctgtttttttagctttgttgatgattgccattgctttcttctcagtcaagccgctttccaattggtcgtctgtcagctgaccaactttcataacgaaaggtaatttttgatttttaacgaaatcaatcagtgtgtcaaaatgttctgtgtacattccgtgatgaagcgaacggtattcctgttgtgctttacggatgtcgatcaaacgggcaatgacagcctgctctctttcctttttcgctttttcaaaattgataggacccataatactgctatagcaaatgtagattaatgcagcagcacagagtactaatacaatattaaatactgttttcatgataaattatgtttttagttgttatattcgcatcgcaaaaatagaataaataaatttaaatacgatagttccgggaacttttttctcgtacaaaaatgataaataactatttagaaaggcaaattaaggaaaattttccttatcaaccaacttttgagcaggaaatagctgtaaaatctctttcagagtttctgctttccacactggcggatgaagtatttatcctcagaggctatgccggtactggtaaaacatctttggtaggggcattggtaaagacgatggatcagttacagcaaaaggctgtgttactggctcctaccggtcgtgctgcaaaagttttttcatcatatgccggtcacccggcttttacaattcataagaaaatataccggcagcagtcgttttctaatgaaaccagtaatttttcaataaatgacaatcttgctacgaatactttgtttatagtcgacgaagcttcaatgatttccaatgaaggattgtcgggcagtatgtttgggacgggaagattattggacgacctgatacagtttgtttattccggtcaggggtgccgtcttttgttgatgggagatactgcgcagcttcctccggtaggtgaggagttgagtccggcactttttgcagatgcattaaagggatatggattggaagtgcgggaagttgacttgacgcaagtggttcgtcagatacaggaatcgggcattttgtggaatgcgactcaattgcgtcagctgatagcggaagataattgctactctttacctaaaataaagataacaggttttccagatataaagatggtgccgggtacggaattgattgatgccatcactagttgttatgatcatgacggcatggatgagacgattgtgatctgtcgttctaataaacgcgcgaacctatataataacggaatacgtgcacagatcctttggcgggaagatgaactgaatacgggagatatgttgatgatagccaaaaataattattattggacagagcaatataaggaaatggacttcattgccaatggagaaatagcagtcgtgcgtcgtgtccgtaagacgcgtgagatgtatggttttcgctttgcggaagtgactctcaggtttcctgaccagaatgattttgaactggatgccaatttgctgctggatactcttcactctgattctcccgcattgccaaaagtagataatgacagattattttataccatacttgaagattacgcagatatatctaacaagcgggaccggatgaaaaagatgaaagcagatccacactacaatgcgttgcaggtgaaatatgcttatgcgataacttgtcataaagcacaaggtgggcaatggcagaatgtttttcttgatcagggatatatgacggatgaatatttgactccggattattttcgctggttgtatacggcatttactcgcgccacgaagacattgtatctggtgaattatcccaaagaacaaattttataaaagatttcttttttttcttcgtaaataattgattcccagtctagatgaatggggagatactc

SEQ ID NO: 35 - DNA, 94620 bp, Bacteroides thetaiotaomicron
ctcgtcatggcatcctgttcgaaagacgaacagacagctgtcaaccgtggtgctgcaatcgatttccgtggcgcaatggcaacccgcgccacagaaacggtaacggctaacctcaatgacattttcgtgacggctcttgacaagaacaatgccaatttctttactaatgaacagttcactaaagacgtggataacttctttaaatcctcccccaactcctattattggccgaacgacgacagcgaactcaaattcttcgcctacgcgccttcgagcagtgatctggacggtaccctgacaatcgacaatttaaccaagacgctcgccgatttttctcctaaaacgactatcgccgaccagaaggactttgtgtcctgcaaagctaccggtaaaaagtcggtcaacgagtcagccggtgttgccttgactttcaaacatcaactttcccagatcgagatcaaggccaagaacgaccaggatgcttaccgttacaaggtggtggccgtgcgcatcggacagccggtatcgaaggggacattcgatttcggtactgaaaactggaacttggaaatggataaggtcaactatacagtgcctgatttcggtgaaataacgctgaacggaacgcccgaatcgcttatgggaacgggaggcagcgccatgctgatcccgcagcagcttacagcatgggatgctgccggggataagcccaatgcgaacaagggtgcttacctggccgtaaaactccagataaccaccaaagccggcgcccgtgtctatccggctgaagttgtcggtgactacgactgggctgccgtgcctgtcaacacgaattgggaggccggcaagaaatacgtttacacactcgatttcacaagcggtgccggcaaggttgatcccgaaaaaccgaatccttctgacccgaccgatccgttcaagcctggcgatgacatcctgggaaataacgccatcaagtttacggttcaggtaacagagtgggtagaagaaacgaaggatgttgacatgtaaagaatcggacggccgcatggcggccggatgaaacaggccgggcggggttggaccggtatccgataccttcatcggcatcacggtgtttttgccttgaagattcgtcggggagccgaaaccggggtgaaagccggtttccggctctgtcccttcccggtcacaaataagcgtgcaagggcctcccgtgcacgtgaaaaacaagaaacgatgatataaatagcacgaatatggaaatgaacaagaatttatgccggaggctcggaaacttgagcctgccggtattgctttcggtcgtcctgctcgcctcgtgccgggatgagattgagacgggcgcgtacacgggaccctatatccgcttttcggtatccgaggggtcggagtggcatagcacgcgggcggcgggcggcccggcagaaaaggcggtcccacgggattccgtgcagcccctgcacggcggagatggcaatactcccctttacctgcacacgctttacaccgacagcatcgcttccccctcttcggacagccgaccggacacggccgtccttacccgtgccacgcccgtaaaaacggagactctctacgaatcgttcggcatatcggcatcggcttatacgggttcctggagtgagacctcgtaccggccggattacatgtacgatgtcgaggtcacgaaagcatcgaactggaccacctcctatcgttggccggctacggaacacctaagcgtcttcgcttacgcgccctaccacggggaagggatcgtcctttcggacaaggcgaagccgggaagcccgacaatcacctacacggtcccggcagacgtcgccaagcagaaagaccttctttttgcaaatccgacttattctgctccgggaggtattctgaaaatactttataatgtgatgcctcttactttcaaccatgccctgacggccgtcaagttcgtgtgcggggatgacatgcagggaggtaccgtaaagagcgtcagtctgaaaaatgtatattccaaggggaatttaacctttgcttacagcattataacacaaagttgctggagcgatgtagatactcccgccgatttctcgcagacattgggcaaaaccactacgggaaccccggacgaggcccttactaccgatgcgcagaccttcatgatgattccgcagacgcttcccgacggcgcacaaattgaagtcgtattcaccgacaaatccaacgtcgatcacacgctgaccgctgacatcaaaggcacagtttggcctattggaaagaccgtcacttataaaatctccagcagctccataaactggacatacgagcttagcgtcaacatgccaggggacttcacctatagcggcggtacacaacaatacagtgtcacaagctacaagcataactccagaggggataagcaacccgcccaatggaaggcacagttttcggagtacggcggaccatggatagataccccacccacttggctgaccggtttcaccccatccggagccggtggagagactccacaatcatacaatgcaactgtcggcgcacagatcggtacgagtagtgacccccatgcgcaaaagttaaggaataacccatcacaaggtagtgtaatttatcaccataacctcgccaaccagactgatggcagttcaacggttcagaacaccgccaactgctatgttgtcagtgctccgggatactactgtttccctttagtatatggaaatgccatcaaaaatggtacgaccaacacttccgcatatacctctacgaaaacaggaagtgatattctgacacctttcatcaaccatacgggcaatccaatcaccagcccttacataaaagagaattccggttgtgttcctgccaaggccgaattgttatggcaggacgcgccgggtttgatttccaatgtacaatacaataattcccaaatgcaactattcgttaatcccgagaattacatatccttccaagtgaatgctttgactatccggcagggtaatgccgtcatcgccatcaaggatgcaaatggtaccgtcctatggtcctggcatatctgggttaccgatgaaaatatcggccaaaccatcgaggtaaccaatcaccaaggcaaaaaatataaattaatgtctgtcaatctcggttggtgtgaaggtcgtaccgaaacttatgcagagcgtagttgcaaggtgaaattcactgccggagacgcgagcaaggaagtgattatcaaacaagtttcggcttcaatcacaacaggtggcaatcatccttattatgagtggggccgtaaagatccgttcccaccttcgaacggattggccaataccaataaaacctggtacgacaaagacggcaatgctcacacggaaagtcctaaaacggagaacttttctaccggcgccacttgtatcatgaattatattctcaaaccggatgtgatgcagagtcaatattatggcgataatacatatgcaaatctatggagtgccgataacaatgtttatactgccaatgacgaaaatgtcataaaaacgatttatgatccctctcccgtgggcttcaaacttccccccagtaatgcttttacgggattcacaacaaccggggagtatgtaagtacactttctcaaatcaacggagagtgggacagctccttgaagggatggaatttttacactgactcctcaaaaaataaaaccatcttcttccctgcgtcggggtatcgcaactattccaatggcggggcgaacatcgttggcagctacggctgctgttggtcggcggtgccgtacaaccagaactaccgtcgcggcctgaacttccactcgtcgagcgtgaacccgttgtacaacggcattcgggcgtacgggtttggggtgcgttcttcccaagaatagggagcgtagcgaccgtatccgtttcattggattattttccctacggctttaaggccgtagggatagtaccggcgaagccggtcgatttttatagatattaaaattaaataattatgaccagcaaggattttatagaagctgaagcaggtaataacggaagtatcattctttatcgtgaggggcttttctggaaagcttatgaaaagtctgcttacgctgtctgtacgcagatcaagcctttgaaggctataaaaagaaggttaaagtcactcggtggcggtgagatagtttcagtgggatttccatgtaagcatgaacaaaagtatataggttctttggagcatatggagactatgcctgaccgtcttgtgttgcgaacgctaaaacctatagacggacagaggtttgaagaatggaaacaggaactttcatcggagcattcagttggagggaggagagatgcgtgtgtgcagaatctgtcacggagtaatattccgcatggagagttaatcatgcgaatccggatgttcaatctggcggaaagtactccgatggattgtatgttatttgtaaatgagttgaaaaagatgctctaatatacaatgaatgagaagtggcagtttatgataatttgcctgtgtataaggctgcatatgatttgttaaggagtgtgtatgagaagacgggaaagattccccgtgatgtgaaatatacactggtggaggtgttgaaaaaggatctgaccgagattatggtaatgatatacagggctaatgctacgactggaaaacttccgtatattgaacgggcaagagatctggttgtaggagtcaaggtccgtttaagactgttgcaagatatgcggcatatcagtgtgaagcagtatgcggcgtttgcccaacaggtggagttgctgtcgaagcaattgtcggcttggcatgattatgcacggagacaggacgaaaagagtcaagaaaaaatataaacaagaaaagatataaataaaaaggattcctttgcctacacaaaacaggataaggccagcatttcgtatagccaagacttgcgagagagtgccagataaattcagtaacccactgtccgtgtaaaaacggtcatggcggatagatgtatccgaagccatgttgcgggcagtaatggacagttttatatcggggttccgaaaggtcctccgatatatacaataagtggttatatttccctgcgtcggggtatcgcaactattccaatggcggggcgaacaacgttggcagctacggctactgttggtcggcggttccgaacaaccagaacaacggtcgcaacctgaacttcaactcgtcgaacgtgaacccgttgaacaacaacaatcgggcgtacgggtttggggtgcgttcttcccaagaatttatccttgtacgaggcagggaatcctttgaatgtaaattacagaaatggctgaatgttataagagacaggatttgcttacggatctttttcaggcctattacgaggcgaggaagaagaaaagaaatactgcgagccagcttgcgtttgagattgatctggaacataatcttatggagttgtatgaacagataagggataggaactacactccttcacctggggtatgtttcgtggttaacaggccagtgaagcgagaaatttttgcctcggatttcagggacagggtagtgcatcatctgttgtataattatatttctcctatgtttgagggcagaatgatttttgacagttattcatgtcgccgaggaaaggggacaagtcagggaatagcacgcctggaacaccacatacgcagttgtacgcaaaattatcgttatagtgcctatatattaaaactggacttaagggggtatttcatgagtatcaggaaggatcgtctgtacgatcttatctgcaagggactggaacgatatagaagaagccggaaacaaaaagaatgcccagatatggaactgatagatttcctgctaagacagattatattcagaaatccccagcgggattgccggatacggggtagcgcggaagattgggaaggacttccacccacgaaaagtttgttcaattctccggaaggtgtgggacttcccataggagatttgacatcccagctgttcagtaacatctatttgggggagttggatggatatgtgaagcgtgttttacgctgtaaacattacgggcgttatgtggatgatttttttattgtccatccaagcaaacgctatctaaaggaactgattccatggatacgggaattcttgaaggaagaattggagttggagttgcatccggataaaatcgaattgcagcattacagtcgtggtgtggcttttctgggagcgtatgtgagaccgtacaggaaatatccgtcaaaacgtaccgcaggattttttcgggaagcggtacacaggctggaaaaagagagttccaaaggaaaacccgctccggaaagactgcgaaagatgttggctgtgctaaactcctaccaggggcatttgaagcatttcagatcatacgctctgctggataggttcttgcgtaattcacctttgaaagaatatttctattttacgggaggttatagaaaagccggtattaggagtcgttttctgatccctataaaagatacgtacgggagaggaaaagaacccgaaacttttcctgaaaccggggggcggattatggataatagcgtacatcgtgaagatagcgggggcaggaatagtaaataagcaccagtatatgtatgaaatgtatgcctatgaaactgaaagtacgaatatttgagggaaaatctcccgaactttatctggccgtagggcactttgtacttagtcctgcatgtctgcgggagaataacaactacccttataaatcctcccggatgtttacctggcatgttctctaccatgaagaccaggtagtggctttcatgcctgttgagagaaaactcgatggtggttataaaattgataattattatgccactcccgatagggagagggggaaccagttgctgaagctgttgaaaagcgtgatcaaggagtcgggcgatgagacttcccctttgcgggcgaccgttcagaaacgggatgtcggaattttcaaatacatgaatttcatcacgatccgggaaaccaagttatatgttatgatggaattggtacgtatgggttccgacagtgggaaacaggatggctgaaagagaatgggaggaactcggatgaatgtatatcaggcgttgcgggagaggatcagaagaatcttcggcgagtatgattatgtgtacctttctttttcggggggtaaggacagcggtgtgctgctgaatgcctgtgtggagcatatcaggcaatatggaggtcggatgggagtattccatatggattacgaagtgcagtattccctgaccacggagtatgtggatgagatgctgtcttcgaaccgggatattctggatgtttaccgctgttgcgtgcctttcaaggtcggttcggctacatccatgtaccagagattctggcggccctgggacccttgtgtccgttgggtcagggagatgcctgtggaatacctgggtacggaagcatttgatttttatactccgcagatgtgggattacgagttccaggaatgtttttccttttggctccgcaagcaacttggagtgcaaaaagtggcatgtctggttggaatacgtacccaggaaagctttaaccgttggagaacgatctatcgtagcactccgggcccttcagccgactggatatgtcctgtcgatgagggcatagacaacgtgtatccgttgtatgactggcatactacggatatatggactgccaatggccgtttccgttggaaatacaacaggttgtatgacctctattatcaggtgggtgttcctctgaacagccagcgtgttgcgagcccgttcatttcccaggccatcccgtcgctgcatctgtacagggtgatcgagccggagatgtggggcaagatgctgggacgtgtgaacggtgttaattttgccgggggttacggtaactctgtagcgatgggatggcggggtgtcaggctgcctgagggaatgacctggaaaaaatatctttttttccttctggacacccttcctgaggatgccaggaacaactatctggataaactggaggtaagcgtgcggttctggcgggagaagggcggctgtctggcaaaagaaacgatcatgaaactcaagaggttgaatatccctttcgaacttggcgggacatcgggatacaggacgcacaagctcccggtcaggatggaataccttgatgacatagacctgcctgaattccgtgaattgccctcgtacaagcggatgtgcatctgtatcctgaaaaacgaccactgttgcaagtacatgggcttttcaccaaataaacaggaacaggaaagaagacggaagatgatggatgaatatagatcttattttaatgaatgaaaagatggacaatgaatttaccagtcccgtgtatggcgtcaaggctgtaccggtggaaaggatcagggcgaattcctataatcccaacgtgacggcccctcctgagatgcggcttttggaactctcgatttgggaggatgggtacacgatgccgtgcgtgtgttattacattgagaaagaggatgtgtacgagcttgtggacggctatcacaggtataaggtcatgatgacctcgcccagaatatacaagcgggagaacggactgttacccgttaccgtcatccgtaaggatctggccgagcgtatggcctctaccatccgccataaccgtgcccgtggaatgcataagatcgagcttatgacacggcttgtcggggaacttacgaggtcgggcatgtcggattcgtggatacgcaggaacctgggtatggacaaggatgagttgctgcgcctgaagcagatatcgggactggcggagctttttgcggataaggaattccgtaaggccgtagaataggatatttggcataaaaccgaaaattcgtatgctcggagtattcgggaagtaagaaaaaatgtaaaaatattataaaatgtgcaagatggagataacagatctgatcaagggaatggaaagtgcaaatgtgtcggatatttacatttttcttcacgaggacggccctgtggcttttgacgcctctgccgcccatcttctgtgttactttcctgaaatggagatggaaagtgtgttttgtagtgacagcaaacgtcacagaattatacagggatttgcattggaaccggtgctggaacgactggcgcaatacccgtgtctggttgatgacgattgtatcagaataatgtgtgtgctgtgaatgataaggcacggtatgaagtaaacgggtatgggcgggaatggcggagcctgatcttctggaactgttcagaaagcatgcgcaggatgggcagaaagagatggtcagcctgttttgcaatgatgtgagaagactctcccggacgaagaagataaagaggctgctcgtgttgggaaggtacgcagggaactctgaactttgcgggcatgtgctccgtgtgctggagatgctgccggaactccccggcatggcttgtcctgcatacaggggcgttctggtattgctcttcctttcacgggacagggatgttttgtgcaggttgcgggagaatgtcgtcctgccatgccgcaagaggggacgtacggaggaaatgctttggctttgtgagattttgtatgctataggcccatctgtttccctgtatgatatttacagggaggtttgtctgtacttctatctggaacggaggaaacaactccggggatattccacttgtgtcagtgaactggactttcagttcgcagaaaggcggttgaggatattgtccgtcgccgtatttcgtctgaaagttattttttacagccccggcgtgtattccgtcggtacactctccctgctgtgccgtatgagttattcggccttcagaaacaggtttctgtctgtttacgggttgcccccgggacgttggctaaggaatcggcgaataaaacgcatatgtctggatataaaatataatcatggactttcactgggagaaatatcggagaggaacggattttcatcagcaagccgtctgtgtgaattctgtaaaagaaacatgggatgcactccggggaggctgaagcaggcactggctcaccggtggcggagcaaataaaaattcatcaggcttgatgtagagcttatttcaaataaaaagcgtaacggctatcagtgctcgtttcgctatcttgccggtgtttaattaaaatcccgaacagcatggaactgtttacttttatcccttatttcctgttactggagcgagaagagagtgacaggaatacactggcaaacgccaacaccgagttcatccgtgaggtctatgagctgcaacgtgtggaaaaggatgttacgctcgtctttttccagctgcaatatctaagttgcaaactggtcattctgcgtgagcattactgcacagcacaaaaagagcacttgccctgctatgcctatatcattggtacgctggagtacctgaaaggtctgctggacagatgcaggttcattcataagtccggttccgccattgctccggcaggtctgccgactacagagggtgatccccccgtctgctggacggcagaggtcatctgcctgatggaactgctgtatgcctgccacgagctgaagatgttcaacggcggtgaggtgacactcgggcgtgtggtggaatacgtctgtcatgtgctgggggtgaacgtgaagaatgcttcgagctactacgcgcggatgcggcggcgtaaggcgggagacagaacctacttcatcgaccgcctgcgtgaagttctgctcaaacggatggaagacgatgacgaggggcacaggagacgcaaccgatgaaatgcggaccctttcacacacggttctccacgtgtgtgaaggccttgcatttacggttatttgttcagttccagaagatgtctgaggttgggatctgcggcgatgcgctccagctcgtcggccacgatccgtctgacatcctccttgatccggttgtagttttcctgtaccatttccttcatgtgattcaccccttcatcgtccacgaagccggtgataacgggtatcttctgatatgccttttcctcttcggctatttttttggcatcgacgacaatctcgcagtggaagattttctgctcaatcctctccccgaagttgtcggctacggagccgacgaacatcccctgtgtcagtccgctgatcttgctgggtggaatgaggctgtccatttgggtggatatggaggtggaaacgtcctgtcggttgatggagatggagtggcgtttctgaagtatcttgccgaacctctcgctgagggttttggccgtttcccccacgacctgtcccgaaaatatgttgcctaccgtgttgatgatcacctttgcctccttgtcggtatagtcacggataagctggctgaaatcctgaaagccgagcagcacggcgaccttgttgctgcgtgcggtggctatcaggttgtccagtcccttgatgaagatggttggcagctcgtcgatgatgatggaactcttcaacttgcccttcttgttgacaatctttacaatacggctgttgtacaggccgagcgcagcaccgtagatcgcctgccggtcgggattgttgcctatgcagaggattttcggctcgtcgggattgttgatgtccaaagagaactcgtcggcggacatcacccaatagagtgccggcgagatcatgcgggacaggggtatcttcgcactggcgatctggcccatgagctggtcggcagctcccgccagccatgcatcgaggaaggggctgaggtagttctccagttcgggataggaggacatgatgggaaaaatctgctcgtagggcttgttaaggaactcgacggcatgggggaaggtacaatacctgccgtccttatacacccgcaggaaccagataatggcggcaaagagaatggtgggcgactcgacgaagaaatcgccctgcttcgccgcccacgaccggttgaggttgagcatgatgctgtatgaactctcgtaagcatcggagatgtcggtcatgaacttcggattgaggggattgcagcggtgactgcgtgagggatcgtcgaagtttatgacatagaacttcggcggcactttatacccctccaaatgaccgatcaggtggttgtaagcaatggtggagaggtcgggaaacttgaaatcgtagatataggcggcatagcctttctctatctgctgtttgatgtaggagttcaccaccgcaaaggacttgcccgaaccgggcgttcccagcacgatggaggcacggaaagggttcacgacattgatccatccgtcgttccacttcttgccataatagaaccgtgtcggcagatttacggaatattcattttcgataagccttgtttcctgcatgaaactttcgttctcgttgttgaacacatcgtccatgagattctgtttgagcaggcgggagatccatacaccggcagcgagcaggcagaggtagccgacggcaagagtgaatatataaaaggcggtgcgtgccaataacagtacgggcaggcagagcagccaccagttgaaaaagaagaggacgacacctgcgcaaagggctgtccagatatgcacccatttgattttttcctcctttacacccttcgtgcccagacacgagagggcaaggaaggtaacggagaaaagctttgtccaaaggatggagccgaacaatccggtcgtgcgctggaagttcagcagaatcctgtccaccactccgatattgacgttccattcccggatggacggatagcagaaccaatagatattgacaactacgaataatacgctgagggcacgcataaagtccatgactttcgccagtcccctgagatcatcttcttgtgacataatactgaatttaaaaaagttatcgtcttgataattatgtaatacgggtcagtcctgacgaccgtaacgccggcggcatttcttcttgtcgggcttcaggagcctgggataccgggggacatagttcagctccggctccatatcggaaagcaaccctcccggaattttttccccgtttccggaagccacagcggacggaacgggcggcagaagtggcgacagggaatttggcggctgttcctgaaagtgtccgttgagcatgttcgccgagaattccttgcccagacgtgagccgttaagtacggtgcggctgcggtggtctataaaggtaacgccgtaaatcctgccggtttcgttgcggcggagaaccaagtctatctgttctttcgccaggcggtcacggaaatcccgttcgtccacggactggcgcaaagcctcggccactaacggtcgaagccgttcacggcacggatcggacttgatctttgcagcggattcctgcatcttcttatccagctgctgtgcaccggtcattctgcccagccgggaggactttatgggagtggccgccgtttcgccgttgccgtccaaagcggtatagagtatgccgtggtaggtgcgtccaccaatttcccccttcacttcttccacacctatattatacagggaaagcagggcacggagttcgcccattgtgcggaaacggtaaagttggatcaggggtttgaccgtacgggcgatctgccgtttgatgtcccctttggcaacatctaccggcttcagctgccactcttcgcctttcttctgaccttccgccggatgcagaccgtatttctgttccagaagttcggtaatctccttgctgcggcggtattcgaacttgtcggaaaccttccttccctcactgtcgacacgcagggaaacgatgtggatatgatgccggccgatgtcctcgtgcttgaagacaagatacggctggttgccgtaaccgagccgctgcatgtattccctgccgatttccgccagctggctgtcggtcagcacgtcgtcgggatgcggattgagggagatgtgtatgaccggcttctcggtgcggtaatggttcggcatccattcgagaaactgccgcacggattcatccggacagaagcgcccgtcttcgggatagcggaggagatgtgccgaaaggacttttgccccgccttcatcgaccttgttttgattgtaggccagtgcgccgtacaagttcttacccacgctgatcctggctaccatgtgaggcgagtttttgggaaagttcgacaatccggcggttcagctctacgagttcaagggtgagcttttcaagtctgtagagcagtgccaatgctttcttttcagtgaaatggatgtgcaattccttgacagcctgattgtaattcactcctatggcacggaactgccggaacagttccgtgagcttgactacatactccattgtggcacggtctgtccggatcaccctgaactcttcgttgaagatccgtgctgcgatgaacttggatttggacaacagaccggactgctcaaacatggtgagaaaccgtgcatggccggcttcgtccagattgaccgtctcacggcggatggccgggttcggcttgggtaacctgcccccttttccccgtgtgcggggacgctttttctcgttgttcatatatacgttttttatgtggtacaattccaccgggtggaattgcctccgtcagctccccctcccacaatttgcgacttcggagcaaattgcagcccccctgcaagggcaagcgttttttgctgcaaaacggagtggtgctgcaaaaaacacagcttgctatgttctggcgaacataaatctttcctctttggagaggaaagagcgctttcggggaaagcggggattagtgaccgacggaaggcaaactgcccattccctgttggatggcgcaaagttaggaagtggtataatcagttgtatatcactaacattagccacattatgccaaatggaagccacttgtgcacacgggtggaacaagaggaaaaacgggtggccgatgatggctgaatcagcggttgaggatgtgcctgaatgggatgcgtaatgacggactgaatgaccaaccggtcagataaccaaccagacggtcagccgttgcaacgttggtgcggtcggctggctgactagccaaccaagcggataaaaggctgtctgtccggcgggatgattaggcaaccgattatcttcctgtttgtccgacaggctatgcagtccgccggattgtgtcatgtatggtcagaccgtcggtcggccaatcagacggacaatacttcggtcggttggctgttcagtcagccattccacgtcaggagccggccacttgaaccccgccgttcccaaaccatgaatttcccttctttttccttctttatttgcggcgttgattcaaaagtatcatttgtaaacaaactgcatcatggaaaaagaaacactctttatcgccttttccacgcaaaaaggcggagcgggaaaaacaacgctgaccgtgctggtggcaagttacctgcactatgtgaaagggatgaatgtggcggtggtggattgcgactacccgcaacacagcattgccgagatgagaaaacgtgacctgaaaacggtcatggaggacgagcattacaagctgatggcgtacagacaactgcaacggataaggaagaaagcctatccggtagcggagagtacggctgaggacgctgtcacgaaagcggacgaactgctggaaaagatgccggaaacagacatcgtgttcttcgacctgccgggcacggtaaacagtacaggcgtgttgaacacgctggcgaacatggactatgtcttttcccccattgccgccgacagggtggtgatggaaagcacactccgctttgcgagccggctgaatgacacgctgatcgctacgggcaagacgaatatcaaagggctgtacctgctgtggaacatggtggacggccgggagaaatcagaactgtacaaggtgtatgaacaggtgatcggcgagctgggactgaaagtgctgaagaccttcctgccggacagcaaacggttccgccgtgagctgacaggggaacatagggcattgttccgttccacgctgttccccgcagacggtacgctggtcaaaggcagcaacctgaaagagattacggaagaactgttgtccattatcaggaagtaggctatgggaaacgaacggaaaaaaataaacctgacggacattgatgagaattccatagtcgcctcgttcaaggaaggccggccggcggacgggcaggcgcaagcagccgggaacaagggacagtccggtgaagagagcggatatgtccgtctgttcatccacgagtcaccggtctgtgcacggcttggcaagacaatctatcttcgtaaggagtttcatgaacggattcagaggatcgtccagacaatcgggaacaacgagatgtccattttcagctatgtggacaatgtgctggaacagcactttgccgcctatcaggacgagatcacgaaggaatacagaaaacgaagtaccgaactgttttaacccccggaaaccatgtcagcaatcttattcttacttatcggtagctatctgttatggatagccgcctacctcttccacgagccgaacagtcggaggaagagagcggaaaaagccgggcagatccttacccggattacggtggacgtgagcgagattttaggcaaaagtacattttcccttagccactccacgccacaaacgcccgaaaaaattgaaaacgaaaaatctgtaagcgaagcaggtatttttgtaccggagaaggaaaagttcccgaaaatagtttctgccgaggaactggacaagctgtttgccgaagggagtccgctgccggaagatcttgaactgatggaagatatggatgtcccgttggagttccggggagaaccggcggatgacaatcttcggatagacgatgacgagcaggacagatgcctgccgggatgcacgccgcaagccacgggcatccgcttcgaggacatgggactggcggtgcgtgtggcggtcaacggtgaagcggccagtgaagaggaaaggcttcaggccggaaagacactggctgaactgcgcaacacgccgatgttcgacaagctgaccttcggcgatgcggagcgtgaggaacgtatcgactcgctgatagagctgcatcttgcggcataccgcaggcggaatagcccggacagcgaagtggcgacagaaaccataccggacactttctccataagtgatattgtttaacgaagtaaaacgtacatgaaggaaagagattacggatagcttgtctattcatttttcacgagaagaaacccaaacaaatttaattaacaacgggagacggcggacttttccatctgtcgtgcccacattcaaattcaattattttatgaatacgaaacaacttgtgttcgtggcggttatgctaatcgccacaggctcgctctatgcgcaaggaaatggatcggccggtatcacggaagcgacgaaaatggtcacaagctacttcgatccgggaacgaaattgtgctacgcgatcggagctgtggtaggtctggtcggcgggattaaggtgtacaacaagttcagctccggcgatccggatacctcgaaaacggcggcgagctggtttggtgcgtgtatctttttaatcgtggctgccactattcttcgttcattctttctctaagaaccggattcacctatatataataatgtatatgaattatgaactgaacaagggaatcggcgagagtgcggagttcaagggactcaaggctcaatatctttttattttcgtcggtgggctgctggctctgttcgtgctgtttgtcattctttatatggccggcatgaaccagtggttctgcattgctttcggcgtaatatccgcatccgtattggtccggctgactttccatctgaacggcaagttcggggaacacggactgatgaagctgctggccaggaaacagcatccccgctacctgatcaaccggatcagtccccggaaactattcacgattaaaaagaagaacgtatgcgtaacacactaaaggctgccacattggaaagcaagtttccgcttctcgccgtcgaagcggactgtatcatctccaaagatgcggacatcaccgccgtctttgaggtggatctgcccgaactcttcacggtgacggcagctgaatacgaggctgtccatgcggcatgggcaaaggcaatcaaggtattgcccaattatacggtggtacataagcaggattggtttatccgggaggattaccgcagccagacggacaaggagaatctaagtttcctttcccgaagctacgagatgcacttcaacgagcgtcctttcttgaaccataaatgctatctgtacctgaccaaaacgacgaaagagcgcatgaggatgcagagcagcttctcttcgctgtgcaggggattcatcatccccaaggaggtggacaaggataccaccgcccattttctggatacggtggggcaattcgcccgtatcgtgaacgatacagggctggtacacctaagacggctcgtcggtgatgagattaccggcacggagaataaggccggactggtggagaaatatttctgtctgtcaatggaaaataccactgcattggaagacatcgaactcggagatgacggcctgcgtgtcggtgacaagcacgtttcggtacatacgctctcggaactggatgcgttgcctggcaaggtgggtacggactgccggtatgaaagactgtcaacggacaaaagcgactgcaagctgtcattcgccagtccggtaggcctgctgctctcgtgcaatcacctgtacaaccagtatatttttctggatgacagcggcgagaacctgcaacgttttgagaagaacgcacgtaacatgcagtcgctttcgaagtactcacggagtaaccaaattaataaagagtggatcgatctgtacctgaatgacgcacattcgttcgggcttacctcggtgcgtgcccattgcaacatcatcgcatggacggacaatcctatggaggtgaagaatatgcgtaatgacgtgggcagccagatcgctatgatggaatgcaagccacgccataatacggtggacgccgccacgctgtattgggcggcgatgccggggaacggcgctgactttccggcagaggagagcttctacacgttcatcgaacaggctctctgcttctgggtggaagaaacgaactaccgcagctccgtttcacctttcggactgaagatgtcagaccgtatcagcgggaaaccgctgcatgtggacatttccgacctgccgatgaagcgtggcgtaaccaccaaccgcaacaaattcgtattgggcggttcgggaagcggcaagtcattctttatgaatcatttggcgaggcaatattatgaacagggcacgcacgtggtattgatcgacacgggaaacagttaccaggggctttgctcgctgatacaccagaagagcggtggaaaggacggtatctatttcacttatacggacgaaaacccgatagcgttcaacccttttttcacggatgataaagttttcgatattgagaagcgtgagagtatcaagacactgatcctcacactctggaaaaaggacaatgaaccggcgacacgttcggaagaagtggctctgtccaatgcggtgtccctgtatatcagacgcatcaaggaggatgaaagcatcgttccctcgttcaacaccttctacgagttcgtgaaaacggactaccggaggatactggaagagaaagaagtccgggaaaaggatttcgaccttgcggggttcctgaacgtgctggagccttattaccgtggtggagaatatgatttcctgcttaactccgacaagcagcttgacttgctcggtaagcggtttatcgtcttcgaaattgatcagatcaaagatcatcccattctttttccggtgacgactattattattatggagctgtttatcaacaagatgcgtcgtctgaaaggggtacgcaagatgatcatcatagaggaagcgtggaaggccattgccaaagaagggatggcggactatatccgctacctgttcaagactgtccgcaaattttacggagaggcggttgttgtgacgcaggaagtcgatgacatcatttcctctcctatcgtgaaggagtctattgtaaacaacagcgattgcaagattttgcttgaccaaaggaagtatcttaacaagttctcgcagatacagtccctgctggggctgacggacaaggaaaaggcgcagatcctgtcggtgaacatgtctaatgatccgaggcgcaaatacaaggaggtctggttcggattggggggcgtacagtcaacggtgtacgccacagaggtatcgcccgaagaatatctgtgctacacgaccgaagagagcgagaaagtggaagtggaacaactggcgaaacagctgggcggcaatatcgaactggctatccgaaggcttgcggaaaagaaacggaatcaaaacaatgaaataccgtaagtgcttatggagtatgaaaccttgtttccgctctactggatatgcggggagtggaaaagcagccgcaagtcgccgcccgtcaccgtattccgtgatggtggtacatacaagattgccctgacctaccaccttgatgcggtggtggtcggcacgatccaccaaagcggcggcatcatctgggcggatcttctgggaagggtgcagctcgcttatgaccgggaggaagaccgtctggtgctggctaccgaagggatatatgtacgtgcggatgattcataagaaaaaggagaactccggttctcctgtaaatggaaagaaaactatccgatttatttaacgttaaaattttaaaagacatgaaacgaataatggctgtctgtctggccgggctgctttgtccgactatggcggtaaaggcgcaatgggtaacgttcgatccctcgaaccttgcacaaagcatcgtgaatacgacccgtaacgtggtgcagaccacgacgacggcagaaaatatggtgaagaattttcaggaaacagtcaagatctacgaacaggggaagcgttattacgacgctttgaaagcggtcaacaatctggtgaaagatgcccgtaaggtgcagcagaccgttctcttggtcggtgaaatatcggacatctatgtaaactctttccagaaaatgctgacggacgggaactatacgccggacgagctttcggcaatcgcctccggatatgcgaagatgctggaagaaagcagtggtatgctgaacgagatgaagatcgttgtgacctccaccggcctttccatgacggacaaggagcgcatggacgtgatagaccgtgtgtaccgtgacgtgaagaaccaacgcaatctggtcaggtattacacgaaccggaacatcggtatctcttacctgcgtgcgaaaaagaagaatgatacccaaagggtgctggacttgtacggaacggacaatcaaaaatactggtgacatgacgggcgaggaaattttcggcaaccttcacgaagtgttgcgtaacctttatgacgagatgatgccgctctgttcggacatcacgggtgtggctaccggagtggctgcgctgggtgcgctgttctatgtggcctcacgggtgtggcaggctctttcgagagccgagccgattgacatttatccgctcttcagacctttttgtctgggggtgtgcatcatgtttttccccacattcgttctggggactatcaacggtatcatgagtccggtggtcaccggctgccacagtatcatggaaggccagacactgaacatacgggagtattccgagaagcggcagaaactggaatacgaggcgatgacgagaaatccggaaacggcgtatctggtcgataacgaggaatatgaacgccagatcgaagatctgggatggtcgccttcggatttgaaggccatggcgggcatggcggcggaacgcctcaaataccaggccaggcagagcgtgagcaatttcttccgcagctttctggaactgctgttccagtcggtttcgctggtactggacacgctgagaaccttcttcctgatcgtattgagcattctgggacctctgtcattcgccatatcggtgtacgacggcttccacaatacaatgatccaatggatttgccagtatatcagcatctatctgtggctgcccatatccgacctgttcagctccgtgctggcaaggattcaggtgctgatgatcgagaaggacatcgctgcactgagcgatcccgcctatgtgcccgacgtgaacaattccgcttacatcatcttcatgctgatagccattgtgggctatttcaccattccgacagtatccacatgggtgattcaggcatcgggagccggcaattacggcaagcaggtcaactcgtggtcactaaagggcggacgtgcagctgccgccatcaccggtgcttccatcgggcatatagccggcaagttaagaggaagatgaaccaacgtaaatattagagatgtatggaatttaaaagtttaaagaatatagaaacgagcttccggcaaattcgcacgatggggatcgtgttcgtttcgctctgtgctctggttaccggctatgctctctggagctcctaccggttcgccgaacggcagagggagaaaatctatgtgctggacaatgggaagtccctgatacttgctctttcccaagacctttcgcagaacaggccggtggaggcgaaagaacatatccggcgtttccacgagctgtttttcactttgtcgcccgataaggcggctatcgagtcgaatatccgccgggcgttgttcctgtgcgacgagagtgcgttccgctactacaaggactgggaggaaaaggggtattacaaccgtataatctcggccaatatcaaccagagcatccgggtggacagcgtggcgtgcgacttcaacagctacccgtatgtggtgacaacttacgcacggcagtcgctcgtcaggtcgagtaacatcacggaacggagccttgtaacccgttgccggctgttgaactcggtcaggtcggacaataacccgcacggcttcacgatggagcagttcaatatcgtggagaaccgggatttgagaaccgttgaacgataacttaaaaaaaagacaggaaatgaaccgattgaaaaaatggatcaggtacgtgcctgacaggatagacgacggactccgctatctgtgcggacggatgtcgcccgatgtacggctcgtctgcgtggtggccatgctcaccggcttcggctgtctgtcgatatacatgacggtatcttcgatataccgcatcggcaggcatgagggggagcagttgcaaatggagcatatcaggcggatggaactgtacagggggataaacaaggatagtataaatattaaaaatcaggtggattatggagaacctaaaaaatcaggaacggcaaccggcgaacgctgcaacgcctgaaaaagcggaagagaaagggcaaacgccgaaacaggggaagaaagaggccaaacctctgactccggaagagatgctcaaacgaaagaagatgctcgtgtatccgttgttctttctcgtgtttctgggagcgatgtggctgatattcgctccttctgacagcgacgagccattaagggagggattcaacgtggatgtcccgatgccggaggacaaggggctgctgtcggataaaaagaccgcctacgaacaaagtgcctttgaaaagaaacaaaaggagaaaatgaacacgctccaggatctggcggtatcgctggaacaggaagagccggtggcggacgaggtattcctgacggaaaaggacacggacaacggcagtccgtctatccgttcctccgccaatgcctatcaggacatcaaccggcagttgggcagtttttatgaaacacggcctgcggaagatgaccagaaaacgctggaactggaatggcgtattcaggagctggagcgtcaggcggaggaagagcgcaaggccagagaaaacggtgaggaacaactgcggctgatggagaagtcctacgagatggcggcaaggtacatgccgggcagcggtggcgaaaccaaacaggtcgccgtgtcctcctctacgggtaaaatgccggtctgcccggttacgcaggtaacggaacgggtggtcagcctgctgaccgcacccctgtccgatgaagggttcgccagacagtacggcaagcccagaaacatgggtttccacacggtggggacagtccggagccgtacggaaaggaacggtatccgtgcctgcgtgtacaggacggtaacggtttcgggcagcgacggtcaggaggtgggactccgcctgctggagccggtgcaggccggagagttgtacatacccgccaacacgatactgaccggcacggcgaaaatcagcggtgaacgtatggaaatcaccgtttcctcggtcgcctttcagggaacaatcctgccggtggaactggatgcttatgacacgaggggcatgaagggcattgaggtcaggggatcgcaggagcttaccgccgtcaaggagatggcggccaacatgggttcggcaatgggaagcagcatcaatatctccgccaatgccggtgcacagctggctgcggacttgggcaaaggggtgatacagggggcatcgcaatacctttccacaaagttcaggagtgccaaggcgactttgaaggcggattacgagctattgctcgtgtcaagacaataaacggttaaaatcaatttattaatcaagaaaaaacaacaagcatgaaaaaagtaattttaatgatggcttttgccattggtatgaccggtgcgtatgcacaaaagaccgtgaaagtggaaaagacgggaaatgacacggaagaaacggcggattccggagaaacgggaaccacgccgctgccggataaggaggacgcaaggcgcagcccgtccaccggtgatttgtttgacgggctgacacgtccggtgacattcgaccggatggttcctccatacgccttggaggtgacatttaataaaactgtacaccttatcttcccggctgctatcaagtatgtggatctgggatcggctgacattcttgccggcaaagcggacggttcggagaacgtgcttcgggtgaaagcggcgttgagggacttctcccgtgaaacgaatctggcggtgatcacggatgacggcagctattatacattcaacgtgaagtatgcggacgagccggccaagctgaatatcgagatgaaagacttcatccatgatggcgaggcggtgaaccggccgaacaactcgcaggaaatctaccttacggaactcggcagcgagtccccgctgctggtacggctgatcatgaagtccgtctatgacaacaacaaacgtctggtgaagcatatcggctgcaagcgcttcggtatccagtacatcctgaaggggatttatacgcacaacggtctgctttatttccatacggaactgaaaaacgcttccaacgtgccattctccgttgactttgtcacttttaaggtggtggataaaaaggttgcaaaacgtaccgccattcaggaacaggttatcgtgccgcttcgtgccttcaactatgtgacggcggttgacggaaagagcaaggaacggacggtatttaccctgcccaaattcacccttccggatgacaagcagctggttgtcgagatgaacgaacagaacgggggaaggcatcagcggtttattctgaccaacgccgagctgatccgtgccagagtcattaacgagctgaaggtgaaatagtatgaaaagggtctctgttattatatgtatacttttgtgctttgtcctgacggacaaggcacatgcccaacgttgcctgcccagtacaaaagggctgcgtattaccgccggcatgacggacggctttcacactgcggacaaacgtaacgagctgggttaccatttcgggatgggaatggacagatatgtgaacggctgccataagtgggtattcggtggcgagtatctccagaagtattatccatacaaggacatacgtgtcccggtttcccaattcactgcggaaggcggctattattataatttcctttcggatgccaacaaagtgtttctctgctatgccggcggttcggtgttggcgggatatgaaaccgtgaattggggcacaggcatgctgttcgatggttcacgcctgtgtgtcggggatgcgtttgtctatggcggtgcggtatcgctggagatagaaacctaccttgccaatcaggtggtattgctgttccatgcccgtgagcgttgcctctggggaaatgacagcggacactttcatttccagttcggggtgggattgaaaattattttgaattgataaaacaataatagaatgaaaaagatgattgaaagcatgattatagcaggttgtatgctggtagccttgttatatatgaccgcctgttctgacaaattggacgttcagcagatgtatgagtttgatctggcgaccttgccggtgcagacgacaatcgtaaagggcgaggaagcggaaatccgttgtcaacttgtaagaagcggcgagtatcaggacaccaaatacttcatcaggtacttccaaccgacaggcaaaggggagcttcgcatggagaacggtacggttttgttgccgaacgacctgtatccgttaccggaagaaacattcaggctctattacaggtcatttggcacagaccagcagaaaatagacatttacattcttgattccttcggtcaggttgtgcaaaagtcttttgcctttaataatgaagcggaagatgaaaaggaggataccgaatgatttatgccggatataccccgaaaaaaaagcagcgacaacgctgagtggagaaactgaatgaaaacctaatgagatccccccttaccggcttccattccggtaaagggggcttgttcctgtattatttcttatcctcttttttttaagccactcgttgcaccgtcgcctgcactcttccaatgtgggcttcacacaggagaaaagttcgttgtctgccgtatccctataatcatagtgatagaacgtgcgccttttccgtcctacggtcatttggaatttttcatatttctcacccgtcttgcaggttgaaactccgttctcgttcatttttgttgccataacttatgattttatagttcgtgaatattaaaacagacttaactgtcggggctgtgtgtatttccgcttgatttccaacagttttcctttcagactgcggataacctttgggttgtaattgcttctgtcggaaacagaccaacgttccgctttattgtattgttgctccaacaggcggattccttgtcggatagcttccttataatctctgacaggttcatcccaaacggacgggtggctaccgcctccggctgtgccggtacaccagtcgatggctaccgcatacgtcccgtcaacggattgcccgatatggatcgtgttgaaggtgtctaacttgatttcctctattatcggcaacatgccatttatccaaccgtgttcgttgaactgcttgccgacataaccgaaaatcatccctctttcatacgtgcgtacattgagtatgatatgtcgtacactcttgccaaaactctcgaaataagcgatttgttccgtgtcattacggcgtactgccaacaagtaacggaggactgcactacgctctaccctgcaagggttgtactctacaatctcctgcaatttctcttctcgtgtcatttgggatattggtttcatatcatttatgtattagagggttaaaatgttgcaatgaataaccggctttggatgaactgcatgcttcctttggaaatgcgctggttgcaccagaaatggtgtgagccgtagccgtaggtgaaaaactcgtccagttcggtcgtttcccgaagtttgtcaatggattggcggagttcctcttctgtccggcaaaagagaagggtgtttaccagtcggataaggagtgcagggattttttcatcccatgcacaaattgtggtttcaaacgttacgttcatatttttctgatttattcattagacagtcattttcaaaatctctctccagtatatcggctccacctcactgagaaggaaatcgataaaatcttttctcgcttctttgcacaattcctggtaaagctctccaaaggtggtgatgttgccgttcaggtaggtttccaccatgtactcgaaaatgttgcttacctcgtaatatctgcactgctgtgcgacagtcctgctgtatcgtttcataaggctttatttataaagatttataatgattctgttcattatccgtgcttttcctacggtataataagtaccgccatagggctgcttgtcccaataggctaaaacaatctcggagttgtcaatcaggtagtcgttcctgtggtggaagcagcctttgcggtaatcttctcggagaatgaccgtttcatcggcagttttcattatccggtcgtataaggacttgttctccggccggtatctgtttgactgccggctgaacggcacaacggcaatgagtcgaatgtccgtgtattccgctttaagggcagttaccgcttgggctgcaagcaaatcgaagccttccgccattccgcttagaaagtagcgatagcccagactatacaaccttcttacttgcgaaactatatccagataaagatgcagcataccgacttggaggatacgctctgaacggtgtccggtgaacgctactgattttgtaatatccattgtcataactgtatgtgttaaagaattaataaccaaatgataatcccgactacgactgcaaaggagagaatggaaaccagacacccccatgcggagcggatcacgtccgttatcagttcttttgcgagccataaaccgataaaccacgctaaaagactgccaccgtacagactccaacagcagcctgaaagaaggagccgaactaaccagccaaacaatttatgcagaggcagattgagtctgttcttatttcctttatgtatttctcttgctgttttcataatcacgacattttttttatgcattgacgagttgagctgacttatttcatgtgcgtcaaaaggtcgggtttaggaaaaacaaggttttgggtaaaaatacctcgtgccattatggcgcagggaagatttttttcaaaaccggaacggcttgaccttgtttttccgttaagaacccgaagtacctttgcacttgaataagttagtttaattcgttcctttgctttaaatgtggagtgatggctactgaaaacagtgagagaaataccccgaaggaagttagccttaaactttgcttaaaatcgttgtgttataaatcccttatacataaagcgatgattaatacgaaaaaaattctacctttgtgttagcgatgcaaatagcatcgtgtaatctgttcgtttaccgtagtccagaaatcgccaatttcaaaaatacagaggtaaatgaaccaggtaggttatatactttgacgtaacctgtcggttcactctgtattgagcgtttggcgatgctttggacttgtgactggcagcgttacgtcaatttaatataataacgttattgttatggatttacaatcgactctcctgaaaggagtagtccggtcttcagaagatgggcttttctatctgtttcccattcagagtctatctacattgcaagagatgaaagggcatttgacctgtgcgatagatgtcttgagcaatccggatgaaagtgatgtggaaaagcgtttggacgcagttcggacattgaacagccttgtggctgcattgagtgttaatgacggtgatcactatgatgtgatagatactgcctttgaggagatcagagagtaaaaaaacagagcgatataataaaagccttcctatttcaaaaccggaaaaaagaaaggtgttgtactgtccaatgtgtgattcatcgcgcttgtttgtacaacacttttctgcggttttgtatggatgaaagattgttccggttccggaagaatgggaacgttttttctactgataataatgtggcttttattccgttattgaggttggggattgaaatgtaagaacttcatctgttccgttattaatctgttcctgttcacgctctttacgccgtatttctttttccttcttttttgttttagtctttatttcctgttctttaaggatttgctttaggggcttgactacatcaggacgttcctttttgaaacgtttatagaagatctcttctataaattccggtaagggggctttccacggttcttgccggtggttgtctatcttgccgagtttatcgggattgagtccaagttcacgggccatttgtacatgggtatccgatagccggtgtttcttttgggcgactatccatttttcgatctgggatttcttgattgccatattacttttgattttcagactttattgttttacctaaaaacaaaccggtaacggattttgcaccgagttgtatcagtttgcatttcatttgcgtgaaattctcgccggaagagataatgtcgtctattaaaaatacgtcccggcccttaaaataatcgggatgaaagatcaagttggataacttgtcttgtccgtgagttcctttcatctgctcacggtcttcttttatccatgtggcacgaaatccgtccacgactttaagtcgacgtgagagaaggctgcaaaaacgggcgaagcgggtgatgttccgttcacgggttgccgccggtatggggatcagcacggcgttggcggctttctccttaaagaacggcatccgggcgatacaaagcgagaagatcttggcgacaagagctgcttgtcgtccttctttaaatctaaataccagattgctcgtctttctgtcagataccgatatgtccttgcatctggtcgggtaataatcgtggatatagaaacacaaggctccgtcgatacgcatcttgcctttgaaatgggtattgtatgggaagaactggcgcacgaaatcgctctcgaaagtaaagtggagtatatcacgccaaagggtgagcgtggtttcatcctgtacccgatagagttctccgttgatactttctttatccgataaaccaatgccgattatcaggtggtcattgaaagtgtcttttgatacaatataccaatcaaaagattggcagatgctcacgatgtcacagttattggtgcaaaggaagtagaaggtattgtcagacctctggataatcagaaactcgccggacatttcggaaaggcgaaaatagttgctgatatgggcttcctccacctcgctgaaggatacggatatggtgaggttttctatcatgacattgttatttggcgtaaagatagaaatttcgggagaaaaagaggccttgcccgttggattttcgggtaaggctcgctatttacaggtttctatgcacgttagttataagaaatggtagtccggttgctgtcgggatggaaaacaacaaggacttcgggctttttctcttgcaggcgtttgtactcgcacagggagttgagtacccactcacgaaacagcttcgtgcaataggtgttgatgcggaagctgagaaatatgatcgcttccagattataataggtaacaatgcttttgttctgtttctcggttatggtcacgtcgccgtcgtaaagcaggcgggatttgaagatggagcgcacattggcgtctattgtctgaacgaacactccgaacagacgggcaagttcgtgcttggtcatccatacgttgccgttctctatctttacactgacgatgggttgttcatccttgttttccaaaccggtgatggtgatgtatcctctatttttcataaggcgttgttttttaaatggtgtgacaatataatgatttgtttattcatacagcgttttgcgccgtacctttttgcatattttttagttttcgatccagcatattcatgtcatggctcaactttctgtccaccacacgggcataaatctgtgtggtctgaatgttggtgtgtccgagcatcttggatacgctctcaatgggaacgcctttggtaaggcagatttctgtggcgaacgaatgccgggcgagatgggaactcattagcatagcaacatcaaatagaacagcgcgttagaaacataatctgttagaaatgagctacatttcattatctggcacacctttctgaaacggattcagacggaatgccgaatcggttccgtttcttaaccgttaacaggttgtttcggaaacctgccgtgttaaccggatgattgaaaaaagttctccgacgggttgtttttctatgatactcagtattttgcgtagcgatgaacgcttacattcataataactttgcactcaaaaaaatgtaggcgtatgaaaattgagaaattcaaggtcttgctgtttttgaagaagaccgaacccgacaagtcgggcaaagctcccatcatgggacgcatcacattgaaccggacggtggcgcagttcagcaccaagctctcgtgcacgcccaagctgtggaacgtgcgtgaaaaccgtctggaaggaaagagccgcgaggcggtggagaccaatgcgaaaatcgagaaactgctgctggccatccatgcggcattcaatgaattgcaggaacggaaacgcgatttcggcgctgcggacgtgaggaaccttttccagggaagcatggaaacccagatgaccctgctccggctgttcgaccggcacatcgaggaaacgagggagcgcatcggcatcgatgtgtgcgcgtcctccatgagcacctaccattatgcgcggaaaacgctcggcgagtttgtcaggaaaaaatacaaggtgaaggacatcgccttcggtgcgttgaacgaacagttcattcgggaataccagtcctatatcgaagtaaaatgcgggtattccaaccagacctcacggcatcatctggccctgctgaaacggatctgccggatagcgtacaaggaagggttctccgagcggtaccatttcctgcatttcaagatacccaagcagaaggagaccaccccgaaggcgttgagccgcgaggacttcgagaagctgcgtgacttggaaatcccggaaaagcgccgctccctcgtccttacgagggacctgttcctgtttgcctgttatgccggaaccgcctatgcggacaccatatccattacccgcgagaacctcttcaccgacgatgaaggcagcctgtggttgaaataccgacggaaaaagaacgaactgacggcgcgcgtcaaactgctacccgaggccattgccctgatagagaaataccgggacgatttgcgggagaccctgttccctaaccagctgtacagtacgcttcgggcgaacatgaaaatcctgcgcgtgctggccggactgacgaccgaactcgtctatcatatgggaaggcactcgtttgcctcgcttgtcacgctcgaagagggcgtgcccatcgagaccatcagcaagatgctgggacataacaatataaagacgacccagatctatgcccgagtcaccccgaaaaagctgttcgaggacatggaccgcttcattgaggcgaccaaagaccttgaactggttttatgagaaagggttgtaaaaacgagattggaaaaaaataaatgtagaacatcagctaaaatgaaccatcatgcgtagcactttcaagatattgccctatatcaataggaaaagaatcaagtccgacggcacgaccgccgtcctttgccgtgtgtccatcgacggcaaaagcatcctcatcacgaccggcatcttctgccgtccggaggattggaacagccagacgggaaccatccgccagccccgcgagaacaaccgcctcgcagaattccgcctgaatctcgaacgggcttatgaccgcctcctgaaagaacagggcgcagtcagcgccgaactgctgaaaaacgccgtgacaggtgtggcgaccattccccagacccttctcaaaggcggcgaagcggagcgggaacggctcaggctgcgtgccgaacaaatccattcgacttccacgttccggcagtcgaagaccacgcagctcaacctgcaacagttcctccagtcccgtggcctggaggacatcgccttttccgacatcacggaggagttcggccattcgttcaaactgttcctgaaaaaggaactgggttatgcctccgggcatgtgaaccactgcctgtgctggctgaaccgccttatctatattgcggtggatgagggcgtgctccggtgcaaccccttggaggacgtgcattatgagaagaaggacccgcccaagatgcgccacatcagccgcagcgagctgaaacgccttatggccacgccgatgccggatcccaaggtggagctggcccgccgcatgttcatcttctcctcgctgaccggtctggcgtacgcggacgtgtataacctgtacccccgacacatcggcaaaacttctgagggcaggctctatatccgcaagccgagggaaaagaccgaggtggagaccttcgtccccctgcacccggccgctcggcagattctggaactgtacaataccacggacgacacccgtcccgtgttccccctgcccaagcgggacatcctttggtacgacattcacgggctgggtgtcatgctgggcatccagaagaacctttcccatcacgccgcaaggcacaccttcggtacccttttggtctccgagggcatttccatagaaagcgcggcgaagatgatgggccatgccgacatcaacagcacccagatttatgcgcagattaccgactgcaagatatcgaaggacatggaccgtctgatggaacggcgcaacagccggaacgaaatgccaatggatgaataacaaaaaagtcaggaatcatggaacgttacattatcactttggacgaacacggcacacttcacgtgccggatgtttccgcaacagccatctggatgaatgaaccggaactgatggaactgttcggcgtggttgccctcacgctccgggcggcgataaaggccgtgtacaagagcggcatcctgaatcccggcgaagcggaacgtcgtgtccgccaagcggacgggtacgggatggacgtgctgtacggcctcccgttggtcattgcccttgccttccgccttcatacctgcggggcaaaacgtctgcgagaacgggtcatcggaaaattcacttgccacggtggacggaataccgcccgcctgttcatctttccggtcagtccgcattggcaaatggtgcggaattgaccgtattatcaactcacgcacaataaagcggcgcatcatgagaggattatctcccgtgatgcgccgctttcgtacattcctacaggtggccgggtcatttgcaagtgttttttgcaaataccggaaagggtggtccacttttcaatgcgtacacgacttctaccgccacctacatttttcccatgtccttctcaggttccgatacggaatgcctcccgataaccctccatcagcagccgttcgatatccgactcccggtacaggattttccctcccagctggatataagacatgcgccccgcatcccggtattcctgcaatgtccggcggcaggtcttcaacaatttggccacttcccggtctgtcaggtagcgttccccgcccaatacggggcggtagttttcggccaataattcaatgtggtccaatgcgtgctccagcattctgaacagcgcggccatctgtccgctttcccttgtcatcaattcgttcattgtcagtctgatttaagtgatactcatttaaccttcctcaaatagtttttcctttcaaggccgccagggtgcggcgttcctccaccagcggcacgatgcgccgcacgtcctccgcccggtagaacatcttgcgcacaatctgtgagtaagccagcgtgccgttgtcgcgcagcgtctgcaaggtgcgcgggctgatttgcaggatctggcacacctccgtgctgtccagccattcactgaggcgtttctcctccgccttgcggcagaacctgtccaccattccggccagccggttgaaacgcgccatcaattcctcaaaagtcttttgctcgattacgattacattttccataagattaccgtttaattgtgattatgccgcaaagtaaacggaattacgggcagagtccaccgcttgtcaggcgcgtggcagcatttggcgttgtcgtggcagccgttggcgttcttcgggtacatctatctccccatcattcctgttccagtccctgccccacaccttatatataatatatggtaaggcaagacaccttatgtaccttgagggatggaaacagcggcataaaagctttttcagacctgccggacgggacttttcaaaaaaatcattgccgactcggtaacgactatggaaaacgcctcttgcacaataccgatttttgcagcgtaatcatcaacaaggaacgatatggacacagagaaagtgaaacagaacccggccgtggaagcggcgggaagcagtggcgggcaagccgcaagaatcttcaagaaggagaatatcccgaagacggcggaaacggtcgggcgggacaccttcgaggaatggatgggacgcatcatggaacgtttcgaccgccaggaccggatcatctcggtgctggtgaacaaggatgccgccggagtgaagtacctggacggggaacggttgtacgacaaccaggacctgtgcgagatgctgaggacaagcaaacggtcgctgcaacgcttccgaagcaagtacaggctccgttaccaacggattggtcacaagacctattacaaggaatcggacgtgctggagttcatcagccaaaatatggaggaagtgctgcaaggcggtaccaaggtgctccgcatgaaagagcaacccggcatggaagccccaaagaacaaatccggcaaaagaccgggccacaagaagtattcacctaaaaaataaaagtaaaaatgatggcaacggaaaaagaaaacatggccatgacggctgaaaccagagaacagaaaccgagtatggccacctgcaaggaagccttggcggattacaggcggatttacctgcccgtgcctgccattgaagaccgcaagccggtattcctcagcaaggagacccgtgacaggctggaccggatagtccggttgttcggtgagcggaaaatgagcgtttcaggattgacggaaaacatcgtccgccgccacttggaaatatatgagaaggaaatagacgaatggcgcaagctgtgattttgataacccattaaaaaacatcgaaaaaaatggaacagaaaaagaaaaagcaagaggacgtgctggtcgtccgcgacgagaaaacgggcgagatcagcgtggtcgccgggctggacggcaagggctaccccaatacgaagcccgcgaagccggaacactcgcaggacttcctgcgcttcgaccgccacggggacatggtggacaatttcttcaagaacttctaccgccagtgcaaggagccgacgcgcttcggcttctatcgggtggcggcggatgcggtggacacgctgcttcccgtcatcaaggacttcctgaaagaccccgtggcaaacgcggagatacttgcctcgcacaaggtggacaccgccaagtaccagcaacaagcagaaacagagaatgtcaaacaagaaaaaaataacaacgaacccattaaaaagacagaagaaatggaaaagaaagaagaactgaaacaagagaaggatgttcagcagccacaggtagctgaaacacaggagaagcctaatctgatagcggacgaccaagtaaactgggaggaactgcgcaagtgcggcattgacaaggagaaactctcggaaaaggacctaaaagccctgatgaactacggcaagacgggattagtgacggtaaagccgaccttcggctatgagagttacgaattgcaggcccgattgtctttccagaagatggaggacggctatctgaagctgacaccccattttatccgcaatgaaccacgccttgacatcccccacaggggctacaccttcaccgaagaggacaagaagacgttgaaacgcacgggcaacctcggcaagcccgtcaacttcgccaacgagaagacaggtgaaatcaagccccactacatcagcatcgaccgcctgacgaatgaaatcgtggacatccctgccgacaaggtgcgcatccctaacaaaatcggacagaccaacctgtcaagggaagagcaggacatcctacgtgcgggattgcctttgcccaaggaagtgatgctctccaacgggcgcaagttccaagccttgttgcaggtgaacgccgacaagcgcgatgtggagttcgtgccgggacaaccgaggcagcagcaatcccagcgtcagggaaacggccaaggtaaggcgcaggacaattccaattcgccccaacagtcacaaggtgaagaagatgggaataaccagcaacgccgtaaccgctcgtggacaaacgaggacgggagcatccgccccatcaagaaatggaaagacgatgtgtttaccgaccagcagatagccgactacgtggcgggcaagacggtggtgctcgccaatgcgaaggacgaccaaggccagccctgcacgaagtacctgaagttcaacttcgagaaaggccgaccgctgacctactcgcagaaccccgacctcgcgcagaccgtcgcaccgtccaacgagagccggacacagctcgccgtgaacaacgaagggaagaccaacgaagcgaccaaacacgtgaaagagccgttgcagcagggtcagaccacgccgaagaatgatgcgcagcagaagcagcaggccaagaaatccaaaggcatgaaagtatcttcctgattgccgccactaaatccatccgataagtattgacgggctgaaacggggaacatgcaccgccttgtgcgcatatcccacaaacaatgccgtgccccgtttcatccccattaaagacaaaagtatcaacgaataaaaaaacagagaaagacatgattaccatattggcagaaaaaccgagcgtcgcccgtgagatagcacggattgtcggcgcgatgaaaagggaagaagggtatttcaccgggaacggctaccacgtgacatgggcgctggggcatctggtgcagcttgccctgccagacggctacggcatcaagggcttccggcgcgacagcctgcctgtcattcctaaaaacttcgagcttataccccgacaggtaaaaacggacaagggctacaaggcggacgcggcggcggtgaagcaaatcaaggtgataaccaagctgtggaacgaaagcgatggcatcatcgtggcgaccgactgcgcccgtgaaggcgaactgattttcaggtatttgtattcctatatcggctgcaccctgccgttccaaaggctgtggataagctcgctgacagatgccgccatccgcaagggattaaagaaactgaaggacggccgcgaatacgacaacctctatcaagccgccaaagcccgcagcgaagccgactggctggtaggcatcaacggcacacaggcgttgtcggtggccgccgggcgcggcacgtattccgtgggacgggtgcagacacccacgctgacgatggtctgccaacgtttttgggagaacaagcgtttccagcccgaaccggtataccagctccatttcaccacgccgtcggtgagcgtggatgaggtcgtgaagttcgcctcggtggagaaatggaaggacaaggaggaagccgccatactatataataaggtaaaggaacagatggcagcaaccgttaccaaagtcgaaaagagggaaaagatagagaaccctccgctcctgtacgacctgaccacgctacaaaagaaggcgaacacgaggcacggcttcacggcggaacagacgctcgccctcgtgcagaagctctacgaggcgaagctcgtcacctatccgagaacatcaagccgctacatcccggaggacgtgtttgacgaagtgcccatgctgttcgaccgtctggcaacccattcttcctttgcggagaagattggagccttggacggactgaaccgccgcagcgtggacgcctcgaaagtgaccgaccaccatgccctgttggtgacacccaaccgtccattggcgctctacaaggacgagcagaccatctacgacatgattgtggggcgcatggtggaagcgttctccccggagtgcgtcaaggacacgaccaccgtccgggcggagtgtgagggcatagcgttcgagacaaaaggctgcatcgtgcgcaaggcgggctggcggtcggtctatggcgaggacaacatagacaccgttttgcccgactggaaagaaggtgatatattggcaatgagcggctgttcgatgagttcgggcatgacacgcccgaagccgttgcataccgaaagcaccctgctggcggcgatggagaccgccgggcgcgagggcttggaggacgaggaagcgcggcaggcgttgaaggactgcggcatcggcacgcccgccacccgtgccgccatcatcgagaccctgctcaaaagggaatacatggtgcgcgtgaagaagtcgctcgtgccgacggagaaagggcttgccctgtattccatcgtcaggggcatggacatcgccgacgtggagatgacgggacgctgggaggcggaactggcggagatagaaaaaggcaggatgccgcacgaggcattcatccgcgacattgaaagctatacccggaaaatcaccacggaactgcttgcctcggacaagctgttcgggcacaaggcatcggactgtgcctgccccaagtgcggcaagggtacgatgcagttctacggcaaggtggtgcgctgcgacaacccggactgcgccctgcccgtgttccgccagatggcgggcaggacgctcaccgacgcggaaatgaacgaactgctggcaaaaggcagcacgggtgtcctcaacggcttcaagagcaggcagggcaagccgttcagcgcaatggtcacattcgatgcggatttcaatacaaaattcgtgtttcccgaagccaaaggcacaaaaaaattcactaacaggaaaggaggaagaaaataatacgtaccttttaataaagtaagctgcatctcggaataaaaaataagcgagcttattttgttctcccctcgatttgcattacttttgccactgattcatgtcataatctgtttcaattcgttgatactcgttattcacatggatttagtggcggcactcggagggataccgggtgccttttttcttctttcctatccattccacaatctgatttttcaccactaaatccatcagaaaatgaaacagaacaagaaaaccgtcccagcggaactgtcctactacgggctgtacctgctggactacctgagaaaataccatcccgacaaagtttccgacacgtaccttattgcagagagggaggaagctgccgccaccacctttgaaaaagaaaggtcggcaggaagtacggtcgagtatgcccacgaggaagccatgcgcgtcctgctgcacgggctgcacttctcgccctacgccctgctgcgcgaggtcgtggaaaacgagttcgccgacgaggtggcggaatccggccgcgaggcgttctgcaacgagctttatccctacttgacaaacctgttcgccggttacgacacgtcggacgacaccttcgccctgtcgcccggacacgacctgctctacacggagctggtgggaaccgtcatgctttatctggagtcctatggcgttcaataggaaacagaagatgcgcgacaacatcgaggcggtacgcacggcgttcacgctggaccgggagcggcgcacacccaccgagagggaacgtgcgctattagagcgttactgcggcttcgggggcctgaagtgcatcctgaacccggcaagggaactggcggacgccgcgcgttgggcgaagtccgacctcgaactgttcgcgcctacggtggaactgcaccgaatcattagagagaacagcaaggatgaaacggagtacaaacgctacgtggactcgcttaaagcctcggtgctgacggcgttctacaccccgaaagcaataaccgacaccatcgcggacgtgctgcacgacaagaaggtgcgccccaacctcgtgctggagccgtcagcgggcatgggcgcgttcatcggctcggtgctgtcggacaacccgcaggcggaggtgatggccttcgagaaagacctgctgacgggcaagatgctgggacacctgtacccgcagcagaagatacgcacggagggcttcgagaagatagaaaagccgttcctgaaccgttttgaccttgccatatccaacatccctttcggggacatcgcggtgttcgacccggaatatgccaacggctcggtgttcaagaagatagcggcaaggaaggtgcatacctatttcttcctgaaagggctggacgcggtgcgtgacggcggcatcgtggcgttcatcacctcgcagggggtattgaatacggaaagcaacggcggcacacgctacatgatgacaaggaaagcggacttggtgtccgccatccgcctgccgaacaacctgttcacggaagatgccaacacggaggtggggtgtgacctgataatcctgcaaaagaatgaaggcaaggaggaactttccgaggaagacaagaggttgggcgatgtggtaaagagcaaccacacgaacattgtttccaacgggtatttcctcgaccacccggaacgcatcatccataccgacgcgaaaagggacaccgacccttacggtaagcccgctatggtttatacgcacagcggtggtgtggagggcatcgcaacggatttgtaccaaatgctgtcggcggacttgtcggcacggctggacttggaacgctataatggcatcaaggaaaaaaggcaggagactcggcagacgattgtcgtacaacctatgcagacggaggcgaaaaaagaagaaaagtcggtacagttgaaagcggaaccggtgcaagccgtggctcaggaggtggaaagcaaacgccccgaagccccggttatggacttgtacgacctgttcggctacacgcaggaagagcggcggttggcggaacgggggctgaaaccggaacggaagaaaagcggtaagtccaaagggaagaaagccgtacagccaacattgttctccctcccgaagagcggaaaggaggaagcggcgaaaaaagaaagcggaaaagtgaaagccaaatccacagaagcggcttccgacatcacgtccttgactccggaagaagcgcaggaaatggaggaaattatccgcaacaggatggatgtgccgcaagcgtcccgacaggaaaccgtttctgccacttcacccgatgtgaaagacgcttccgaaaccacagaggacgatgacccggaggatgccatctaccgcagtctggactgggagaccaacccgcccatcaacggcttctatgaaatgatgatgtcgctcacgccggaacgccgggcggaactgcgccgcctcggtcgggagaagatggatgccaatgcagccaaacaggcggaaagggcggcggaggcgaaaaaagaagaaagacaggctacggaaatggagcaaccatcgtccgtgcgcccattttatcccgttgagaacggttttgaggcggaagggaaagcgcaaatcgagcgtgtggaaagggaaatgcgcgaggaagaagccgccttgacacccgaagaacggcaacgccggaaagaggaagcgatgatgccacgcccgttcaagggcatcatggagccgcacttgaaagacggctctctggtatgggaacacacaggcggcgtccgcttccaaatcggggtgctgagggatgtcaccaggtacggggcgactttccagccgctcgacatggaggggatgcaggcgcagaaggcacagttgtacatcgacctgcgtaacacctacgagcggctctacgtccacgaagcggagaaccacgaggaaaacgccctgctgcgccgcaacctgaacacctactacgatgagttcgtcatgcgctacggcaacctgaacgccaagcacaacgcaaagttcatcctgatggacgcttcggggcgcaacatgctctcgttggagcgcggcgaggacgggcagtttgtcaaggcggacatcttcgaccgtcccgtttccttttcgcaggaaacattggtcgaagtggaatcgcccgaagaagccctgtccgcctcgctcaacctgtacggcggcgtgaacctgccctacatggaatccctctgcgacctgccgcaagcggagatgctggaagccctgaaagggcgggtgttctacaacccgttggcggagggctacgagattgccgaccgcttcatcgccgggaacgtggtgcagaaagtcgccgacgtggagggctggattagggaacacgagggacacgcaatgctgccgcaggcgcaggagtcattggcggctttgcgcgagaatgtgcccgaacaaatccccttcgaggacttggacttcaacttcggggagcgttggatacccacgggcgtgtatgccgcctacatgagccgcctgttcgacacggacgtgcggataacctactcggaaagccttgacgagtattccgtgaactgtgcctgcaagacgatgaaaatcacagacgagtttctggtaaagggctattaccgcaactacgacggcatgaacctgctgaaacacgcgctgcacaacacctgcccggacatgatgaaaagcatcggcaaggacgaaaacgggaacgacatcaaggtgcgcgacagcgagggcatccagctcgccaacgcgaagattgacgaaatccgaaacggcttcaccgaatggctggaagaacagtcgccggagttcaagaaacgcctgacagatatgtacaacggcaagttcaactgcttcgtgcgcccgaagtacgacggctcgcaccagaagttcccgggcttggacctgaaaggcttgggcataaaggacttgtacccctcgcagaaggattgcgtatggatggtgaaacagaacggcggcggcataggcgaccaggaagttggcggcggcaagacgctgataatgtgcgtcgcctcctacgagatgaagcgtctgggcttggcgcacaagccgatgattatcgggttgaaagccaacgtgagggagattgccgagacctaccgcaaggcttaccccaacgcccgcatcctctacgcctcggagaaggacttttccgccgccaaccgggtgcgcttcttcaacgacatcaagaacaacgattgggattgcgtcatcatgtcgcacgaccagttcggaaagatcccgcagtcgccggagttgcagcagcgcatcttgcaggcggaactggacacggtggaggaaaaccttgaggtattgcgtagtcagggcaaggacgtgtcacgcgccatgctgcggggcttggagaaacgcaagttcaacctgcaagccaaattggaaaaggtggaacacgccatcaagacgagggcggacgacgtggcggacttcaagcagatgggcatcgaccacctctttgtcgatgagagccaccaattcaagaacctgacgttcaacacgcgccacgaccgagtggcggggctgggcaactccgaggggagccagaaggcgctgaacctgctgttcgccatccgcaccatacaggaacggacgggcagggatttgggagccacgttcctctccggcacgaccatatccaatagcctcacggagttatatctgctgttcaagtacctgcgcccgaaggcgttggagaagcaggacatccgctgtttcgacgcatgggcggcgatattcgctaagaagacgaccgactttgagttcaacgtaacgaacagcatcgtgcagaaggaacgtttccgctactttattaaagtacccgaactggcggcgttctacaacgagataaccgactaccgcacggcggaggacattggcgtggaacgtccgaagaagaacgagatactgcaccacattccgcccacgcccgaccaagaggtgtttatcggaaagctgatgcagttcgccaagtccggcgatgcgactatcttaggcaggccgccgctgtcggaaacagaggaaaaggcgaagatgctcatcgccacggactatgcccggaagatggcattggacatgcgcatgattgacccgaattacgaagaccaccccgacaacaaggcgagccattgcgccaagatgatagcggaatactatcataaatacgatgcgcagaggggtacgcagttcgtgttcagcgacctcggtacattccagccgggcggcggatggagcgtctataccgaaatcaagcgcaagctggtggaggactacggcatacccgcccatgaaatccgcttcattcaggagtgcaagaccgagaaggcaaggaaggcggtcatcgaggcgatgaacgaggggcaggtgcgtgtgctgttcggatcgacgagtatgctcggcacgggtgtgaatgcccagcgcagggcggtcgccatccatcacctcgacacgccgtggcggccgtccgacctcgcccagcgtgacggacgggcggtcaggaaaggcaacgagattgccaagctgtacgcggacaacaaggtggacgtcatcatctatgccgtggagaagtcgctggactcgtacaagttcaacttgttgcactgcaagcagacgttcatatcgcagttgaagtccggcgcgatgggcgcacgaaccatcgacgagggggcgatggacgagaagtcgggcatgaacttctcagaatacatggcgatactgtcgggcaacacggacttgctggacaaggcgaagctcgaaaagaaaatcgcctcgctggagggtgagcgcaagtcgttcaacaggggcaagcgcgattctgaactgaagctggaaagcaagacaaccgctctgcgcaacaaccaagccattatcgccgccatgacggaggattgggagaagttcaccgctgccgcacagatcgacaaggacggaaaccggctcaacctgataaagattgacgggctggacaccaccgatgaaaaggccatcggaaagcggttgcaggatatagccaagaacgccacgacaggcggagtaccccagcgtatcggtgaattgtacggcttccccatcaaggtggtgagcgagcggacgctcagcgaggggttggagttcatcgacaaccgtttccatgtcgagggtaactacaagtacacctacaacaacgggcatttggcgatggcggacacccatgccgccgccttgaacttcctcaatgcgttggagcgtatcccggcgattatcaagcagtacgaggaaaagaacgaggtgctggagcgtgagataccgcagttgcaggagatagcgggcaagacgtggaagaaggaggaggaactgaaacaactgaaatccgaactttccgctcttgaccgcaagatacagttggaactggctcctaaacaagagccagtactggaagaagacggaaagggaaaagaatcccagaaagaaagtctccatgccggggtatctcatgaaatcgtcccgactccgccatcagacaggcacacttggcatatccgtccggaaatgcaaacggaggcacctttaccgcaggtaaagaaagtgaggatttgaggcgcttggataaaaacagttaaggggcatacgggaggacaaccgtatgtccccggctcacttatattttatcagcaaaaaaaacgattattatggcaacaataaaaatcaagttcaggtcctcttcggtcgcaggcaaagagggcacgttatgttatcaagtgatacacgggcggcagacccgcctgattagtacggggtataaattgcacctttatgaatgggacaaggaagcgggcaaaatccgcagcgtgaaaggcaatccggaccgggaacgctatctggaagccttgcgtttccgtatggaggaagaccagaaacggttgaacggcattatccggaagctggaacagtcagggaaactttcttccgagcagatagtccttgcctatcacagtccggaaggacatgacgactgtttctttgtctatgcccggaaagtcatcgaccagaccaaacgcatggggaaagagcggacatccgaagtctatgccagttcactcaacagtttcatccgtttccggggcgaagcgggagatgtacctttggatgcgatggattccgtcatgatgatggaatacgaggcttacctgaagcagaacgggaaatgcccgaatacggtatctttttacttgcgcaatctgcgtaccttatataatagggcatcggaggaaggattggtggaaaaccgcagtccgttccgccatgtccatacgggagttgagaagacggtcaaaaggggcgtatcctcagaaatcatcggacggatcaagaatctggatttggaattatatccggccttggctttcgcccggaacctgttcctgctctgcttttatcttcgcggcatgtctttcgtggacttggctttcttgaaaaagaaagatttgcaaaacggcgtgcttgtctatcggcggcacaagaccgaccaacagctttgcatcaaatgggagcagcccatgcaggaaattgtccggaaatacacaaatccggattctccttaccttcttcccatcatcaaggtgccgggagaaaaggaaagacggcaatacctgaatgcctcgcatgtgatgaacaagcggttgcaaaagattggccggatggttgaatgtcccatcaagctcacgttttatgtcgcaaggcatgggtgggccagcatcgccaagagtcagaatgtgcccgtgcctgtcatcagcgaggcgttagggcatgattcggaagatacgacccgcatctatttggccctactggattcttcggtggtggacaaagccaacagcaaggtcatccggtctattggcagataagaatgattgggtacccccaaacacattttgtaagttgagagattccccttgaacctttcccgttcagggggatttttgttggacaaagtggtaaatctctctttaagagatgtttcgcacgccgcaaaattacaaaaaatactgcaatccacacaggatgaatcctgaaaattacgttttgggcgaaccttcccacaggatttgttcgacaaaagaagaagaattgtttgacaaataaaagtgtatgaattaacaaactgtttattttcaaataaatagcaggttggatacatctcttaaagagagatgtaccgattcaaggcctgagagcgcgatgtacattctgtagtggtagcctcattaaaggtacagctatcctttgtatataagcggattagggggggaataaaatgcgaatcgacaagaaaaccgttgggaaaaaggcttggcggtagaaagtggatttgttcgacaaatcggtgtatctctccgtaagagatgtatttcgcatgcaaagttacacacaattgttgggaaaacggtgataaataccaaaaaagttaagaaatgaatagtttccaatacgtccttaaaaaggatttgtcgaacagttgtttgacaaattgtaattattacattttatacttcattggatatcacctaattatctccaattgctaaacatgatacatctcttacggagagatgtaccgataatgtacatgatttcgagtctaccaaagtacgattgaggtcatgccgaaataagataatgatagcatatataatgctggggaatttccccgaacttttggataataccgttgtaactacatgtgtttcaatatataataaacacttggaggagtcggaaatgtatcccttcaccaactaaggcgtaaggctatccatttattatcatggacgaaatactacctatagaggataaactgcactggtatgccatgcgtgacctcaaacgcagacatgccaaattgcccgcctacaagatgttcgagaacttgaaggtgcagtgtttcactcctatggtgcatcgtttggtcgtagttggtggcaagcgggtggatcaggaagtgcctttcatgcaggacttgcttttcgtgaaagacacgagggagcatcttgatgccattgtggagagtacccccaagcttcaataccgttacaagctcggtgtacagcacactcctatcatcgtccctgtcgcagatatggaacgtttcatcaaggcggtagaagccagtgataatcctaagttctattcccctgacgaggtgacaccggagatgagaaaccggaaaatccgcatcatcggcgggcagttggacggatatacgggcacattggtgaccacacgtggttcgaagacaaaaaggctgctggtggaactgcccaccttgttggctgcctccatagaagtagaagcggagtatattcagcttattccatgaggatatgaaccgattgtaaatttttccctaacaaacaggaaaaatcaatcccccttgcgaccgaaaactaatgctattataaattgatttaatcacaatttcaatgaacaggttcggcatagagcttggcaagttgatggagaatcatctgtcagacatacttttcagtgagcgttccaatagagagcatattcatctgtaccgtgttgataattattgggtggcattcgaacgttctgcttttcacctttgtcacatctatacgaaatcggttattaatgcgatgaaagtgtttcgtgtgcccctccctattgttgtgacaagtgtagaggacagggaaatgccatttgccgtaggtgacatggagtgtatgaaaagaacatttgtagaaaggatatacaagacaggaaagccagttgacggcaaatcattcaatgaatggcactaccaaaacaccatagtatttcaagacacaggctatagaaggtcttaaacaaagaaaaatcaggaatatgagtataaataaagtattttacatcttgctcattgtcgcaagtacagtgacactgggctcgtgcggttcttccaaggaagtagtttatttccaggatttgagacccggggaaacagaaatcaagttgcctgaagtgaaagccattacagtccgaccggaggataagatttccattatcgtcaacagccgtgacccccagttgacggacttgttcaacctgccttatgtgtccaggcaattgggtcagtctttaaggacaaatggcgtgacggcttcaagcaatcaaggagtatccgcttataccgtagatgccaacggtaagatagattttcctgtacttggcaagatacacgtggccggaatgaagcgggaagaaatcgccgaatgtatcaagaacgaattgataaaggagaatttggtgaaagaccctgtcgtgaccgtggaatttgccaatctctgcatatccgtgttgggcgaggtgaacagtccgggacgtttcagcattgaccgggacaggctgaccatactcgatgcactcagcatggcaggcgacctgaccatctacggaaaccgttccaaggtgatggtgttacggcaagaaggggatgtgcaacgggtgtacggactgaacctcacttccggcgaacacatctattcttcacccgcctattatctgcaacagaatgacgtggtgtatgtggaacccaatgaagtgaaagcccgtcaatctaccgtcaacggcaacaacgtgcgttccacctcgttctggatttcgctggcatcgttgctgacttctgtggccatcctcatttttaattaatcacgtccaatctaaatattgtatatcgtggcaactcaaaacaatatatccaaacctaaacaggcggatgactttatccgtatacaagatttgttctacctctgtctcaacaagtggtattggttcgtcatatcgttggctgttaccgtcggagtggctgtcgtctatcttttgaccaccccgccggtatatacccgttcagcatcgctccttatcaaagaggattccaaagggaactcattgggtgatgcggctggtctgatgggagacttcgacctcttccagaccaacaccaacgtaaacaatgaaatacaatcgttgcagtctcctgcggtaatgcttgatgtggtgaaacgccttcatttggacatcagttatcacacggacggagggttttacaagaaagtcttgtatggtcgagattgcccctacacggtagactttaacgaattgcaagacaacgagagcgtggcttttaccattaaccccggtcttgatggccaagtacttctgacggatttttctcgtaatggtgaagatgtggcaggaaagataacggctgtgttgaatgacacagttgacgcccctatcggaaaacttgttgtaaaggttgcgaacgattccgccacccatgattcacctgtttatgtctcacgcagaggataccaagatgccacaggcgactatgcttccaacttgtcagttacgttgagtgatgagaaatccactgtcatcaatctgtcattcaaagacgtgtgcatccaacgggcggaggatgtgctgaatacggtgatagccgtttacaatgagaactggataaaggacaagaatcaaatcgcagttagtacctcggctttcattagtgaccgtctcggtgtgattgagcaggaacttggcaatgtggatgaaaacatctcctcttacaagagcgaacaccttctgcccgatgtacaggccgctgccagcatgtatatggaacagagcagcgagaccaatgcgcaaattctggcattgaacacgcagctttccatggcacggtatatccgcaattacctcaccaattccaccagcaagaaccagctgcttccggccaactcgggcattgaaagccctggcatcgagcaacaaatcctggctatcctgcgggatattaagaaagatattgacaacggggaacagccgggggaagctgtgaccgccgctatgttccaagccatgcgggacgcactggcggaacagaaacaaaaaccgctttccattgacgatgtaacggcgatgatagccggacagatcggacagcttgcaccgatggacgaggaaaccgccgacctgtttcagcggttagtaaagaaaatgattgaacaggcagagaaataaatgtaggagaatattagaaaatgggaaaaagcaactcgtactatatgcagcttcatgtagaagcactgtttacaatgaatgaaaagaacgaacttatgactataagggaaccatgggactccacttcacagccggctccccgcttctatttgacaagaccactttacgaaaaaccacatgcttattttcgcgctgacgtaccgaaagaattaagagaaaaactacaatcaattaccaacagagagccagtactgatgctgccgaatgaatcacctatttatgataaagaatatcggcaactattaggagaaagtaagatttcagaagatgcttgtttttggcttcctgaacagccaaagttaaaagcctgcttactcactaaagacaacattgagcctcagatgagccactattttccctggctacctgaagagttgctggatgttcccttttgcgctgcttatttggaagattctcaagtcgtatctatttgtcgtagtgttcggattattcttgaggcagaggaagcgggaattgaaacggctgaactttacagaagaaaagggtatgcattccacacacttgcagaatgggcagaagcagttagacgaaatggtagtattcctttgtatagtgcgtccacttctaacttagcctctttaggtttagcaaaaaaggcaggcggcattttctttggtaacggtttttgcgtttgctgatttatggttttggggtataataaactgtttgaagaagaaaagaagcggctaaaatagattgcggagaagttggacttgccgaaaaatccaaacccacagcggggacggaaaaagaaatagagaacagcaaatcgaaataggaggagtgaaaatgaaccaaggaagaattattgtgattacaggttcgccgggaacaggaaagacaacaattgcgtcgattgtcgcaaaagaatcgaacatggataaatctgtgcatatgcacacagacgactttttccattatttaagcaaaggagcaataccgccgcatttaccagagtccaacgaacaaaatttagttgttattgaagcctttttagaagctgcaaagcgctatgcccgcggtggatatgatgtaattgtagatggaattgtagggccgtggtttttagaaccatggagagcccttgttcgagaagattatgaagtacactatattgttttaagggccagtaaagaagaaactatgaagcgagctgtggagcgctcaaaattagacagaaaaacaaatgttgaattagtagaaaccatgtgggagcaattttgcaatctgggaatatatgaatcgaatgttatagatacgaccacttattccattcaagaaactgtttccgcagtacaagaaaaaatcgcaagtagggcagcgttgttgtcttagatttttttgcttttttgtggtatattatcctcagacagagctaaaggagagagcggaacatgaaaagcgattattcaaaagaaagcatcacagagtttttaagccgaaagtacggtgaggatataaggctttttccgataaaagaagggcaggagtcacaggcgtattggttttcgcgtggcggcagagaatatgtcgtgcgcataaattcaaatatggaaggcttcaaaaaagacaaatacgcctatgagcacttccgctcggatagagttcctattccagaggttgttgaaacaggcaactttgacggcacgcactacttctgcatcagcgtaaaagcggacgggattacatatgaggactccgatgaagaaacggttgtgcgactgctcggcgatattacggatgtaaccgaagcaatatcgcgaaccgatatatcaggcacttccggctgcggcgtgtttgacagcgatacgggaaacgctccgttttacagctggagagaatatcttgcggaggtattcgagagagactggacggcggtaagcaggagctatgttaacctctcactcatcgacgagcttctcgcggcatatcgtgagcttatatcttattgcccggaagaaagagcgctgttccacggggatttcggctcgaataatgttatcgtaggcaaaaaatcgaggataagtggcgttatagactgggactgcgcggcttacggggactttctttacgacatcgcgaccgcgtatttttggcggacatggctcatgtgcatggaaaaaactgcggcgtattgggagagaaaatactctcacctgccgagatataccgagcgaattttatgctatgagctgcggatagggctgacggaaatatacgaaaacgctgtcgaaaacgatactgagacaacagagtggcttcaaaacaggtgccgcgagattttgagagaatacagacaaagaaaggcatgataaaatgagaatactgttcacaggctttgacccgttcgggggagagaaaatcaatcctgcgggagaagccgtaaaaatgatgaaaaacgaaatacaaggcgcggaaattttaaagctcgaagtgccgacggtgtttggaaaggcaggagaggttcttaaaaaagcggtggagcaatacagacccgacgcggtggtgtgcgtaggtcaagccggagggagagccgccattactcccgagatgatagccgtgaacataatggacgcgcgcattcccgacaacgccggaaacaagccgtgccacgagcttataataaaagagggaagagaagcgtatttttcctcacttccggtgaaggatatcgagaaaaatctaaatgataacggaattccgtcgtcggtatcgtatggagcggacaacgagtaaaagagtgaccgccgagataacccattgctcggcggtgttcctttccaagttaattgcgtgatatagattgaaaagtggatagatttatgatacagtgaatagatttatgatataatgagttatcaacaaatcggaatttgatgaggtgtaattatggtaagaattgcaacagtaaatgatgcagagcaattaaacatcttaaatgatgaatttaatggtgagagcgaaacaagcatagacaatattagaaattcccttatgaataataaacaggaagttgttatcgttgctgatgaagatgatatgttagttggatttgtttgtgttcagcttaaaaaatcgttctgctatgatgaatatatgcctgaaattacagaagtgtatgttaaaccagcatacagaaaaagaggcttagcgagtgagatgattacttttgcagaggcttattgtagtaagaattatccacttcaccaatatgaacttctaacaggacaagaaaatcttgttgcacaaactgtatataataaacttggatatgtagatgataatgaacttcatttatcaaaacgagttaagagatagtcaaatcggaatttgtggaggtaaaatatagataaatcaaggtagaattattgtaatcacaggtgcgccggggacaggaaaaactacaacggcatctgctgttgcaaaagaatcagatttggaaaagtctgtgcatatgcacacagatgacttttatcattatttgagtaaaggggcaataccaccgcatttaccagaatcaaatgagcaaaatttgattgtcattgaagcgtttttagaagctgcgaagcgatatgctcgtggtggatatgatgtaattgttgacggtattatcggaccgtggtttttaaagccgtggcaaagtcttgttcgggaacattatgaggtgcattatattattttaagggcaagtaaggaagaaaccttgaagcgagctgttgaacgctcaaagttagaccgaaagacaaatatcgaattggtagaaaccatgtgggagcaattttgcaatctgggaatatatgaatcgaatgttatagatacgaccacttattccattcaagaaactgtttccgcagtacaagaaaaaatcgcaagtagggcagcgttgttgtcttagattgttttggtgcaattcccatttatcgagcagatgaagttggggagccgcctggaggcggcggtgccgaaggataaaataggagatgttaaggttatgaataatgaatacgataatgagaagttttttgaagaatatgcaaagatgtcccgcagtaaagaggggttaaaagctgctggtgaatggcatcaattaaaacctttgtttccttcgttagaaggaaaatctgttcttgacttggggtgcggatatggctggcactgcaagttcgcagaagaacaaggagctacaaaaatattagggatcgatttaagtaagaaaatgattgaggaagcccaaaagcgcaattcaggaaatcaaattgaatatcgtattagcggattagaggaatatgactatccagaaaatgaatgggattgtgttatatctaatttagctctgcactatatagaggacatagtggaaatatttcaaaaagtgtataggacattaaaaccaggtggaatttttctttttaatatcgaacaccctgtttttaccgcaggagttgggcaggattggatttatacagatgatgggaaaccgcaatattgggcgattgataattactttataacaggagaacgaaatacacattttttaggatgtgatgtagtaaaacaacatcacacacttacacagattataatgggattgctgaacaatgggtttgagcttaaagttgtagaggaagcagactttttagaagaatttgatccacgctataacgaagaaggtgtatcagaacttgatgaacaatttgagcggttgccagacggacacgaagcaaaacgcagttactatttaggcttccgacaagcacaaagtgaagcaagaccaaacattgttattagtctattgaagttaaattagatgctaaaaatttgtaattaagaaggagtgattacatgaacaaaaatataaaatattctcaaaactttttaacgagtgaaaaagtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaactgaatactcgtgtcactttaattcaccaagatattctacagtttcaattccctaacaaacagaggtataaaattgttgggagtattccttaccatttaagcacacaaattattaaaaaagtggtttttgaaagccatgcgtctgacatctatctgattgttgcagaaggattctacaagggtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcagtttcatcaagcaatgaaacacgccaaagtaaacaatttaagtaccgttacttatgagcaagtattgtctatttttaatagttatctattatttaacgggaggaaataattctatgagtcgcttttgtaaatttggaaagttacacgttactaaagggaatgtagataaattattaggtatactactgacagcttccaaggagctaaagaggtccctagcgcctacggggaatttgtatcgataaggggtacaaattcccactaagcgctcgggaccccttgtaggaaaatgtcctaagtgtggcaacaatattgtattaaaaaaatcgttttatggttgttcaaattatcctgaatgtaccttcactttagctgaacattttagaaagaaaaaactcaccaaaacaaatgtaaaagaattactagagggaaaagaaaccctggtaaaaggaatcaaaacgaaagatagaaagtcctacaatgccgttgtaaaaatcggagaaaagggatatattgattttatctatgtatgagaacgtattttttgaaatgcttgagcgaatcattcaattagaaaacgaaaaagaatagaatcacaaatcacaagtgattaatcacaaatcacttgtgatttgtgattgttgatgataaaataagagtaagaagaaatagaaagaagtgagtggttgtgggaaatttaggcgcacaaaaagcaaaacgaaatgatacaccaatcagtgcaaaaaaagatattatgggggataagacggttcgtgttcgtgctgacttgcaccatattataaaaatcgaaacagcaaagaatggcggaaacgtaaaagaagttatggataaagccttagaagaatatattcggaaatatttacctgacaaactttaaaaggagtgaaaatgaaatggcagttacttatgaaaaaacatttgaaatagagatcattaacgaattatcggcaagcgtttataatcgagtattaaactatgttttgaatcatgaattaaataaaaatgactctcaattattggaagtcaatttattaaaccaattaaagcttgcaaaacgtgtaaatctttttgattattctttagaagaattacaagccgttcatgagtattggcggtcaatgaatcgctattcaaaacaagttttgaataaagagaaagtggcttaatatggcaaatatagtcaattttactgacaaacaatttgaaaatcgcttaaatgataatttagaagaattggttcaaggaaaaaaagcggttgaatcgccaaccgcttttttacttggtgggcaaccagggtcagggaaaacgagtttgcgatcagcaattcttgaagaaacacaagggaatgttattgtcattgataaagaggggttaaaagctgctggtgaatggcatcaattaaaacctttgtttccttcgttagaaggaaaatctgttcttgacttggggtgcggatatggctggcactgcaagttcgcagaagaacaaggagctacaaaaatattagggatcgatttaagtaagaaaatgattgaggaagcccaaaagcgcaattcaggaaatcaaattgaatatcgtattagcggattagaggaatatgactatccagaaaatgaatgggattgtgttatatctaatttagctctgcactatatagaggacatagtggaaatatttcaaaaagtgtataggacattaaaaccaggtggaatttttctttttaatatcgaacaccctgtttttaccgcaggagttgggcaggattggatttatacagatgatgggaaaccgcaatattgggcgattgataattactttataacaggagaacgaaatacacattttttaggatgtgatgtagtaaaacaacatcacacacttacacagattataatgggattgctgaacaatgggtttgagcttaaagttgtagaggaagcagaaccgcctaaagagatgatggatattccgggtatggaagatgaacttcgccgcccgatgatgttacttgtaaaggcgatagcgaaaaaataatatctctattaggaaaactgatataccccaatttagagaatggcatagtaattcctagtgataaagagaaaatgattgcactggcaaataaatacattgaaaaagaaaatgtagatgcactcattctcgcctgtacggagctgccacttgccataaagcccgaagatgttaatgtgccaatcgtgaatacaacccaagtacatatcaatgcaatttaccaatatgcaattcgataaaaatagcaaagccagccgagccagtcaacggtcaagatgaacggcgcatttcatgcgccgccgttgacagccccgcccgtctttgctaaagggtaatcaaggcgggaaagccctaaaatggtttccccgcccatttcaattttgggaaaagaaatgctccaaaatcaaaaagagagcggtcaagcactttgaggattggccgccttgttcacccattcagcggaacggcgggcggcggtcaaggccgggtgcaaacccgttcatttcagccttgacggttgcctgctgtcctgctacttttccgggagtgtggccacacttcgggacactttgtccacaagtcggagcgaaggacgagggacgggggctttcatatacctgccgccgttctctgaaaacaggccgattttttgctcattcccattcgcaaaaattcagcctgttttcctgccggagcaaacggggtgcaagaagcaccgcaccccgtttcctctgtcagccacgccagcaggtataacacactacactttgcaagcaaagtcgtgtgccaaagggggcacccctttggaaaccctagacaacaaaacaggcggtatgctgccctctccgggagcataccgccgtttgttgtcagcagcccgtttcacggtctgcgtgtagttccttgtaaactgacctaaggtggaagctaaaacaaagttttatcatgaaggattatatttggactaatgaaagtgtgaataaatgattgggaaaaataaacctttcacctcttttctggtgaaagactgaaaggcactttgtgcgagtgtcgtttcaatgtgagccatcttagagtaaaatcaggatggctcacattgggttaaaaggatgaagagaaacttgcgtttcgtagaaaatgtggtaaaaggtatcagatgaaagatgaccgggatatgaactatgacatcaattaacaataaaacaattacgagcgtatatgaaaaaatgaaagcttacgagagaataagcaagaaactgttcattttgctattcatgctggtcttttatgggtattcatccataattgcacagccgtccatacccgctggtcaggtagatatatttgtaggggcggatttcaactaccgggatttgtttcacaatgggaaaatatatgagattttgctgaatctgactcccggtgtgaaatggaacatgggcaaggggtggcaggcggcagcacaggcattagtgccggtgtataacgactatggcgaccgatacaagaaagtacggttgaacatggcggtgttatctaaagaggcgcattggcgatcccggtggttcctgaaagcaagcggcggcttgttcggcagggagcggtatggattggacttgaaagggatgtatgtcgtaaaccgctggttggcattggaagtgcaggctggattaaccggctattgttcaatggcagtggactgggaagcaagtacccccaaacggattaccgccttgctgggcaccgatgtctatctgaacaaatggaatacgcagttccgcgcaaggggcggacgtttcctctatgaagattatggagccatagttgaagccatgcggcatttcaaccactgtacggtcggattgtacggcgagtatagcaacgagggcggcaagaatgccggttttaaggtggtgatgatgataccgccttacaagcggaaacggcgcactgtcaatttccgtccggcttctaatttccgcctgacatacagtatggaaggtgacgcctatgccaacaaaatgtacacgaccgacccggaggagaacgaacgcgagggctggtttgaccgcaatgccctgcaatggggcagcaacaccatgaagccggacttctcggaaaaggaaggagggcggaaatgagaagattattgattggcctccttgtcgtgatgggctgcattccgatattgagggcgcaagagtattcgggcgttaccggcatgatccacgtgcccacggcggaaatggcgacagagggagaagcccgtatcggtttcttcttcctgaatcaggaatttcttcctgacacctaccagtatgaaggagagaaattcaacacgaccaaccattttctggccatcacccccttcccttggatagaaatagcgtatgtctgtaccatactgaaggggattgacaacgatggccatgtcggacataataagaaagaccggtactttcacctgaaagtgcgtccgctgaaagaaggcaaatggtggcctgcaattgccataggcacccaggatcccggcagcaaggtgaacgagtcctatgccgaaggcaaatatccggtcaacgactacttccagaattattatatagccgccagcaaacacgtcatgtacaggcggaatgaatttggttttcatttgacctaccgctattttacatcggatttcaatgccaaatggcggggcatagccgccggtatcacctatcgcccgtcctttgccagaaaccttcgggcaacgatagaatataccggtgacgatatcaacatcggcgcagactgtttgttgtggaaacacctctttttgcaggcaaccttgcagaatgggaaacatttcacaggtggcctgtgtttcaagttaaacctgttgggcaagacccaccctgattgaagacacaaacaatacggatataactactagaatacagaatttcaaaataacctaatttaatcgtttaattatttttagaaatggaaaatcttagaaatctatcaagatggggaatgttcgcattccttagtgtggctttgtgcaccagtttcgtagggtgcagtgacgatgatccggattacagcaacgtgacgccgcccacggtgtccgtatcgcacagtatcagcgggcgtgtcaccggcatggacggcaacggcctttcggctaccgtgagcatgaacggcgaatcgacacagaccggcgcagatggcacgttcacttttgacgatgtggatgccggaagttataccctgacggcttccgctccggggaaacagtccaaggaaacaaccgtcaccgttgcagaaagcggaagcggagccaatgtcgtatggaacgtgtcattgcccaatgaaggcacgaccattgaagtagccgccaacggcgatacggaggccaacgtgacttcagagaccatcgaaggcaatgacgagggcgcggtcacagtggctgtcaccgtacccgagacggcggaattgcctgcgggaagttccatcgtggttaccccgctttacacgctggatgaagccgaagccaatacccgtgccacttcccgtgctgccgaaagcgtcatgctgattggtacaagcgtggcttgcaccgatgcgaacgccacgctttcaagtcccatcgaattggcttacgatgtggatgcggaagtggcgcaatccatcacggcacagaaatacgtgaacgggcaatgggtggatgcagaatatactgtagaaggcggacaagtaatcgtgtttgccgaccagttcacttcctatacgttgctctttggagcggatgtgacttcttcctccacaagcacgccgttggcctttgaacaagacctgtgggacaacctgtatggatcgggtgacatgaccgttggttcggcctcgttcacttatcacatcggaacggaaatcacttcgtccgggaccagtcggataaccgcttacctgattgagattctggcccgcattgccggcgcaggtgtcactacggctacgggaacttaccccatcaatgtgaccttgcccgtcggtacggccttgcacgtggcaggtactcaacaagtgaccactttgaccgtctccgcattgaaccgttccgtcagtggaagacaatacggtgatgtggcagtcgtgacaacctcttacaacagaaaccataatggagggacgagtgacaattgattgttgtttctcaccttgtagacagatatattaaaaagcactgtctgcaattacctgcaagtagttataatagccgcccggaatcaggacggctatttttgtagctgtatccgaagcaggaaagaaatcgtaagttttcgggaaccacaggtacaacctttgcatgtgaaatggcgactgcaactatgaacccaaatgttgtagtcgccattgttttgttgtacctgtatgcaagtagttgcattgtctatcagactctctgtgcattttgcattgtctgcactcttgccggatgttgtaatatccgttcgttcggatgcctgcgttacgcttgcataatcccaatgactattttacaatcaaacacccgtcatggtgcggctcaatttgttttgaatcgttctaaaaaaataattattcataaactctgaaccggtcgcatggattgtggttgataatttctatttttgcccataaacgaggtagcacattctgatgagagaatgcactacggataatatgactagcaatgaaagtatccttgacacaaaagatatatgccgggaacttcctgttgctggccgccatagtcggaatggtggttatcctctttcgtgagcgtagccggatgcgggagatagatttcgaagtgcatgacctgcaatcggtacggaatgacatccatgccgcacaccttcacatcaccgagctttccctgctgggcgagagcctgatcagccaagaaaatgcagatacggcaaactatcgccagaaacggctgtccacagacagcctgctgctggccttgaagccccggtgcaggcagcatgtacgtcccgaacagatagacacgctccggcacctgcttgccgacaaggaaatgcacttgttccgtgtcgtggaagccatcgggatacaggatgctgctgacagtctgcttgtccaccatctgcccaaagtggcggaacgtgccacccgcatacgcaccgtgaggaaaagaagggacaatatactgggagcgttgggcgccaagaaaaccgtccgggttttgccttccgccggagaactgcacgcattcagtgacagcctgattgccatgcagcaggaagggacggaggatatggaaaccagtgccgacagcctgtacgcccgcaatctggcattgaacgcccggctgaaccacctcatcaagaatctggacaggcaagtgcaggaagccttctttcagcgtgagcataagataatggaagcgcaaagccgttccacgctcctgctcacctctaccttgtccaccgccatcctccttttaatcctgttccacatcgccatccaccgggaaatccgccgcaatcatggcgaaaaaaagaaacgcgaagaacttatcggcgaattgcaggcgagcaatgagaagaaccggcaattgctgcaattccgtcacaacctgatgcagactgtcagccatgaaatgcgcacggccctgacggcgataagcggcaatgcagaactcctgctccgggatgaagccctggaagaccgggtacgccacatattaaccgtgcgtgaatctgccagccgcatggcttccatgaccaccgagctgctggaatttttcaggctggagatccataaagaaaagctgcatatccgtccattccgctccgagtcaatagcaactgtgttggaaacggagttcgcccctttggctgaagccaaaggaatcgaattcgtgactgacaaccagacgacagaagtgctgggaggcgataaggagcgcatattgcgcatcggaagcaacctgctctccaatgcggtcaagtttacccgcagcggtcgcattacactctgcacggactataaggacggcaacttcatcctgtacgtgcaggataccgggacgggcatcccggaagaaaagcaggaacagattttcgcccccttcgaacgtctgggcaatgctgtgactcaggacggcttcgggctgggccttgccattgtgaccaatctcgtacagctgatgcagggttctgcttccgtacagagcaaacctggcataggaagccgcttcaccgttgtcctgccgctgccgaaagccgaagaagtaccggaagaagagaagtcaatggatgtccgtccttcactggccggatgttccgtgctggccatagacaacgacccggtgacgctccgcctgatgcgcgagatgtaccttcaatgtggcgtttcatgcgacaactgccttacgttggccgagctgaccgacaggatacggagcaaggattatgacctgttgataacagacttgagaatgccggaagcgaacggctacgagattctggaactgctgcgcatgtccgacatcggcaattcccgtgaacttcccatcgtggcagctactgcggccggctatgtatcggaggaggaactgaaagaagccggattttccggattgcttcccaagccgttttccatagacgaactgatggaggcgacacggcactgcatccgtgaaagagggaaccggcagccggacttctccgccctgttggctttcggcgacaagcggaaaacattggagcagctgattgccgaaacggagaaagagatagaggaagtccggaaggcatccgaaaggaaagacttgacagccttgaacagctgggtacaccatttgaggagctcatggatggtgatacggacggaacgccccttgcagaagttgcacgaagccatccacaaggaaccgtactcggacgaagaagtcgcctatgcagcccgtgccgtgttggaacaaggagaaaccatcatagaagccgccagaaaggagatgaagaaatgggaaagataatcgtagtggaagacaaccttgtgtacagcaggtatgtctgcaattttttggaagaaaacggataccggacagtcagtacctccgattgcaccggtgcccggaaactgttttcaatgctggaagatgacgacatcgtgcttgccgacctccggttgcctgacggtgacggcatcctgttgcttgaagaactgcgccgcgaggggaagcacaatccctacgtcatcatgacggattatgcggaagtgcctaccgccgtgcgttccatgaaatccggagcggaagactatatccccaagaaactgctgaccagccagcttcccgccatgctccaagacttgcagaaaaggcagtcattccatgaggaacccctgttcataagggagagcgaagcctaccagaaagtattcggacgtctccacgtcctagccaaagccgacatctgcgtgatggttcggggtgagaacggtacaggaaagaaacatatcgctgaaaagatacatgcccaaagcgaccgtgcggacaaaccgttcgtgacagtggactgcgggctgttatccgaaagtctggccgcttccgccttgtttgggcatgaaaaaggggcttttaccggggcggtcgggcgcaaggaaggctattggtcggaagccgagggaggaacgttgttcctggatgagataggcaaccttcccctcggcgtacagcagatgctgctctgcgccatacaggacaggcgttaccgtcctgtcggcggcacaaaagacaggaaagccaacgtgcgcatcatcaccgcaacgaacgagaatctggaagaagccatatcggaaaggcgtttccgccgggacctgtatttccgattgagtgagtacaccgtgaaagtacccccgctcagggaatgcccggaagacatcctgccgcttgctgaattcttccgggaactttacaaccaagagcatggcagacaggtaaaaggtttcgatgcggaggcgaagaaacggttgctggcccatgactggccgggaaacgtacgggaactgaaacaggcggtccaatccgccgtgctttttgcccaaggggaattggtgacggcggaagaattgaacttggatgagtccggaaagccttccgatcctgacattgccttgaaaggggaatgcatggaaaagaagcggatatgccaggctttggaaaaggccgggcataatcggaaagaggccgccagactgctgggcataagccggagcacgctgtacgagaaaatggacctgtatgggattcagacgaagaggtgacatggcaggggaaaggacgaaacggaatggaaaaaagcggaaagaaagggcggtactgtgtacgaaaaacggacacctgtccggaagtcggacacgggaaggaggctgcctattcttccttaaaacaaattttcgtctgccaagagcttgatttgcaagaaattgcatacaagttcatcaccataacattgtaattggactatcatttgctcctatggatgtatgtgcgcacatttcatccgagtaaaaacaaaaaattaggaacaaatggaacatctcaccttgacggaaaccgagtttttccgtctgataagcaatcccgacagccgcaccgggttacgcacggcctacgatgagtttacacaaagggtcatccaactctgtctcatcccgcccgaaagcggacatccggtacacgccctgagctatgcggaaacggagctgcaataccatgaggccctgcaaggcaggagccatgagagcgaactgaatctgcatgtacacaaggcccttgcctttgtgcgcaagatgctacggttccttgcccgggaataccatccgttgccgccctcccacatgtttaccggcgagaaaaccggcgcccctccttctgatgcccctccgatatgttggacaggcagcatatccgacctagtggaattattgtacgggctcgacaccctgaaatgtatcaacggcggagaaaccggtatccaggaactgatggtccatttctcccgattcttcggcatggagttgaagcccagtcagtgctacaacgcctatgtggatatccgtcgtcggaaaaatgacagccgtacctatttcttcgaccgggcttccgaaaagctgaacgagcgaatcgtgaaagacgatgagcgggaacgggcacgcaagagatgaaagtttttctgtctgattcatgaccgggaacaaggtgtatgggtagaagccccttgctcccggtttctttttcctgttctagcaatgacaatttgcaagaaaatgctccaaaatttcgtatctgtcggtcaaatgattatttttgccctccaaacgattacgcatgaatataaccaatatagacgacatacgcaaactggcctccggcgatgaagggggacggacagaatacaagctgatcaccgggcagttggagcgcggcatggagacactgtgcgccttcctcaacggcgagggcggtacggtactgttcggcgtggctgacaacgggaaaatcaccggtcaggaagtgagcgacaagacgaaacgggaaattgcggaagccatccgcctattcgagccgtttgccacgataacggtctcatacgcaaacattcccgacacggacaaacaggtcattgccttatatgctgaggaacaacgctatatgcgtccgttcacatataaaggcagggcttaccagcggatagaaagcgtgacgtctgtcatgccgcaggacaagtacaaccacctgctgatgcaaaggggcggcaaatacagttgggaggcaatccccaaccccgacctgcaaatcagcgacctcgacgagaatgtcatcatcggtgcggtacgcgccggaatcaactgcggacgcctgccggaaaccaccattcgcgaagaaatacccgccatccttgaaaaattcgacctgttgcatgacgggaagctgaacaatgccgccgccgtactgttcgggcgcaatctgtacgactatccccaatgcctgttgcgaatggcaaggttcagaggcacaagcaaagaggaattcatagacaaccaaagacagcaagggaacatctacgcgctattggacgctgccatgtcgttttttttcaagcacctgtccttgtcgggtaaaatagaggggctgtaccgtgaagaaaagctgagcataccttacaaggcattgagggaatgttgcatcaacgccttttgtcacagagcctaccaccgtccgggcggttcggtgggcatcgccatttatgacgaccgcgtggaaatagagagcagcggcgcgttccctcccgacatgacccttgaaaaactgcttggcggacacagttcagagccgcccaacctcatcatagccaacgtgctttacaaaagcgagttgctggaaagctggggtcgcggcatcagcctgatgatagacgagtgccgccgtgccggcatacccgacccggaattccacacggacgggagttccgtatgggtggtattccgctatgagatggaaacggctggacaagcatccgacaagcatccgacaagtacccgacaagcacccgacaagtacccgacaagcatcgtccggctcattgaactgataggggaacacacttgctcgctgaaagaaatgatgggaatgatggaactgaaggacagggagaatttcttgggcaattaccttaacccgtctatggaagccggattggtggaaccgctctatcctgaccagccgaaacatcccaagcagaaatacaggctcaccgaacaaggaaaggctttgctggaaaggggtgagtaacatggtgaagaagaaaaggaaacacggcggacactactgcaaggtatgcggctgccacaagtccaacgagagcttctcgggcagaggacacgcgctgcacatctgcaaggaatgccagtcgcttccaaaggacgaacaggcggacatgatgcgctgcaacgaggtggaacgcgccgcgttccgcttccccatgaggcggcaggactgggaactgctggaaaaatatgccaagaagtacaaggacagggagtcgggaaaattcgcgcaggagatgctggacatgaaacggggcgtttttgtgccggaagaggacgatgaagaagcggatgaatggaacaacgacatttttcaggtagcggaaaccccgttttcggaattggaggaagacacccgtaccgccatggaggaactactggaggacaacatcaacgagtacatgatacacaaggactatatccccgaagggaaggacttgcaggacatagccgattgggtgttgaaggaaaccaatgacacgttttacttgaaagccgttcccgatgacgcctaccgcaggctggtggatgataccgtccggaagatggtcaaggagtggaaagacgacggcttggagataaagacctacgccgagtcgctcacgatcatggaaacggaacggctcgtcatccgcaaaatcacccgcaaggacacgggcgcgttgctcgccctcatgggcaagtcggaagtcatgtacgcatgggaacacggctttgacaagaaggaggtgcgccaatgggtgaaccgccagttctcccgttaccgcaaggacggctacgggtatttcgcccttgtgttgaaagacgggggcaaacttatcggacaggccgggctgatgaaaagcgtgataaacgggaatgaagcggtggaactcggctacatcctggacaatgcgtattggcacaacggctatgccacggaagccgcccgaagatgcctgcggtacgctttcgagaaactgggcttgcaagaggtctattgcagcatccgtcccgaaaacacgtcctccatccgtgtggcggaagccattgccatgaaaccttgcggcagccataccattatatacaatggaaaagaaatgccccatctgctgtataaaacggagaaaccaatgcagtaattttcatttcaattgtcaatcaacgagaaaaggacaatccttaacccggtctgaacatccagccaagttaaggattttccttttttcgcctatggcgtttttacttgccctgcaagaggtgttgcagttccgggtcggactggatgcgctgcaactcgtcggcgacaatctgccgcacttccgccttgatgcggttgtagttctcctgtatcatttccttcatgcggtcgttgccgtcggcatcggtgaagtccgtgatgacggggatgggcttgtaagcctgttcctcgcgcttcaccttctccacgtccaccacaatctcgcaatgaaagattttctgctcgatgcgctcgttgaagttgtcggccaccgcgcccacgaacatgccctgcgtcagcgtggaaatcttgctcgcgggtatcaggctctccatctgcgtgttgatggaggtggacttgtcctcccggttgatggtgacgctctgccgcttctgcaagattttgccgaaacgctcggaaagcgttttggcggtctcaccaacgacttgacccgaaaagatgtttcccaccgtgttcatcacgaccgccgcttctttgtccccataatcgcgtttcaactgcgaaaagtcctgaaagccgaggcagaccgccaccttgttgcttcgggcagtggcgataagattatccaatcccttgaagtaaatcgtaggcagctcgtcgatgattaccgccgacttcagcttgcccttcttgttaatgagcttgacaattcgggaattgtacagacccaacgccgcgccgtagatgttctgacggtcgggattattgccgacgcagagaatcttaggctcatccgggttgttaatatccaacgtaaactcactgtctgacatgacccaataaagctgtggggaaatcatgcgcgagagcggtatcttcgctgatgcgatttgccccatcaactgctcggctgcacctccctgccaagcgtccataaagggcgaaagatagttttccaactccggatagctggtgagaatagggaaaacatcctcataacgtctgttcagcaactcaatggcgtgtgggaaggtgcaatactttccatcctgataaatccgtaaaaaccagataatactggcaaaaagtataatcggactctccacgaagaagtcgccttgcttttgcacccaagttttgttcaaatttaataaaatggtataggcactttcgtaggcatcggtgatgtcctccatgaaatccgggtgaatgggattgcagcggtggctccggcgcgggtcgtcgaagttaatgacgtagaacttcggcttgaccttgtagccgtcgccgtggttcatcaggtggttgtaagcgatggtggaaaggtcgctgaacttgaagtcatagatgtacatcgagtaagatttttcaatcatctgcttgataaagctgtttaccacggcatacgactttccgctgcccggagtgcccaatacgatggaagcgcggaacgggtttaccacgttgatgtacccgtcgttccacttcttcctgtaatagaagcgcgtaggcaggttcaccgaatactcgttctccatgaggcgcgtctcctgcatgaagctctcgttttccacgttgaacacgtcatccatgaggttggtgcgcaagaggcggctcatccacgtgccggacatcaggaggcagacatagcccgccgccatcgaagcggcatagaaggctacgttggcttccacgggcagcggcagggagagcatccaccagttcaggaagaacagggccagccctgcggcaagcaccgtccaaatcctgccccacgtgattttttcctccttcacgccctttgtacccaagcaagagagagccaatagcaacagcgcaaaaagttttgtgtaaaggatatggtggaacagtccggcggtgcggtcgaaattgaccagcacccggtccacgacaccgatgtcgatgccccacagccttacggcttcatacccgtaccaatagaggtggacgaccaccagaataatgctcacggcgcggagaaagtccatgattttcgccaacgccctcaaatcgtcttcctgttgtgacataaatctgtttctgtttttaagttgaacaatatgtccgcaaggctttccccggacataagcatacctcaagtccgacctgagcctatctcaagtccgaggtgaggctaccaaaggtctgaccttagatagccaaaggtctgacctttgcttggatgccctgcggacggataatttataatcccaaacccttccggcgtttcttccgcttgcgtttgagttcgcgctcgaaggcggcttcttccgcctgtgcgcccgatgcgtcgccgccaagcaagcccaagcccgtggaatggctctcgccgtgttccacataggtatgggcttccgcctgcggttcgtcccgtgtaagggtgaacggcatcggcggcgtgtccgcatacggcaaagtgaagtgctcctgcaaggcgttggcggaaaattccctgcccagccgggagccgttcagcacacagcccgtgcggtggtcgatgaaggtcgccccgtagatgcgccccccgtccgtgtggcggaacaccacatccacgcccttcgctttgagcagggcgacaaattcatccttgcggtacgtcctgtccaatacggcagcgacggtcttgcgcgtcatgtccgccagacgcttgtcgcggatttgggcattgggatactcaaacctgcgcagcacggcttcatagccgacggacttcccgatgcaggatgccttgaagggattgccgaccttgttcccgccatcatcggtggcggaatagaccagtccgtgatactcgcgtccgttcaccatgccacgggcttcctccacagtgacgttgtagagggagagcaaggcgcggtattcgcccattgtccggaacttgtaggtagccatcaccgccttgacggtgttcgacacctgacgcttcacgtctccctgcgaggcatccaccttgcgcaaggaattgtcgttacggtgctgcctgcggtcggcggggtgcagaccgtacttgcgttccagctccgtggtgatgcgcttgctgcggcgatggatgaaatccttgttcaaccgcctgccattctcgtccacattgacggagacgatatgcaggtggtggcggttgatgtcctcatgtttgaaaattagataaggctggtcgccgtagcccagcttctccagatactcccgcgcgagactttccatctccatgtccgtcaggcggtcgtcgggatgcggattaagggagatatggatgaccttgttccgtgtgcggacgttctccggcatgtaccgtttgaaatcctgttcggcacgggcgatgtccacccgtccgctgccatcgtcgaagaccttgttcccggcgagcagcttcccctcgccctcgttcactttcatgccgttgtaagccaacgccccgtacagcgacgtgcctaccgtgatttttgcgaccatctttcctgaaactcccttgaaagttcaacgacctgccgcgtgattgcggccagttccttcgtgcattgctccagcttgtagagcaatgccatcgcctttttctccgagaaatggcagcgcagctccttgaccgtctggttatagttgttccccaccatgcggtactgcgcatggaaagcggacagcttcgtgcagtagtcgagcagcgtcttgtccgtgaccagtacccggaacggctgtccgaagaagtgcgccttcaggaacaccgccctcgcctccacgccggacttgccgtgcatagcgaggaacctgagccattccccgtcgtcgaaacgcaccatcacgcagtgcgacttgcggctttcccgtggatgccgcccccacttgggactgtcagtcccgttctttttcttgttctcgttcatattacaatggatttagtggtgtcacggcataagcgtagcttcggcaaccgcaccgcaggtggaaacaggcttcccgacttcggagaggaagccctccccgtgaggggcaaggtcgtttcgggagtaacccgaaaccctttgagttactcaaaggacaccttgctgtgtctttgaggacacaaaaatccgtggtaaacggattggggatagacctgccattacccatttataaggcatcggtcgcccgatacctttctgctgcccaaaagaaggacggagccggggtctgcggtgcgcgctttcggctttgccctgccgcttgggtgcaaaggtagggtgttttccaagtctgaaatacggctcaaaaacgccacaagctgccacgacagcgccaaatgctgccacgcaagtgaaaaaaacatagttgcctgcctgtccgttttcagatttgcgaaccggaaggcattcttgcccgcctgccagttcacctgcctgcctgtcagtctgcttgcccttgtgcctgcctgccggcacgctggcatacaggcattggagcggggaaatgccaaagagcataaaccagccaaacaaagaaactgttggaaagcgatggaggaatgtgctaagatgtccacgagactacatttagcacaagtgaaaaagagttcttcatgtttgtagtcaatatgtttgcgaatccgcaagcattcttgcccgccagcctgctcacctgcctgccagtctgcttgcccttgtgcctgcctgccggcatacaggcattggagtgctgaaatgccaaagagcgaaaatcagccaagcaagaaaactattggaaagcgattggtaggaatgaattaagatgttcatgagtccacattggccacaatagaaaaagttctacctatttgtggccaatatgcctgcgaacctacaagctagcattcttccttgccaggtggcaggcattcttgcccgcctgccagttcacctgcctgccagtctgcttgcccttgtgcctgcctgccggcacgctggcatacaggcatcggaatggtgaaaatgccaaataacggccacaagccaaacgcaagatgagtggcgataaggccgggtaaagaacgccacaagctgccacgacaacgccaaatgctgccacgcaacggcaaaaggatacaacctttgagaaagcccctttcctttgcaggcgaaacggtcggcacgcctgcctgcttccgggctgacatccttgccaacctgcctgccagtccgccagcccttgtgcctgccggcacacaggcatacaggcaaaggcttggtggaaaggcaaagggcggatgccgtttcaatgggccaaacgccaggaaaagcggtggaaagggtggccaaagaacgccacaagctgccacgacaacgccaaatgctgccacgcaacagcaaagagacacaaccttggcgaaagtcattttcctttgcaggcggaatggtcggtatgcctgcccttatgcttgcctgccggcacacaggcatggatgggaacaggcataccgggagggatgccggactgcctgctcgcttaccgggcggatggctgccgaccggaccaagaaacggatgtctaacaaataaaaaagaagaaagcatgaaaaaagaacctttgttcatcgccttctccacccagaagggaggagcaggcaaaacgacactcaccgtactgatggcgagttacctgtattacgtgaagggatatgacgtggcggtcgtggactgcgactatccccagttcagcatcaaggacatgcgcgaacgcgacttgaaaagtatcgagcgcaacccgtacctgcgcaagctggcatacgagcagttcaagcgcatcggcaaacgcgcctacccgattgtggggagccgtcccggcaacgcgattgaaacggtcaggccatttgtcgagtcggcgacaccgcccgacttcatcttcttcgacctgacgggtacggtgaacaacctcgacctgatccggacagtagcgacgatggactacatcttctgcccgatagccgcagaccgtttcatcatggaaagctcgctgaagtacgcgggcgtcatcaacgacacgctgatcactaccggcaagtcgaacatcaagggcatccgcctcttgtggaacatggtggacaagcgcgagaagaccgacctgtacgacatctatgacaaggtgatagccgggatggggcttgaagtgctggacaccagtctgcccgacagcaagcgtttccgcaaggaaggctctgaggaaggcgaccgcccgtttttccgctccacgctgctgccgccggacaaggcattggcgaaagggagcggcatcgatgccctcgcggaagaaatactcggcatcgtaaagcgttgaaccgatggccaagaaactcgatgtcgatattgaccccggcaagttcctggattcgttccgtccggaaatgcccgcgcccgcctccccggggagcctcggaacagatggcaacacttccgcaaaggaggccaggctggcggaaaaaccgaaagcaaaggtgggcaaggatgccacggaaaaggaagaggaatacctggaacgcttcctccatgcaccgagaatccccgtgtgttcgggcaagaccgcctacatccgcaaaagctaccacgagcggatacagcgtatcgtgcaggtcatcgggaagaacgggcttacgttgtcggtctatgtggaccgtgtgctggagcagcacttccgcgaatacgaggaagtgatccgccgactttacaagaaaaattacgaggacatttattgattttattcaccctaaaaaacgaaaacaagatgggatttttcaattcgagaatgaaaaagaaggggaatggcaacccgaaggcggacactccccaagtgaacaatctggaaaaggcggacgtagtcatccacattgtggacgacacccaattagaaaaagcggcggtgttcctccgctatctgacgcccagacaaggagcgcaccgccagtgcatttacctcagccgtgagatgcacgggaagctgtcccgcattgtgcggacactgggcgggaacggcagcaccattggcgggtacatcgagaatgtgctggaagagcacttgcaaacctatggggacgacatcaatgccctgttacgccgtgaaacctcgcaaccgctctgacgatggccgagctgctcatcgtgctgatgatggccttcaacctatggatggtcatctacctgacttgggaacgccgggaagaaaacgtacccaaggaggacaaggaaaaggatgtgggcgcaccggaaaggtccggcgacatcatggggaaaagcctgttccggatgcctgaacgaaaaccgcaggctgctgcaccgatgtccaatgccaccgtgcaagcccccggcgaggaggtggacgagaaggacgtggcctttgacgatgaaactgcctcccccaatagccggctttcgggagccaggccgtcgcgccaagtgcccgacgaggaactggacgaggtgtttgccgacaagcgtgtttccgacatcggggcggaatatgacgaagacggagatgatgacggcgagcctcatgaagcgggaggcatgaccttcgaggacatcgaccttgccatgcggacggtgaagaaaccgaaagccacgaaagaggaacgccgtcacgccggaatggtgttctgcgacatgaagggcaacgaactgttcgcgatgatagaaaagagttcggaagcgacccgcaggaaactggacgagctgatggactactatctggactccgtgtcggcggcgcaggcaaacactacaccggtgattatgcccaagaaagcgcccgcagttccggacaacttcgaggacttcaacatccgcgactatgtataacaagtaaaaacgtaacagcaatgcgaaaaaagaaaatcgactacggctaaaccatcggcttgccaccgagaccactaaatcccaaaagccggcttcatccaaagccgcaagaattaaaacaagtatcaaccgccaatgggaacatccaacccggaggcacaaaacagaaaagattatgacaaagacattgaagaaaaagcaaatcatcctcgcggccctcctgctggctgccaacatccaagttttcgcgcaaggcaacggcatggcgggcatcaccgaagccaccagcatggtcacttcctactttgacccggcgacgaaactcatctacgccatcggcgcggtcgtcgggcttatcggaggcatcaaggtgtacggcaaattcagcgccggcgaccccgacacctcgaagaccgccgcaagctggttcggcgcgtgtatcttcctgattgtaagcgcgaccatcctgcgctcgttcttcctctaacaaacgggtatcctatacatatataataaggtataaggacaatggctgagtaccccatcaacaagggcatcggccgtccggtggagttcaagggcctgaaggcgcagtacctgttcctgttcgcgggcgggctgctcgccgccttcatcctcttcatcatcctctacatggcaggcgcgggccagtggctctgcatcggcttcggcgcggtatccgcctcgtcgctcgtgtggctcacgttccggctgaacgcgaagtacggcgaacacgggctgatgaagttgggcgcggcacggatgcgcccacgccatgtgctccaccgcagacgggtgtccaatctgttaagacgaaaaaagaagaaaggaagaaacgtatgagaaacatcatgaaagccaccacgctggaaagccgcttccccctgctttcggtggaacacgggtgcatcgtctcgaaagacgcggacatcaccgccgccttcgaggtggagcttccggaggtctataccgtcacggcggaggaatacgagggcatccacgccacgtggtgcaaggcaatcaaggtactgcccgaccattcggtgctgcacaagcaagactggtacgtgaaggaacggtaccgccccgacctcggcaaggagggcatgggcttcctcgcccgcagctacgagatgcacttcaacgagcgcccgttcctgcaccacaagtgctacctgttcctgacgaagactacgaaggagcgcatgaggcagcagagcaactggaatacgctgtgccgggggcatatcgtaccgaaagaaatacaggacaaggagacggcggtgaagttcatcgaggcggtggagcagttcgcgcgtatcctgaacgattcggggcatatcaaattgcgccgcctctccgatgacgagcttacaggcacggacaaggagacgggcatcataggcaggtacttcgccctgtcgctgggcaacgcggactgtctggaggacatcgagatgacggcaagggaaatgcgcgtcggcgacaaccgcctgtgcctgcacaccctgtcggacacggaggacctgcccgcagcggtggccacggactgccgttacgaaaggctgtccaccgaccgctcggactgccgcctgtccttcgccgcgccgctgggactgctgctgccctgcaaccacatctacaaccagtatgtcttcatcggcaacagcgacgaggaactgcgccgcttcgagaaaacggcgaggaacatgcagtcgctctcccggtacagtcgccagaacgccatcaaccgcgagtggattgaagaatacctgaacgaagcgcactcgcaggggctgaagtccgtccgcgcccacttcaacgtgatggcgtggagcgacgacgcggaggagctgaaacgcatcaagaacgacgtgggcagccagatggcaagcatgggctgtgtgccgcgccacaacacgacggactgcccgacgctgttctgggcgggcatccccggcaacgcggcggacttcccggcggaagagtcgttccacacgttcatagagcaggcggtgtgcctcttcgcgggcgagaccaactacaaggactctccgtccgccttcggcatccgcatggcggaccgcatcagcggcaagcccctgcacatcgacatctccgacctgccgatgaagcgcggcgtgacgaccaaccgcaacaagttcgtattgggtccttcgggcagcggcaaatcgttcttcatgaaccatctggtcagacaatactatgagcaaggctcccatgtggtgctggtcgatacgggcaactcctaccaagggctgtgcgagatgatacaccgcaagaccaagggaaaggacggggtttattatacctatacggaggacaacccgatttcctttaatccgttctacacggaggacaaggtgtatgacatcgaaaagagggaaagtatcaagactttgttgctgacgctgtggaagaaggacaatgagcctgctacccgtgcggaggaggttgcactttccaatgccgtgtcgcagtacataggacgtattaaggaagacaacagcattgtcccatgcttcaacacgttctacgagtttatagacacggattatcgcaaggtattggaagataagaaagtgcgtgaaaaggactttgacattgccagtttcctgaatgtgctggagccgtactacaagggcggtgaatataattacctgcttaattcggacaaggaactggacttgctacacaagcggttcatcgtctttgaaatcgaccagataaaagagcacgccatcttgttcccggttacgacaatcatcattatggagttgttcatcaacaagatgcgccgtctgcaaggtatcagaaagatgataataattgaagaggcttggaaggcgattgcttcggcgaatatggcttcctatgtaaagtatctttataagacggtcagaaagtatttcggcgaggcaatagtggtgacgcaggaggtggacgacatcatcagctcgcccatcgtcaaggagtccatcatcaacaactcggactgcaagatactgctcgaccagcggaagttcatgaaccgcttcgaccagatacagggattgctggggctgacggaaaaggagaagtcgcagatactttccatcaaccagtccaacgattcgtccagacgatacaaggaggtgtggataggcttaggcggcacacagtcggcggtgtacgccacggaggtgtccatacacgaataccttgcctatacaacggaggaaacggagaagatggaagtccgcgaactggcggggaagctgggcagcgacatggaagccgccatacggcagattgcggagaaacgtatggacgaagaaaagtaaccgatggaaacatcacccgaccacagacggcgtttgaggccaccttatacggcatataagggtgtatcaaacggcgtatgaggtcaagacacattttatcaacaaaaaaacaagaattgaagattatgaacattgaactgacaaagacacaacggctgctgctttgcggcggtctgataggcttggcgtcgctgatgctgcaagcctgcgagacggtaatgaaagaaaacgaagacatccgcgagaagatttgcggcaactggcagagcgtggagggcaagcccgacatattggtgtacaaggagggcgcactttacaaggtgacgctgttccgcagggcgggcgtccaccggaaactgaagccggagacctacctgctgcaaagggaggcggacggtaacctctacctgaacacgggcttccgcatcgacgtggcatacaacgaggaaacggacatcctgtccttttcgcctaacggcgactatatccgggtgaacacggatgaaacagccaatggcgaaaagaagaaagaacaataagaatgtaccactaaatccaatgtgaatatgagacaaaaactgaaaatgccattggtggcagcctgcctgtgccttgcaggtgcaggcacggcaaacgcccaatgggtggtgtccgacccgacgaacctcgcgcagagcatcatcaactccgccaaggagatggtggaaacggcgggcacgaaagccaacacgctcaacggcttcttggaaaccaagaaagtgtttgagcagggaaagaagtattacgacgcgctgaaatccgtacatgacgtggtgaagggcggcgtgaaggtgtcgaaaagcatcgggttggtgatggaaatatcagaaatctatgtggataactaccagaagatgctctctgatgagaactacacgccggaagagcttgccgccatatcgtcgggctacaccatgctgatagacgagagttcggacgtgctgcaagacctgaagaacgtggtgaacgtgacggggatgtcgctcacggacgcggaacggctggcgattatcgacaacgcctaccgcagcctgatgaactaccgcaacctcgtgcgctactacacgaacaagaccatatcggtgtcctacctccgggcaaggaagaagaacgacatggaccgggtgataggactctacggaaaccccaacgaaaaatactggtaagttatgggagagttcgacaaccttcaccagatactcctttcgctctacgacgagatgatgccgctgtgcgcggacatgacgggcgtggcgaaagggcttgccgggctgggcgcgttgttctacgtggcggtgcgcgtgtggcagtcgctcgcccgcgccgaggcgatagacgtgtacccgctgctccgcccgtttgcgctcggtttgtgcatcctgttcttcccgaccatcgtgttgggtacgatgaacagcgtgttaagccccatcgtgcagggcgtacacggcatcctcgaagaacagaccttcgacatgaacgagtaccgggagcagaaagacaaactggaatacgaggcgatgatgcgcaacccggagaccgcctacctcgccagtgatgaggaatttgaccgccagttggacgagctgggctggtcgccctcggacttggtgacgatgacggggatgtacatggaccgggcggcgtacaacatcaagaagacggtgcgtgactggttccgggaactgctggaactgatgttcgccgcagccgcgctcatcatcgacacgctcaggacgttcttcctcgtggtgctgagcatcctgggaccggtagccttcgcctttgccgtatgggacggcttccactcgacgctctcggcgtggttcagccgctacatacagatttacctgtggcttcccgtgtcggatttgttcagcaccatactggcgaagatacagattctgatgttgcagaacgacatacaagcgatgcagaccgacccgaacttctcggtggaggcgagcaacggggtgtacatcgtgttcctcatcatcggcatcgtgggctacttcaccatcccgacggtggcaggctggatcatccaagcaggtggcggcataggcagctacaacaagaacatcaacaccgccggggctttgggcggcagcgtggcgggagccgccgcaggaaacgtggcaggccgcgcgggcaagctcatcaagggaacggcgggaaagctgttccgaagataggcattccggacaatccgtttccgtgagttgcccgacccttaaaaacggattattgaacaattaaaagacgaaaagaagaaaatggaattcaaatcactcaagaacatcgagacgagtttccggcagatacgtctgttcggcatcgtctatacggcggcctgcgccctcgtggtggtctgctcggtggtgtgcgccttccgcttcgccgaggcgcaacggcagaagatatacgtcctcgatggaggcaagagtcttatgctcgcgctctcgcaggacctgtcgcagaaccgcccggcggaagccagggaacacgtgcgccgcttccacgaactgtttttcaccctctcgccggagaaaagcgcgatagagcacaacgtgaaacgcgccctgctcttggcagacaagagcgcgtacaactattacgccgacttcgccgaaaagggcttctacaaccgcatcatcgccgggaacatcaaccaagtgttgcaggtggacagcgtggtgtgcaatttcgaccgctatccctacgaggcgcggacatacgcccgtcagatgattatccgcgagagcaacgtgacggaacggacattagtaaccgcctgccgcctgctcaacgcgagccgctcggacgacaacccaaacggcttcaccatcgagggcttcacggtattggagaacaaggacatccggacgattgaaagataatgcgtatgggaaagatgaaaaatctcattgaaaagtggaccaccgggctgaaaggttggttacgcaataggctggacgccctgccgcccaaagcacggcttaggatagtccttgcggcatttgccgtgttcgcctcgctctgtctctacatgactgccgccgcaatcatcggcttcggcaaaggggaagaggcattggagatacggcacatcgagaagttagaaatatataataaggtgtatcactcaaatttgaatccacaatgaaattatcagattggatatgggaaaagatggaaaacttgcaggatgccggattccgatggaaaccgaccttgaagttctgccatcaggtgcttcgcttggattacaatgccattgccgattccatcgtaaggaacgggcatcgcccggcaattacggaagagcaggcaaaaatactctgggattaccgtttcttccggaatctggaccagacggaacgcagcggctggcacaaggttatggatgtactgcaacaaaccgattggggcaaacagcaggtctggttgttgtccggattgaaaatggggaatgaaacacttccccaaaaactgaatgccatgtacacgctgctttgtagtgcccatacgggtaaaagccataccctatgtcctctgcccaatccggaagaagtggctaccgcccataagctggtagggtattgcatgaaggacgaggaactcgactacttgaagcggcttgccctgcatggggaatatccgggagacctgaccgccatcaggcatggtctgatggatatgtaccaaaagatagaggacctcgaatgggaacgggccaaggaaatgcgtgcggacaatcactggtcggcggactccatcgatgcggccatccaggaggaaaaaggacggattatgcgcagtgcctccgatttgtacgagcagaaagtgcagggcaagttcccggacgactatcggaaagccctgcaccgggaacggatggtgcttcatggactctctcaaaagggatgggacgggcagacaaaaattccgaaacctctgttggtcaagtatgggttggcggaatcattcggaaaaataagcgatgcgttgatggattacattatccgttgtgacatgggagacgatacttatcccaagcatatggtagggcatcataaccgcatcatcaaagaacagtcccggataggattggaacgcttggaacacaggttgtttccggataaaaacaaaccaaagctccatccggcttctttgggtacgcataaaatgcccattcgcttacagaatcaggtaagcaaagagaataaaggtataaaaatcagactttgacaagctaattgaactgatgatggaaacaaaagaacagaagaatgaatcaagaacaaaagagaaaaagccgctgacggaacaacagcgtcagcaaaggcagaagatgctggtctatccgctgatggtgctgctgttcgccgggtgtatgtggctcatcttcgcgccgtcctccgaggacaaggagaaagaacggcagggacagggattcaacacggacatgcccatgcccgaagactccaaaatcatcggggacaaggcgaaagcctacgagcagcaggatttggaaaacaagcggaaggaacgccggggcatggtgggcgacctctccgcgttctggaacgacagcgacggtgacacgccaacggacgatgccgacacttcggacgattaccgcctgacacggacggaaacgaccgacggggaaacggcggacgaaagacaggcgggcatccgcacttccgctgccgcctaccaacggctgaacacctcgctgggcacgttctacgagccgccgaaggaggacacggaaaaggaggaactccgggagcgcatcgacgaactggaagccatgctggtggcgcaggatagcaagccttccacgatggaggaacaggtcgccctgttggaaaagtcctatgagctggcggcgaagtaccagaatgacaacaatgccggacaagccgcacagcccgatgaaacgggaggttctgtgagtacaggcgaaaagagcatgaaggcagaacccgtaagcgatgtaaggcggacggtggtgtccgccctgccgcagcccatgacagactcggcgttcatcgcggactattcgggggaacgcaactacggcttccacaccgccatcggtgcggaggaaacgacggggaagaacaccatcgccgcctgtgtgcagggcgaccagacgctgacggacgggcagacggtgaagctccggctgctggagccgatgcgcgtgtcggggcgcgtcatcccccggaacacgctccttgtgggcgcggcacggttgcagggcgaaaggctcggcatcggcatcacctcgctggaacacgggggaaacatcatcccggtagaactggaggtgtacgacagcgacgggcaggcgggcatcttcatacccggctcgatggagatagacgcggcaaaggaaatcggggcgaacatgggcagctcgctcggaagcagcatcaacatatcgaccgacgcgggggcgcagctcgcctccgacttggggcgaggggcgatacagggcatctcgcagtacatctcgaaaaggatgcgcacggtcaaggtacatctgaagtcagggtacagggtattgctctaccaagaaaaggaatgaacagtccaaaaacataaaggcaaaaaaagaaaaaataatcaacaaactaatttttatttaccactaaatccaacgtaaaatgagtatcaagaaagtaatgacaatgtttgccctgctgatgggcatcgcctgtgcgagctacgcgcagggagtgacgaacgacagcactgccaccgccaaggaggacgggctggaactggtgaaggacgtctatccgcagacggaggaggacggcgacctgtaccacggtctgacgaaaaagctgatgttcgaccgcatgataccgccgcacggcttggaagtcacgtatgacaagaccgtccacatcctgtttccggcggcggtgcgctacgtggacttgggttcgcccaacctgatagcgggcaaggcggacggtgcggagaacgtcatccgtgtgaaggcgacggtcaagaatttccgcaacgagacgaacatgagcgtcatcacggaggacgggtcattttacacatttaatgtgaaatacgccgatgagccgcttatcctgaacgtggaaatgaaggactttatccacgacggcagcacggtgaaccgaccgaacaacgcgcaggaaatctacctgaaggaactgggcagcgaaagcccgatgctggtacacctcatcatgaagtcgctgcacaaggaggacaagcgcaaggtgaagcacatcggctgcaagcgtttcggcatccagtacctgctgaaagggatttatgtccacaatgacctgctgtatttctacacggagataaagaaccaaagcaatgtgccgtttgacgtggactacatcacgttcaagattgtggacaagaaggtggcgaagcgtaccgccatgcaggaacaggtgctgttcccgctccgcgcctacaactacgccgtccgtgtagccgggaagcggtccgaacgcacggtgttctgccttccgaagttcaccatccccgacggcaagcagctcgtggtggagatgaacgagaaggacggcggacgccaccagacgtttaccgtggagaacgaggacttggtacaggctgaaaccatcaacgaactgcgcgtgcgatgaaaggaaaggtactgtttattgtaacgcttctgttcgtcctcctggcaggacgggcggaagcccaacggtgcctgccgaagatgcggggcatcgagttgagagccgggctgaacgaggcggacggctatgtgctgggagccatgctttcgagctacgcgaaaggtgggaacaagtgggtgtacgggctggaatacctgaaaaccagccacggataccggagtacgaccatccctgcggcacagttcacggcggagggcggttactactacaacttcctctcggacgcgaaaaaggtggtgttcttctacgctggcgcgtcagcccttgccgggtacgagacggtgaactggggcggaaagacgctgtacgacggggcgaggctgaacaacaaggacgcctttgtctatggctgcgccgccacgctggaaatggagctgtacctcgtggacttcattgcgctgacggcctcgctgcgtgaacgcttcctgtggggcggcagcatgggcgtgtgccacacggaatacgggataggcgtgaagttcatcatcaactgaatgtgcgcctatatggatatagaagcgatgaaacgctatccgctggaggacttccttgcacggctggggcatcatcccgtgcaaagacgtgccaacgccatctggtacaggtcgccgtaccgggaggaacacacgccttccttcaaggtaaacccggaaaagaacctctggtttgattttggcgagggcaagggcggtaacatcttcgcccttgcgggggagttcatccaaagcggcgacttcctcacacaggcgaggtatgtggcggaggtggcggacatgccgttgcaggactatgagcaacgccgcacccccgaagtgcggcaaccagccggacacagcttcgaggacgtggaagtgctgcccttgcagagccgggcgttactccattacctgcaagaaaggggcataccgtccgccatagccatcgcgaactgcaaggagatgcgctactccacgcacgggaaacggtatttcgccgtggctttcggcaactgcggtggcggctacgagatacgcaacccgttcttcaagggctgtgtgccgccaaaggacgtcaccctgctgccgtcaggctctgccgtttgcaacgtgtacgagggctttgtggactacctttccgcccgtgcattaggcatcggcggcggggaggaccaccttgtcctcaactcggtgtccaatgtggcgagggcgtaccggcatctggacggctacggaacggtgcggtgccaccttgacaacgacgaagccgggcggcggacattggaagccctgcgcacacgttacggcgaaagggtgtcggactgctccggcatctacggcggatgcaaggacttgaacgagtatctgcaaagccgtctgaaacaaaacgagaagaacaacaagaacatcaaacttaaaatgtaacggttatgaacatgaacaaattaaacaatacacggaaagtgaaaagaaacatagtaaaatcattggcaaccctttgtctggggctgctctctgtatgcttcaccgcctgcgatgacgatttggacgtgacgcaagcctatccgttcacggtggaagccatgcccgtgccgaaggaactggcgcagggcgagacggcggaaatccgttgcgaactggtacgcgagggcgagtttgacggggcggtctataccatccgctatttccaatacgacggggagggcacgttgaagctggataacggcttggtgttgcagcccaacgaccgctacctgctggagaacgaaaaattccgcctatattacacctcggagtgcgacgagtcgcaaagcctgaccatcacggtggaggacaatttcggcaatgcctgcgagtgggaattggagttcaacaacgactcggacgcggaaacggagggaggcgtcgctgtgtctgacaccttgaacgccagccgatgatgcgcaaggcgttgctcctgctgctggcggctgccctctgtggcagcctgccggcacaagacacggacagcatggcggaactgctggcatcgtttaacaatcatcccaaggctgacatcgccgttgaactgataaaaaagtacgagggactgcacgaccgttccgattacccctactacggctacgggcatcgcaggttgcccaacgaaaacctttcctatgacatgacggaggcggaagccgaagccctgctccgcaaggatttggcggtgcgctacaagctgttccgcaaatttggtaaagatgccttgcttcttaccgtattaagtttcaatgtgggtcaaggggtattgcttggtcacggcggacacccgaaaagcaaactcatccgcaagctggaagccgggaatcgagacatttaccgtgaatatatcgcttactgccggtacaaaggaaagcagcacgccatgctattcaatcgaagaaaaacagaatttgcgttgctatatattccgtgatatgattaaaattccttgcggtaaataatttcgcaaggaatttttgcttccaatacaaataaacatattatctttacaaataaattttcgaaaaatgaaagagccgaaagaaatctattatttacctgtagaacagttatctgatgatgttattcaatatattgaaaaagtttttgagttattagatgctgtaaaaaatgattgcaatagcaataatttttctcgccgatttactttcataagagatgagaaagctattagtgatgttgcggaaattaaaaaagataataataaattaaatcatatatatatcaacgaaaatttctgtcagtatttatggtctgtttgtgtctatcttatcgcatattttgaaaatgttatacatatccctatgatggatgctgttggtattaataaaaatggatataagcccaatatgatagatgtagaatatggcaatgattgttttttcagaggacggcaattattacataactttaatagagatgcatattgggttactccaaatatctgtaatccgcagcaatttgaaaatattataagccatgcgaatgatgtctattgtgctgcaatagcatttatatatgctcacgagttttcacataattatttggggcatacacaaatacagcaaacgctttctcgttcaataaatgatgaaattgcagcagatgatatggcaattagctttattcaaactgaatataactctgcatggggaagaacctataaggcaggaattgcaactacattagcagcccttttattaatgggagaggattctatttctggtggtggaacccatccagatatggatgttcgaatagaaaatttggttactaaactggaattgcacgaaatggatcttctttggggctatttaggggttgctttaagattatggcttcttgtttttgatggcttatccatcaaagaggatatgcagcaaccggggtttggttcatacaaagagatatatt

SEQ ID NO: 36 - DNA, 90592 bp, Bacteroides thetaiotaomicron
attcttcgccgcccttgcacacatccaaaaactaccttaagaagcatttgtaaatccaaaaagaaaaaattatatttgttgtgatttaaaagaaatagaaaccagacagagtttaaattacactcccgcctaaacgtcgaaatgtttttgtttcttttttatcatcattttaaatctactttgttctgttattaattttttccctaaatgggcatggggtacctatgcctgcactgattcttcacagttattagtttattatttctgtggcataggtaatatagttgtcgtagtaggaatgctattgttgtttgcttggaagagaattggtttttggatattgttaaccgcttgtatactagcttcttttgcatctattgcaatggagtctattcctttccaactaataggattgctaatttgttacttagttttgaaactgaaacgtgatggtatttcttgttgggataatttggaataatattcataaattttatccaaaagaaggaaaaagaataaaataaacaagaactaaagttacatcctattcataaaaatactatatttattgcagctagagagcactttaagtaatgcttaagacagaaaacgaaaagtagtatatatgctatatattttctattattaattacttaaacacattttttatggaagccaaaaaatcaaaaaaggctgcaattgagaatcaaagaggttcttggttgttgatgggtttggttgttgcgcttgctttcatgttcgtatcgttcgaatggacacagcatgatgtaagagttgcggcagtatcatctgatgatgaatccatctttgtaacggagctcgttccaatcacattccctgaagagaaactggaaccgcctcctccaccggaaactaaagtaacagaattgttcgaaatagtagatgataccgaagaggtgacggataacgtttcagtagtaccagacaatgtgaatgaaccttacaaggttgtttgggtaccgccagtagtggaaactaaagaagttgaggaagatgttattcacgtaagtgtagaagtcatgcccgaatttcccggtggttcagctgaattgctgaaatatttgagtactcatatcaaatatccgacaatgtctcaggagatgggctcacaaggacgtgtaattgttcagtttgtcgtagacaaagacggatcgattactaatccgacagttgtacgaggggtagatgcttacctggataaagaagctatccgtgtgataagtggaatgccaaagtggaagcccggagtgcagaacggtaagaaagttcgagtaaaatatactgtacctgtagtattcagactgcagtagttacttgaaataaatgattaaaagggtcggtccaccgcgggagccggcccttttttcaataaaataatatatctttgcgtcacgaacaaaaaaaatgaaagactggtttatgaatcttctgtattacctaaaaagaccttttatccggctctcccgtttccgctaccgttgtggatatggtgtgcactctccttttgctttcagtctgatcacagatgtgatttatgagaagatgccttattatgcatacgacctgctgaaggtggaacagaaaaagcggatcacaacacagagatgggagaaaggaataccaagaatcaaccgtctgttgttccgcctggtgaataaagtgcaaccggccactatcatagaagtaggccagccctcggcagcctctttatatttacagtcagccaaaccttctgccgggtatctttttgcttctgacttatcagagctctttctggatgccgatactccggtagactttctgtatctgaatgactatcggaatccggctttgctggaagaagtttttaacatctgttcccgtcggactactccgaatagtttgtttgtcgttcatgggatctgctattcaaaggcaatgaaaaatctttggaaacagttacagaatgatgagcgggtgggaatcacttttgacttgtatgatgcaggcttgcttttttttgatacaacaaagattaaacagcattatatcgtcaacttctgatcacctttatacgttaatcttatatatagtaatgatgaaaaatagacgtttatgaaaaaaagccttgtatatacaaagaccggtgacaaaggaactaccagtcttgtcggcggaagccgcgttccgaagacccatattcgtttggaagcatacggaacaattgacgaacttaattcccatctgggatggctgaatacgtatttgctggatgaggcagaccgggattttatcctgagtatacagcataagctattctctatcggttcgcatttggcaacagaccaggaaaaaacacaactgaaagccgccagtatccttactccggaagatgtggaacgcatcgagcgcgagattgataagctggacgaacagttgcccgaactttgtgcctttatcatacccggaggcagccgtggagcggctgtttgtcatgtgtgccgtacgatttgccggagagccgaacgtcgcattctgactctgtccgaaacttgtacaatttctcctgaagtgttagcttttgtcaacagattatcagattatttgtttgttttatcccgaaaaattaattttgatgaacaaaatagtgaaatattctgggataatagttggaaatgatagattttattatacttttgccgaaaaatagaaaataagtattcactttttaatactcaagattatgtattggacattggaattagcatcgaaactggaagatgctccctggccggcaaccaaggacgaattgattgattacgctatgcgttcgggtgctcctcttgaagtgatagagaatctgcaagagatggaagatgaaggcgaaatctatgagagtatcgaagatatttggccggattatcctagtaaagaagatttcttttttaacgaggaagagtattgatttagaaaaagaaaccgaacatataaaaatacccgataactttcacacagctatcgggtattttttattctcatgcaatattaaaagaccggcatctgccagatgaatcctaccgaaatccggttggtactgtaattctcttgtcccagcactttggcacgggaggtgaagtcataagaacgtcctacataggtcacgaagaaatgcaggttagtttccatcggataaaattcgatgcctgccagatatccccaggaggtgcggtaatttcctttttctattccttcggaggctttggtcacagaagccgtttcatacattcctttcacaaaggcattccatttcggaagaaaacgatagttacacttggctactacggataaataacctgtatcaaacgcattgtgtccgcccggacgaccgacgatgcttgtgataatccctttacggtcaatctcttcttttgagtacatgaagtcgacgaaggcgttccactttccgagattcagttcatttcctacggcataataatacatattatgatctttggcttcgttcatcacagaggccgaccagcgggttttaaatacattattaaaattgccaatccagtttaaggtatagaccagcggcatttttccggatttcagatcggggagattaccctccgcatcctctgtgattccgtaagtgttgtcgaaagagctattgcggctgttcaatatctgcagattaagttgctgatcgggagtaatgttataacttgcattcagaccggtcaggaagttactcatataatcgatcatatcacaatattgatagacatcgatcgggttgaggtcaaactcgaagccgccatagttggcactttgtttaccggcaaacaggttgaacttatcgttgagcttgataccgatgcctgcccagtcgatggaggtcgggaggttgtctatcatattgtttccgtcgttcgagcggttgagacgctggcggtaacgataagaaagccagttgttgatatttcctttcgcttcgatgcggagctggtgcatattgaagtcaccttcctgaaatccattctggaaatgagcgtcaaaactcccctgcatattcaggtataagttgaacttatccgttttcttttttacgtctgtcagttcctcgaaaagaggagtgtttggggagaacttttgggcatacattgcctgtatgctacccgcaaggagtagcataaacattaattttttcataagtaggtccggtttttagtattcgttaaagtattcctgaatttgtttccagtccgtggttttggtcagcgcaagcatcaatagtacacgtgacttttgtggattcaattcttgagaggctacaaactgatacttggcgtcatccacttccgcatcaagagtggtaggaccagtcggtacgcgggaagaacgaacgactacaatgccttttctgcgggcgtctatcaatgacggaaatatgtttttatggatattaccgtttccgactcctgcatgaatgattcctttatatccgttgttgagcaacggagtcatcatatcggcttcaatattggaatagctgtatacgatgccgactttgggcaatgaagtcagtttggtgacatcaaatacggattgggtggtatgtttcttcagtgtgatctgattataacatactttaccgttcagtacatatcccaatgcgccggagttgggagcctggaaagtctgtacatcgaccgtgttcattttaactacgctttctgcacctagaatcagaccgttcatggcaaccagtacacctttgtcttttgattctttagctgcagcggtaactactgcattataaagattcagcggaccgtcggcacttaatgctgtagaggggcgcatggcacctaccaatacaacaggcttgtcacttttgacagtcagattcagaaagtaagcagtttcttccatcgtatccgttccatgagtgatcacgattccgtcgatatccggtcgtttcaataactcgttgattttcttggcaagtgtcagccagacttcgtcattcatgtcctgtgaaccgattctcacaatctgttcgccggttacattggcgatatctttgatttcggggactgcatccagcaatgcaccgatagcaacttgtcctgccgtatagctggtgcccgtagccgagcttcctgttccggcaatggttcctccggtagcaaggatgtggatattcggttttgcggcaaatgccattgttgcggataatagtagtgttactactaccaggcctaatttcttaatttgtttcataactgaaatgagtttaggttaataatatattagaatatttgaataaagagcagtcctaaaacaatagcgactacggtagataccagtccgggcatcataaacgaatgattcaacacatatttaccgatttttgttgtcccggtgcggtcgaaattaatggcggctacgacagtcgggtaattcgggataaagaaatatccgttcactgcggggaataaggcaatcagcatatacggagaaatacctaacgcgatgcccagcggcatcaatgcccgcaccgtggccgcctggctatacaacaggatagacatgacgaacagcgcaataccgaacagccatggcatctgccgcacgattccttcgatggaaagagtgagctgtgccatattgccctgaaggaaagtatcacccatccacgcaataccgaagatggcgataacagcctgcatcccggcagggaatacagaaccctgcgttgctttgattccatccgtcttggttactataaggatgatagcggctgccgacaacattacgatctcgataatggaggacataccgagcgtgacgatttctccatcgatgaggaaactgggacgcataccttcaaaagatccgaaaaggacgataaaagcagttgccaatataaagatgagtacggaaagcatggcggaacgtttgttcttgacatctttaatctctatcttcttgtcattgaaaagaccttctttcaagcgtttctgatattcgggatcctctatcagttccttgccgactttcatggagaataaagcgccgaccaatactccgatgatagtggcgggaatcgtaattttaagaatatcgaataatgtaatgtcgaaacctgccagtaacccgagcaaagctaccgttgcagcagagatgggactggctgtaatagcctgttgcgaagcaatcacagcaatacccagcggacgttccggacgaatctttgtttcggtagctacctcagcaatcacgggcaatacggaataagctacatgcccggttccggcaataaaggtgaacagataagtcaccaatgggctgagcaacgtgacgtgcgaaggatttttgcgtagcaaatgttctgccagtttcaccatatagtccagtccgccggctgcttgcatacaggaggcagcggaaataacggcggcaatcatcaacataacgtcgataggtggtgcggtgggttgtaaaccaaaaacaaacgtgagtattcccaatcctactcctcccatgacaccgagtccgatgcctcccaaacgtgcgccaataataatggctgtcagaacaaatgctaattgtaatatcattggttgttgttttataagttcctaacaaagataaaggatttatcttcgttttttctctgtttctaagataaacaacaaaaaagttattgaatagtttttgcatatttattaaaacaataacatctctgactggttattatatcaactaacgaatgtgttattgttataaaacaaccgatatggaacagaaattatcaaaaaaaactcgtacagagagcgacttgataggtagtcgtgaagtgccggaaagtgcattgtatggagtacagacactccgtggtattgaaaactttcgcatcagcaagtttcatttgaatgagtatcccctgtttattcaggcattggccatcactaaaatgggagctgccgttgccaaccgtgaactggatttattgactgaggaacagacggatgccatactgaaggcttgtaaagaaatactggaaggaaaacatcatgaccaattccctgtagatatgatacagggtggagccggaaccaccaccaatatgaatgccaatgaagtgattgccaaccgtgcactggaactgatgggacatgcacgcggagagtatcactactgctcgcctaacgatcacgtcaatcgttcgcaatctaccaatgatgcgtatcctacagccattcacattggtctgtattatacccatcttaaattggtgaaacactttgcaacactgatcgaggctttccgaaagaaaggagcggagtttgcacacatcatcaagatgggacgtacccaactggaagatgccgtaccgatgacactaggacaaacctttaatggattcgcaagtattttggaacatgaactgaagaatctcgattttgccgcacaggattttctgacggtcaacatgggtgcgacagccatcggaaccggaattaccgccgaaccggaatatgcggaaaagtgcattgctgccctgcgcaagattacaggactggatatcaaactggcagatgacctgataggcgctacttcggatacttcctgcatggtaggatattcttcggccatgcggcgtgtagctgtcaagatgaacaagatttgtaatgatctgaggctattggcttccggtcctcgttgcggactgggagaaatcaatctgcctgccatgcagccgggctcttccattatgccgggaaaggtgaatcctgtcattccggaagtcatgaatcaggtctcttataaagtgataggaaacgacctttgtgtggctatgagtggagaggctgcgcagatggaactgaatgcgatggaacctgtcatggcacaatgctgttttgaatctgcggatttgttgatgaacggttttgatacattgcgtaccttatgtattgatggtatcacagccaatgaagaaaaatgccgtcgggatgtacacaacagtatcggagtagtgaccgcactgaatcccgtaattggctataaacattctacaaagatagcgaaggaggctctggaaacgggtaaaggagtgtatgagctggtgctggaacataacattctttccaaagaagacctggatacgatcttgaaaccggaaaatatgattaaaccggtgaaactggatattcatccgaatcattgattcataggggtaaaatgagaggccagcctgttgatataggctggtctctgtgttttgtatcattagtgtattttatgtatttaatcttggattctttttcatttactcgtaaaaaaaacgaaataaataaaggaaataaattgataatgtctgttttttagtatattcgtaaaaagtagtgtacatacaaagcaaaactaaaagaatacaaattaaaaacagcgattatgaaaaacaaaccttttgagaattttgactttatagacttctgggatgatgatgaatatgctatgaatgaatatattggcgcacctcctacagaagagatgatagaagaaacagaacgtgaactgggatacaaactccccgaatcttatatttggctgatgaagcagcataacggtggaatacctttcaatgtttgttttccttgcgacgaacctaccagttgggcggacgaccatgtggctatcactggcattatgggagtcgataaggataagatttattctctttgcggacagctcggcagccgtttcatgattgaagaatgggggtatccggacattggagtggctatctgcgactgtccttctgtgggacatgatatgattttccttgattatcgggagtgtggtccacagggcgaaccgaaagtcgttcatgtcgatcaggaagatgattattatgttactttccttgccgataactttgaagaatttattcggggacttgtcaacgaagaagtctttgatacgtcggaagaagatgaaagaatggagctggaaaaagttcggaacgcagctttctcaccgctcttgtccgatttgtgcgcaaagtgtgatcatcccgtggatacggagcgatggattcggaagatatcggaagagatagtaaccgataaaggattctttgcgcttcatgccgacgaacgttcttatctgctttacgacatccagttgtggctttacaccaacgtttatcccgatacgacggaagaagattacctgtctgcttataaaaagataatagcgctggacggtgagttcagtacgggaggatatgcttcggactttgttaccgattggctgacacgacgcaaggagagcggtatggttacgtgtaatgacggtattctttcgatggcagcgggaactaaggaggccttgctggcaaatcgggagttgatttcgaacaaagagcaataatttgtgtttatttattataaatatatatctttgtcccgaattataaacacgtagatttatgaaaaagatttttggtgctttaatgattgccgtatgtatcggtatggcgatgcctgcccaggcacaattacattttggtgtaaagggtggtttaaacttgtctaaagcaagcttttctgatgtgaaagaaaactttaaaaaggataattttacaggtttctttatcggtccgatggcggaattcaatattccggttgtgggattaggagtcgatgcgtctttgctttttgctcaaagaggtataaaaatctctgatggaggtgaagaagctactgtcaagcagaatggcttggatattccggtcaatttgaaatataacatcggtctgggaagtctggtaggtctttatgtggctgccggtcctgatttttactttgattttgccggtaataagacaatagacggagtaaaaaccgataaaaagaaagctgaagtcggtatcaatgtcggtgcaggtgtgaagttgctgaatcatctgcaagtaggagctaattataatattccgttgggcaagactgccagctttgaagacattgaaggctcatacaaaaccaagacttggcaagtatccgttgcttatattttctaagccatccgttacattcaatcatacaaagaaagagcttccgataaaggaggctctttttttattcaaggtattttgtttaaggtactggtctgtaaacctgaatctattttatcagattccggtgtgcagactatttttcttatcagtgttccctcttcctcttttaaatccccatttttttattgtacttttgtgcttgcaatgaaaaagtatgtagatgtcatattaccattaccgcttccgaagtactttacctattccctgccggatgaatgtgcggaagaggttgagattggatgccgtgtgatagttcctttcggacggaagaaattttatacagctatcgttcgtaatgttcattattgtgctccgacggagtatgaggtgaaggatatatctgcattgctggatgcttctcctattttattgtccactcaatttaagttttgggagtggctggcggattactatctctgtacacaaggagacgtttataaagcggcacttccttctggtttgaagttggagagtgaaacgattgtagaatataatcccgattttgaggcggatgcaccattatcggaaagagagcagcgtattcttgatttgctttcagtagattctcagcaatgtgtcacgaaactggagaaggagagtggcatgaaaaatatcctcacagtcatcaaatctctgctggataaagaagccatctttgtgaaagaggaattgcgccgtacttacaagccgaaaacagaggcgagagtacgattagccggttctgctgatgaaaagcggcttcatatcttatttgatatcctgtcccgtgctccgaagcagttggcgttgctgatgaaatatgtcgagtgttcgggaatccttggaagagaaacaccgaaagaagtttcgaaaaaagagctgttgcaacgtgcaggggtgtctccttctattctgaatggcttggtggagaaaaagatatttgagatttactttcatgaagtcggccggctgaatcaggaaatgaaggaggtcgtagagttgaatgccttgaacgagtttcagcagcgggcgcacgatgagatcgtgcaatcctttcaggaaaaaaatgtctgcctgcttcatggagttacatccagtggaaagacagaagtatacattcatctgatagaagaaacgattcgtcaagggaaacaagtattgtatctcttgcctgaaatagcattaaccactcaaatcacagagcgcctgcaacgggtattcggttctcgtttggggatttatcattccaagtttccggatgccgagagggtagagatatggcggaagcaactgggagataaaggatatgatatcatccttggagtccgttcttccgtatttcttcctttccgtgatctgggcctggtgattgtagatgaagagcatgagaacacctataagcaacaggaccctgctcctcgctatcatgcacggaatgcggctattgtactggctgccatgtatggagcaaaaacgcttctcggcactgctaccccctccatagaaacatggcagaacgcaaggaatggaaaatatggatttgtacaactgaaagaacgatataaagaaattcagctgccggagattattccggtggatatcaaagaactgcatcgcaagaggcggatggtcggacagttctcgccgttactgatacaatatatgaaagaagcactggaacagaaagaacaagtcattctcttccagaaccgtcgcggatttgcaccgatgatagaatgccgtacttgcggctgggtaccgaaatgtaagaactgcgatgtgagtctgacttatcataaaggtatcaaccaactgacctgccattattgcggctatacctatcaactgccgaagttctgtcccgcctgtgaaggaacagaactggtcaatcgtggctttggtacggaaaagattgaagatgacatcaaagtccttttcccggaagcggctgttgcccgaatggatttagacactacccgtacccgcgctgcctacgagaagattatcgccgattttgagcagggaaagacggacatactgatcggtacgcaaatggtatcgaaaggtctggactttgaccacgtaagtatagtgggcatcttgaacgcggacaccatgctcaattatccggatttccgttcttacgaacgtgctttccaactgatggcacaagtagcaggacgagccgggcgtaaaaataaacgcgggcgggtggtactgcaaacgaaaagcattgatcaccccattatccatcaggttatcggtaataactatgaagaaatggtagacggtcaactcgctgaacgacaaatgtttcattatcccccttactatcggttggtgtatgtctatctgaaaaaccataatgaagcattgctggaccagatggctgcggtcatggcagagaaactaagaactgtgttcggaaaccgggtattggggccggacaaacctcccgttgctcgtatccagacattattcatcaaaaagatagtgctgaagatcgaacagaatgccccgatgggacgtgcgcgggaattgctacaacgtatccagaaagagatgttggaggatgaacgctataaatccttgattgtctattatgatgtagaccccatgtagcactcgatacagacctaatatttttcttataataacctttataaattaactaaccatgaaacgacttacgatttattgcttaacatgtcttattggtgtgagtcctctttttgcccagcaaggagtgactcagtgtggaacccctacggggcaaccgaaatttccaatagaaacttatcaggaactgcccgacccttcctccccctctgataaagactgggcagcagttaccaaccctcagatttcctggggaactattgacacccgctatgcgaagcatcggcttcctcagctgaaaaaacagcagcttaccactttaaaaggctggcgtggcgaacgtataaatgcgcaggctgttgtctggaccggcactgaggtgaaagatctgaacttcagctttaccgattttaaagataaaaaaggaaatagcctttcggatgaggcgtttaaagccggtttcatccgttatgtaatgaccgatgaactgaataaagatggcagaggcgcatgcggtcaccgtcaagcagtggattacgattcgttgttggtagccgacccgattgatacgaacttgaaatcaatgtctgttccggcacgtactgttcaacctatctgggtgcaatgctggattcctcaatcggctactcccggaacctacaagggtgccttgctgataaaagacggttcccgtctgttgcagcagcttaatctcgaaatccttgtttcttcccgtgaacttcctgcaccgtccgaatgggcttatcatctggatttgtggcagagcccgtttgccgtagcccgttattatcaggttcccttgtggagtcaggagcatctggatgctatgcgcccgctgatgaaaatgctggcggatgccggtcaaaagattatcacagccactttgacacataaaccttggaacggtcagactgaagattatttcgagacaatggtaacatggatgaaacgtgccgacggcacttgggcttttgactatacggtttttgatcgctgggtagagtttatgatgagtgtcggtatcaatcagcagattaactgttactctatggttccctgggaattatctttccagtattttgatcaggcaacaaattcattgaaatttgtgaggacagcaccgggagaacctgcttatgaagaaatgtgggttgcgatgcttacttctttttccaagcatctgagagaaaagggatggtttgatatttgtgcaattgcgatggacgagcgtccgatggatgtcatgcagaaaacgttgaaagtaatccgcaaggcagatccggagtttaaagtttcactggccggtaattatcatgctgagatagagccggacttgtacgattattgcattgttatcggacagaacttcccggaagaagtacgtctccgccgtgcggccgagaataaacgtaccacctattatacttgttgtacggaagcacatcccaatacattcactttctccgatcctgctgaggctgcatggatgagtttctattcttcgaagaagcatctggacggctatctgcgttgggcatacaatagctggcctttggagccgttgctcgattcacgtttccgcacgtgggcggctggagatacttatcttgtgtatccgggagcccgtagctgtatccgtttcgaacgtctgatcgaaggtattcaggcacatgagaaaataacgattcttcgtcaggaatttgagaagaagggaaataaagccggattaaagaagatagagaaaatgctggccccgttcaatttgggtaatatgccggaaataccagcagccgttaccgtaaaccgggccaatcagatacttcattcgttttgataatagaaacgaatgaagcctgtcaattattaaacgtaaattatgaagaaaatattatttgtctgcctcggaaatatctgccgtagctctacggcggaaggagtaatgcttcacctgatcaaagaagccggactggaaaaagaatttgtgattgattccgccggaatcctgtcttatcatcaaggcgaattgccggatagccggatgcgtgcacacgctgcccgtcggggctatcaactggttcatcgctcccgtccggtgcggacagaggacttttataattttgatttgattattggcatggacgaccgtaacatagatgatctgaaagaaaaagctccttctacggaagagtggaaaaagattcatcgtatgacggagtactgtacccgcattcccgccgaccatgtccccgacccctactatggaggggccgaaggatttgaatatgtgctggatgtactcgaagacgcttgcgctggtctgcttacttctttaactcaggataactgatccgtgtgtgataagcgatcttcagtttttctttgaataccgtcttgatggtcgcaatgtccttgaaagtgatagggcattctttgaaataaccttcagcaacttgggagtctataattttgtcgaccaggttgctgatagtttcttccgtatattccggcagactgcgtgacgccgcttcgacagcatccgccatcatcagaatagctgtctcctttgagaaaggattagggcccggataggtgaacagttcttcattcggttcctcgtcggggtgctcgttcttccatgagatatagaagaacttcgtttttccccgtccatgatgggtgctgataaagtctttgattactttcggcagattatgcttgtccgccagttttaatccgtctgtcacatgactgatcacgacctgggcactttgctcgtaattcagattcttatgaggattgacgcctcccgactgattttccgtaaagaaagcgggattctccatcttgccgatatcatgatacaaagctccggtacgtactaattgacttttcgctccgatacggatcgctgcctctgccgccagattggctacctgcatagagtgctggaaagttccgggcacggtttcggacatctgccggagaagatcactgttgatattggaaagttcgaccaaagtcacattagaggtaaagccgaacgtcttttccagcagaaacagcaacggatatgtaaacagcagcagaataccattaataaagaaataggtatacatccgtgcattcagcttagagaagtcattggcaagtccattctcggtcattagctcgaatgcgaagtaaatagccgcataagtcagtatcaccaataaggccgtgcggaagagctgtgatctctgcgaaagttcccttaaactgaaaatggcaactaatccggcagccaactgcgtcagaatgaactcatgcggaaaacgcagggatatagagcagattaatatcgtaatgacatgtgtcagaaaggcagttcgtgaatcgaggaaaacccgtatgataatgggcagcatcgcgtacggaatcatatatacattaaatatattatgtgataccatgaaagctgttactacactataaaatacaatcagtgtaaacagtaacgacaggctgcctttgcgctcataataatcttttcggaacaggtcgagatagagcataaagcaaagcatcagcataccgacaaacaaaatctgtccgccaagaatcaagcggctctgatcaatggattcacttcgcttgatagactctttgcgtaatgattccagaatattgtacgtttcggggctgatgatttctccacggtctataattttctgtccgctgacgactaatccgttggcccaggaatagttgttcagcatttcctctttggcggtctgtgtccgttgctggtcgaatgtgagattgggcgtgatatattcgtttaaagaacattgtctcagaatctcacggttgaagtgggtcgtatctgcggaaagcaagtactcataagcttttttgaccgtatatatatgatcggtaggcttggagttggcgagtttatcgtcgatgatcatgattgccgaagtactgtccttgtggagttcttgtatgttttctgtcgaaacgatgccctctccgtatatttcttttaatgtccgttcgatgtatcgcagataatctacggaaggaagtatacctttcaggtgagtatggtaattctctttcagcttggcgattgcgtctttctctacttgtttgtcaagcagataatatggttggaaggaagccagcaaactatcctgttcccggttcaccactgcgtcgtctttatagatcggaaagtcaaaagtggctatcagctgcccgtacttccagggcttgtttatgtcaaactgatagttgaattttccgtcacgtggcaggaaatagacaatcagtgtcactgtcgctacaaacagcaatgatttatataatatatctcttcttgagaacctctttttcttcttcatatgttccatacgcattgaaatttttgcgaaaagtacaaaaaaaaacaatagtgtggaaaaaaaggtttaattttgccacgatttacctatactaacccaaattatggcagaaagaaaagtaagagttcgttttgctccgagtcctacgggagcattgcacatcggtggtgtgcgtacagctttgtataattatctatttgcgcgtcaacacggcggagacctcattttccgtattgaagatactgactccaaccggttcgtgccgggagcggaagagtatatacttgagtcattcaagtggttgggtatccactttgacgaaggagtgagcttcggtggagaacacggcccgtaccgtcagtccgaacgtcgcgaaatctataagaaatacgtgcagattttgttggataatgacaaggcatacatcgcttttgatactcccgaggaactggacgctaagcgtgcggaaattgctaacttccaatatgatgcatcgacccgcgggatgatgcgtaattctctgacaatgtcgaaagaagaagtggacgcattgattgctgaaggaaagcaatatgtggttcgctttaagatcgagccgaacgaggatgttcacgtgaatgacttgattcgtggcgaagtcgttattaattcatctattctggatgacaaggtgctttataagtcggctgacgaactgcctacttatcatctcgcaaacattgtggatgaccatttgatggaagtgtctcatgtaatccgtggcgaagaatggttgccttcggcaccgctgcacgtacttttgtaccgtgcattcggctgggaagacacgatgccggaatttgcccacttgcctttgctgttgaagccggaaggaaacggtaaactaagcaagcgtgacggcgaccgtttgggattccctgtattcccgttggaatggcgtccggaatcgggagaagtgtcttccggatatcgtgaatcgggttatttgcccgaagcggtgattaacttcctggctttgttgggatggaatccgggcaacgatcaggaagtgatgtctatggacgagatgataaaactgttcgacattcatcgttgcagcaagtccggagctaaattcgactataaaaaaggtatttggttcaatcatcagtatatccagcttaaaccgaatgaagaaattgccgaactgtttttgcctgtgttgaaagagcatggggtagaggctcctttcgagaaggtcgttacggtagtcggcatgatgaaagaccgtgtaagttttatcaaggaactgtgggatgtatgtagtttcttctttgtggctcctgctgaatatgacgaaaagacagtgaagaaacgctggaaagaagactcggcaaaatgtatgactgagttggcggaagtaattgccggcatcgaggatttcagcattgaaggtcaggagaaagtagtgatggactggattgctgaaaaaggttaccatacaggtaatataatgaatgctttccgtctgacactggtaggcgaaggtaaaggtccgcatatgttcgatatttcctgggtgttgggcaaggaagagacattggctcgtatgaagcgcgccgtagaggtacttaaataattaggatttgtaaattatgctttacaatctggcaatagttatttatgaccttttggttcattttgctgctccgttcagccgtaagccccgaaaaatgatgaaagggcattgggtggtgtatgaacttctacgacagcaagtggagaaaggggagcagtatatttggtttcacgctgcttcgcttggcgagtttgaacaagggcgtccattaatagaaatgatcagggaaaaatatcccgattataagatattgcttacatttttctctccgtccggttacgaagtgcgcaagcattaccggggagcggacattgtctgctatctgccgtttgataaaccgcggaatgtgaagaagttcctggatattgcaaacccgtgcatggcattctttatcaagtacgaattttggaagaattacctggatgagcttcataagcgtcgcatcccggtgtatagtgtttcttccattttccgtcgcgatcagatattctttaaatggtatggtgggacttatcgtaatgtgctgaaggatttcgatcatttgtttgtgcagaatgaggcttccaaacgctatttgtcgaagattggcatttgtcgtgtgacagtggtgggagatacccgtttcgaccgtgtgttgcagattcgggaagaggccaaagaccttccgttggtgaaaatgtttaaaggagacaatgcctttacgtttgtggcaggcagttcttggggaccggatgaagatttattcctggagtacttcaacacccatccggaaatgaagttgatcatcgctccgcatgtgattgatgaaaatcatctggtggagattatcagtaaactgaaacgtccttatgtacgctatactcgtgctgacgaaaagaatgtactgaaagttgattgcttgattatcgattgcttcggactgttatcttctatttaccgctatggagaagtggcttatatcggaggtggttttggcgtcggtattcataatacgctggaagctgctgtatatggcatccctgttatcttcggaccgaaatatcagaagtttatggaagcaatccggttgctcgaagctaaaggcgcatactcaattaaagactatcacgagttgaaaaccttgctggaccgttttcaggcagatgatgttttcatgcgtgagaccggtgcgaatgctggttattatgtgaccagtaatgccggagctacggagaagattatgcacatgattaacttttagagatggataaggttgggcgtcgcctgaaaaacaggtaagccctatcatttcgctctgctgttctgagcttgtcgtctcgtttttcttaaagaagagagattcgtcaatgaactcagaatataacagaataagataagaataaggagatgtgtcagaactccccttttaacgaattcatcttcgccacaactatctgtagcgaagatgatttttaatttataagggtttcgatacacccgcttaccagtacatcttttgaaaatgctggtattctatttatttatttcctgttttaataactcttccagttcttttcgtgtcacatgggtgaatcgtttcactatatttccttgcttgtctatcaccaaatacatgggcaaacctttcatctgaaaatgtttccaaagataaccccattgcttttcgtttaaccaataatgttcaccgacaatgtcttgtatgagtattttccaagtcttttcgatggaactggggccagttaggtagacaaaagctacgttttcgcctaattcttttttaataggttcatattctttaatcgtccttcggcagccaccgcaccaggtagcccaaaagtcaatgaattgtacttttcctttatggcggtcgacgagagcagacagtaattcttcttctgatactttaggtgcttcgcagacagagtatttctttgttgtcacttttgcgcgtggttgcatctgtcggttcatgtcttgaatgattcctaagaaaatcgggtttgtaatttccgttgccatagcttcttgttgagtggtcagtggttttaaattatataggctggagcgcatatagattgcccgtatataatcgaccattaaacaagtgctgtcttgcatgatatggctcagatactccttcgctttggtgaatagtttctgactgaattcattatattctttggggtattttgcaataagcgcgatcagctcgctgccttgttggaaggggatacctgttttgagagctgtctcgtattggcgaataagcgcttgttcctcctttgtaagcgctgcttttgatagtaaatacttctcaaattttaaaggatcatgatgtagctcatagagttctcctgagatcacgttgcggtaattgtaacaatagagcgctaagggatgattgacagggaaactctttaggaaatcatagaaattggcaggaaaatcaaaattggcaaaggctgtactggcttgttcacgcgtgatgttttccttcttctgataagccgtttgcagacaataacgggttgcattcagattctctatgcaatcgaacgcacatgagagattggcaagtgtgcgggtatcttcactaaattgcgtttttgtgttgttgtgtgccacgcactgtttgtattggtcgatgcagcgtttcttaaattcattggcgctgatgcctgcaatagaatccagtatgtcgccatttctataaaccggagctattcttgtaatcaattctggctggcaccattcattattgatggtagcatattgtccgctgaatacaaattgttttccttgcggattgcttagattgaccgctacattagtttctttatcgggacttagcagaatgactatatcggctttccctatcgtcatccgtacttgtgtgttatgatagagaggaatattgattttgaagcttccgtctgcttcgatagtcgggaagagggtttcggctgcccccatcacaatattaggagctccgattttgaggtccggatgatcatcagggctataattagctattgtgccgcttagtatggcttttcctttttgatattcgggactccgtaattgtgcttgtactatgttgaatagcagggacaagaaaaggaaggtaaacagtctgttcataatagttctttgattgcatttataatttctttatctgtattctctgtgctatatcctctgattatttttcgtatgattcgtttctggtccagtatgaaaaagaagggcgcagccccacctgtctggtattgtttgataacttcgttcgtggcatttagaatcgtataattcaaatctttccgtttggcgtagtttcggatggcggatgcattgtggctccaggattctatagcaatgagatcaaactcctcgttgctgaataactcttttaactttttcagaaaaggtacagctgcctggcaggcgccacagccaatgccggtgaaattgattagtatgactttgcttttgcagttggcaagtgataaagactgtccatctatattttctaatatccatcccggagctttttggcctgtgagtccggatgtggatggcgagtctccgcttttcttgtggagatcgctgtatttaactgtttcataatctttggggaaataatcattgatgttaaagtctctgatgttgagcttgttaatctgaaggttggaacaagttgaaacggaaatatcatgtgacatttcccttcgctccttaaaaggtaaattatccgatttattaatccataattcataaatagaagtcgtattgccgatatcgaatgggggaagaggcatgtggaaggcttttccaaagaattcaacctgttgttcctcattgattgttagtttgaaatagtaatcattaccctcgtctttcagttctatggtgatattatcatcagtggtaagcgcatacttgatgatgttctttgcgaaattgaagaatggaggtcttactagcctgaaagggagtggtttgaatgtgaagtcatcaattactaactttttattatcgtgataggcttctactcttacgttaccatcataacaaaagtttagctttgtagtatccttggcatccagtgaaacatagcttgcgccgatggttgaatctatggggtgattatattctttgatgaatccatgtagaatggataatgcggtggagtccccgggttgccagctttcgttagcaacataatatgttgcggattcaattttctctagattggcaaataccttttttaaatagtctctctctctgttttgagcattgactgccggcattgttgcaaaaaggagagtaataagcagtagttttgttttcatgattgatcgtggagtagtatgttttctatagttagatgtttttattctgtttgattacaaatctacgaataattcgtaaattagaggcaggcaattggttaaataaaacaaatgaatacatgaactccttcatggatattagctgatccaatacgctcctttgctaatttttcaaagatcagagatgcattgaatatagtaccctgaaaacacatgaacttactaatgatctggaacctgatatttatattattcatgtgaatcagtagttgaatgttgttcatttctttgcggttttgaactaaatgatagtcaatagtatcttaaatgggctgtctaaaaagtcaatagtatcttaactctcctccttctggaaggaggagtacccgtagggggaggtggtaggtgaatacataatcctatcatttacaaagaaataggaacaaacattatctctcctaccacctcggtcttcgaccactcctccttcccgaaggaggagattcgagatagaatcgactttttagtcacccccaatggagatactactgtttgattcattcctttgcaattttgaatcaactactgattcacattatttataccattgggaatacatcaggtaattgtgagcgattttttggtttagctcctttgcttgctccgggtctaccttcttaataaatttagccggtacccctccccaaatgcttccgggctcgatcactgtattgctcaataccaaagaaccggcggcaacgatggagccttcgcctactacggcatgatccaatatggtagaccccatcccgataagtgcataatctttgacggttgctccgtgaatcgtcacattatgtcctacggaaacatgatcaccaatttcgatggttgacttctcatataaagtatgtagcacgcttccatcctgaatattgactccattgcctatccgtatggaattaacgtcaccgcgcaatacggtacaaaaccagatgctacagtcatttcctatttttacatctcctatgatagttgcattgtctgcgagaaaacagttctctccaatttcgggggtaaagccccgcactgatttgattaaagccataaaatatattgtttctaatgatgtttttattgaatatgattggggattgtctgacacccgggtctcgtaccgtctgacacccgggtctcaagcagcctgacacccgggtgtcggtatgctcaacacccgggtgtcagacaaaagctgttttaaatagcttttgttgcttctagcagccacttcttttcttcttcgtttagacttggagaaagtttttcgtaaacggttcgatggtagtcattgaaccacttgacttcctctgccgtcagcatttctttgatgatgccttttttgcagatcgggcatagggtgatcgtctcaaatttgaaatattctccgaacatgccttccttatctttgcagaccaatgtcagattctcggtgcgtatcccgtggctgcctgctttataaacaccaggttcattggatgtaaccataccgggttgcagcacaatgggattttcgttcatacggatactttgcggaccttcgtgtacgctcagaaaatgtcctacgccatgtccggtaccatgaaggaagttcatgccatgactccagataggcatacgggccaatacatcgagttgggcgccgcgggttccggctggaaatttagccattgccaatgcaatatggccttttaatattaaggtatagtctgttttttcttcctccgtcagttcgcctaatgcaatagtacgtgtgatgtcagttgttccgtccagatactgtgctcccgaatctaacagcaagaaacctttaggctgaagcgtgacatcactctcctccgttgcggaatagtgcacgattgctccatgttctttatatccggcgattgtgtcgaaactttctcccatatacaaaggttgggctgctctgaactcatgcagcttccggtctacgctcagttcggtctctttgcccgaaggcactgattgttccagccatttaaggaacctgacaagcgccacgccatcccgctgcattgcgtgatggatgccgacgatctcctgctcattgcgaatggctttcagcaatgtcacaggagattctccacgaatgatcttgcatgcaggattgatagccgaataaatcgcatagttcgttttctttgggtcgataagtatgttttctcctgcaaaagaattcaggaaagattcagcttcatcatattttctcaggctgacttgctgttcttgcaagtattcatttacctgttgggtaatcttctccggcgaaataaagtagactacttcatcttgagtaaccagtagataacttactataaccggattgcaatgcacatcacttcctctcagattgagagtccatgctatttcgtccagactggataaaaataaagcatagatgcctttctttttcagctcggcacgaatggcggcaactttttctccacaactttttcctgcatatttaacatcgtagatgaaagccggagcatcaggcatggatggacggtccttccagatgtttttcagcggatcgccaaacaggttgacctgtaactggtagggggcaagatcttctttcatttgttccacctgttgtacggagaacattttcccatcaatactcacagattctcccggctttagattctgacagaggaactttgtgatactaggagtttccggcagcatctctttatataatgtaatgccgctgccttccagttccttttccgcttgcaggaaataacgggaatctgtccatagtccggctttatccattaagatgacgactgttccggcggaacccgtgaaaccggaaatccattcacgggacatccaataaggagctacatactcactcaggtgaggatcggtgctgggaatgatgaacgctttgatattgttagggcggaatgccatccgtagtgcgtgtatacgctcttttatgctctgcttcataccttattatattatttatagacatatttaagagtttcaaaggtactaacttttcgcggttaatgatttgtttatgaatagtttttgagaaatatttgccgaaagttttgtgaataaagaaagtatgtgtaattttgcggcgcaatttgactgcggaaatttttaaccaataacatattaataataacaaaatgattgtagtacctgtaaaagaaggcgaaaacattgaaaaagcgctgaagaagtttaaaagaaaatttgagaaaactggcatcgtgaaagaattaagaagcagacagcaatttgataaaccgtctgtaactaaaagacttaagaaagaacgtgcagtttatgtacaacaacttcagcaagtagaagattaataattcgtaatttcctttgaattattgaattcttttcatacattcgttgcacgattttagatgtagcgatattatgttaattaaatcttttcttgattacctccggtatgagcggaactattccgaaaaaaccgttctggcgtatggcgaggatataaagcaactacaggagtttgctcaggaagagtacggaaagtttgatccgttggaagtggaaggtgaactgattcgtgaatggattgtttcattaatggataggggatatacttcaacttctgtaaatcgaaagctaagttcgctccggtcgttctataagtatcttttaaggcaaggagaggtgacagtagatccgttacgaaaaataacaggacctaaaaataagaagccgttacctgcttttctgaaagaaagcgaaatggacaagttgctggatgatacggattttggcgaaggatttaaaggttgtcgtgatcggttgattattggagtgttttatgctacaggcataagactttcggaattgataggtctggatgataaggatgtagatttttccgcttctcttttgaaagtaaccgggaaaagaaacaagcagcggctaataccgttcggtgatgaactgaaagagttgatgcttgaatatattaatgtaagaaacgaaacgattccggaaaggtcggaagctttctttgttaaagaggatggtgagcggctttataagaatctggtctataatttagtgaaacggaacctgtcaaaggtggcgacgctgaaaaaaagaagtcctcacgtgctgaggcatacttttgctaccacaatgctgaataatgatgcagaactgggtgcggtaaaagaacttttgggtcacgagagtgttgcaactaccgagatctatacgcatgccacatttgaagaacttaaaaaagtgtataaacaagctcatccaagagcttaaaaaaaaggaggtaagtatggatattagaattcaatcaattcactttgatgcgtcagagcaattgcaggcatttattcagaagaaagtgtctaagttggaaaaatattacgaagatataaagaaagtagaggtgtcattaaaggtagttaagccggaagctgctgaaaataaagaggcgggcataaagattcttatccctaatggtgagttttatgcaagtaaagtgtgtgatacattcgaggaagcagttgatttggatgtggaggcgcttgaaaaacaactggtgaaatacaaggaaaaacagcgtagcaaataaaaaaatcgcaaatattttgcgggaaagaaataaataactaaatttgcagccgtttcgctcgcgttagaacgtgacggttgcattttttagctagaacgcctctttagctcagttggccagagcacgtgatttgtaatctcggggtcgttggttcgaatccgacaagaggctccaaggatgaatgaggatcatccggttttagcgaaagggatgacggtagtcaattcggttcgcgtggcgggaagaattagaagaagaactgagaataaaacatctatgttcagagtattgttcgctatttgattttaattctttgtttgaaatattaagggcaaataccagagtggccaaatggggcagactgtaaatctgctgtctttcgacttcggtggttcgaatccatctttgcccacaatcagagtgacaactttggcaagaatgcggaagtagctcagttgatagagcattagccttccaagctgagggtcgcgggtttgagccccgtcttccgctcttttttttcttgctgttatagctcagcggtagagcacttccttggtaaggaagaggtcccgggttcaagtcccggtaacagctcataaagatgtaaatgctgattattaatcaaataaataacaagtaaagctatggctaaagagaaatttgaacgtaccaaaccgcacgtaaacattggtacaatcggtcacgtagaccacggtaagacaacgttgacagctgctatcactactgtgttggcaaaaaaaggtctttctgagttgcgttctttcgattctatcgacaacgctcctgaagaaaaagaaagaggtattactatcaatacttcacacgttgagtacgaaacagctaaccgtcactacgcacacgttgactgtccgggacacgccgactacgtaaagaacatggtaactggtgctgctcagatggacggtgctatcatcgtttgtgctgcaactgatggtccgatgcctcagactcgcgaacatatcctgttggctcgtcaggtaaacgtacctcgtctggttgtattcttgaacaagtgcgatatggtagacgacgaagaaatgttggaactcgttgaaatggaaatgagagaacttctttcattctatgatttcgatggtgacaatactcctatcatccagggttctgctcttggcgcattgaacggtgttgaaaaatgggaagacaaagttatggaactgatggatgcagttgataactggattccacttcctccgcgcgatgttgataaaccattcttgatgccggttgaagacgtgttctctatcacaggtcgtggtactgtagcaacaggtcgtatcgaatctggtatcatccacgtaggtgatgaagttgaaatccttggtttaggtgaagataagaaatcagttgtaactggtgttgaaatgttccgtaaactgttggatcagggtgaagctggtgacaacgtaggtttgttgctccgtggtgttgacaagaacgaaatcaaacgtggtatggttctttgtaaaccgggtcagattaaaccgcactctcgcttcaaagctgaggtttatatcctgaagaaagaagaaggtggtcgtcacactccgttccacaacaaataccgtcctcagttctacttgcgtactatggactgtacaggtgaaatcactttgccggaaggaacagaaatggtaatgccgggtgataacgtaactatcactgtagagttgatctacccagtagcattgaacccaggtcttcgtttcgctatccgcgaaggtggacgtacagtaggtgctggtcagattactgaaattatcgactaatacacaataattaatcagttcccggttttactatcgggaactgattatgtacaaacgggagtagctcagttggtagagcaccggtctccaaaaccgggtgtcgggagttcgagcctctcctcccgtgctaatattattgaaatgaaaaaggtaatagcttatattaaagaatcttacgacgaacttgttcataaagtatcgtggcctacgtattccgaacttgctaacagtgcagtagttgttttatatgcttccctgcttattgcattggtagtatggggtatggatgtctgtttccagaacttcatggaaaaaattgtttatccacattaaaaaattaggaattgaaaatggctgagattgaaaagaaatggtacgttctacgtgctattagcggaaaagaagctaaggtaaaggaatatcttgaagctgaccttaaaaacagcgaccttggtgaatatgtatctcaggtattgattccaactgaaaaagtgtatcaggttcgcaatggtaaaaaaattgtgaaagagagaagttatctccctggttacgttttggtggaggctgctttggttggtgaggtcgctcatcatctgcgcaatactccgaatgtgataggctttttaggcggctccgagaaaccggtgcctctcagacaatcagaagtgaatcgtatacttggtacagtagacgaactacaggaaacgggtgaagaactcaatattccgtatgtagtgggtgagactgtgaaagttacttttggtcctttcagcggattcagtggtatcattgaagaagtgaatagtgaaaagaagaaactaaaggtcatggtgaagatattcgggcgcaaaacgccgcttgaattaggctttatgcaagtggaaaaagaataacgcggaattgttacgctgttgttgttcttcgtttaatgtttatatataaatcaataaaaaaatggctaaagaagttgctggactaatcaagttacagattaaaggaggcgctgcaaatccatcacccccagttggacctgctttgggttccaagggtattaatatcatggaattttgcaagcaattcaatgccagaacccaagacaaggcaggtaagattttgcctgttatcattacttactacgcagataagtctttcgattttgtaatcaagactcctcccgttgctattcaattgcttgaagtagctaaggtaaagagtggttctgctgagcctaaccgtaagaaagttgccgagcttacttgggagcagattcgtacgattgctcaggacaaaatggttgacttaaactgttttactgtggatgctgccatgagaatggttgctggtacagctagaagtatgggtatcgctgtaaaaggggagttcccggttaataactaataaacttcaattgtaatgggtaaactgacaaaaaatcaaaagttagctgcagaaaaaattgaagcagggaaagcatactcactgaaagaagctgcatctttagtaaaagaaattactttcactaaatttgatgcctcactggatattgacgtacgtttaggtgtagacccacgtaaagctaaccagatggtgagaggtgttgtttcacttcctcatggtactggtaaagaagtacgtgttttggtactctgtacaccggatgctgaagctgctgcaaaagaagctggtgctgactatgttggtcttgacgaatatattgaaaagatcaaaggtggatggactgatattgatgtaatcatcactatgccatctatcatgggtaaaattggtgcactcggtcgtgtactcggtcctcgtggattgatgcctaacccgaagagtggtactgtaactatggatgttgctaaagctgtaaaagaagtaaaacaaggtaagattgactttaaagttgataagagcggtattgttcatacttctatcggtaaggtatcattcagtcctgatcagattcgcgacaacgcgaaagagttcatctctactctgaacaaactgaaaccgaccgcagcaaagggtacatatattaagagtatttatctttctagtacaatgagtgcgggtatcaaaatcgacccgaaatcagtggatgaaatctaataaaacagagaaataatgagaaaggaagataaaaattcgattatagagcaaattgctgctacagtaaaggaatatggccacttctatttggtagacgttacagcgatgaacgctactgctacaagtgcattgagaagagattgtttcaagtctgacatcaaattgatggtagttaagaatacattgcttcacaaagctcttgaaagcctggaagaagacttttctcctctttacggttctttgaaaggtacaactgctgttatgttttgcaatactgcaaacgtacctgctaaactgatcaaggacaaagctaaagacggaattcccggactgaaagctgcatatgcagaagaaagcttctacgttggtgcagaccaattggatgctctcgttgctatcaagagtaagaacgaagttatcgccgatatcgttgcattgttgcaatctccggccaagaatgttatttctgctcttcaatcaggtggtaacacccttcacggagttctcaaaactcttggtgagagacccgaataattttcaaaaaacaacaaagtatttaaacaattaaaatcatacaaaaaatggcagatttgaaagcttttgcagaacaattagttaacttgacagtaaaagaagttaatgaacttgcaactatccttaaagaagaatacggtattgaacctgctgctgcagctgttgctgttgctgctggtcctgcagctggtgctgctgctgtagaagaaaaaacttctttcgacgtagtattgaagagcgctggtgcagctaaacttcaggttgttaaggccgttaaggaagcttgtggtcttggcttgaaagaagctaaggacatggtagacggtgctcctagtgtagtaaaagaaggtttggctaaagacgaagcagaatcattgaagaaaacattggaagaagctggagctgaagttgaacttaaataacattagcctggtaatcaggtaattcggttaggaatccttcgcaagaggattcttaacctttttgtgtatatatttcaaattaagttctccaaattcattcacagatgtcttcaaatactgtaaatcaaagagttaattttgcttcgactaagaatccgcttgaatatccggatttcctggaagtacaattgaagtcattccaagactttctacaattagataccccacctgaaaagcgcaagaatgagggtttgtataaagtatttgctgaaaacttccctattgccgatacaagaaacaattttgttcttgagtttttggattattatattgatccgccgcgctataccatcgatgattgtatagagcgtgggctcacatatagtgttcctttgaaagcgaaacttaagctgtactgtaccgaccccgatcacgaggattttgatacagttattcaggacgtattcctcggcccgatcccttacatgactgataaggctactttcgtcattaacggtgccgaacgtgtagttgtgtcacagcttcaccgttctccgggtgtgttcttcggtcagagtgtacatgccaatggtacgaaactttactcggctcgtattattccgtttaaaggttcgtggattgagtttgctaccgacatcaataatgtgatgtacgcatacatcgaccgtaagaagaaattgccggtaactactttgttacgcgcgattggtttcgagaacgataaggatattcttgagattttcaaccttgcagaagatgttaaggtaaacaaaacaaatctgaagagagttctgggtcgtaagttagctgcacgtgttttgaaaacatggattgaagatttcgttgatgaagataccggtgaagtggtttctatcgaacgtaacgaggttattatcgaccgtgaaaccgtactggaggaagtacatattgatgaaattctggaatcgggagttcaaaacatccttttgcataaggacgagccgaatcaatctgatttctctattatatataatactctgcagaaggacccgagtaactcggaaaaagaagctgtgttgtatatctatcgtcaattgcgtaacgctgatccggccgatgatgcaagtgcacgtgaagttatcaacaacttgttcttctcagaaaaacgatatgaccttggtgatgtaggtcgttacagaatcaacaagaaactgaatctgacgactgatatggacgtgcgtgtcctcacgaaggaagatatcattgaaatcatcaaatatctgattgagttgattaattcaaaagcagatgtggatgatattgaccacttgagcaaccgtcgtgtacgtacagtaggtgaacagctttctaaccagtttgctgttggtttggctcgtatgtctcgtacgattcgtgaacgtatgaacgttcgtgacaatgaagtatttactccgattgatttgatcaatgcgaagactatttcttctgtgatcaattctttctttggaacaaatgctttgtcacagttcatggaccagacaaacccgttggctgaaattacgcacaagcgccgtatgtctgccctaggtcctggtggtctttctcgtgaacgtgccggatttgaggttcgtgacgttcactatacacactacggtcgtctttgtccgattgagactcctgaaggtccgaatatcggtttgatttcttccttgtgtgtattcgctaaaattaatgagctgggattcattgaaactccgtaccgtaaggtggaaaacggaaaagtggatctttccgataatggtctggtttatctgactgctgaagaagaagaagaaaagattattgcacagggtaatgctccgttgaatgatgacggtacatttgttcgcaataaagttaaatctcgtcaggacgctgacttcccggttgtagaaccgtctgaagtagatttgatggacgtttctcctcagcagattgcatcgattgctgcttcactgattccgttcctggaacatgatgatgctaaccgtgcattgatgggatcaaacatgatgcgccaggcagttcctttgttgagaagtgaagctccgattgtaggtacaggtatcgaacgacagttagtgagagactctcgcacgcagattactgcagaaggcgatggtgttgttgacttcgttgatgctactacgatccgtattttgtatgaccgtacagaggacgaagaatttgtaagcttcgagcctgctttgaaagaatatagaattccgaagttccgtaagacgaaccagaacatgactattgacttgcgtccgatttgtgacaaaggtcagcgcgtgaagaagggtgacatcctgactgaaggttattctaccgaaaagggtgaattagctttgggtaaaaacctgttggttgcttatatgccatggaagggatataactatgaggatgctatcgtattgaacgaacgcgtggttcgcgaggacttgttgacttctgttcacgtagaagaatactctctggaagttcgtgaaacgaagcgtggtatggaagaattgacttctgatattccgaatgtaagtgaggaagctactaaagacctggatgaaaatggtatcgtaagaatcggtgcgcgtatcgaaccgggtgatatcatgatcggtaagattactccgaaaggtgaatctgatccttctccggaagaaaaactacttcgtgctatcttcggtgataaggcaggtgatgtgaaagatgcttctttaaaagcttctccttctttgaaaggtgttgttattgataagaaacttttctcacgtgtaatcaagaaccgtagctctaaactggcggataaagcattgttgcctaagattgacgatgagtttgaatcaaaggttgcagacttgaagcgtattctggttaagaaactgatgactttgactgaaggcaaggtttctcagggtgtgaaagactacttaggagcagaagttattgctaagggatctaagttcagtgcttctgattttgattcacttgactttacttctattcagctgagtaactggactagtgatgaccatactaatggtatggttcgtgatctggttatgaactttatcaagaaatacaaagagctggatgctgaattgaagcgtaagaagtttgctatcactatcggtgatgaacttccggctggtatcattcagatggctaaagtatatattgctaagaaacgtaagattggtgtaggtgataagatggcaggtcgtcacggtaacaagggtatcgtgtcacgtgttgtgcgtcaggaagatatgccgttcttggcagatggtactccggttgacattgtactgaatccgttgggtgtgccttctcgtatgaacattggtcagatttttgaagctgtattaggtcgtgccggaaaaactttgggcgtgaaatttgcaactcctatttttgacggtgctacgatggacgacttggatcagtggacagacaaagcgggattgccacgttactgtaaaacttatctttgtgatggtggtacaggtgagcaatttgaccaggcagcaaccgtaggtgtgacttatatgctgaagctggggcacatggttgaagacaagatgcacgctcgttctatcggtccgtactcattgattactcagcaacctcttggtggtaaagcacagttcggtggtcagcgtttcggagaaatggaggtttgggcactcgaaggcttcggtgctgctcatatcctgcaggaaatcttgactattaagtctgacgacgtagtaggacgttctaaggcttatgaagcaattgtgaaaggtgaaccgatgccgcaacccggtattccggaatccttgaacgtattgttacacgagttgagaggtttaggtttgagtatcaacctagaataaaataatgaaagaatgcaggatgtcaataggccgatgaaggtctgttgacattcgcatcttcttcaatttccaatgattcaattatcaaatctcaattatatagagtatggcttttagaaaagaaaataagacgaaaagcaatttctcgaagatctcaattggtctggcttctccggaagaaatcctagagaattcgagtggtgaagttttgaagcctgaaaccataaattaccgtacgtacaaacccgaacgcgatggtttgttctgcgagcgcatttttggtcctattaaggattacgaatgccattgcggtaaatataagcgtatccgttataaaggtatcgtctgcgaccgttgtggtgtagaagttacagaaaagaaagtacgccgtgaacgtatgggacatatacagttggtggtgccggtggcacacatctggtatttccgttcgcttccaaataagatcggttatttgctcggactgccgacaaagaagctggattcgattatatattacgaacgttatgttgttattcagccgggtgtaaaggctgaagatggcattgccgaatatgatttactttctgaagaagaatatctggatattctggatacacttccgaaggacaatcaatatctggaggataatgatccgaataagttcatcgctaagatgggagctgaagcaatctatgatttgctggctcgtttggatctggatgctctgtcttatgaattgcgtcaccgtgcaggcaatgatgcttcacagcaacgtaagaatgaggcattgaaacgtctgcaggttgtagaatcgttccgtgcatcacgtggacgtaacaagccggaatggatgattgtacgtatcgtaccggttattccgcccgaactccgtccattggttccattggatggtggtcgttttgctacttctgacttgaatgacctttatcgtcgtgttatcattcgtaacaaccgtctgaagagattgatcgaaatcaaagctccggaagtaatcttgcgtaatgagaaacgtatgcttcaggaatctgtagactcattgttcgataattcacgtaaatcaagtgcagtgaagacggatgctaaccgtccgttgaaatcactgtctgatagcttgaaaggtaaacaaggacgtttccgtcagaacttgttgggtaaacgtgttgactactctgcacgttcggtaattgtcgttggtccggaactgaagatgggtgagtgcggtattcctaaattgatggctgccgaactttataagccgtttattatccgtaagctcattgaacgtggtatcgttaagacggtgaaatctgcaaagaagattgtagatcgtaaggaagcggtgatctgggatattctggaacacgtaatgaaaggacatcctgtactgttgaaccgtgctccgacattgcaccgtttgggtatccaggcattccagccgaagatgatcgaaggtaaagctatccagttgcacccgttggcatgtacggcattcaacgccgacttcgacggtgaccagatggctgttcacttgcctttgagtaacgaagcaattcttgaagctcagatgttgatgcttcagtcacataatatcctgaatccggcaaatggtgcgcctattactgtgcctgcacaggatatggttcttggtttgtattacattaccaagttgcgtgctggtgctaagggagaaggacttacattctacggaccggaagaagcattaatcgcttataatgaaggtaaggtagatattcatgctccggtaaaggtgatcgtgaaagacgttgatgaaaatggtaacattgttgacgttatgcgtgaaacttctgtaggacgtgtgattgttaatgaaattgttcctcctgaagcaggttatatcaatacgattatttctaagaaatctcttcgtgatatcattagtgatgtaatcaaggtttgtggtgtggctaaagctgcagacttcttggatggaatcaagaacttaggttaccaaatggcctttaagggtggtttgtcattcaacttgggtgatattattatcccgaaagaaaaagagacattggtacaaaaaggttacgacgaagttgaacaagtcgtaaacaactataatatgggtttcattaccaacaacgaacgttataatcaggtaattgatatctggacacatgtgaactctgagttgtctaacatcttgatgaaaactatttcttcggatgaccaaggatttaactctgtatacatgatgctggattcgggtgcccgtggttctaaagaacagattcgtcagttgtccggtatgcgtggtttgatggctaagccccagaaagctggtgctgaaggtggtcagattattgaaaacccgatcttgtcaaactttaaagagggactttctgtgttggagtactttatctctactcacggtgcccgtaaaggtttggcggataccgctttgaagactgccgatgccggatatttgactcgtcgtctggtagacgtttctcacgacgtgatcatcacggaagaagactgcggtacacttcgtggattggtttgtacagacttgaagaataacgatgaagtaatcgctaccctgtatgaacgcatcttaggtcgtgtttctgtacatgatattattcatcctactacaggcgaattgcttgttgccggtggtgaagaaatcacagaagaagttgctaagaagattcaggattctccgattgaaagcgttgaaatccgttctgtattgacttgtgaagcgaagaagggtgtttgtgctaagtgttacggacgtaacctggcaacaagccgcatggttcagaagggtgaggctgtcggtgtaattgctgctcagtcaatcggtgagccgggtacacagttgacattgcgtacattccacgctggtggtactgctgcgaatattgcggcaaatgcaagtattgtggctaagaacagtgctcgtctggaatttgaagaacttcgtacggtagatatcgtagacgaaatgggtgaagctgcaaaagtagtggtaggccgtttggctgaagttcgttttgtggacgtaaatactggtatcgttctttctacgcacaatgtaccttatggttctacattatatgtatcggatggtgatctggttgaaaagggtaagttaattgctaaatgggacccgttcaatgccgttattataactgaagcaactggtaagattgaattcgaaggtgtaattgagaatgttacctataaagtggaatcggatgaagcaaccggtcttcgtgaaatcatcattattgaatctaaggataaaacgaaagttccttcggctcatatcctgacagaagacggtgatctgattcgtacttataacttaccggtaggtggtcacgtgattattgaaaatggtcagaaagtgaaagccggtgaagtaatcgtgaagattccgcgtgctgtaggtaaggcgggtgacatcacgggtggtcttcctcgtgttactgagttgtttgaagcacgtaatccgtctaatcctgctgtcgtttctgaaattgacggtgaggttacaatgggtaagatcaagcgtggtaaccgtgaaatcatcgtaacttcgaaaacaggtgaagtgaagaagtatcttgttgcattgtccaaacagattctggttcaggagaacgactatgtgcgtgctggtactccattatctgacggtgctactactccggctgatatcctggcaattaaaggtcctacggctgtacaggaatatattgtgaatgaagttcaggatgtataccgtctgcagggtgtgaagatcaatgataagcattttgagattatcgttcgccagatgatgcgtaaggttcagatcgatgagccgggtgatactcgcttcttggaacaacaggtagtggataagcttgagtttatggaggaaaacgatcgtatctggggtaagaaagtggttgttgatgcaggtgattctcagaatatgcagccgggacagattgtgactgcccgtaagttgcgtgatgagaacagtatgctgaagcgccgtgacttgaaacctgttgaggtacgtgatgctgtagctgcaacttctactcagattcttcagggtattacgcgtgctgcactgcagacttcaagctttatgtcagctgcatccttccaggaaacaacgaaggtgttgaatgaggctgctatcaatggcaagacagataaacttgaaggaatgaaggaaaacgtaatttgcggtcacttaattccggcaggtacaggtcagcgtgaatttgaaaagattatcgttggttcaaaagaagagtatgatcgtatcttggcgaacaagaagacagtacttgattacaatgaagtagaataatacaattcaattgactatatgaaaaaggagcgattgctgtagcaggcagttgctcctttttttgtttcttttacctgactgtatcattcttatctcgataaaattttgttattttgcaaaaaaacattttatcttatttaatatggaagaacaaaataacaaccagttacagatcgagttgaaagaagaagtagcgcaaggaacttatgcgaatcttgcaatcattactcattcaagctctgagtttattctagactttgtacgggttatgccaggagtgccgaaagcaggagtgcaatctcgtattatagtagctccagaacacgcaaaacgcttgttgcgggcattggaggataacatagcaaagtatgaacgtgcttttgggcctattcgtatttctgaagagtcaccgatgcctccgctaagtgttgtaaaaggcgaagcatgaggttgatataaaaacattaaaaaagaaaaaaaagttgtagcgcattgaatattcaaatattattcgtatttttgcagcccaaaatgtatagttacgaaattaatataacaataatataaatcaaaaaacaattaaaatgcctacaattcagcaattagtaagaaaaggacgcgaagtgctggtggagaaaagtaaatctccagccttggattcatgtcctcaaagacgtggcgtttgcgtgagagtatatactactactccgaagaagccgaactctgcaatgcgtaaagtagctcgtgtacgtttgactaaccaaaaagaggttaactcatacattccgggagaaggacacaatttgcaggaacactcaatcgttttggtacgtggcggtcgtgtaaaagaccttcctggtgtacgttaccacattgtacgtggtacacttgatactgcaggtgttgctggtcgtactcaaagacgctctaaatacggagctaagcgtccgaaaccaggacaagctgcgccggctaagaaaaaataaggattaaaacctaattagaattaaagtaataacttacgttttagtttgttggaaatgctaaaggttgagtaaattctccggtgggagagttgaagaagtcaagaagtagacaaccaagaacaaaaacattatttttcaaacaaatgagaaaagcaaaaccaaaaaaacgcgtaatccttccggatcccgtttttaatgaccaaaaggtttctaagtttgtaaaccatttgatgtatgatggtaaaaagaatgcgtcttatgaaatcttttatgccgctctggaaacagtgaaagcaaaacttcctaacgaagaaaaatcagctctcgaaatttggaaaaaggctttggataatgtaactccgcaagtagaagtaaaatctcgtcgtgtaggtggtgctaccttccaggttcctactgaaatccgtcctgatcgtaaagaatcggtttcaatgaaaaacttgattctgtttgctcgcaaaagaggtggtaaatctatggcagacaaattggctgctgaaatcatggatgcctttaacgaacaaggtggtgcatacaaacgtaaagaagatatgcatagaatggctgaagctaaccgtgcatttgcccatttcagattctaatactataagaatataaccgatttagattaaaaacttaaagtaaaggaataagaaaatggcaaagacagatttacatttgactcgtaatatcggtatcatggctcacattgatgccggaaaaacaacaacttctgaacgtatcctgttctacactggattgactcacaaaattggtgaggtacacgatggtgctgcaacaatggactggatggaacaggagcaagaacgtggtattactattacatctgctgcaacaacaacaagatggaaatatgctggtgatacttataaaatcaacttgattgacactccgggacacgttgactttactgctgaagtagaacgttcgttacgtattctggatggtgctgtggctgcttactgtgcagtaggtggtgtagagcctcaatcagaaactgtatggcgtcaagctgataagtataatgtgccacgtattgcgtacgtaaacaaaatggaccgttcgggtgctgacttctttgaggttgtacgccagatgaaagctgttttgggtgctaatccttgtccaatcgttgttcctattggcgctgaggaaaccttcaaaggtctagtagacttgattaaaatgaaagctatctattggcatgatgaaacaatgggggctgactatacagttgaagaaataccggcagatctcgttgatgaagcaaatgaatggagagataaaatgcttgaaaaggtagctgagtttgacgatgctttgatggagaaatatttcgacgatccttctactattacagaagaagaagtgttgagagctcttcgcaatgcaacagttcagatggcagttgtaccaatgttgtgtggctcttcatttaagaataagggtgttcagacattgttggactatgtttgtgctttcttgccttctccattggatactgagaatgtgattggtacaaatccgaatacaggtgcagaagaagatcgtaaaccgagtgatgatgagaaaacatcagctttggcatttaagattgctactgacccttatgtaggtcgtttgactttcttccgtgtatattcgggtaagattgaagctggttcttatatctataattctcgctctggtaagaaagaacgtgtttctcgtctgttccagatgcattcaaacaagcagaatccggttgaagtaatcggtgctggtgatattggtgcaggtgtaggttttaaagatattcatactggtgatacgctttgtgatgaaacagctccgatcgtattagagtctatggacttcccagaaccggtaatcggtattgcagttgagcctaaaactcagaaagacatggataaattgtctaacggtttggctaagctcgctgaagaagatccgacatttacagttaagactgatgagcaaacaggacagactgtaatctctggtatgggtgagttgcacttggatatcattattgaccgtttgaaacgtgaatttaaagtagaatgtaaccaaggtaaacctcaggttaattataaggaagctatcactaagacagttgatcttcgtgaagtttataagaaacagtctggtggtcgtggtaagtttgcagatattattgttaagatcggtcctgttgatgaagatttcaaagaaggcggattgcagtttatcgatgaagtgaagggtggtaatattcctaaagaatttattccttcagttcagaaaggtttcacaagcgcaatgaagaacggtgtgttggccggatatccgttggattcaatgaaagtaactttgattgatggttcattccacccggttgactctgaccagttgtctttcgaaatctgtgctattcaggcatataagaatgcatgtgctaaagcaggtccggtattgatggagcctatcatgaaactggaggttgttactccggaagaaaacatgggtgatgtgatcggtgacttgaataagcgtcgtggccaggttgaaggtatggaatctagccgttccggtgctcgtatcgtgaaagcaatggtgccactggctgaaatgtttggttatgtaacagcgttacgtactattacatcaggtcgcgcaacttcatcaatggtatattctcatcacgctcaagtttctaactctattgctaaggcagtattggaagaagttaaaggacgtgctgatttactctagaagaatatcaaaagcagcaggctagcgaatgactcttagcctgccgctttatcttatttataaatatattaatttaaaaccataatgagtcagaaaattagaattaaattgaaatcttacgaccacaacttggttgacaagtcagctgagaagattgtaagaaccgtaaaggctacgggtgctattgttagtggtccaattcctctgcctacgcacaagcgtatctttacagtaaaccgctcgactttcgttaacaagaagtcacgtgaacagtttgaactctcttcttataagagattgattgacatctatagctcaactgctaagacagtagatgctcttatgaagcttgagttgccgagtggtgtggaagtagaaattaaagtttgataattaaaaattagtgaaatgccaggattattaggaaaaaaaatcggaatgacatccgttttcagtgctgatggtaagaatgtaccatgcactgttatcgaagcaggtccttgtgttgttactcaggttaaaactgtcgaaaaagatggctatgcagctgttcagttgggttttcaggacaaaaaggaaaaacatacaactaaaccgttgatgggtcactttaagagagctggagtaacaccgaagagacacttggccgagttcaaagaatttgagacagagttgaatctgggtgatactattactgtagagatgtttaatgacgctaccttcgtagatgttgtcggaacctctaaaggtaaaggcttccagggtgtagttaagagacatggtttcggtggtgtaggtcaagctactcacggtcagcataaccgtgctcgtaagccgggttctatcggtgcttgttcttatccagctaaagtattcaaaggaatgcgcatgggcggacagctcggtggtgacagagttactgttcaaaacttgcaggtattaaaagtaatcgcggatcataaccttcttttgatcaaaggttctatcccgggttgcaaaggttcaatcgtaataattgagaaataatggaagttaacgtatataacattaaaggtgaagacactgggagaaaggttacgttaaacgaatctatcttcggaattgagcccaacgaccacgctatctatttggatgtaaagcaatttatggccaaccagcgtcagggtactcataagtcaaaagaaagaagtgaaatcagtggctctactcgtaagatcggtcgccagaaaggtggtggtggagcacgtcgtggtgatatgaattcaccggtgctcgttggtggtgctcgtgtttttggtccgaagccaagagactacttcttcaagttaaataaaaaagttaagacattggctcgtaagtcagcattgtcttataaagttcagaacaacgcgcttattgttgttgaagacttcgtttttgaagctcctaagacaaaagatttcgttgctatgacaaaaaatcttaaagtttccgataaaaagctacttgtaattttaccggaagcaaataaaaacgtatatttgtcagctcgtaacatagagggtgcaaacgtgcagactgtctcaggattaaatacttacagagtattgaatgctggggttgttgtgcttacagaaaactctctgaaggctattgacaatatcttaatttaaaaaggaggcttaaataatgggaattattattaaaccgttggtaacagagaaaatgactgcaatcactgataagctgaatcgttttggctttgttgtacgtcctgatgctaacaaactggaaattaagaaggaagttgaagctctttataatgttactgtagttgatgtgaatacagtgaagtatgcaggcaaaaataaaagccgttatactaaagcaggtatcatcaatggacgtacgaatgcattcaaaaaagcaatcgtaacattgaaagaaggagatactattgatttttatagtaatatttaataaaaatggcagtacgtaaattaaagcccacaacaccggggcaaagacataaaattattggtactttcgaagaaattactgcatcagtaccagaaaagtctcttgtatatggtaagaaatcatctggtggtcgtaacaacgaaggtaagatgactatgcgctacattggtggcggtcatagaaaggtgattagaattgttgatttcaagagaaacaaagacggtgtaccagcagtggttaagacaattgaatacgatccgaatcgttcggctcgtatcgctttgttatattacgctgatggagaaaaaagatatattattgctcccaatggattgcaagttggtgcgactctgatgtcgggtgaaacagcagcgccagagattggtaatactcttccccttcagaacattccggttggtactgtaattcacaatattgagttacgtccgggacagggtgctgctctggttagatcagctggaaactttgctcagttaacttctcgtgagggtaagtattgtgtgattaaattgccttcaggtgaagtaagacagattcttagcacttgtaaagctactatcggtagtgttggtaactcagatcatggattggaacgctcaggtaaggctggacgctctcgttggcaaggtcgtcgtcctcgtaaccgtggtgttgtaatgaacccggttgatcacccgatgggtggtggtgaaggacgttcttccggaggacatccaagatctcgtaagggattgtacgctaagggacttaagactagagctcctaagaaacaatcgtctaagtacattattgagagaagaaaaaagtaatctgattaattgagtaaactatgagtcgttcattaaaaaaaggtccatatattaacgtaaagcttgaaaagagaatttttgccatgaatgaatctggcaaaaaagtcgtagtaaagacatgggccagagcttcaatgatttcgcctgattttgtaggccatacagttgcagttcacaatggaaataaatttattcctgtatatgttaccgaaaatatggtaggacacaagttgggcgaatttgctccaactcgtacattcagaggacacgctggtaacaagaaaagataacaggaattatttgaaataataaagtaataaatataatgggagcaagaaaaaaaatatcggctgaaaaaagaaaagaagcccttaagaccatgtattttgctaaattgcaaaatgttcctacttctccacgtaagatgcgcttagtcgctgatatgattcgtggtatggaagtgaacagagcacttggtgttttgaaattttcttcaaaagaagctgctgcaagagtggaaaaattgcttcgctctgcaattgctaactgggaacagaaaaacgaacgtaaagcagaaagcggcgagttgttcgtaacgcagatttttgttgatggtggcgctacactcaaaagaatgagaccggcaccgcagggtagaggttatagaattcgcaaacgttcaaatcacgtaacattgttcgttggtgctaaaagtaataacgaagatcaaaattaaggtagatgggacaaaaagttaatccaataagcaaccgtttaggaattatcagaggatgggattctaactggtatggtggaaatgattacggtgattctttgctggaagatagcaaaatccgtaaatatcttaatgcaagacttgcaaaggcaagtgtatcaagaatcgtaattgaacgtacgctgaagctcgttactattactgtttgcactgctcgcccgggtattatcatcggtaaaggtggccaagaagttgataagttaaaagaagagttgaagaaggttaccgacaaagatattcagattaatatctttgaagtgaaaagaccggaactggatgctgtaattgttgctaacaacattgctcgccaggtagaaggtaaaattgcctaccgccgtgccattaaaatggctatcgcaaatacaatgcgtatgggtgctgaaggtatcaaaattcagatttcaggacgtttgaatggagctgaaatggctcgttctgaaatgtataaagaaggaagaactccgttgcacactttcagagctgatatcgactactgtcatgctgaagcattgactaaagtgggtcttttaggtatcaaagtttggatttgtagaggtgaagtgtttggtaagaaagaattagctccgaactttacacaaagcaaagaaagtggtcgtggaaacaatggtggaaacaacggcggaaagaacttcaaaagaaagaaaaataatcgctaaacgaatttgaattttaggaaactatgttacaaccgaaaaagacaaaattcagaagacaacaaaaaggccgtgcaaaaggtaatgcccagagaggtaaccagctggctttcggttcttttggcattaaggctttggaaactaaatggattacaggccgtcagatcgaagctgctcgtattgcagtaacaagatatatgcaacgtcaaggacagatctggatccgtatattcccggataaaccaattactagaaaacctgccgatgtgcgtatgggtaaaggtaaaggtgctcccgagggatttgtggctcctgtaactccaggtagaatcattattgaagctgaaggagtatcttacgaaatcgcgaaagaagcattgcgcttagctgctcaaaagcttcctattacaacgaagtttgtcgtaagacgtgattatgatattcaaaatcaaaatgcgtaaggtttatgaaaattgcagaaattaaagaaatgactactaatgatttagtagaaagagtagaggcagaaacagctaattataaccagatggttatcaatcattctatttctcctttggaaaatcctgctcaaatcaaacaattacgcaggactattgcgcgtatgaaaacagaattacgccaaagagaacttaacaataaatgatcagcttgatggaagcaagaaatttaagaaaagaaagaacaggggttgtattgagcaacaagatggaaaaaactatcacagttgctgccaagtttaaagaaaaacaccctatatatggtaagttcgttagtaaaacgaagaagtaccatgctcatgatgaaaagaatgaatgcaatatcggtgatactgtacgcatcatggaaactcgtcctttgagcaagactaaaagatggagattagtagaaataattgaaagagctaagtaattatgatacaagtagaatccagacttacagtatgtgataacagtggagctaaagaagctttgtgcatccgtgtattgggtggcacaggtcgtcgttacgcttcagtaggagatgttattgtagtttccgtaaagagtgttatcccttcgagtgatgttaaaaaaggtgcagtatcaaaggctttgattgtacgtacgaagaaagaaatccgtcgtcctgatggttcttatatacgttttgatgataatgcttgcgtgttgcttaataatgcaggtgaaattagaggaagtcgtattttcggtcctgtagcaagagaacttcgtgctacaaacatgaaggttgtgtcacttgcgcctgaggtactttaattttgtaaaagatttgagtaatgagtaaattacatattaaaaaaggcgatacagtttacgtaaatgctggcgaagataagggcaaaactggtcgtgtattgaaggttcttgttaaagaaggtcgtgcaattgttgagggtatcaatatggtatctaagagcactaagccgaatgcaaagaatccgcagggtggtattgtgaagcaagaagcttctatccacatttcaaacttgaacccggttgatccaaaaactggtaaagcaacgcgtattgggagaagaaagagttctgaaggaactttagtgcgttattctaaaaaatcaggagaggagatttagtaatgagtaatactgctagcctaaagaaagaatatgcagatcgtattgcacctgcattgaaatcacaattccagtattcttcaacgatgcaggtacccgtacttaagaagattgttatcaatcaaggtttaggtatggctgttgctgataagaagattattgaagtagcaatcaatgaaatgacagctatcacaggtcagaaggccgtagctaccatttctcgtaaagatatcgcaaactttaagttacgtaaaaaaatgccgattggcgttatggtaactttgcgccgtgagagaatgtatgaattcttggaaaaactagttcgtgtagctcttcctcgtattcgtgacttcaaaggtatcgaaagtaagtttgatggtaaaggtaactatacccttggtattcaggaacaaatcattttccctgaaataaatatcgatagtattacaagaattctcggaatgaatattacctttgtaacctctgcggagacagatgaagaaggttatgccttgttgaaggaattcggtttaccttttaaaaacgctaaaaaagattaatagaatatggcaaaggaatcaatgaaggcacgtgaagtaaagcgtgctaaattagtagccagatacgccgagaaaagagccgctttgaaacaaatcgtgagaacaggtgaacctgccgatgcttttgaagctgcacagaaattgcaagagttgcctaagaattcaaatccaattcgtatgcacaaccgttgcaaactgactggtcgtccaaaaggttatatccgtcagttcggaatttcaagaatccagttccgtgagatggcatctaacggtctgatcccgggcgtaaagaaagcaagctggtaattattgtttaaatattgtcagggaagtcctgattaatttaatttatttttatatgactgatccaatagcagattatttgacgaggttgcggaacgcaattggtgctaagcacagagttgtagaagttcccgcttcgaacttgaaaaaagaaatcactaagattctttttgaaaaaggctacattcttaactataagtttgtagaagatggtcctcaaggaactatcaaggttgccttgaagtatgattctgttaacaaagttaacgcaatcaaaaaattagaaagagtatcttctccgggtatgcgtaagtatactggttacaaagatatgccgcgtgttattaatgggctgggtattgctataatatctacttccaaaggtgtaatgactaacaaagaagctgctgaactgaaaatcggtggtgaagtcttgtgttacgtatattaatttaggaggaataagcaatgtcaagaataggaaaattacccattagtatccctgctggagtgacagtcactctgaaggatgatgtggttaccgttaagggacccaaaggcgaacttagccaatatgtgaatcctgctatcaatgttgccattgaagacggacacgtgactttaacagaaaacgaaaaagaaatgattgataacccgaagcaaaagcatgctttccacggtttgtatcgttctttagttcataacatggttgtgggcgtgtctgaaggatataaaaaggaactggaacttgtcggtgtaggttaccgtgcttctaaccaaggtaacatcattgaactggctttaggttatacacacaatattttcattcaattgcctgctgaggtgaaagttgaaactaagtctgaaagaaataagaaccctcttattatattggaatcgtgtgacaaacaattgcttggtcaagtttgctctaaaatacgttctttccgtaaacctgaaccatataagggtaaaggtattaagtttgttggcgaagtaattcgtagaaagtctggtaaatcagccggcgctaagtaaatcatataaaattagattattatgacaacaaaaatagaaagacgagttaagatcaaatatagagtacgcaataagatttcaggtactgctgaacgtccgcgtatgagtgtatttagaagtaacaagcaaatttatgtccagattatcgatgatctttctggtaagacactggctgctgcttcttctttaggtatggctgagaaagtcgcaaagaaagaacaagctgctaaagttggtgaaatgattgctaaaaaggctcaggaagcaggtataactactgttgttttcgaccgtaatggttacttgtatcatgggagagtaaaagaagtagctgatgctgctcgtaacggtggacttaaattttaatcattatggcaggagttaataatagagttaaggttactaacgatatagaactgaaggatagattggttgctattaatcgtgttactaaagttaccaaaggtggtagaacttttagtttctctgcaatcgttgttgtaggtaacgaagaaggtattatcggttggggacttggtaaagcaggtgaagtaacagctgctatcgctaaaggcgtagaatcagctaaaaagaacctggtgaaagtacctgttttaaaaggtactgttcctcatgaacaatcagctaagtttggtggtgctgaagtattcatcaaacctgcatctcacggaaccggtgtagtagctggtggtgctatgcgtgctgtattggaaagtgttggtattactgacgttttggcaaaatctaaaggttcttcaaatccgcacaaccttgttaaagctacaattgaagctttgagtgagatgcgtgatgcaagaatgattgctcagaacagaggtattagtgttgaaaaagtatttagaggataaggaggagatatgtcaactataaagattaaacaagttaaaagtagaattggtgctccagctgatcagaaaagaactcttgatgcactgggacttcgcaaactgaaccgcgtggttgaacacgaaagcacttcttcaattcttggaatggtagataaagtaaaacacttggttgccattgttaagtaattatttgttgaataaaaaaacgaattacaatatgaacttaagtaatttaaaacctgcagaaggatctactaagacaagaaagagaataggacgtggtgccggttctggtttgggtggtacttctacaagaggtcataaaggagctaaatcaagatctggatactctaagaaagttggctttgaaggtggtcagatgcctcttcaacgtcgagtacctaaatttggttttaagaatatcaatcgtgtagaatataaggctatcaacttggatacaattcagacgcttgcagatgctaagaatctgacaaaagttggtattagcgactttattgaagcaggatttatttcttcaaatcaattggttaaagtattgggtaacggagctctgactaacaagctggaagtagaagctaacgcattctctaagagtgctgctgctgctattgaagctgctggtggaactgtagtaaaactctgattcaatgagaaaagctattgaaacattaaagaatatatggaagattgaggatctgagacagcggatcctcatcaccatattgtttgtggcaatttaccgtttcggatcatatgtcgtattaccgggtattaatccggcaatgctggcaaaattgcacgaacaaacaagtgaaggccttttagccttgttaaatatgttctctggaggagcattttctaatgcctctatttttgcattaggaatcatgccttatatctctgcatctatcgttattcagctattgggaatcgctgtgccgtatttccagaagttgcagcgcgaaggtgagagcggcagaagaaaaatgaatcaatatactcgttatctgacgattgctatattgttagttcaggccccttcttatttgctcaatcttaaaatgcaggctggcccttccttaaatgcttcattagattggactctgtttatggttacctctaccattattttggcagcaggtagtatgtttattttgtggcttggtgaaagaataactgataaaggtattggtaacggtatttcatttatcatcctgatcggtattatcgctcgtttccctgatgctttgatacaagaagttgtatccagagtagcaaataagagtggtggtctgattatgtttataattgaagtcgtattcttattgttagtaattggtgctgcaatcttgttggtacaaggtacaagaaagattcctgtacaatatgctaaaagaattgtaggtaataaacaatatggtggtgcaagacagtatattcctttgaaggtgaatgctgctggtgtaatgcctataatctttgctcaggcaatcatgtttattccaattacatttatcggtttttccaataatgtaaataacgcaggtggtttcttgcatgcgtttacagatcatacaagtttctggtataattttgtttttgcggtaatgattatattatttacatatttctatactgcaattacaatcaatccgactcagatggctgaggatatgaagagaaataatggtttcatccctggtatcaaaccgggaaagaaaacagcagagtatattgatgatatcatgtctcgtattactttaccgggttctttcttcttggcattggttgctattatgcctgcttttgctggtatatttggggttcaagctggatttgctcaattcttcggcggtacatctttgttaattcttgtaggtgttgttcttgatacactgcaacaggttgaaagtcatttgttgatgagacattatgatggtctgttgaaatcaggtcgtattaagggacgcgctggtgtagcggcatattaattctttagaatagaaatgatatttcttaagacagaagatgaaatagaattgctccgtcagagtaacctgcttgtcggtagaactctagctgaggttgctaaagtggtgaagcctggtgtaactacacgtgagttggataaagttgctgaagaattcattagagataatggggcaactccaacttttaaaggattcccgaatcaatatggagacccgtttcctgcatccatctgtacttctgtaaatgagcaggtagtacatggaatcccgggggatattgttctgaaagacggcgatatcgtatctgtggattgcggaacttatatgaatggtttttgtggagattctgcttatactttttgtgtaggagaggtagacgaagaaattcgtaccttgttgaaggtaactaaagaagcgttatatatcggtattcagaatgcagtacatggaaaaagaatcggagatatcggatatgctattcagcaatattgtgagtctcattcttatggtgtagtgcgtgagtttgtcggtcacggcatcggtaaggaaatgcacgaagatccccaggtacctaattatggtaaaagaggatatggtcctttgatgaaaagaggtctttgcattgcaattgagccgatgataacgttgggagacagacaagtgattatggaaggtgacggatggactgtgaggaccagagatcgtaaatgtgctgcgcactttgagcatacggtagctgttggagctggtgaggctgatattttgtcttcattcaaattcatagaagaagttttaggagataaagcaatataatatggcaaagcaatctgcaatagaacaagatggagttatagttgaagcattgtctaatgcaatgtttcgtgttgaattagaaaacggacatgagattactgcacatatttcaggtaagatgcgtatgcattacatcaagatcttgccgggagataaagtgagagtcgaaatgtctccttacgacttatcgaaaggaagaattgtgtttagatataaataaaattaagatatgaaagtaagagcatcattaaagaaacgcacgccagaatgtaagatcgttagacgtaatggccgtttgtatgttattaacaagaaaaatcctaagtataaacaacgtcaaggataatttgttatttttgcaaaaaaaataatttagtatatggctataagaatagttggtgtagatttacctcagaataaaagaggtgaaattgcgttgacctatgtatatggaataggtcgcagtagttcagcaaaaattttagataaagctggtgtagataaagatctgaaggttaaagactggacagatgatcaagctgctaagattcgtgagattatcggtgcagagtataaagtagaaggtgatcttcgttctgaaatccaattgaacattaagcgattaatggatattggttgttaccgtggtgtacgtcatcgtattggtctgccggttagaggtcagagcactaagaacaatgcacgtactcgtaagggtagaaagaaaaccgttgctaataagaaaaaagctactaaataataattgttgatatggcaaaaaaaacagttgcagctaagaagagaaatgtgaaagtagacgctaatggacagttacacgttcattcatctttcaacaatattattgtttctcttgcaaacagtgaagggcagattatctcttggtcatctgcaggaaagatgggatttagaggttcaaaaaagaatactccttatgcagctcagatggctgcccaggattgtgcaaaaattgcatttgatcttggcctgagaaaggtaaaagcatatgtgaagggtccaggtaacggacgtgagtctgctattagaactatccacggagctggtattgaggttacagagatcatcgacgtaactccgcttccacacaatggttgtcgtcctccgaaaagacgtagagtttaatttacctttaacttaaaatgatcttgattttgtttttggattgcaataatttcttctctgcaatcgcggctgcaacaaattgagttcatgaataaacaattaaatatttaaaagaaatggctagatatactggaccaaaatcaagaatagcccgtaaattcggtgaaggcatctttggagctgataaagttttgtcaaagaagaactatcctcccggacaacacggaaattcaagaaaaagaaaaacttctgaatatggtgtgcaacttcgtgaaaagcagaaagcgaaatacacttatggagttttagaaaaacaattccgcaatttgtttgaaaaagccgctaccgctaaaggtattaccggtgaggtgcttcttcaattgctggaaggccgtcttgacaacgtagtattccgtttgggtattgctcctacacgtgctgctgctcgtcagttggttagtcacaagcatattactgtagatggtgaagtggtaaacattccttcattcgcagtaaaaccaggacaattgattggtgttcgtgaaagatctaaatctttggaagtaattgctaactctcttgcaggtttcaatcacagcaaatacgcttggttggagtgggatgaaacttctaaggtcggtaaaatgttgcatatacctgaaagagcagacattcctgagaacattaaagaacatttgatcgttgaattgtattctaaataataattaatttcatggcgatattagcatttcaaaaacctgataaagtattaatgttggaggcggactccagattcggtaaattcgaatttcgtccgttggaaccggggtttggtattaccgtaggtaatgcattacgccgtatcctgctctcttcattagagggttttgctatcactactatcagaatagatggtgtggagcatgaattttctagtgtacctggagtaaaagaggatgttaccaacattatcttgaatctgaaacaagtgagattcaagcaagtagttgaagaattcgagagcgaaaaagtgagcatcactgtcgagaattcaagtgaatttaaagcaggtgacataggtaagtatttgactggatttgaagtgttaaatccggaattagttatttgtcatttagattctaaggcaactatgcagattgatattactattaacaaaggtcgtggatatgttcctgctgatgaaaatcgcgaatattgcacggatgttaatgtaattccaatcgactctatttatacaccgatacgtaatgtcaagtatgctgtagaaaacttccgtgtagaacagaagactgactacgaaaagctagtgcttgagattagtaccgacggttctatacacccgaaggaagcgctgaaagaagctgcaaaaattctgatctaccacttcatgttgttctctgatgagaagatcacgcttgaaagtaacgatactgatggcaatgaagagtttgacgaagaagtattgcatatgcgtcagctgttgaagactaagcttgttgatatggacttgtcagttcgtgccctcaactgtttgaaggctgctgatgtagaaactctcggcgacttggtacaattcaacaaaactgacctgttgaagttcagaaacttcggaaagaaatcgcttaccgagcttgatgatttgctggaaagtctgaatctatcgtttggaaccgacatttctaaatataaattagataaagaataaaaaatgagacataataaaaaattcaatcatttaggtcgtactgcttctcacagaagcgctatgttatctaacatggcttgctccttgatcaagcacaaaagaatcactacgactgtggcaaaggcaaaagctttgaagaagtttgttgagcctttgattacaaagtctaaagaagatactacgaattctcgtcgtgttgtatttagcaacctgcaagataagattgcagtaacagaattgttcaaagaaatctcggttaagattgctgaccgtccgggtggttatactcgtatcatcaagactggtaaccgtttaggtgataatgcagaaatgtgtttcattgagttggttgactacaatgaaaacatggctaaagaaaaagttgctaagaaagctactcgtactcgtcgttctaagaagagtgccgaagctgctgctcctgctgcagttgaagctcctgcaactgaagaaccaaaagctgaatcagctgaataattttacagttattcttatacatataaaaaaggctactcatacgggtagccttttttgtatccttatgttttagttatcctaagatacattaaaagatttaccgaatgaacttttcataagaattatctgttatatttgcaggagaatatggcaaaatttgtaaaggtaatattgtttctgttgctggcggttgcccttcatggggtcgcaggcaatgttttcactgaaaagcaggtggaacaaccagagcatgctgttacatattctatgaaaccgcaggggcagattaatgctccagaatctccttatcttcctgtggctgaattaactaatttgcaaagccatcagatatcggtgacacgcatccaacgtgtgcaaatcggtgaatacttctcttctctgagaaatgtgctgcaatgttgtgcagaccgtgataactcgctgtcacagcattggggaaggatttataatactacaacttcctattattgccagcctgcaagtgaatattatgtatttactttaaggcatattattatttagacgtttatttattggtattattttacggattgctggcgttaattatatagtgccggtcagtctttattatcttcatatttttactaataatttaaacttcaatattatggcaactcaagctattgatgctactatatttgcatcttcacatcccgatatcgctaaacgtacgagtatctccggtcttttaatttcttgtgtaatgttactgattggtattttatcttttgcttctacttttgaactggaagataaatcgtctactgtcagtatggctctgatggtctttggaacaggattgttccttttaggtatattccggcttttctggaagtcaaaagaagtggtctatgtaccgacaggaagcatagcgaaagagcgtagtattttctttgatctgaagcatatggacaagttgactgaccttgttaattccggttcattttctgcggattcaaagataaagagtgaggcaagtggtaatatacgtatggacgtgatactatctgctgataataaatttgcagctgtacagctattccagtttgtaccttatacatatcagccggtgactgctgtgcattattttaccaatgatgcagctgcagctgttgctgcgtttctgactaaaagtcaattgaattaaagtgcttaatgccaaatggtattcatgttgatggcgaattgtcattcatcagaagatcatttctaagatagtcaagtgcagggatgcagggataaatggataatggattgataattactgaatatcgcacttctatgtcttaatagcttagatacaagcaggctttaaggaataatttgacatgtggggattaaccgtcgatgacggcaatccccatttttttcattaagaagcacgcattcatgttctgtgcgactccgcttctcatctggtatgaaaatgtcagttcgttgttggtaatgtccgcttcgaaacaataattccggatattttgtggaaaagcatctattagtgtgcctagcagtaggtcatgagtagcgataataccattggcatccatgctcatgaactgtttgattaaggcaaaagaacctttctgtttatccatagagttagttcctttcagaatttcatcaaggatgataaataattcttctccggctttgagtttatcaatgattagtttcagtcgtttgagttcggcgaagaagtaagattcgttgtcggtgagtgaatcacttgtccggaggctggtgacaagacgagcgggaaatatttccattttcgcagcccatacaggagcaccaatgcaagccaagaggtagttgacacctacggtgcgcaggtaagtacttttgcctgccatgttggcgccggtaataatgataaagaacgggcgtttctccatatcgattccattgcggacacatttattgcggttcatgagcggatgccctaaggcttcggcttgcagatggaaagactgagaagttatttgaggatagatgtaatccggatggttgtatgagaatgttgcaagagaacaataagcatcaattgctccgatagcttcgatccagcggggaagatctgcggagtgtgcttctttccatttctcgatttgcatgacttggcggagttcccaaaataggaggccgttcaagatggtgctcattagcagattacctcgctggtcgagtgcattcatgagtttagcaaggcgatgtacggactgggaagctgtttgattttggcttgtaagttcggctttcagttgttgcaatgcagggctgtgcatctcttttttctcggtgatgagaatctggtcggcgtaagtagacagaatttgtagtttttcgccatacgtcgcttgtattttggttattccttttgagaagataaaactgaatacgacaaagcatgcaaatactatcccgctgatgcttgcagggagaaatcccagaatcgttgcgccgatacacaggaggtttataatacctactgctgtcgggaggatacggaggaaagcgtgtttccgatagtcgctcggactgttgacccattctttaatttcagaggtgtcggatggcttgcctttataaagtaatccgagcaggcggaattgttgtcgaaactcaagttctgaagatagttcccgaatcgcttcctgacgttgttcgatagcttctttttcttccagatgtgcattgaaccagttggcaagacgctgtttgccgatgggggtcgaagtacgattgatatactggaatagtgagtgctcgccaaatatgtccaagtcgaaagtatagagatgagacggatcgatgtattcctttccgttgtcgaagtcggaaaagtcatattgcagtgctcgtagttcctgctgattgatttctattttctttttgagataatctttccagtaaaaccatcggttgtggctttgcaccagccaaatgaaagcgatgatgggaattacggtaaagacgatgagctttaaccatccatcagaccaaaaaataatagcggaggctactgcttctacgaataagatcagtctcagaaggctgatatagcgaatgcgtttccgcgctttttgtagttgttgttctgtttcctgaatgatttgttgataggttgctataatattttcttgtttttccatacgattatattgcttttcggacaaaggtaatataattcgtaaaaggcagaatgggagcgtgtttttgtaaagagcagatttactctttattaacggtcattcagtaatcggtgatgaagcaagttgtgatggtttagagtaaagttacataggaaataaacacactttgttattgtcacttgtcacctttgcgtgataagtgtcttataattagtcaagtaatggtgataataaccggtgataataaggtgataatagatgtttttctgctttctattatcacctgtttttaatagacaatacggttaatttgctgattatcagtggtaagcgcactgttttaaagcctttgcctatttatgttaagaactcccttttaggcatgaatgtacgttgtttatgccatatattacttcctgtatgccgcctatattaagacaagactcggcaaccttaacctgtaaacaaggtttgactaatatattttgttcgtttcatattttcgtttcacgtccgtgatctgttcggttcacgtatgtgagctcaatagtttacgtacgtggactgatgggagcatgtacgtgaaacgatttattgttactgacggaatatattaatcatgcctgcataatagcataatgaatcgttcatttgctgttgttcccgggagcttattctttcatagttgatatggggctgactaaaaagtcggtagtatcttaaatcttctccttcccgaagggaggggaattggagatactaccgactttttagtcaaccctgacgactcaggtattaacgcctgatattccggatgaaaaaagacaagataagattataaaaagaaccataaaccgtatttcatgagtaaacaaacttcggggacgattgacttgcttccgggataattgtgtgtaagaggtgctgtgccaagaaggcgaaaggggcttcttggcttcttttttcaacatttctttttccattcttgcatttatgcgctaaaatttataactttccactcgaaaaggcgttgaatgaagaaaggaggatggcttatgaagaaaggatatattttgtggttgctgataagcgtgattagccttccggtagttgcgcagaatatcatttattcaaacttgaaagagttgatggttcaagatggcgatacccttgcagtgttgcgagtagagaagcgttccagaagccagattctattgacaggcggggctgactaccggataacggcaggcaatgatgaatctatgtgccgccagttgaagaagcgttgttttgcggtgcgtacttctgaaggagacttatttatcaactgtcgtaagttgcgttataaaaagatgcgtttcggggtgtggtatgctccggctgttcagttgggcaaaaatatctatttctgtgcgatgccattagggtcggtaatcggtgggacatttgcagaagaagatgatgtgaaactgggcggaaatgtgggagatgctcttgctgcttcaagtctggttactaaacgggtctgctatgagctgaacggtgagaccggaaagattgattttgtaggaagagaaaagatggcgcaactgctggaaaaacatccggaatggaaaaaagcctaccttacaaaagacagtcaggaagcgaagcataccttcaagtatctgcaaatgctgtgtggtgagcagcagaaagaataaataatacctttctgataataaatctaccaaaacctttgtcttttctcttctttttttctatattgcgaagagttatagaactgtattgcttacagtttgtaatccttaattctgcttattatgaagataactcttggcaacacgttacctccctacccagctttcatagaaggtatccggagggcccccgaccgtagttatatgcttacgccggcgcagacagctacggcattgaagaatgcattgcgctatatccccttggaattgcatgagcaactggcacctgaatttatggaagaattgcgtacccgtgggcgaatttacggataccgcttccgccccgcaggcgatctgaaagccagaccgattgatgaatatcgtggcaaatgtgtggaaggcaaagcctttcaagtaatgattgacaacaatctctgttttgatatcgcgttgtatccctatgagcttgttacttatggtgaaaccggacaagtttgtcagaactggatgcaataccttctgatcaagcaatatctcgaagaacttactcctgagcaaacactggtcattgagtccggacatccgttgggactgtttcgttcccgtcccgatgctccccgcgttattattaccaactctatgatgataggccagttcgacaatcagcacgattggcacattgccgcacaaatgggagttgccaactatgggcagatgacggcgggcggctggatgtatatcggtccgcagggtattgttcatggcactttcaacacattactcaacgccgggcgattgaaactcggcattccgcaggacaaagatttgcgtggtcacctcttcgtatcttccggtttgggaggaatgagcggggcacagccaaaggcagccgaaatagccggagcagcctctattatagccgaagtcgatagctcccgtatcgaaacacgttatcggcagggatgggtaggccatgtcacacaggacctgtcggaagctttccgcctggcaaaagaagcgatggaacgtcgggaaccttgctcgatagcctatcatggcaacgtcgttgatttgctggaatatgcggaacgcgagcagattcatattgaacttttgtccgatcagacctcttgtcatgccgtttacgaaggaggctactgtcccgtaggcttgactttcgaagagcgcacccgccttcttcatgaatctcctgatcagttccgtcgtctggcagacgcttctttgcgccgccattttgaggtaatccggaaactggtggcatgcggcacttacttcttcgattatggcaactcctttatgaaagcgatttatgatgccggagtgaaagagatttcccgcaatggagttgatgagaaagacggatttatatggccgagttatgtagaagatatcatgggaccccaactctttgattatggctatggccccttccgatgggtatgtctgagcggtaggcacgaagatctgataaaaacggaccgtgccgcaatggagtgcattgatgtcaatcgccggggacaggatctggataattataactggatacgcgacgccgaaaagaacaggctggtagtaggtactcaggcacgtattctctatcaggatgccgtaggaagaatgaatatcgccctccgtttcaatgaaatggtacggcggggagaagtaggaccgatcatgttgggccgcgatcatcatgatgtgagtggaaccgattcgcctttccgtgagacatcgaatatcaaagacggaagtaatgtcatggctgatatggccgtgcagtgtttcgccggaaactgcgcgcgtggcatgagcttggtagccctgcataatggcggcggagtcggtatcggaaaagcgattaatggcggcttcggcatggtatgtgacggcagcgaacgggtagacgagatacttcgctcggctatgctttgggatgtgatgggcggagtggcccgccgttcgtgggcccgcaatccgcatgcaatggaaactagtgacgctttcaatgaatcacattcggaagggtatcatataacgatgccttatctggctgatgacgagctgattaaaaagacaataaaagaagcattgtaatagaaagtaacgaaatagagaaataaatatgaattggagtaagatcatcgaatgtgtccccaactttagcgagggacgtgatttggagaaaatagacaagatagtagccccttttcgtggcaaatccggcgtgaagctgctcgattatagcaatgatgaagatcataaccgtctggtagtcactttggttggcgaaccggaagccttgcgcgatgcagtcattgaagctatcggcattgctgtccgtctgatagaccttaatcatcatagcggacagcatccccgcatgggagcggtggatgtggttcctttcattccgatcaagaatacgacgatggaagaagccgtcgccctgtcgaaagaagtggcttcccgggtggcggaactatataatctcccagtctttctgtatgaaaagtccgccacagctccgcatcgggaaaatctggcctccgtccgtaagggagaatttgaaggaatggcggagaaaatcagacttcccgaatggcagcccgacttcggtcctgccgagcgtcatcccactgccggaacggtagctatcggtgcccgaatgccgctagtcgcttataacatcaatctgagtaccaataatcttgaaatagccacgaagatagcaaagaatatccggcatatcaacggcggtctccgctacgtcaaagcaatgggggtggaactgaaagaacggaatatcacccaagtatccattaatatgaccgattacacccgcaccgccctttaccgtgctttcgaattggtgcgtattgaggcccgccgctatggagtggcgattgttggaagtgagatcattggtctggtgccgatggaagcgctgatagatacggcctcctattatttaggactggagaatttctccatgcagcaggtgttggaagcgcgtatcatggaatagcacccggagtattaaaataatgtgcgtccgatataaagctgcggaaacttatatcgaattatgattgaactaataagaaccgaataataaaagatcaatgagtgaaaacctgattatattcaatgcccgtattgtcactccgacaggaacctccgcccgtaaaggtgcggaaatgggacaactccgtatcatagaaaacggaacggtagaagtgaccaaaggcatcatcacttacgtcggcgagagtcgtggcgaagatcgtgacggctactaccagcattactggcattacaacgcccggggacattgcctgcttccgggctttgtcgattcgcatacccattttgtttttggcggagaacgttccgaagaattttcatggcggctgaaaggcgaaagctatatgtccatcatggaacgtggcggagggatagccagtaccgtaaaagctacccggcaaatgaatttcctgaaacttcgctcggcagccgaaggctttctgaagaagatgagtgctatgggagtcaccacggtagaaggtaaaagcggttatggactcgatcgggaaacagagctgctgcaactgaaaataatgcgcagcctgaacaatgacgagcacaaacgtatcgacattgtatccactttcttaggagcccacgcccttcccgaagagtataaaggaagaggagacgaatacatcgactttctgattcgtgaaatgctccccgttatccgcgagaacgaacttgccgaatgttgtgatgtcttttgcgaacaaggagttttctctgtcgaacagtcccgccgcctccttcaggcagccaaagaacaaggcttcctgttaaagctccatgccgatgaaatcgtttcctttggtggcgctgagctggctgccgaactgggcgctttgtctgccgatcatctgcttcaggcttccgatgccggaatccgtgcaatggccgacgcaggagtagtagctaccctgctgcctctgacggctttcgcactgaaagaaccttatgcacgcggtcgtgaaatgattgatgccggctgtgccgtggcacttgccacagacttgaatccgggaagctgtttctccggttccatcccgttgaccattgctttggcgtgtatttacatgaaacttagcatcgaagaaaccatcactgcccttacactgaacggagctgctgcccttcatcgggcagaccggatcggaagcatcgaagtaggcaagcaaggtgactttgtcatactgaattcggacaattatcacattctgccatactacgtaggcatgaactgtgtcatcatgactattaaaggcggtatgctataccccgtcaattgataactaaaagcataaaataccatgttagcagatttaaccgtaaaagatttcttagataaggtagccggcaatgatccggtacccggcggtggcagtattgccgctttaggtggagcgctggcttccgctttggccacgatggtgacaggactcaccatcggcaagaaaggatatgaagccagcgaagaagtaatgcagcacgcacagacgcttaccacccgattccaaaaagaattcatcgccttgattgataaagactccgaagcctatgatgaagtttttgcctgttttaaacttcccaaagctaccgatgaagaaaaagctgtccgtagcgctgccattcaggaagccaccaggcatgccgccctcattccgatggaagttgcccgaaaagcacttgaagtgatgcccgtcatagcagacatcgcccgtctgggaaaccggaacgctattacagacgcctgtgtagccatgatggcagcacgatccgccgtattgggggcattgctgaatgtccgcattaatctgggggtacttaaagacaaagaatttgtccaagaattgcaagccgaagcggaccggatagagcaaaccgcttgccggaaagagaaagaattactggatgccgtcaaccaagacttacgcgtatgagcaagaatgtgtatcaaataggttccggagaactgaccttcgaaatcatcgaacggatcatcaacgagaatctgaagctggaactggctcccgaagccaagctccgcattcagaaatgccgtgattatctcgaccataaaatagcttcttccgaagaacctctttatggcatcaccaccggcttcggctcgttatgcactaaaaatatatctcccggcgaattgggaaccttgcaggaaaacctgataaagagccatgcctgcagtgtaggcgaagaaatccgtcctgtcatcatcaaactgatgatgttgctcaaagcccacgccctctcgttgggacatagcggcgtgcaactaatcactgtgcagcgtatcctcgactttttcaataacgacgtactgcccatcgtctatgatcgcggttctttgggagcttccggcgatctcgccccattagccaatctgttccttcctttgatcggtgtgggcgacgtcaactataaaggaaagaaatgcgaagccatcagcgtgctcgacgaatttggctgggaacccgtccggctcatgagcaaggaagggcttgcactgctcaacggtacccagttcatgagtgccaacggtgtatttgccattctcaaagccttccgcctctccaagaaagccgacctgatagccgccctttctctcgaagccttcgacggacgcatcgacccgtttatggattgcatccagcagatacgccctcatcccggacagatcgagacgggagaggctttccgtaaactgctggcaggcagcgaactgatcgaacgtcccaaggcgcacgtacaggatccttactctttccgttgcattccgcaagtgcatggtgctacgaaagacgctatccgctatgtttcctccgtactgctgaccgaaatcaattccgtcacggacaatccaacgatcttccctgacgaagacagaatcatttccggtggaaatttccacggtcagccgttggctatctcctatgactttctagccattgccttggcagaactgggaaacatttccgaacgccgtgtctctcaattgattatgggacttcgcgaacttccggagtttttggtagccaatccgggactgaattccggttttatgattccccaatatgctgctgcgtctatggtcagccagaacaaaatgtactgttatgccgcatcgagcgattccatcgtttcgtccaacgggcaggaagaccacgtaagtatgggggccaatgccgcaaccaaactttataaagtgatggacaaccttgaacatatccttgccatcgaactgatgaatgctgcgcagggcatcgatttccgccgtccgctgaaaacgtctccgctgctggagagtttcctgcatgcctaccggaaagaagtgccttttgtgaaagatgacatcgtgatgtataaagaaatacataaaacagtcgcttttttaaaaaggactaagttagagtactaaacctcctttttcgcttttcgttaataatggtgactgttattgccggataaacgatcgattcttatcggtatttatccggcatttgccgattattctccctcttacagcgataaaactttacttcatatacctctattccttacttttgctctatatttcctcttaacacttgttttcatatacctctaatgaatgataatatttatcaaatgggctataaataaaaggaaacttgatttgttaattgagttttctatatatctttgttccgtttttcgctttaaatggtgaatttatagaaaactgagtctaacaaaatctaaaaagagtgatgatggagcatggaagagacgcgtcccaaaaggcggagctgagagaacggattataatgaccgcgacagaagcttttactttgaaaggtatcaagtgtattacgatggatgacattgcggcagcattgggcatttccaaacgtacgctctatgaggtttttgcagataaggaatcattattgaaagagtgtattctgcaaaagcaagctgaaagagacaaatacttgcaggagatatacgagcaatccaacaatgtgctggaggtgatacttgctgtctttcagaaaagcatcgagatctttcatcagaccaacaagcgcttcttcgaggatataaagaaatatccgaaggtatatgcgatgatgaaagaccgtagtgaaagtgactcggagaagacgatgtctttctttaagtcgggggtagagcaaggtatctttcgggcggatgtcaactttgagatagtcaatctgttggtgcgcgagcagtttgatgtgctgctgaatacggacatttgcaacgaatatccttttatagaagtatatgaatccatcatgtttacctatatacgtggcatttccacggaaaaaggagccaaagttttagaggaatttatatcagaatatcgtaaaaaccgggtcgagcaacaataggagctaggttcggatgacaaacaattaaggatcaaatagaaacgagtttatgaacagattgaaaagattgacaggcaagaaaatgcttctgacggcaatggctctctgtgcgtttggctttgcaaaggctcagacggagcagacaacgcagaatacgctgacattgacgttggacaaagccctggaaatagcgttggatgagaatcctacgataaaggtggcggcagaagaaattgccttaaagaaagttgcaagtaaggaagcatggcagagcctgttacccgaagcaagcctaaacggatcattggatcacacgatcaaagcggctgaaatgaaactgaacgatatgtcgttcaagatggggcaggatggtacgaataccgccaatgccggactgagcattaacctgcctttgtttgcaccggcagtctaccgggccatgtcaatgacaaagacggatatcgaactggcagtggagaagtcgcgtgcttccgaactggatttgatcaatcaggtaaccaaggcttattatcagctgatgcttgcacaagatagttatgaagtgcttcaaggcagctataagttggcagaagataatttcaatgtcgtgaacgccaaatatcaacaaggtgcagtcagcgaatttgacaagatcagcgcagaagtacagatgcgcagcatcaagccgaatgtcatttctgccgccaatgccgtgacgctggcaaaactccagttgaaagtgttgatgggcattacggctgatgtggatattaagactgacgataatctgacaaactacgaatcaatgctgtttgccaatcagttgaaagaagaagatatgagtctggagaacaatacaacgatgaagcagttcgagctgaatatgaaattgctcgaaaagaacgtgaagtcgctgaaaacgaacttcatgcctactttgtcgatgagcttctcttatcaatatcagtctttgtataatccgaacatcaatttctttgattatacgtggagcaacagttcgtctttgatgttcaatctgagcattcctttgtatagggcgagcaactttacgaaggtaaaatcggcccgcatccagatgcgccagcttgactggaaccgtatcgatacggagagaaaactgaatatgcaggtagtcagctaccgtaacaatatgactgccagttccgagcaggtggtcagcaacaaagaaaacgtgatgcaggctgaaaaagcggtacagattgccggaaaacgttatgaagtcggtaagggaaccgtgcttgaacttaacagttcgcaggtatcactgacgcaggcacaacttacttacaatcaatcaatctacgattacctggtagctaaggctgaccttgatcaggttttgggaaaacaataaagatagacaactaaaattacaactaaggaatatgaaaaaaggtatccaattagtggctctgctattgacagtagtaatgagctcatgtacgggtggaaaagataaggctgctgtgaaacaggaagacgagaagcccagagtaaaagtggctgatgtaacagcccgtcccgtagatcagatacaggattatacagcgacggtagaagctgaagtaaagaacaacattgctccttcgtcacctgtccgcatcgaccggattctggtagaagtgggcgaccgtgtatccaaaggccagaagctggtgcagatggatgcagccaacctcacacagacgaaactgcaactggacaatcagaaaattgaatttaatcgtatcgacgaactttataaggtaggcggtgcttccaaatcagagtgggatgctgcgaagatgcagctcgatgtgaagcagactgcttatgataatctggtagagaatacgtttctgttgagcccgatcaacggagtaatcactgcccgtaattacgataatggtgatatgtatagtggcggaagtccggtgctggtagtagagcagatcactccggtcaagctgatgatcaatgtgtctgaaacctacttcacgaaggtgaagaaaggcgaaccggtagatgtgaagctggatgtatatggcgacgaactgttcaagggaactatcagcctgatctatccgactatcgacgcaactacccgtactttccagatcgagatcaagttggacaacaaagatcagcgtgtacgtccgggaatgtttgcccgtgctaccttgaacttcggtacggcggacaacgtcgtagtacccgacttggctattgtgaaacaggcaggttccggcgatcgctatgtgtacgtttataaagatggcaaagtgtcctacaacaaagtggagttaggcagacgtatgggctcggagtatgagctgaaatccggtgtgcccgataactcgcaggtggtagtggccggacaggcacgtctgataaacggtacggaagtagagatcgagaagtaaaatcactattaaactaatcactataaagaaatgagtttatacgaaggtgcggttaagaaaccgattatgacctccctctgctttctggcagtggtgatttttggtcttttctctttgtccaagttacctatcgacttgtatccggacatcgatacaaatacgatcatggtaatgaccgcatatcctggcgcaagtgcttcggatatagaaaataacgttacccggccgctggagaataccttgaatgcggtgagtaacctgaaacatattacctctcgttcttccgagaatatgtcattgattacattggaatttgagtttggtaatgatattgacgtgctgacgaatgatgtacgtgacaaactcgacatggtaagctcacagctgccggatgatgtcgagaatccgatcatcttcaagttcagtacggacatgattccgattgtattgctttcggtacaggccaatgagagccaagccgcgctttacaagatactggacgaccgtgtggttaacccgttggcacgtattcccggtgtgggaacggtgtctatcagtggtgcgccgcagcgtgagattcaggtatattgcgaccctaacaaactggaagcttataacctgagcattgaaactatcagctctattatcggagccgaaaacaagaatattccgggcggtaacttcgatatcggtagtgagacgtatgccctccgtgtggaaggggagtttgatgattcccgccagttggcagatatcgtagtaggtacgcacaatggagcgaatgtcttcctgcgtgatgtggcccgcatcgtggatacggtggaagagcgtgcgcaggaaacctataataacggtgtgcagggtgcgatgattgtggttcagaagcagtcgggcgccaactctgtagaaatttcccgtaaggtagaagaagcgcttccgcgtttgcagaagaacctgccgagtgatgtgaagctgggagtgattgtcgatacttccgataatatcttgaatacgattgacagtttggcagagactgtaatgtatgccttgctgttcgttgtgatcgtcgtgttcctgttcctggggcgctggcgtgcgacattgattatctgtatcacgattccgctttcgttgatcgcttcctttatctatttggcgattaccggaaatacgatcaacattatctcactgtcgtctctgtctattgccatcggtatggtggtggatgatgcgattgtggtacttgaaaacgtgacgacacatattgagcgtggctcggacccgaaacaggcagcagtacatggaacgaatgaggtggctatttccgtaatcgcttctacgctgaccatgatcgctgtgttcttcccgttgaccatggtaagcggtatgtccggtgtgctcttcaaacagctgggctggatgatgtgtgccatcatgtttgtgtctaccgtggcggctctgtcactgaccccgatgctctgttcgcaattacttcgtttgcagaagcgcccgtcgaagatgttcaagctcttctttactccgatagagaaagcgttggacgcactcgatacaggttatgcgaaaatgctgaactgggcagttcgtcatcgtccggttgtgattgtgggatgtattgctttcttcgttgtcagcttgctgtgtgcgaaaggaatcggtacggagttcttccctgcacaggataatgcccgtattgctgttcagcttgaattgccgatcggtacacgaaaagagattgctcaggaactttccgagaagctgactaaccagtggctgacgaagtataaagatatcatgaaggtatgtaactataccgtaggtcaggcggactcggataatacgtgggcttccatgcaggacaacggctcgcacattatttccttcaacatcagtctggtagacccgggagatcgtgatatctcactggaagcagtctgtgacgagatgcgtcaggacttgaaaggttatccggagttcagcaaggcacaggttattctgggaggtagtaatacaggtatgtctgctcaggcaagtgccgactttgagatatacggatacgatatgacgatgactgatagcgtagcagcccgtttgaaacgtgagttgctgactgtgaaaggggtgaccgaggtgaacatcagccgtagtgactaccagcccgagtatcaggttgatttcgaccgtgagaagctggcgatgcacggactgaacctggctacagccggtaactacttgcgtaatcgtatcaatggtgccgttgcttccaaatatcgtgaagacggggatgagtatgatatcaaagtgcgctatgcacccgaatatcgtacaagtctggaaagcatcgagaacatccttatttataatgccaaaggcgagtccgtgcgtgtaaaagatgtcggaaaggtagtcgaacgttttgcgcctcctaccattgagcgtaaagaccgtgaacgtatcgtgaccgtatccgccgttatctccggtgctccgttgggtgacgtagtggcagcaggtaacaagcttattgataagatggatattccgggagaaatcacgattcagatttccggttcgtatgaagaccagcaggattcgttccgcgacttgggaacattgggtatcctgattgtcattcttgtattcatcgtaatggcagcacagttcgagtctctgacttatccgttcattatcatgttctctctgccgtttgcatttagtggagtcttgatggcgttgttctttacgggcagtacgctgagtgtaatgagtttgctgggaggtatcatgctgatcggtattgtggtgaagaacggtattgtgctcatcgactacatcacgctctgtcgagagcggggtatggcggtcatcaactctgtggtgacatctggtaagagccgtctccgtccggtattgatgacaacagctactaccgttctgggtatgatcccgatggctatcggtggcggacaaggttctgagatgtggagtccgatggcgattgccgtaatcggtggtctgacggtatctactgtgttgacactcgtcctgattcctacgctgtactgtgtatttgccggaacaggtatcaagaacagacgtcgtaaactccatcgcaaacgcgaactggatgtctacttccaggaacataaagatgaaattattaagaaataacagaaaagaaatatgaaatcagtattgataacattcgatcaggcgtattacgaacggatcatggcattgctcgaccgtctgaactgccgtggctttacataccttgaaaaggtgcagggacgtggctcaaagacaggcgatccgcacttcggcagccatgcctggcccagtatgtgttcggctatccttacggtggtcgatgacaataaagtcgatccgttgctggatacactgcataagatggacttacagaccgaacagctgggattacgtgcatttgtatggaatattgaacggaccatctagcgttcgaacagtgaataaataatcggaagggagaatctataaataatgtagattctcccttcttttttcttgcttttccctatctttgcagcctgaaaacgtccggcaccgatgaacttgtggtccggcaccgatgaggccttccttcggcaccgatgaggaggtggctcggcaccgggtaaaaaacgaggactcaatgagtgcttatatctacttataagatggagattatcaagaactacctgaaatattcgttacggcttgtactgatcgtgtttgcagcactctttgggttgcactggcttccggctataacgatcgacggacacacgatgaggcgtgtcgatcttttaagcgatcttcgctatccgaagcaggaagtggcggtagccgattcggataccattcctttacctcctgtcgtaaagccggtttttgtcgatacttgtcgtgcgggcatgacttgtattgaagattacggtgactctacccgtcgcggtatggcttctttttatgaagcgctcgaccgtacttcttcttcacatccggatcatgacgggctggtacgtatcgccgttttcggtgattcatttatagaggcggatatctttacggctgatttacgtgaaatgcttcagaagcggtttggcggttgcggtgtcggatttgtcacaataacttcgatgacgagcgggtatcgtcctaccgtgcggcatactttcggcgggtggtccagtcatgcggtgacggacagtgtgtatttcgataaaaagaaacagggtatttccggacattactttattccccgtgaaggagcatacgttgagttgagggggcaaagcaaatatgcttcgctgcttgatacctgtcagcaggcttcgattttcttctataataaagattccgttcatcttactgcccgtgtgaatcggggggagagtaagaattattccttagcgccttcgggcgatttgcagaagatttccgttgaaggacgcatcggctctgtccggtggacggtagatcgtgccgattctacgttgttctatggcttggcgatggatggtaagaaaggaatcattcttgataatttctccttgcgaggcagttccggcttatcgttgcgggggattccgcaacaaatgctgcgtcagtttaacgagcagcgtccttatgatctgattattcttgaatacggattgaatgtggctaccgaacggggacgcaattatgataattatcagaagggactgctcacttctatcgaacatctgaagaattgttttccacaggcgagtcttttgctgttaagcgtcggcgaccgtgattataagacagaagacggtgaacttcgtaccatgccgggagtcaagaatctgattcgctatcagcagaacattgctgccgaaagcggtatcgctttctggaatatgtttgaagcgatgggaggcgaaggcagtatggcgaacctcgtacacgccaaaccttcgatggcgaactacgattatactcatatcaacttccggggaggcaaacatctggcaggactgctctatgaaacattgatatatggtaaggaacaatatgacaggaggcgtgcttatgagcaagaataacctgttgctgggctttatcttgggactgatggcaacattctttcttctttcggcaggaaaggcgcaagaccgtatccctgcctgtcctccactggggaagaccttgaaaatgataaaacctttgcgggaaatgaactgggcgaatgataccatcgccgtgcagacttcttttccttccgctttccgcgaaaccggaagggatgagataatcgacagcattgccctgctgacacccgtatttgaacgtctccgtcaggtacgtgccggactttccgaagatacggtgcgtattctccatatcggagacagtcacgtacgcgggcacatctatccgcagactacgggaacgctgctgaaagaaacctttggtgctgtctcttataccgatatgggggtgaacggggctacctgtctgacgtttacccatccgggacgtattgccgatattgcagccatgaagccggaactgctgattctgtccttcggaaccaacgaaagccataaccggcggtataacgtcaacctgcattataatcagatggacgaacttgtcaaactgttgcgcgacagccttcccgatgtccctattcttctcaccacgcctccgggttcttacgaaagtttccggcaaaggcggcggaaacgtacgtacgccatcaatccccggacggttacagcggcagaaacaattcgccgttatgccaaagatcatcgtctgctcgtgtgggatatgtacgatgtagtagggggcaagcgccgtgcctgtaccaactggacggaagcgaaactgatgcgtcccgatcatgtgcattatttacctgagggatatatcctgcaaggaaatttattataccaagccattattcaagcttataatgattatgtttcccattgatattgatttcagccggttaaaagaggtgcttacctacgatccgcaggcaccgatgatattcagcagtggtatcttcctttggctgtttgccgcctttatgatcgtatacaccttgttgcagcgtaagtatacggcccgtattctgtttgtgacgcttttctcttattacttttattataagagcagcggcacttactttttcctgctggcgctggtcacggtttgcgacttcctgctggcgcaatggatggaccgtaccgaaggacgctggaaacgcaaagggttggtgactctgagtttgggagtcaatctgggacttcttgcttacttcaaatataccaattttttgggaggagtgattgcctcgttgatgggaggagaatttacggcgcttgatatattcctgcccgtaggtatctcattcttcactttccagtcattaagctataccattgacgtttaccggaaagacatcaagccattgaccaacatactggattacgcgttttatgtatccttctttccgcagctggtggccggaccgattgtgcgtgcccgtgactttattccgcaaatccggaaaccgcttttcgtttctcaggagatgttcgggcgggggattttccttattctctccggtttgttcaagaaagcaatcatttccgattatatcagtgtcaacttcgtggagcgtatctttgataatccgaccctttattccggtctcgagaatctgatgggagtatacgggtatgctttgcagatttactgtgacttctccggatatagcgatatggctatcggtatcgctctgctgttgggctttcattttaatctcaactttaattctccttataagtccgcctccattactgaattttggcggcgttggcatatctcattgtccagttggttgcgcgattacttgtacatatccttgggaggaaaccggaaaggtaagttccgccagtatctgaatctgattattaccatgtttctgggtggattgtggcacggagcttcctggaactttgtactttggggaacatttcacggcatcgctttggcggtgcataagatgtggatgtccatcataggtcgtaagaaaggagaacaaagtcatggctggcgtcgtgtattcggagtcattatcactttccactttgtctgtttctgctggatattcttccgtaatgccgattttcagaactcgatggatatgttgagacagatattcaccactttccgtccgcagcttttcccgcagttgatcgaaggctactggcgcgtgtttgctttgatgctgctcggctttctgcttcatttcactccggatagttgggaaaatgctgcttgccgtggagttattcgcttgccgttcttagggaaagctctgctgatggtggctctgatttatctggtcattcagatgaagagttcggagattcagccgtttatttatttccagttttagctttctttccacactgttttgaattaaatgatagtcaatagtatcttgaatggggctgactaaaaagtcaatagtatcttaaatctcctccttcgggaaggaggagtacccatagggggaggtggtaggtgaatacattactctatcattttcaataaaaaaggaacaaacattatttctcctaccacctcggtcttcgaccactcctccttcccgaaggaggagaatggagatactaccgacttttgggtcatccccaatggagatactactgtttgattcatttttaaacagttgtgaacaaatctctatgtaatctgtattttagtctatggacgtgtgtggtattttgcgctagctttgccacgaacagataaatagacatactatgagacatagaatcctctttttctttttggcttttattggaataagccagttcgtgacatcgtccgatgtccgtaataaatataatttcaattcagactggttgctttatgtgggtgatgttcccgaggcaaagcagccgcgtttttctgattcggagtggaagaaagtgactttaccgcatgccttcaatgaagatgaggctttccgcctgagcattgatgaactgaccgatacgattatgtggtatcggaaacatttccgtctgcctgccaacagcaagaataagaaagtttttgtagagtttgaaggagtccgtcaaggggcggatttctatataaatggtcagaatgtcggcctgcacgagaatggtgtcatggctgtcggttttgatctgactccttatattaagtacggacaggaaaatgtaatcgcagtccgcatcgacaatgactggaattataaagaacgggcgacgggcacgaaataccagtggagcaataagaactttaatgccaattatggcggtatccccaaaaatgtatggctgcacgtcaccgaccgtctgtatcagactttacctttatatagtaatctcaaaacgaccggagtctacatctatgccgaagacatccgtgtgaaatcgcgcaaggccattattcatgcggaatctgaaatcagaaacgaatataaccgtgataagcaggtttcctatcaagtagaactgatagaccgtgatggtacatcgatccaaacattcgaaggaacaaaggcggtagtgaaaccgggtgaaacaatcacgctgaaagcggcatccgaagtggataacctgcatttctggagctggggatatggctatctgtatacagtaaagacaagcctgtgggtagatggcaggaaagtggacgaagttgccacccgcaccggattccgtaaaacgcgcttcggtaaaggaatgatctggctgaatgaccgtgtcattcagatgaagggctttgcccagcggacaagcaatgaatggccgggagtcgggatgagcgtacctgcctggctgagcgattatagcaatcatctgatggtggagggcaatgcgaacctcgtgcgctggatgcatgtcaccccgtggaaacaggatatcgagtcgtgcgaccgtgtaggattgattcaggctatgcaggcgggagatgccgaaaaagattgtgaaggacgtcagtgggaacagcgtacggaattgatgcgcgacgccatcatctataaccgtaataatccgagtatcttattttatgaatgcggcaatgagtccatcagtcgtgaacacatgattgagatgaaagcgatacgtgatttgtacgatcctcacggcggccgtgcaatcggttcccgtgaaatgctggatatccgcgaagcggaatatggaggcgaaatgctgtatatcaataagagtgcgcatcatccgatgtgggcaatggagtattgccgtgacgagggattgcgcaaatactgggatgattattcctatccttatcacaaggatggagacggcagcaattcttataagtccaccgttaccaacaaagtacagaagaaagtggatgcccgtgtctacaaccgtaatcaggattcctttaccatcgaaaatattattcgctggttcgattactggcgagaacgtccgggaacgggtgaccgtgtaagttcgggtggcgtgaagattatcttctccgataccaatacgcactatcgcggagtagaaaattatcgtcgtagcggagtaaccgacgccatgcgtattcctaaagatcccttctttgcacatcaggtgatgtgggacggctgggtagatacggaatgtccccgcatctatatcgtcggtcattggaattataatgacacggtagtgaaaccggtatatgtcgtatcgagtgccgataaagtagaattatttctgaatggtaagtctttgggctatggtgaacaggattatcattttctgtataccttcaaagatatcgctttcgtaccgggcagactggaggccgtaggatacgacgaaaacggaaaagaatgttgccgtactcagttgcagactgccggcaagccggaacagattcaattgagtttcatccagagtcccgaaggatggaaagcggatggtgccgatatggtattgcttcaggtagaagtcatggataaagacggcaaccgttgcccgctggcaaatgacttgatacactttgaagtagaaggacctgccgaatggcgtggcggcatcgcacaaggagaaaataattatatcctttcaaaagacttgccggtagaatgcggtatcaatcgtgctttgatccgttcgctcactactgccggaaacgtccgtatcacagcgaaggccgacggattgaagccggcagaaatcagccttacttcctcacctgtcgaagtgaaaaacggtttgagcaactatatccccggtgatgaactggaaggcaggctgactcgtggcgagactccgcagactccttcatacaaggtctcaaaagtggatgttggtatcgtttccgccattgccggagccaataatgagagtacagtcaacagtttcgatgataatgaactgagcgaatggcggaatgacgggaaagcagctaccgcatggattacctataagttggaacgtgccgcacgggtggatgaagtctgcatgaaactgactggatggcgtatgcgcagttatccgctggagatatatgcaggcaaagaactgatatggagcggagatacggataagagtctgggatacgtccacttggatgtaaaaccggtactgaccaatgaaattaccatccggctgaaaggtacaagcaaagaaggagatgcctttggacaaatagtggaagttgccgcccccgttgccaatgaactggatttgtttaaagcgaaggatggggacaagaccggccatgaattgcgtattgtagaaatagagttcaaggagaacttgttgaaatagttttttagggtttgtatgattggttttccaaggaccgtccatcgtactgtcagtatagtgacatcatctgtcttttttgatcagaatgtgtcttctttactggcagactgaaggacgttgttccttgatttcaacctttgaatttagcaataagatggaacattattaaaatattttctctttctttgcaataacgaaaaaacattgaaccttatggattacccattgaataatcagccggctactgatcgctacgatcgcatgcaatataaatactgtggcaagagtggcttgcaactgcctctcatctctttaggattgtggcataacttcggtagtgtagataactttagtgtagcgaccgacatgattaaatatgccttcgaccatggcatcacccatttcgatcttgctaataactatggccctgtgccgggaagtgccgaaactaatttcggacggattctcaaagaaaacttccagggataccgggatgagatgataatctcctccaaagccggacatgatatgtgggcaggaccttatggcggtaacagttcccgcaaaaacctgatggcaagcatcgatcagagtctgcgccggacagggctggagtattttgatatcttctatagtcatcgctatgacggagtcactccggtagaagaaaccattcaaacgttgattgatattgtaaagcaaggaaaagctctgtatatcggaatctcaaaatatcctcctctgcaagcgcggattgcttatgaaatgatggcaaaagcaggcgttccttgtcttatcagccagtatcgttatagtatgttcgaccgtgcagttgaggctgaaagccttcctttggctgccgaatacggttccggctttatcgccttttcccctttggcgcaaggattactgacggataaatatctgaatggcatccccgaaggctcacgcgcggcacgtccttccacttttctgcaacgttcgcaagtgacgcctgaaaaggtggaggctgcccgacaattgaatgaaatcgcccgtcaccgtggacagacgctggcagaaatggctttggcatgggtgctgagagacgaacggatgacatcggtcatagtaggagcgagctcagtgaatcagctggcagacaatttgcaggctttaaaccagttggaatttactgctgaagaattaaacgggatagaacgaattttgtgtaaagtctgatggctctattgggataattggactgtcatttgctgagagtgattaaaagattattaatcataattggcgcaccaaacttatttttttatacatttgcaacggactcttccgcagaaagcctccgggtggtgggggagccgtgtatatagagaagacgtttacaagcgtttgtctttcgtgtttcagaacttcgcaaactttgaccaccggaatgacgaatagcaactaagacgtcctcctgatgtgtatttatatacatccgtgcctctttttgagaaaacaaagggaggttacgggtgttgtacatatcggcgtgggctttctgcgttgttcgttctcggtggtgggcattgcgaaggccttgaacatggaacggacgaaggtaagattcccacgcttttttatatattcctttcatcttacatttatccgtttacccggtgggagtcagggggacactcataggaagattgggcatgattcatgcgggacagcttatcgaacgtacgcttcacgaacagggacgcacagttacctggttcgccggacagttatgctgtacacgtcccaatatatacaagatattcaagaaggaaaatatcgacatccatcttctttggcgcatttcgtgcatactcgatcatgatttcttccgcgatttatccgataacatccgtatcggtacttcttcatgtgtatccaaataagatacatttctgtatcctatccggaactatgatttctcctgctggtatactcctttcgcatacctttgcggcatattaacataaaatcacaaaagaatatgaaaaagctgattctaattatgatgctggttttcggttgtgtcattgggacgtatgcgcaaaagactgtctttaagtttcgtgatgcgcaggcacgtgccggagatgcagtaaccgaagtttgtgtaaagcctacagttgtagaggtgaaaattcttgaagagaaaggacgaataaaggatgtatggacactgagcagagaagaggtggaagttgccatgaagggtgagcttgataacatccgtgcatggggaacttatttgtccactatcaagaacgattgtgatgtaatcatgggagccacttttaagatagaggatgatgaaaagtcgggaggatatacggttacggtcgtaggttatccgggcgtgttcaccaactggcatactgccacgacagaagattacgaatggatacgtatccagaaactttcgggtgccgatgatagaaccaaaatagcacctgtcataaagaacaagaattaataaccaaaaaacatagacaataatgaaaaaagtattatcaattgttgctgcgcttttgttgtgcgtaggaacacaggcacagattgtatcatccagaagtgcaatcgtcaagactcaaaagcaagcgagtaacacacaatggttcctgcgtgcaggcctgaacatcatgaacctcaacggtgacggagttgaagcggattcaaatattggctacaatgctacattcggctatcaaaagcctatgggcggtgccggagcatattggggaatggaattcggcctcggttcccgtgggtttaaagccgatgaaatgaaatgtatcgcacacaatattcaatattcaccgttcactttcggatggaaaattggagtagcggacaatcttagcatcgatccgcatctgggtgtttttgccagttatgactataccagcaaaatgaaagaaagtggtgaaagcatcagctggggagattttgcagattatctggaagtggattacaatcatttcgatgccggtatgaatattggcgtaggactgtggtatgaccgtttcaatctggatttcacttatcagcgtggattcattgacgtattttccgatctcgatggaatcaagactagtaactttatgatccgtctggggattgctttctaattgagacacatattttaatcatataaatttcagcatttgcgctcttttcttttgatggaaaagacgtgaatgctgttttcttaaacatagcggcgtatgataacaagactgagactttgggtaattgtatttttattgggtggagtactgccctctttgattgcacaaacttttactgaacaaaagaatacttatccgctcagtgcggacggcagcaaatatgtagtcaacggattcattcctttcagtccgatgaacgatgaaagtatttatgctaatgctctgttgtggactattaaaaacgtttgctctgcacagcgtgacggaataacagaagtaagcattcctgccaagagttttagttgtaacctggtgcttacttcccaggcggatgccaaacaaaagaatacgtactattgtacggcccaatttcaggtaaaagatgggaagctggtctattatctttccaatattcagatagaatcatcggtggttataatgaagaaagtcactccgatggaaaaactacaacctgagaagaagccttctcaccaggaaaccatggatgactttgtgcaaatagaatcgcagatgctgaacaaactgtttgattttgtcagcacaaaccagctttctcctatcacccattggaatgaaataaatatcggcaaaccggtaaaggggatgacagaagatgaatgcctgctggcttttggcaaaccacaaacaatctcagaatcaaatggtgaagtgcaatggatgtattccagctctttctatctttttttcaaaaacgggtgcgtggaaacgattataaaataaagaaaagaagtaatcccgaaattgcttctcgtgtcttatcatctttctattgatcggctattgtgtatgtctttggtaagaggaagtcagtgtgtgtgataaaatgatctgaaaagtagtgaagatttactggaaattctatcgcccttatgatgaacttgaacttggggagttgtgatttgttattgatgtttattgttttagtgatagttcctgtttttaagcttaaaactttgataataagcctgtttttttatttttatttggtggtaatatatctgtgattgtgtatgaatatgtatagtatttaagcttgctattactagttgaaaggataataaaagtgttgggtgtttgagactttttttcgatatcttgttattatatatttgtgcacattgactctttgtttatcttaaagcggaacttatatttgagataaacaaaggttctatttgaaatgaacagacattttgctttatgctttctccacagtaattcaacgcgacttttgctctcatgccctaacagattgtctgtatgcctttattcatcttagtttcaggtatggcagcaagtgtggtagcagttatgagagcaagtgtttgctctcactcttccatgtatcattatctgtcatttgtttgatgttgtcatttgatttacagtgtattaatgtctgaggtgtcaattattaatgattgatatttcagacattaataattgataaatcatcctttaatagttgataactccgctgtttttgagtgataaatgatttattgtttcttggaagagcaggttaatcgaacagttggtgcggtcaagttaattgaatcatataagtaagggatcagtttcctgccttgtttcattcattccatcggctggaaccactgttttcaagcgtccggaactttggtttcacggctttgaaactaaagtttcaagccgatgaaactttagttccaagcaggagaaacaaaagtttcaagcgggagaaactaaaaagctctgtacttccctaataatggttgacttgtttatctctaatagctgctatgtgttgactagaaatattactaaccctggcagctgtttactttattatttattattcctgcctccggtttacttatttt

SEQ ID NO: 37 - DNA, 90149 bp, Bacteroides thetaiotaomicron
acatattattatacagtatttgtagacgaatatttttacgaaaataatccgctagaaacttcctctaataataattgggggaacgaaaattgggaagaatttgttaataaagacgaccgctatgcactactaatctttagtccacaaaaaagtccggatggagaaagtagctatgcaagtgcgaaatatatgatcacacaaaaatctatccaaacctattacagcacagaaaaatttaatagtgacaaaactgcgctaggtatggaacatatagatgaaacaggtgtacctaatggatgggaaagcggaagttacggcagttctcaagaaaatggatataagaatacctatcctgtagttaacaacaccaatataagtagctacggaacagaaactctatcaaatggtaagaatacatttacaataaatgatgcagcaaatgctattcaagcatgcatggcacgtaacagagatgaaaacaatgatggaaaaatcagcggctcagaagtaaaatggttcttgcctgccatcaaccagttagttggaatgttcttaggtgcagaaagcttaccaactccactatttggtgatggtgataagcaacctggaacatatacatataataaaaaagaaataggaacttatggtacttaccactatattagtagtgataagcaaagactgtggtcagaagaaggagccacttttggtcccgctgcaggtatactttatgcaaaagcccccgaaaagcttagatgtgtacgtactttaggaatcagttcccaatataatagtacaagtaaaaaggaaggaaagatatataatatgaataatagttatacattccagatggcttatctagataagcaaagtatacgtacctcatttatagagaatggtgaattagatttacatcacaattttagttcttacaatagaccttatactgcattccaagttgccaataaacgaatgacaattgatgggatagagaccagcaacggatggggaggatcgaataatagaccaagacccacaaactgggaatcacttgtaaaaaacagtggactatctcgtagtgtatgtacaaattactttgagaatgctaataagtctgataaaggttcatggagagcacctaatcaaagagaacttatgattatctatcttcaagatccgagtttggtagaataccaagtcacagatgcttatgattatcgatatggttcttttacaagaacatgttggaaattcaacgaaaatgatcattttactgtagataaggacttaataacaaaaggcactgttggttcatttgttcgttgtgttcgtgacgttaaataaataaaacttaaaagtaaatattatgacaccaaaagacatcctgcaactagaatcatcagatatgcgccaagcctatctgtttgaagagaacgggcgctggtatgcttatgagcattcagccaaccgaatcgaaaaatttgtgaaaggctttgtagacttcaaacacaaagtgcaagatgtctgcggtcggataaaagtagaaatcgacctcagtattttggaaaagtgttccatcacgctgtgtgaagattcgctgcttgtacttgattgccctgcagcataaaaaactgtagaagagtataagcttcataactcgtagtaagaaattacacaatatattgtttgttttgtttgtgttcctcaatccactcagaggcagcttgtgaaagtagcgctgagtgggtggggattttttgtgcaaaaagaaaatgaaaggagaacaaatgatgatgacaaataaaaaaataaagattaatggatgtactcctatagaagacttgatcaccgaagattttggtgctataggaacccccgaaagagatgaattcgagcgaggatgcgaagcctttatcatatgggacgaaaaataagtttcacgatttggtgattttgacaggaaaacatggaaacataagttataattcgcgaaatgtcttcagattgcattgcccataagaaaggcttccaacccgtagaagcctttttaacttgtcaaagtgatagcttcatgtcaatgaagcaaaaatgatagctatatttacaaagcttgttttgtttgtgaacaacaattcaccggaagcataagttatgattcgcaggagttcacatgatttgcatatctgattatttattgcgttctttgtattacataaaatgtataacgtaaaagatgaacgacttcgaggaatacataagacagagcgaaccgcataagcgggagaaaggatacgcttggcaaacagccattggcctgcaagctgttgatggtcttaaaccttcggaatatttgaaggaaaaagcccgccaacacattgaaggggatatcactattgacgaggtcaaacaattagttgatagttattacaaatcaaaggttgcccgttcatctagcgaagatcgtacggaagaagccgataaggtctcagccagaataacagagatcctttcggagaatacattcacattctcacctatcgaatacttggctattcatcggcatttatttgaaggcatattcagccatgccggacaaatacgggattacaatattacaaagaatgaatgggtactgaaaggagcaacagtactttatgccagtgcaggaagtatccgcgaaaccttggaatatgatttctctcaagaaaagatttttgattataaaaatctgaatatagatgaggccatcagacatattgcccgattcgtttctggaatatggcaaatacacgcctttggtgaaggaaatacacgcacaacagccgtattcacgatcaaatatctgcatacttttggattcaatttcagtaacgagaccttcgccaaccattcttggtacttccgcaatgctctcgtcagagctaactataatgacctaaccaaaggtgtgtatgccacgaccgaatttttagaaaaattcttcagaaacctgattctcaacgaacaaaatgaacttaaaaatcgaaatctacagatcgacgaaatcgaaaaggaagccattcaaagtgcaaaacagactgatatggatatcccaaagtgcaaaaattgcactttagactgcactttggaagagatagccgtacttaactacctcaaagaaaaaccaaatgcaacacaaaaagaaatagcacagcacataggaaaatctgagagaaccgtcaaatccatgaccgtaaacttaagtgaaagaggtattatagaacgcaaaaacggacgtcgtaatggcttttgggagatcaagaaatgaatatcttatgtgagtgattctttgcatatctgattatttattgtgttctttgtattacataaaatgtataacgtaaaacatgtaatagccatgaagcctaataatcctttcctcgtatacggttacaatagtccggattggtcccaaaattatacaagagtaattgtatattgataacacaggtaattgaacagaggcaatctgaaaatgaaaacttttcgaaacatatctactttttatcacattatctttgtttatctcttataaacctgtatatttggagtattataactgatacatttatattaatacagaattactatgagtcataccatcttcctaatcatcgccctcgtcactacaggaatttttcttattcaattcgtattatccattttcttcggagacatagatgcagatgtggacgtggatgctgatatcagcagcgtagtatctttcaaaggtctcacccacttcgggatcggattcggatggtatatgtacctcgtaggaaatgccgatatagcaagttatgcaatcggaattctggtaggtctgttctttgtctttgccgtatggttcctttataagaaagcctatcaactgcagcaagtgaaccggtctgaagagaccgatcaattggtaggacgggaatgtaccatttacttcaagcaaagtgataacaaatataccgtacagacaaaccgggacggcgccatgcgcgaagtggacgtgatctccgaaaccggaaaagcatatcagaccggagacagaacaatcatcagcagctacaaagacggaactttatacattaaataactattcaaatacacaattttatgacacaagaaatgctaatcatggctgctatactagtggcggtcattctgcttacttttatcggtatcctgtcgcgttaccgtaaatgtaagagtgacgaagtcctcgttgtatacggtaaaacagggggagaaaagaaatcagccaagttatatcacggtggggccgctttcgtatggccgatcattcagggctacgaattcctttctatgaaaccattgcagatagactgtaaactgacaggcgccctatctgcccaaaatatccgtgtggacgtacccactaccatcaccgtagctatcagcacagacccggaagtgatgcagaatgctgccgaacgtatgctgggactgacaatggatgacaaacagaacctgattacggatgtagtatacggtcagatgcgtctggtgattgcagacatgactatcgaagagctgaactccgaccgtgataaattcttgtctaaagtaaaagacaacatcgacacggaacttcgcaagttcggtttgtatctgatgaacatcaacatcagtgatatccgcgacgctgccaactacatcgtcaacctgggtaaggaagctgaaagcaaggctctgaacgaagcacaagccaacatcgaagaacaggaaaagctgggtgctatcaaaattgccaatcagataaaggaacgtgaaacaaaggttgcggaaacccgcaaagatcaggatatcgccatcgccgaaactaaaaagcaacaggaaatctctgtagcaaatgcggataaggagagaatctctcaggtagcctttgccaacgcagaaaaagaatcgcaagtggccaaagcggaagcggaaaagaatatccgcatcgagcaggcaaacaccgaaaaggaaagccgtgtcgccgaactgaactccgacatggaaatcaaacaggcagaagctgctaagaaagcggctatcggacgtaatgacgcacagaaggaagtggccttatcaaatgccgaattagccgtcacacaggcaaatgccgacaagcaagccggtgaagccgctgcaaaatcggaagctgccgtacaaactgcccgggaaatcgcccaaaaagaagtggaagaagcaaaagcgaagaaagtagaatcttcactgaaagctgaaaagatcgttccggcagagatcgcaagacaggaggctatccttcaggcaaatgccatcgccgaaaagattacccgtgaagcggaagcacgtgcaaaagcgactttggcacaagcggaagcggaagccaaagctatccaactgaaactggaagcggaagcagaaggtaagaagaggtcattgctcgcagaagcagaaggtttcgaggctatggtcagagcagcagaatcgaaccctgccatcgccatccaatacaagatggtagaccaatggaaggaaattgccggagaacaagtgaaggctttcgaacacatgaacctaggcaatatcaccgtattcgacggaggaaacggaggtacaagcaatttcctcagttcactggtgaaaacagtagccccaagtctcggtgtactggataaactgcctatcggcgaaacggtaaagggtatcatcaacccggaaagcaaaacggaagagaaacctgccggaaagccggaggagaaaaaagaagagaagaagaaataaccaataaattatttcatagagattgcctgccttcattttgaaggtaggcatttttttatatctttgcgagcaaaatattaaaaatgaataaccataaacttcaccttctgcctttatttatattgattacggggcttgtcactctcactgccggctgcaaaaagaaagatatgtctctcaaactgaacgaaccccgcaacatccgtggtgtagtcagttacaaacgttctttcccggatttgaatgataaacatctcgccgtggcccaagccgtcggcatctgcccgccggaggacagggacgccgccgaaaagatgaaagaacagcttatccatatcaccgacaaccaattttacacagtagactctctgacgcattccatcccctatctggtcccccgcgccagtgaattgctcgacaccatcggctccaattttcttgattcactgacagcaaaagggttgaacccaaatcagattatcgtcacttccgtactacgttcgcagagtgacgtgaagcgtctccgccgtcggaatggaaatgcttccgcaaactccgcccattgctatggcgcaacctttgacgtcagctggaaacgattcaaaaaggtggaagacgaagacggacgacctctgcaggatgtcaatgccgataccttgaagctcgttctgtctgaagtgttgagagacttgcgccaagccgataaatgctacataaaatatgaattaaaacagggatgtttccacatcactgcacgatgagtataaattgcaataaaattcacccgtaaacagccgaagaatccaaaacgtttcactaaatttgcagaaatttttctttaatacgattcaatgatagagaaactgattgttcttgaggatattgacccggttattttttacggcgtaaacaacgccaatatacagttaattaaagctttatatccgaagctacgcatcgttgcccgcggcaatgtcatcaaagtgctgggcgatgaggaggaaatgtgtgccttcgaagaaaatatcaccaaactcgaaaaatactgtgccgaatataattcgctgaaagaggaagtcatcatcgacattataaaagggaatgctccgcaagcggaacagaccggaaacgtaattgttttcagcgttaccggcaagcccattatcccacgaagcgagaaccagctgaaactggtggaaggctttgccaaaaacgatatggtattcgccatcggccccgccggttcgggaaaaacatatactgccatagccctcgccgtccgtgcgctgaaaaacaaagagatcaaaaagattatcctcagccgccccgctgtagaagccggagaaaaactcggtttcctgcccggcgatatgaaagataagatcgatccgtatctgcaaccattatatgatgctctgcaggacatgatccccgctgccaagttaaaggaatacatggaattgaacattattcagattgctccgttagcatttatgcgtggacgtacactgaatgacgcagtcgtaatcttggacgaagcgcagaataccactgtacaacaaatcaaaatgttcctcacccgtatgggtatgaataccaaaatgatcgttacgggagatatgactcaaattgacctccccgcctcacaaacttcgggactggtgcaagcactccgcatcctgaaaggggtaaagggaatcagctttgtagaattgaacaaaaaagatattgtacgccataaactagtggaacgcatcgtagatgcttacgaaaaattcgacaaggaggcgaaagccgaaagggagaaacgaaagaatgaacaactggttatcaacggcgaacgaccggtgaaacaggtcaacaactagtcgtttctgtgatttgtaacttgtaatttgtaattataataaaacaatgaaagcattaacaaaaacagatttcaactttccgggacaaaaaagcgtgtaccacggaaaagtgcgcgatgtgtacaacatcaacggcgaaaaactcgtcatggtagcaaccgaccgtatctcggctttcgatgtggttttacctgaaggtatcccttacaaaggccaaatgctgaatcagattgcagccaaattcctcgatgccactactgacatctgtccgaactggaaaatggctacgccggacccgatggttactgtcggagttttgtgcgaaggctttccggtagaaatgattgtacgcggctatctgtgcggtagcgcatggcgtacttacaaaagcggcgtacgcgaaatctgcggtgtgaaactgccggatggtatgcgcgaaaacgagaaattcccggaaccgatcgtcaccccgacaacgaaagcggaaatgggactgcacgacgaagatatctctaaggaagaaatcctgaaacaaggactcgctactcccgaagaatatgagactctggagaaatatacactggctctcttcaaacgtggaactgaaatcgctgctgaacgcggtctgatcctcgttgatacaaaatacgaattcggcaagcacaacggtactatctatctgatggacgaaattcatacaccggattcaagccgttacttctactctgacggctatcaggaacgcttcgaaaaaggcgaacctcaaaagcagctttctaaggaattcgttcgtgaatggctgatggaaaatggtttccaaggcaaggatggtcagaaagttcctgaaatgactccggctatcgtacagagcatcagcgatcgttacatcgaattgttcgagaatatcaccggtgagaaatttgtgaaagaagataccagcaacatcgctgaacgtatcgaaaagaacgttatgaatttcttgagcaaataagcatggattacccacaacaacatatcaagccttacaacgaagacggtaagaaaaccgagcaggtggaacgtatgttcgataacattgcgcatgcttacgacaaactgaatcataccttatctttaggtatagaccgcagctggcgccgtaaagctattgcctggctccgtcccttccgcccacagcacatcatggatgttgccaccggaacaggagacttcgccatcctcgcttgccgcgaactgaatcctgacgaactgatcggaacggatatttcggaaggcatgatgaacgtgggtcgtgaaaaagtaaagaaggaaggactctcggacaaaatttcttttgcccgggaggactgcacttctctctcctttgccgacaatagatttgacgctatcaccgtagcattcggtatccgcaattttgaagacctggacaaaggcctctccgaaatgtgtcgtgtactgaaaccgggcggacatctggttatcctggaactgactactccggatcgcttccccatgaagcaactgttcgccatctactcgaaagtagttatcccattgcttggcaaactcctctccaaagacaacagtgcctaccattatctgccggacactatcaaagtatttccccaaggggaagtcatgaaaggagtcatatcgaaaaccggattcggcgaagttcatttccgacggttgacatttggtatctgcacactttatacagcgacaaaataatgaagaatgatgaataattaatttaatcctttcgtgtcatggaaaaatacggtttaatcggctaccccttgcgacattcgttttcaatcggctactttaacgaaaagtttaggtccgaaggcatcaatgcggaatatgtgaatttcgagattcccaatatcaatgattttatggaagttattgaagagaatcccaacttgtgcgggctcaatgtcaccatcccctacaaagagcaagtgattccttttctgaacgaactcgatcgggatacagctaaaattggcgctgtaaacgtcattaagattatccgccaaccgaaaggaaaagtaaaactggtcggctacaattccgacatcatcggttttacacaatctattcagccgctgctacaacctcagcacaaaaaagcactgatcctcggcaccggaggtgcttccaaagctgtttatcacggactcaagaatctgggtatcgaaagcgtgtttgtatcgcggacacacaagaccgacgatatgctgacttacgaagaactgactccggaaatcatggaggaatacaccgtaatcgtcaactgtactccggtaggaatgtaccccaaagtagatttctgccccaacattccttacgaactgctcactccaaaccatttgctttacgatttgttatataatccgaacgtcactcttttcatgaaaaagggagaagcacaaggtgctgttacgaaaaacggtttggaaatgctacttttacaggcatttgccgcttgggaaatatggcaccgataagataaaggtgctgacagccgttttctgatagagttaagaatatgggcgtgatattttaattgaggggatttattatgaagaaaagagcagtctacagcattattattatcatgctggtacttaccagttgcacaatcggcgggagtttttatatgttgaacttctccttgacgccgaatgccaaaatattgtctaaagacgccgattcatatccctatatgtacagaaactatcctttcctgcgtccgtgggtggatagcctgaaacaagtgaatgctctgaaggatacattcattatcaatccgcaaggcatacagttacacgctttttacatcaccgcacctgctccaaccagtaaaacggcggtaatcgttcatggatacaccgacaatgctatccgtatgttcatgatcggctatctgtataatcgtgatctgggatataatatcctgcttcccgacttgcaacatcagggagagagcgaaggacgagccatccaaatgggatggaaagacaggatcgatgttttgcaatggatgaacattgcaaatgaaatctttggagacagtactcaaatggtagtacatggtatctcaatgggaggtgccaccacaatgatggtatccggcgaaaagcagcaaccttatgtgaaatgttttgtagaggattgcggctacaccagtgtatgggatgaattttcgcacgaactcaaatcttccttccacctgcctgctttcccgttaatgtacactacaagctggttatgcgagaaaaaatacggatggaacttcaaagaagcttcctcgctaaagcaggtagagaaatgtgagctgcccatgctgtttattcatggagacaaagatacatatgtccccacatggatggtttatccgctctatgaagcaaagccggaacccaaagaactctggatcgtaccgggagcagcccatgccctctcgtacaaagagaataaacaggaatacaccgacaaagtacgggatttcgtcgggcggtatattcattaaacctattataacaaggagttttggaatcataacagaaaaagtttctatatttgcaaatgtaaaatgattgttatgaaatcaatattgacgcttatacttgctacttttctactgattccactgcaagcccaagaaaaggtatatacggtagacaacttgccaaaagtacatctgcaaaataaaatgcagtatgtatgcaatccggcagggatactttcgcaagctgcttgtgacacaatagacactatgctccacgctctggaacaacagacggggattgaaacggtagttgccatagttccttcgattggtgatatggagtgttttgatttttgccatcagctgctcaatcaatggggagtaggcaagaaaggaaaagataacggactcgttatcctgttagtcaccgaccaacgctgcatccagttttacaccggatacggtttggaaggggtacttcccgatgcaatatgcaaacgtatccagactaagtacatgattccatatctgaaagacggcaactggaatgaaggaatggtagccggaatccgggcgacttgccagcgacttgacggatcaatggaaaatgaatcgctttctgaatcgaataatgaatcgatggatttcattttcgctgttatcctgttcgctgtaatcggtgtagggatagcgttctttgccgcaagaaatcagagccgttgccccaaatgcgggaaacatgccctgcaaagaaccggaagcagacttgtatcacgtgtcaatggggtaaagacggaagatgtcacctatacttgcaagaactgcggaaatacaatcatacgtcgtcagcaaagctacgatagcgactatcacaacagagggggtggcggaggcggtccgttcatcggcggattcggaggcagtggcggaggctttagcggaggcagcttcggtggaggaatgggaggcggcggtggagccggttcacgattctgatccctacagataatattaaataatcaaatactcatcaaaaagtaagaaacatgaaaaagtcaattatcatcattttagccgttgtggctatccttgtcatatgggtagtcagtgtatataacggtcttgtcaccatggatgagaatgttagcggacaatgggccaatgtagaaacccaataccaacgtcgcgcagacctgatacccaatcttgtaaacaccgtaaagggatatgcttctcatgaaaaagagacattggaaggagtggtagaagcacgtagcaaagccacacagatcaaagtggatgccgaaggtctgactccggaaaagctggcagaatatcaaaaagcacagggtgctgtaacgtctgcacttggcaaattattggctatcacagagaattatcctgacttgaaagccaatcagaatttccttgaattacaggcacagctggaaggtaccgaaaaccgtatcaatgtagcccgtaaaaacttcaatgatgcggcacaatcgtacaacaccaatatccgccgtttcccgaaaaacatatttgcagggatgttcggattcgacaagaaagcatactttgaagcggaagaaggaagcgaaaaagctccgaaagtagagttctaaaggatgatttcttaaagaacttccaagctaaaatcggaatcgccgttacctgatttattcagataacggcgattccagctcttaaccaccacgaaaggacttccataaaagagcgttaaaaaggaacttttgctcctgtctctttaacggtttaactagtctctttccactatcaatcagcataatgattaaaataatacgaaccattaattaacacttttatgttttattcttcttccggacgaagcttgataaacaaatagttggctgtacgaaaaaaaagcagtacttttgcagccgtatacaaaaaataattctttaactcatgagtaatcaacgatacatgatgcggggcgtaagcgcatcaaaagaagatgtgcacaacgccatcaagaacatcgacaaaggaattttcccaaaagcattctgcaaaattattcccgatatactgggtggggacccggaatattgcaacatcatgcacgccgacggcgccggaaccaaatcttcccttgcttatatgtactggaaagaaacaggcgatttgtctgtgtggaaaggtattgcacaggacgcattgattatgaatatcgacgaccttctttgtgtaggcgctgtagacaatatcctcgtttcttcaactatcggacgcaataaactgttgattcccggcgaagtaatctccgctatcatcaacggaacagacgaattgctggctgaactccgtgaaatgggtgtaggtgtatatgctaccggtggcgagactgctgatgtcggcgacttggttcgtactattatcgtagactctaccgtaacctgccgcatgaaacgctcggacgttattaacaatgccaatatccgtccgggagatgtcattgtaggccttgcttcttacggacaggctacctatgaaaaagaatataacggaggtatgggcagcaacggtctgacaagtgcccgccacgacgttttcggcaaatacctcgcagagaaatatccggaaagctatgatgccgccgtacctgaagaactggtttactccggaggattaaaactgacagatactgtagaggattctccaattgacgcaggtaaactggtactctctcctacccgcacctatgctccggtagtgaaaaagctacttgacaccttacgtccggaaatccacggtatggttcattgctccggtggtgcgcaaaccaaagtgctgcatttcgtagaaaatgtccgtgtagtaaaagacaatcttttccctgttcctcctctgttcaagactattcaggaacaaagcggtacagactgggcggaaatgtacaaggtattcaatatgggacaccgtcttgaagtttacctgtcaccggaacatgcagaagaagtgatcgctatttccgaatcattcggcattcctgcacagatagtaggacgtatcgaagcgtgtgaccagactgaattaatcattaaaagcgagttcggagaattcagatactaaagaatggcagataacagtaccatattagaaaaactagacggacttgtagcccgttttgaagaaatatctaccctcatcaccgacccggcagtaattgccgaccagaaacgttatgtcaaactgaccaaagaatacaaggatctggatgacttgatgaaagcccgcaaagaatatatccaactgttaggcaacatcgaggaagccaaaaacatcctttcgaatgagtcggacgctgacatgcgtgaaatggcaaaagaggagatggacaacagtcaggaacgtcttccggcattagaagaagaaatcaaactaatgctcgttcctgccgatccgcaagacagcaagaacgccatcctcgaaatccgtggtggtgcaggaggagacgaagccgcaatctttgccggcgaccttttccgtatgtatgccaagttctgtgaaaccaaaggctggaaaatggaagtatccaatgcaaatgaaggaacagccggaggatacaaagaaattgtttgcagcgtcacaggagataatgtctacggaatattgaaatatgaatcgggtgtacaccgcgtacaacgtgttcctgccacagagacacaaggacgtgtgcatacttccgccgcttcggtggccgtactccccgaagccgaagaatttgacgtagtcatcaatgaaggagaaatcaaatgggataccttccgaagtggcggtgcaggcggacagaacgttaataaggtagaatccggtgtacgcttgcgttatatctggaagaacccgaatacaggcgttgcagaagaaatcctgattgaatgtacagaaacccgtgaccaaccgaagaacaaggaacgcgccctggcacgactccgtacctttatctacgacaaggaacatcagaagtacatagacgacatagcttccaaacgtaagacaatggtatctaccggcgaccgctcggctaaaatccggacatacaactaccctcaaggacgtatcaccgatcatcgtatcaactataccatctataatcttgccgcttttatggacggagatattcaagattgtatcgatcacctgatcgtggcagaaaatgcggaacgcctgaaagaaagtgaactctaaaaattatagtatagacatgaataaacaacagctatttgaaaacataaaacgcaagaaatcattcctttgcgtagggcttgataccgacatcaagaagattcccgaacacctgttgaaagaagaagatccgatcttcgcattcaacaaagcgattatcgacgcaacagccgatctgtgtatcgcttacaaacctaatctcgctttttacgaaagtatgggcgtgaagggctggatcgcatttgagaaaacagtaaaatacatcaaggaaaactatcccgaccagtttattattgccgacgccaaacgtggcgacatcggaaacacttctgccatgtatgcccgtactttcttcgaagagctggagatagattccgtcactgtagctccttatatgggtgaagacagcgtaactccgttccttacttacgaaggcaaatgggtgatcttactggcactgacttctaataaaggttcccacgacttccagttgacagaagatgcaaacggcgaacgtcttttcgaaaaagtactacgcaaatcgcaggaatgggcaaatgacgaacgtatgatgtacgtagtcggcgctactcaaggacgtgcttttgaagatattcgtaagattgttcccaaccacttcctgctcgttcccggtgtcggagcgcaaggcggttcgctcgaagaagtttgcaaatatggaatgaacagtacctgtggcctgattgttaactcttcccgtggaatcatctacgttgataaaacagaaaagtttgccgaagctgcaaggcttgccgcccaagaagtacaggtgcaaatggcagagcaactgaaagcgattctttaaagagaaggaatgccttacgaaagaaagataatcaacgatccggtattcggattcattaatatcccaaaggggttactgtacgatattgtacggcatccccttttgcagcgtcttacccgcatcaagcaagtaggactctcgtcagtagtataccccggcgcacaacatactcgtttccagcactcactaggtgcgttctatctgatgagcgaagctatcacccaactgacctccaaaggtaactttatatttgacagcgaagctgaagccgtacaagcggctatcttactgcatgacatcggacatggtcctttttcgcatgtgcttgaagatacgattgtacaaggagtttctcacgaagaaatctcccttatgctgatggaacgaatgaataaagaaatgaacgggcaacttagtcttgccatacagatctttaaggacgaatatccgaaacggtttctgcatcagctcgtcagtggtcaattggatatggaccgcctcgattatcttcgtcgtgacagtttctataccggtgttacagaagggaatatcggttctgcccgcatcatcaagatgcttgatgtggccgacgaccgtctcgtaattgaatccaaaggtatctactctatcgaaaatttcctgacagcacgtcgcctcatgtattggcaggtatatttgcacaagacatcggtagcctatgaacgaatgcttatcagcacgttgcttcgtgccaaagaactagcatcacagggagtagaactgtttgcttcgccggccttacatttctttctatataatgacattaatcatacggagttccataacaatcccgattgtctggaaaatttcatccaattggatgacaatgatatctggactgccttgaaagtatggagcaaccatccggataaagttctttccacacttagtctgggcatgattaaccgaaatatctttaaagtggaaaattctgccgaacctattggtgaggacagaataaaagagttaactttgcaaatcagccagcaactaggcataaccctttccgaagcgaactattttgtctctacccccagcatcgaaaagaatatgtacgacccggcagatgacagtattgatattatctacaaagacggcactatcaaaaatattgccgaagcatcggacatgctaaacatctcattattgtccaaaaaggtaaagaaatactatctctgctaccagcgattgcatagataagtataaaatattcattcaataacacggaaatctgaaaaaaaaatccgttatttgtgaactaatttaatttaaaataaagacatggagttctcggctaagcaaattgcagcatttatccaaggggaaatcattggagatgaaaacgcaacggtacacacattcgctaaaatagaagagggaatgcccggagctatttctttcctgtcgaaccctaaatatacgccttatatctacgagacacaatcaagcattgtattagttaataaagattttgtccctgaacatgagattcgggctactctgatcaaagtagacaatgcttatgaaagcctggcgaagctgcttaacctctatgaaatgagtaaaccaaagaagcaaggtatcgattcactggcttatattgcccccagcgccaaaattggcgagaacgtatacatcggtgcctttgcctatatcggcgaaaacgccgttatcggagataatactcaaatttacccgcatactttcgttggagacggtgtgaagataggcaatggttgtcttctttactcaaatgtaaatgtttatcatgactgccgtatcggtaatgaatgtatccttcactcaggtgcagtgatcggagccgatggattcggtttcgctcccaccccgaacggatacgataagattccacaaatcggaattgtgatcctggaagacaaagtagatataggtgccaatacctgtgtagaccgtgctacaatgggagctaccatcatacatagtggcgctaaaattgataatcttgtgcagattgcgcacaacgatgaaattggctcacacacagttatggcggctcaagttggcatagcaggctctgccaaaatcggagaatggtgtatgtttggcggtcaggtaggtattgccggacatatcacaatcggcgaccgggtaaatctgggagcacaatcaggtataccaagcagcatcaaagcagacagcgtactgatcgggactcctcctatggaaccgaaagcttacttcaaggctgccgttgtgactaagaatttgccggatatgcaaaaagaaatacgcaatctgcgtaaagaagtagaagaattaaaacaactattaaataagtaaataagtaaccaatgctgaaacaaaaaacgctgaaagatagcttttcactgagcgggaaaggtcttcacactggacttgatctcactgtaacttttaatcctgccccggacaatcatggatataaaatccagcgtattgacctggaaggacaaccaactatcgatgcagtagccgacaatgtgacggaaacaacccgtggcacagtattgtcaaagaatggagtcaaagtaagtaccgtagagcatggtatggcagccctttatgcattgggcattgataactgccttatccaggttaatggtccggaatttccgattttggacggtagtgcacaatattatgtacaagaaatagaacgtgtaggaacagaagaacaaagtgctgtcaaggatttttatatcatcaaatctaaaattgaattccgggacgaatcaaccggctcttctatcatcgtgctaccggacgagaattttagtctgaatgtactcgtttcctacgattcaaccattatcccgaatcagtttgcaacacttgaggatatgcacaatttcaaagacgaagtggctgccagccgtactttcgtctttgttcgtgaaatagagccgcttctctccgccggcctcattaaaggtggtgacctcgacaacgcaatcgttatttacgaacgcaaaatgtcacaggaaagctatgacaaactggctgatgtaatgggtgttcctcacatggatgcggatcagttggggtacatcaatcacaaaccactggtttggccgaacgagtgtgcccgtcacaaactgctggatgttatcggtgatcttgcattgattggtaaaccgattaaaggtcgcatcattgctacccgccccggtcacaccatcaacaataagtttgcgcgtcagatgcggaaggaaattcgcctgcatgaaatacaggcaccgacatacgactgtaaccgcgaaccggtgatggacgtaaatcgtatccgtgagctattaccccaccgttatcctttccaattggtagacaaggtaattgagatgggtgccagctatatcgtaggtatcaaaaatatcacagcaaacgaacctttcttccagggacatttcccacaggaaccagtgatgccgggcgtacttcaaatagaagcaatggctcaggtaggcggtttgctcgttcttaattctgttgacgaaccggaacgttattctacctatttcatgaagatagatggcgtaaagttccgccagaaagtagtaccgggagatacactgcttttccgtgtagaattattagccccgatccgtcgtggcatctccacaatgaaaggttatgcattcgttggcgaaaaagtcgtttgcgaagcagaattcatggcacaaatagtaaaaaataaataaaaccaaaaacatggtaagtcctctagcgtatattcatcccgaagctaaaatcggagaaaatgtagaaattgcgccttttgtatttattgataaaaacgtagttattggcgataacaacaagattatggctaatgtgaacatcctgtatggttcacgcattggtaatggaaatacgatctttccgggtgctgttatcggagcagttccacaggacctcaagtttcgtggagaagaatcaactgctgagatcggagacaataatctgattcgtgagaatgttacagtcaaccgtggtacggcagctaaagggcgtaccattgtaggaagcaacaacttattaatggaaggggtgcatgtagcacacgatgcactgatcggtaacggatgtattatcggcaactccaccaagatggcaggtgaaatcgttattgacgacaatgctattatcagtgccaatgtattaatgcatcagttctgccatgtaggcagccatgtaatgattcagggcggatgccgcttcagtaaagatatccctccttatatcattgcaggacgtgagcccatagctttcagcggtatcaacattatcggccttcgtcgccgtggttttgccaatgaagtaatcgaaagtattcataacgcttaccgtatcatttaccaaagcggtctgaatacaacagatgcattgaagaaaattgaagatgaagttgagaagagtccggagattgactacatcatcaatttcatccgtaattcagaacgtggtattattaaataaacagttcaaaatagtcatattatgatatacagatttactatcatatctgatgaagttgacgattttgtcagagaaatacaaattgatccggaagctacatttcttgacttccatgaagcaatactgaaatcagtagggtacacaaacgaccagatgacctccttctttatctgcgatgatgattgggaaaaagaaaaagaagtcactttggaagaaatggacgacaatccggaaatggatagttggataatgaaagagactactatcagcgaactggtagaagatgaaaagcaaaaattgttgtatgtattcgactacatgacagagcgttgcttcttcatcgaattgtctgaaatcatcaccggaaaagatatgaatggtgccaaatgtaccaagaaatcgggtgatgctccgccacaaactgtagattttgaagaaatggctgctgcaagcggttcactcgacctggacgaaaatttctatggtgatcaggactttgatatggaagattttgatcaggaaggcttcgacataggtggtaacgcgggtggctcttatgaagaagagaagttttaagtattaagtatcaagtattaggtattaattgctatgcagtgacaagcagttaatacctaatatttttatcccctggcactttaatacttaacacctaatacttaatactttaaaatccatgcccactctcattgttttaatcggacctacaggagtaggaaaaacagaattaagcctgcgactggcggagaactttcacaccagcattgtctccgctgattcgagacaactttatgctgaattaaaaataggaacggcggctcctaccccggatcaattaaaacgtgtgcctcactatctggtaggcactcttcatcttaccgattattacagcgccgctcaatatgagcaggaagcgatggaaatcctccatcaattattcacagaacatgaggtagtagtacttactggtggatcaatgatgtatgtagatgccatctgcaaggggattgacgacatccctaccgttgatgctgaaacacgtcaggtgatgctgcaaaagtatgaggaagaaggattggagcaactttgtgcagagctccgtttattagatccggactactatcgcatcgtagacctgaaaaacccaaaacgggtgattcatgcattggaaatctgttacatgaccggaaagacatatacatctttccgcacccaacagaaaaaggaacgccctttccgcattcttaagatcggattaacccgtgacagagaagaactgtatgaccgcattaatcgtcgtgtagaccaaatgatggaggaaggattactggacgaagtacgttccgtactctcctaccggcatctaaactctcttaataccgtaggttacaaagaactgttcaaatatctggacggagaatgggaactccctttcgctatcgaaaagatcaagcaaaattcacgcatttattcacgcaaacagatgacatggttcaaaagggatgaagaaatacgctggttccatccggaacaagaaacggagatacttgagtacctccgtctacaaaatctgactcatttacccagtttggataccttctgataaacttcccgatagacattattgcccaaccggaacagaagcgtcattttctttccgtcaatccggtaagatataggaacgatagcatttgccgatctgccatgttcattacgcagtttctcgcagtaaaggccttttgcaatgatgctgtactcccccgaacgggtaattttgtacgggcaaaatacatcgtccgaactgcggctgcctgaactcacgtctacagcatctttgatatacgcatccacattgaaataattgccatctttatcaagtaccttatatctgaccacttgcgaagagccttcactctgaacaagtttccagattccttttaagttttgactcatacaaagtgcaggtacaagaaaaagaaatgaaacagctagtaaaatcttacaaaattgttttttcataataataaaattttaagttcaacaaatagttaataatagtgtatatcgcttttattccatatttttatttcaacaggatataactgctcatttttaatcaaataatgtatcctctcatttatctttcaaaactactttaagcataggttttactttcacttcagcaacagacttattgacatcagcaatccgaagtatcccatttttaggcgctttcaaattaaaacgaccatctgcgtcagctacagtataatcatttgttccttttactaacacagtagccgcaatcgtttttccttcttcatcagtcacaactccagttacagaaatccaatcagaacgatatttatcggtttccaatcttacaatctttgttccatccatttcatttacagacaccgatcttatatttttggtagacatacctttcaatttagacttcttaatcttttcatcgtctatacaataaataatttctccttctacatcttttgccatgctttctgccaattccaaagcatctgcataaggctttttcggattagctttattaaactcatattccgcatctgtaaacaaagtgataatcagcaccccatttttccctctttccccataaatatccgtagctgatttatctttcaatatagtaaagtttttaatacgatcaggagcaagtttggaaatagcatcttcttccaatgcttctttaccgtcaataataaccaaaggcttttttttagcttgagcaacatgccattcctcatcatgagatccccccatataaaagtgtgattttttaggtgattcgctctcagtccttacctttgcaggttttggaaatttttgtttattctgatattcttcttccgtcaacaaatcaactaaaactactccatctttccccctctctccataaacctctacagctgctttgtctttcattacagatatacttttaatacgttccggagagacactggataaagcttcttcgccaacggcttctttgccatctatataaactaacggcttcttaccacttactgaatgaaacgttacaccccaattcttacttccacgattgagagcatctaatctcgtttttgaaatagcatcaatcttgtacttattctgcaatatttgttctgcggttgaatgtaactgaataaccatagccccgtttttcgctttatctccataaatatctgtagcctcttttccatctaatatagaaatactttcaatacgacttggatctaaagcatctaccacagtacgagaagattctttaccatcaatgatcaccaatacatctttatctcgcaaatccaccgtagatatccccccaatatgggtacccataagtttcgatttatctacagatgtattcattcccggctttatttttgcttgagttttggttattttaaaatgattatcttcatccggcagtagtttagtagccaacaccccattctttcctttttctccataaatagatattgttcccttctccttcaatattgaatcacccgtgactaccaactttttcagtgaatctccagaagtaatattcgacacatctttggtgatttcttccacttttgcttctacaattgcagccaaatcattaactttgactgcagaaatctcctcaactctttcggagatttcgggacgggcaaaagcggttactgcaatagttgccaacggaagtacatacaagtacttcaaacgtgcccaaggattcgatttttcttttaacatcatagtgatacgttttttaagtttactgtgattaaagctgttggccatagagtagagccttgtgccaacggctttttttattaataataactgataatctttcgcatcaataccttcattaataactgtttcatcggcttcatattcatgaatattctgtaattcctgtttcagcagccatataccggggttgaaccattgaaaaaagatacagatatcagctaccaacaaatcgatggaatgacgattctgaatatgtgccatttcatgaatcagaatctcgcgtccatcctcttccaaatctttccgggaaataacgatatatctcatccaactgaaaggagcgacctcccgttccagaacaatcagtctgactcctcctttaagcctttcccgtttacccgatttaatcagtaatagtaaacgggataaagagtaaagattacggcatgcaaagaatataataccaaccagataaaacagcaacagaacttgtacccaggaaatggaaagttcctccggctgtgcaaccgacacctccgcgggatccatagcttccgccatcatcaatagttgctcaactgtcagtacggtctgactcaattcggtctgatgagcagtagtcacctctataaagggaatcagcagggataaaaataatatccctaataaggctatcctgttgaaccgatggaatgtttccttacttaacaacaatctgtaaaacagataaaataaagacagacaaaccgccgatttcaaaatatagataagaaagattcccatagtcattgatatttaaaggagacaaatatagttttaacccggattagtataaataataaggacgctgaatgaccattttattaagtatattgattcctaagttatttatccaatacgatttttatatcttttgcagcttttgtcctgaaaagcaccttctcaccccgagaaatctggagagaggcgtctttaggagttttcagctcaaagtgtccagttgcatcagtctttgtagacgatgaagttccatacatagtaatagtgactccttccataggctttccttccttatccattacaatacccgaagccaatacccacttatccgaatttctttccgtttcaacacggatcgtagtttcaccctccccgctattatcaatacgtgatactccacgcacttcatttgccggaatatttttcaattcttcttccgaggcttccttaccatcaataaagaataatacctttcctgtaggaacaactttattatcgtggatattcattgccatctcccaagcattgttatagggacgttgcggattctttttaatgtcttcatattcctcctcagaaagcaagtctatcaaaatcactccattcttcgccttctcaccataagcctccaaagcagcctctgatttcaagacagaaaagctttttatacgatccggagaaatcttagacaaagcattaggttccaaaacttctttaccgtcaatcactactagtggttcctcaccatcatatacaccacgaatgggaagtccgccaatgccagggacagagttcagtttaggaaatgatccggttttagtcttaaatttagcctgagttttagtaattcgaaagtggttatccgcattcggcagtaattcaatatcataaacaccatgttttcctttctcgccatagatagaaagagccgcatcgctacgtaatatagacacagtctttattcgattcgggttggcttcatcattcattatcgaatacaatgtatctttagatacttccttaccatctaccaatataagaggcttatttgattccgatatccgttcaaaacggccaccatataaaacaaccgaacttcgcttggaagcaacggaatcattgaatattacaactgaatctgctgaatatacaatcgatgaatccttagaaacccaacgtcctccatacatttttgatttctcaggcactacatagggcttagctttcagggagtctttcagcacatctttggtgatttcttccacttttgcttctacaattgcagccaaatcattaactttgacggcagaaatctcgtcagccttttcagagatttcgggacgggcaaaagcggttactgcaatagcagccaacggaagtacatataagtatttcaaacgcgcccaaggatttgatttttcttttaacatcatagtgatacgtttcttaagtttactgtgattaaagctgttggccatagagtagagccttgtgccaacggctttttttattaataataattgataatctctagcgtttataccctcattaatgaccgcttcgtcggcttcgtattcatggatattctgcaattcctgtttcaataaccacgctccaggattaaaccactgaaagaatatacagatatctgctatgagcaagtcccaagaatggtgctttctgatatgcgcacattcgtgaatcagtatttcacgtccgttctcctccaaatcagttcgtgaaatcacaacaaacttcatccaactgaagggtgccacattccggtcatgaaccaacaaaacagtatgtttatctatctgtctccgttgcgccgtattcattaaccgaacaagacggaataaagaatagacattccggcaaacaaggaaaaatatgcccgctatataaaatagaagaactatttctatccaatgcactgggcttctccacgtatctaccaaatcatctccttccactactgttgtcacctgggtttcctgatgattctctgccataacaagtagttgttcaattgtcagtactgcctgatttatttcattctgcggcgccttggtcacttcaatcagcggaagcaacaaagaaaacacgagaatgcccaacaacgcaatccggttaaaacggtagaacgtttctttactcaacagcagcctgtaaaacaaataaaacaataacaggcacacccccgattttagtatatagacgaaaaagaatcccatatatagattaattccagttagttctctgccaatttcttctcaaactcctccaaataggaaggattctttttagatgccaacacccaaatgcctttcttggctttactaccaaacttagattccagattcgtcgactccggcaaaatttcccatacatcatgcaacagatcatccggagataagctcttcaactgctggtaagaaatttcttttccatccaaaagaataagctgtccatcatgcccggttcctccatccgtacaataaatcttaaagaaatccttcacataataaatgcacttcacagtatgagaggtcttcacttcatgagcaagtgcaggatgagcgttctgctgctttttaactccatagagttcattcaacgatttaagcattcctttttttacccgatgaacaaaatccgccaagtcactttctgtccacggagtagtggaagacaaacgtagtattcctttctccttttggtaaacacctttccgataactgatgacattatcatcagaacttgattccgaaattgaccatcctgcatatcccacagggatatgcatttttagagtatcgatttctataatttgtacagtgtccgattctgcataactcttagaaaccagaatctcttcgaaatgtctcacatccaatgtatcctgtatgaatgcatttccctcctgattattcatattcagaagattcggacgggcaaaaagaacagctgtaatagctgccaacggaaatactatcaagtattttgataatttccaaggatttgattttttcttcaacatcatagtaatacgttttttaagtgaactgtgatcaaaactattcaccatagaatacagccttgttccaacagtcttttgaattaataaaagctgatatttctttgcatcaatccctgctttcagaactgattcatctgcttcaaactcatgtacagttttcaattcttttctgaatagccacattgcaggattaaaccactggaacaaaaggcaaatctccgccaataataggtcccggaaatgtttgtgcatgatatgcgcatactcatgagctataatttcttcgccatactcctccaagtcctgccgggatagcacaatatagtgtctccaactaaacggtgccacattttgctgatggaccaccaatctgatttttcctttccaacacttcttctcactgttacgaatcaaacggtatatacatgctatggaaaatatgtaacgcaacaataacagcaatgctccacccagatacagaaatcccaaattgccaagggtcaaaatagtgcaatcagacctttctttctctaattgtgtatgtaacgtagttgttgtgacctgctccattttctgcaaatcatgttcttgctccgtttcttcttccggaatattcagacgttcaaacacttgttcaatctgtggtaaatggaagttctgtgaaactttgagcgaaggaatgacaaatgcaaccaatataagtccgatcaacaccatccggttgaatcgatgaaatgtctccttgcttagccaaaagcggtagaataaataaaaaacagacagacaaagcgctgttttcaacatatatatgaggaagaaaatgtgcatagtattgttttgtattagattgtgttattctttattatttctgatgagcttgttccacctcgtttataagccttttcaagtcatccaaagaaatatcctcctctttgaccagagatgaaacagcgctcaaatatgaattattgaaatacttgctgattacattccgcaatgtccctttacgaaaatcttcttcgctgacaacgggatagtactgataagtattcccaaaagtatgatgagccaggaatcccttatcttcaagcccgcgaacaattgtagataacgtattgaaatgaggcttcggttcctcatagaaagccaacatttctttcacaaacaaagggcctttctcccagaaataccccatcaattcctcttcttttactgttaatcctttcatatttacaacattgtttactgcaaataacgagaagttttagttcataaactaattttcatagttaaagtaaactaaatgctttagtttatcttcttttctaacaattgcggcaaggtatacctatttacatattggcattaaactcagattctatcgggatttatccatccattcccccagcctctcagaaaagaattatgtttttatctctcatactctcattcttttcttataaatatcagagaactaacaagatacaaaatgagagatactttcatcatcggtatctctcattctatttcaacttatctctcatgatttttcggacagtataccgttatcttaccttcatccggctgtcctttacagatgatactacctatcttcttagcatctcttacctacatccttatcttatctcccttacatacctctgttttcttaccgacatcttcatcgttccactagagtgcacaggcctgtgcactctagtgaacagatcgtgccacccgggtgaaacgatctgttcacccgagtggcacgataacaattgaacttatatcacacgaccttatccgatagataacacaagaatatagggttgtttatctgaaaagtaaggctacatctcccttattatcccagtaatttatcaatgataaaatggccgatgaagaataaatcgcccatgaaaacaatgctgaatatcagaaaagcaaagcaggtactccaacgggaacctcctgcttcctcgccacgtttaatacggagcagggaactgtgcagacaatcacccgcaatgaacagcacaaacagactcggtatcaagtcaccccatgatatcaaccacaggttatcaccttttcccatcaggaatgtcaatgctacggccaacaggaagacagaagcatactgcaaatcttttctcttcgaattcatagcggtaatatttaaagtacttttcacaaagatatcgaatatcttccaataatccttatcaattctatctaaaaaaggttatgcctgatcggaagattcggacggagcattccctgccttagcggatttctttttcagccgaccgctctttctcagcgcttcggcaataatccactgaagttgtccgttggtactgcgaaactcatcggctgcccatttttcgatggcatccattgtctcggcatctacacgcaaaacaaaactctttattgaagattcttttttagccactaccttcttaccttctgtttttatttattaatgattcaacgtacctgtattgactaccggctgtgcagcctcatccgcacaaagaactacaagcagattgctgaccatcgccgccttcttgtcctcgtccaattcaacaatttcttcttcagaaagtttatgcaaagccatacgtaccattgatacggcaccctccacaatcttttcacgggcactgataatggccgaagcctgctgacgacgcaacatgacggctgcaatctccggagcataagccagatagttaatacgggcttccactatttccattccggccatcgccagacgttcgttaagctggtgttccaactgatcattaatttcatcgccaccgctccgcaatgtcaattcatccgaattcgcttcgttatcatcgtaagcatacaatcctgccacctgacggagagcagcgtcactctgcacacgcacaaaatcttcaaaagcattcattcgtccggcaacggttacgctcatctgtccggttcctttattatccgccatcgtctgtgcatcgatttcgaacatggccttatacgtatccttcagtttccagacaagcaccagtcctatcagaatggggttaccaatcttatcattcaccttgataggttctatatccagattacgggcacgcaaagagagctttttcttattcataaaaggattcacccaaaagaaaccggtttcggtaaaggtacccttgtactttccgaagaataccatagcccgggcttcgttcggttcctgagaaaaatatccgggaatcatcagaatagctgctgcaagaaagaggatcaacagcaggaacaaaacaatacttcctttaaaaaggataaagctcatcacaatcagaagaggcagtatcgccaaattaacaaacaaggctacaaacccattaataaccacgtcattgtactgaaattcttttgcattcataggactaaattttgatattattttgatatcacaaatatatcacttttcattctgataatgcaaggggaaagactcttttttctccgcaatacatcatttttaactaaacagcagtcatccgatactaaacaaatttaaaaggcgtaagaaaataagggtttaattcaaacaaaaacaggatgtactttgaggtatttaagtttattgttatttttgcagggtatgaacttaacccccttaaacaagtaaaatataaaacgatttataaaatgagaaaagtaagtttagccctgctcctctgccttctctgcctcgccggaatggcacaaggacaaaaggcacttgatttaaaagatattacctccggacgcttccgcccggaaaatattcagggagtcatccccacaccagatggagagcactacacacaaatgaacgccgatggtacgcaaatcatcaaatactcattccgcacaggagaaaaggtagaggtgatctttgacgtgaaccaggcacgcgaatgtgacttcaagaatttcgacagctatcagttctcacccgatggtgacaaattactgatcgctaccaaaacgaccccgatataccggcattcatacacagctgtgcattatatataccctttgaaacgaaatgataagggagttacgacaaacaacattattgaacggctgtccgacggcggacctcaacaggtccccgtcttttctccagacggaacgatgatcgctttcgtgcgtgacaataatatatttctcgtaaagctgctctacggtaacagcgaaagccaggtgaccgaagatggcaagcaaaatatggttctcaacggtatccccgactgggtatatgaggaagagttcggtttcaaccgcgccctggagttcagtgccgataataccatgattgctttcatccgcttcgacgagtcggaagttccttcctattcttttccgatgttcgcgggagaagcaccgcagattactcctttgaaagattatccgggagaatacacctacaagtatccgaaagccggatacccgaactcgaaagtagaagtacgtacgtacgacatcaaatcgcacgtgacccgcaccatgaagcttccgatagatgcagacggatatatcccccgcatccgcttcacgaaagatgccagcaaacttgccgttatgacattgaaccgccatcaggatcgtttcgacctttattttgccgatccgcgctcaacgctctgcaagttagtgttgcgtgatgagtcaccttattatattaaggagaacgtgttcgataatatcaagttctatccggaaactttcagtttgcttagcgaacgtgacggtttcagccatctttactggtacagcatggggggaaaccttatcaagaaagtaaccaatggcaaatatgaagtgaaggattttctgggttatgacgcaacagacggctctttctattataccagcaatgaggaaagccccttgcgtaaagcagtctacaagattgataagaaaggcaaaaagacaaagttgtctcaacgtgaaggaaccaatacgccgttattcagcaaatcgatgaagtattatatgaacaaattctcgaatctggatactcctatgctagttacgctgaatgacaacacaggcaaaaccttaaaaacgcttatcaccaacgaccagttgaaacaaacgttagccggctatgctatcccgcaaaaagagttctttaccttccagactacggacggggtaactttgaatggatggatgatgaagcctgtcaacttctccgcatccaagaaatatccggtgctgatgtaccagtatagcggtccggggtcacaacaagttctggatacttggggaatcagctgggagacttacatggccagcctcggctatatcgttgtatgtgtagacggtcgtggtacaggaggccgcggagaagcgttcgagaagtgcacttatctcaaaatcggcgtgaaagaagccaaagaccaggtcgaaacagctctctatttaggcaaacagccgtatgtggataaagaccgtatcggtatctggggatggagctatggcggatacatgacattgatgagtatgagcgaaggaactccggtattcaaagccggtgtagctgttgccgcacctacggactggcgtttctacgacactatatatacagaacgtttcatgcgcaccccgaaagaaaacgcagaaggatacaaagaatcatccgctttcacacgggctgacaaactgcacggcaatctgttgctggtacatggtatggcagacgataatgttcacttccagaactgtgcagaatatgccgagcatctggtgcagttgggtaaacaatttgatatgcaagtatataccaatcgtaatcatggcatatacggcggcaacacccgtcagcatctatatacacgattgaccaacttcttcctgaacaatttgtaatggctgacagagtgcgcaagcctgaatggctgaaaataaatatcggtgccaacgaccgttacaccgaaactaaaagaattgtcgactcccactgcctgcatacgatatgcagcagtgggcgttgtcccaacatgggagaatgctggggaaaaggaactgccacatttatgatcggcggtgacatctgtacccgcagctgcaaattctgcaacacacaaaccggacgcccgcatccactggatgccaacgaaccgacacacgtagcggagtctatcgctcttatgaaactagatcatgcggtagttacctcggtagaccgtgacgaccttcccgatctgggagccggacattgggcacataccattcgtgagatcaaacgactgaatccgcagaccacaatcgaagtactgatacccgattttcagggtagaatggaactggtagacctagtgatagaagccaatcccgacatcatttcccataatatggagacggtaagacgcatcagtcccctggttcgcagtgcggccaactatgataccagcctgcaagtgatcggtcacatcgcccgaagcggaacaaaatcaaaaagcggtattatggtggggttgggagaaactccacaggaagtggaaaccattatggacgacctgctggcagtcggctgccagattcttacgataggacaatatttgcagcctacgcaccgtcattatccggttgccgagtatgtgacgccacagcaattcgccacatacaaaaccatcggtttggagaaaggattcagcattgtagagagtgctcctctcgttcgttcgtcttatcatgcagagaaacacattcgatagaaaacaaaacacattcactatttgttttataggtaaaaccggcaaataaacataaagatggatcataaaggaacactttcttccgcgtttaacatgtcattgggttttatccccgttattatttccattttattgtgtgaatttataacgcaagacacggctatttacatcggtactggtataggtattgtagggatatacctattactacaccgtaaaggtgcgctaattcctaattttattctttatattgccaccggaatgctggcactgctgtcacttgcagccttgattcccggtgactatgttccgccaggtgctctgcctcttaccctggaagtcagtatcctcattccgatgctgatactctatatgcataaaaagagatttatcaaccactttctgagacagataggctcctgcaataagcgcttgtatgcgcaaggagcagaggcggcagttgtttcggcccgttttgcattgatcttcggtatcctgcattttattattatcagtattgtcgttgccagtcaggaccctttaagccagacaagtatggtgatactttataaggtatttccccctgtcgtatttgtgatgagtatcctgttcaatcagattgctatccggtatttcaaccatctgatgtcgcacacggaatacgtgcccatagtcaatacgaaaggagatgtcatcggaagaagtcttgccatagaagcactcaactataagaatgcctatatcaatccggtcataagaatagccgtatctactcacgggatgctgtttctttgtgacagaccgatgaatgccatccttgataaagggaaaactgacataccgatggaatgctatctccgttatggtgagtccctcaccgaaggagtaaaccgcttggtgcacaatgcgcttccacacgcaacggaagacttcaagccagagtttaacattgtctatcacttcgagaatgaagcaaccaaccggctcatctatcttttcatcgtcgatatcaaagatgattctatcctttgcactccccgcttcaagaacagtaagctatggagtttcaagcagatagaagaaaatatgggcaaaggctttttcagcagttgcttcgaagatgaatacgaacacctgaaagatgttatttgtataagagaaaaatacagggaatcttagacaattcgggaatatgccctttccagtctttcaccgtgcgggtttgtataaactcgccttcgcaagttatattggcagcaatacatagttttgtctgcggacggcaattctgcaagatatcttctatcatcttatgattccggtaaggagtttcgatgaatagctgtgtctgactttcagcatagacacgctgctccagtgttttcagtttcttagcccgttctcccggttctatcggcagatagccatgaaaggcaaagctctgtccattgaatcccgaagccattacagaaagaataatagaggaaggtcctaccagaggaatcactttcagtttctggcgctgggcaatggcaaccacatctgctcccggatcggcaacggcaggacagcccgcctccgaaatcacccccatcgaggctccacccgccaaaggcttcagataaccggatatatcttcgggagaagtatgcttattcaaagggtaaaaagtcagcgaatcaatatcaatttcccggtcaaccttcttcagaaagcgacgggcagaacgaacatcttcgacaataaaatgccggataccacgaataatctccgtattataagaaggtaacacctgttcaagaggtgtatcgcccaatgtaacgggcaacaggtaaagagcagtttccactttaggtaataggtgataagtaataagtaataggtatgggctagagtttcaggtaaccggactcttcgaacatactctgataatcggtaagttccagcagatcctttattttaagatctttatgctttttcatgtaggatgctataatccgtgctcccacccacgaaccgatcaatgcaggggcttgtcctcccagcatatcaacagtaggcgccggtttcatatagtagcggatcaccattgggtcacgtgcgtgcagatgatcgtttgcacagatatactcccagatatccttttcgtttttcctgcaccattcgttctcctgatcggagtatcccattgcctgaccaatatcgtcataaccaagcaaatgctgcaccacataattgattttgccggaatgcatcatcagatcgaccagacaagtaccttcatgatagttcatttcgtaacggctaaggagatagaatgcgaaacaatccggcacaatccgttccggacgcatcgaggtacattgatagtcatagtagaaacgtttgtagagaggatagtcttctcccatatacttatcgaggctgattcccagcaatgtatctaccagaatgattgattcattgaatgcggatatctgcgaataaataaatggtattttcgtatcggggacttccttcttcagcttccggaatcctttggtgagtcctttttctacttcgtcaagattgggatatttagcttctacatcgctcagcaaacgaagcaaggtgctatccgagtagaatttttgcaaacgctgagaaatggtgtcgtccttcaccgtaccgatagacagtacatcttctatcagaatctttgtcggctggcgatagtccattgtcagtttctgcatagcggaaaagctgttggagcgaacatattcgctcaacagcttatcgtatctcagaacagaaatcccttcttccttctgctccgcaacctttcctgtgcttaagccgcaggaggcgaaaagcatacctattaatatagtaagaagagagatccgtagtttcataaccttttatccgtaaatgatattaccattttcgtccatgtactcatccagtcctttttcgtaagtagccattgcacgaagactcatacctacgctggagaaaccaccgtcatggaataagttctgcatagtcactttacgggtaaggtcggagaacatcacgatacaataatccgcacattcgtcagctgttgcatttccaagcggagacatacggttagcgaaatcatacagcttatccatacctttcactcccgaaccggcagtagtaaaggtaggcgactgtgaaatcgtattcacacgtacgctatgctcacgaccgtagatgtacccgaaactgcgtgcgatagattccagcagggctttagcatctgccatgtcattgtagccgtaaaaagtacgctgagcagcgacataactcaaagctacgatagaaccatattccgcaatagcgttcagtttcttggcggactgaatcattttatggaacgatacagccgaaatatccaatgtcttgtccaacattccatagtcaaggtcatcataagtacgtttcttgcgcacgttaggagacataccgatagagtgcaatacaaaatcaatttgtccgcccaatatatccatagatgtcttgaatacattcgtcagatcttccacactggtggcatctgccggcactacctgacagtttagtttttcagctaatgcattgacttcacccatacggatagccatcggagtatttgataatgtaatagttgcaccttcttccacggcgcgctctgctactttccaggcgatagactggtcgttcagtgcaccgaagataattcctctttttcctttcaacaagttgttactcatatcttctaatagttaaattttgtgcaaagatagtatctttctgcataaaaacacgagaagtgtgcaaatattagacataaatgacaaaaaatacacgtattctatcaataactccacatctgcctgaagtttcccccttatctttgccaatgataattaagaggttttttcataatatttattttaaggttagaattaggttaacatgaatttgtcttattcctttccggcaggctgcctgcgagaggtcgcctgcggagggagataagagttatgagaagccatcttagaaatcgaaagagaataccagaaaaacaataaatgtataaccctatagaaaagttactaaatgaacacaatgacaagaagactcctctggatggtcgtatgttgtttgccgtttgtctcgggatgcaaacaaagtgagtgcgcaataagcgaaaacgcaatagatgacaccatttaccagaatttacctttcgaaatgccgaaagtacagcagccggtttttcctgcttatgaggtaaatatctctaaattcggagccaagggggatgggatgaccctgaatacgaaagcaatcaacgatgctataaaagaagtaaaccaacgtggcggaggtaaagttatcatcccagaaggcacttggctgaccggacctatcgaactgctcagcaacgtgaatctttatacagaacgcaatgccctgatactcttcaccggtgactttgaagcatatcctatcatccccacttctttcgaaggattggaaacacgccgctgtcaatcaccgatttctgctcgtaatgcagagaatatcgctatcacaggatatggaatatttgacggaaacggagactgctggcgcccggtgaagaaggaaaaactaacagcttcgcaatggaataaactggtaaaatcgggtggtgtactcgatgaacaggaaagaatatggtatcctaccgccggttcgctgaaaggtgcaatggcctgcaaagacttcaatgtgcccgaaggcatcaacacggacgaagaatggaatgaaatccgtgcatggttgcgccccgtattactgaatttcgtgaaaagcaagaggattttgctggaaggagttactttcaagaactcaccgagctggtgtctgcatccgttgtcatgtgaagactttacagtgaataatattcaggtaatcaatccctggtattctcagaacggagatgcactcgatctggaatcttgcaagaatgcactgatcctgaatagtgtattcgatgcgggtgacgatgccatctgtatcaaatcgggcaaagatgagaacggccgccgccgcggagaaccttgccagaatgtaatcgtaaagaataatacggtattacatgggcatggcggatttgtagtaggcagtgaaatgtccggtggtgtgaagaatatctatgtagaagattgtacattcctgggaacagatgtaggtctgcgcttcaaaagtacccgcggacgtggcggtgttgtagaaaacatctatatcaataacatcaatatgatcaatataccgaacgaaccgttacttttcgacctgttctatggtggcaaaggagccggagaagaatcggaagaagatctgctgagccgtatgaagacggcgattcctcctgtaaccgaagagactcctgcgttccgtgatattcatatatcaaatgtcatttgcagaggttcgggacgtgcgatgttcttcaacggacttccggaaatgcctatccgtaacgtaactgtgaagaatgttgtgatgacggaagctactgacggagtcgttatcagtcaggtagacggtgtcacactcgaaaatatttatgtagaatcaaccaaaggaaagaatatactgaatgtcaaaagcgccaagaatctgaaagtcgatggagagacttatgaagagattgacgccaaaggacagatattgaatttcaaataagagattccaccacagaaaaccacaaaatcattatatagagtaaaaagctcaaatagcagactaatttatcttccaaagataagccggtctgctattttttcaattacttttgcagaaagaaatacgacgtataatatcatgccttaaaatcatgaagaagaatatttttatcatcacactccttgtcgggtgctgctctctgtccgcctgggctcaaaaacaggagaaaaccattactgtagaagtaaacaataactggaaccgtgccaagacggatgaaccggtagtaatcaacttgcgtgacttgcataccggatttaaagtaaagtctgccgtagtaatggaaggaagcactgaaattccttctcagctggacgacctgaacagagaccgtaagatggatgaactggcattcgttaccagcctccctgctcacggaagaaaaacatttcaggtaaccctgtcttctgaaaagagtacgaaaacctatccggcacgggtttatgcggaaatgttcattgctgacccgagaaaaggaaagcatcagtcagtacaggcaatcactgtccctggtacaagtaatatatatagtatggtccgtcctcatggtcctgtactggaatcggaactggtaggctatcgtctttactttaacgaaaaacagacaccggatatctacggtaagttcaataaaggactggaaatcaaagaatctcagttctaccctactgacgaacagttagcaagaggattcggtgacgatgtcctccgggtattcgacagttgcggtccgggtgctttcaaaggatgggacggaaagaaagcaactcatatcactccggtggctacccgtacggaacgtatcatctcttacggtccggtgcgtgtcatcgcagaaatcgaagtgacaggctggaaatatcaaaatgcggaattggacatgatgacccgttacacactctatgccggacaccgtgatcttcgtatcgaggcattcttcgacgagccgattaagaacgaagtgttctgtacaggcgttcaggatattgtcggtaccgcagaatcttactcggatcacaaagggcttgtcggcagttggggaacagactggccggtaaacgataccgtgaaatatgccaaagaaacagtaggtcttgggacctgcattccccaacgatatgtgaaatcggaagagaaagacaaagacaactacctctacaccatcacatctccgggaagcaaatacttacagtatcacaccactttcacttccatgaaagaaactttcggctataagacaccggaagcatggttcgcttatctccgcgaatggaaagaagaattggtacatccggtaacggtcaaaataaaagatattcattaaacaaagcatacaaatacagttaaacaatcaaatactggagtatttaccagtttttataccgactctgcacaattattactcctttgtgcggagtcttttttttacctttgccccattgagagacttcaactgaatctttaatatcaaactattatacctatatcatgaaacgattgacacagactttagctttttgcctgctaactgttttcactgcggtagcacagaaaaactatgtatccgaagtatgggtttccgatctcggaaatggtaaatacaagaatccggtgctctatgccgattattccgatccggacgcttgccgcgtaggagatgatttctatatgacttcttccagcttcaactgtctgccgggattgcagattctacattccaaggatttagtgaactggacgattatcggagctgctgttccctatgccctcacccctattgaaacaccggaacgtccggaacacggcaaccgtgtctgggcacccagtatccgccaccataacggagagttttatatcttctggggagacccggaccaaggcgctttcatggtaaaagccaaagacccgcaaggtccgtggacggaacctgttctggttaaaccgggaaaaggaatcatcgatacctgcccgctttgggatgaagacggaaaagtatatctggtacacgcctatgcaggaagccgcgccggactgaaaagtgtaatcaccatctgtgaattgaataaggaagcgaccaaagccatcaccccctcacgcattatcttcgacggtcacgaagcacaccagacgtgtgaaggcccgaagttttataaaaggaacggctattattatatcttccatccggcaggcggtgtgccaaccggttggcaggtagtactccgttctaaaaatgcgtatggtccttatgaatggagaactgtactggcgcagggtgattctcccgtcaatggacctcaccagggagcttgggtagacactccttccggagaagactggttcttccactttcaggatgtaggcgcttatggtcgccttgttcacttgcaaccgatgaagtgggtgaatgactggcctgtaatcggtatcgacaaagatggtgacggttgcggcgaaccggtaatgacctacaaaaagccgaatgtaggaaagatatatcccatctgtacaccgcaagaaagcgacgaattcgacggatatatactctctccgcaatggcagtggcacgctaatatcaatgagaaatgggcatattatgccggagacaaaagttatgtcagactatactcttatccggtagtagcggattataagaatttgtgggatgtagctaatctgttgttgcaaaaaactccttcggacaatttcaccaccacaatgaaactgaccttcatgcctaatcccaaactgaaaggtgaacgtacaggtttggtagtaatgggcagggattatgcaggattgattctggaaaatacggacaaaggtcttgtgctgtctcaaattgaatgtaaaaaagcagataaaggagaagcggaacaggtaaactcttctgtcggtcttacccaaaacacggtatacctaaaggtacgtttcagttgcgacggcaagaaaattaaagccagtgaaggaggtaacgacctcattgtgatatgcaacttcagttatagccttgacggaaagaagttcttgccattaggcaacccttttcaggcaagggagggacaatggattggcgccaaagtcggcatgttctgtacccgtccggctattgttaccaatgatggaggatggacagatgtagactggttccgaattacaaggaaatgattcgttttttattcctatctttgtaagcagaaagaaaggaaaacaggattaacataaaaaaacaagaagttcaatgaagaaactagtcattttcgatttggatggtacattactgaataccattgccgaccttgcacacagtacaaattatgccttgaataagttaggatatcccacacatgagatcgagaaatataacttcatggtaggaaacggcatcgacaaactttttgagcgtgccttgccggaaggagaaaagtccaaagagaatgtactgcgcgtacgcaaggaattcgtcccttactatgacattcataatgccgatgacagccgcccttatcccggtattccggaattactctcatacttacaggatgcaggtattcaaattactgtggcttccaacaaatatcaggcagccacccaaaagttgattgaccattattttccggaaatccattttaccgctgtgttcgggcaacgtgaagggataaaggttaaacccgatccaaccgttgtattcgatattctggaagttgccaaagtaaccaaagaagaagtgctgtacgtgggtgattccggcgtggatatgcaaacggctgctaatgccggagtgacagtttgtggagtaacatggggattccgcccacgtgccgaactggaagaattcagtcctcaatatattgtagataccgctgaggagatcaaacgtcttattctctaatatctgaatctacagaaagatctcattcttcaagctgtacgatagatctatgcggattatatcaacatagatctatcatgcagctatttttcttcaataacagaacaatattttaaagattctgcgcagagaattgaaaaccggttcccgcatcatataatttactatttctttttaacttcagaaaatcaatatccggcagacttccatccgctttgcgaggcaatgttaactgagcaggatccaaactcacaaaatcatcctcacctacggtcatatctacaggaagaaaagaattattgataatcgtacattcctcccgattcacatcgacaatatgttttcctgcagccctcggcttatatgacaaattattccgaataatatgatcatatccgtccacgtccactatttctccgggagacttacgattcagcatacagaaattagacggattctgataaccggtattattgaaccaggaaattcctcccaaatggtgattggcataaaatcctttgttcttgtttttatatgccagacaattcttcactacatggtgtggaatctcattcggcatcttcacttttgagcgcataccatagccacccgctttaaaccctgtaccatctcccgcacccacaaatcctccgggcttatatccattataaaacgcccagcaatcttcaatcgtataagctgcttgtgcctttatcaaatcaaaaccgtcatcactgttgtaccaggcccgacatcctttaaacacatttcccgtataggaggcagaagccggatgcccaccgaagccatccacatttccaccggtaccattctcagatacagggtcataattattataagcatcacagttcagtacgagattattacttccccgcaccaaataaaaaccaatagccatgccatcgtgcatcgccagattctcgtaaatattatgatttccaccttgattgtatatacactccgactgagtatgctcccggatagtaacctgtgttttgataatctcaaaattgcggaaatggaggtaagagcctgatacataaaagacagatacccgtttaccctccggctttacttcagccagattgaatatcggacgttcatcctgataacctgtatagcagattctcttggcctgagtgccacttttattcatttcaaaaacataagcgcgcaaatgatctcctcccatcatctgctcttcccgtatccgatactcgcctccgcgaatatataccgtatctccgggaacgacttttgactgcgctttttgtaaagtagcgaaaggtttgtcaagcgtgcccgcatttgaatcatcaccattggtagctacaaaataattcgtagccgaaagagacaggaaacaccccataaaaaaaagactaatacctatatgctttttcattatgcttatatttaaaaacctattgaaaactgatttccattttactgttgttaatgtgcttctttattacctgactcttatcttctacctctaaacaaatattctgtaaccggaagttttttccagttaccgttttcatgccgctaaattacagctttctttatagtttagaatgtacatgcgtacacaaagcctagaaaatcgtatttcacctgagatttacatcaagaatgaacgataatacatcgtttctttgtttttccgtacgctattacatcctctattctaaaaagaaaattaactttgtaaccattaataataatgtagaatcgtagaaatcaaatatgaaaaatgcactgctgatattcgcattcttatctttctatctcagttcagtacatgcatctgtcgagatacgttcgaacaaactgaccaccggtgacggactggcgaataattcaatccgatatatgtttcaggacagcaagggatttatgtggatgggaaccgtcaacggattaagctattatgacggcaactcttttgtcagtatctacccggaccctaatctgccgatttcattggccgacccacgcatccggaatatggaagaagactctaacggttttttatggatcgccaccctctcttctttatatagctgttacgatttaaaacatgggcgcttcgtcgatttcaccggttgcggagaatacaaacagagctattcgaaaaaaatcattgcatccgaccagtctatctggttgtgggataacaataacggatgccgtcgtgtcgtctatcaggatggccagttctcgtcgcaggcatacaaaaaagaattaggcaacctatcttctgacaaggtactgtttgtctacgaaagcaatgacagccccggacatgtatggataggaaccaagcaaggattatggaaataccatgacggcaaactggaagcaatggatacacagggagaaagctgggaacatatcttttcttatgaccaatatacctgcatcattaccggaaaaaaagaaatctaccgccactctctttccaataaccgactggagaaaatcgcttcattaaccgaactcggagatacaggtgtaatcaccggaagcctccgcctgcaacatcaatgggtgatgtttaccgccactggcagttacatcctagatcccgttacgggaaagctgcgccggttctcccgcctgaatattaaaaacggtaacgtcaccagagacaataaagggaatgcatgggtacacaactataccggcaacgtatggtatgtcaataccagcactggcgacatcaaacattttcagtttctttcatccgagcatttgggatatatcgatgtagaacgttactctatcattcatgattcacgggatatcatctggattacgacttacggaaacggactctttgcctacgatctgaataccggcgatctgcagcacttcacttttgaagtcagtcactccagccatatcaattccaattatctgcaatatatcattgaagaccgttccgggggtatctgggtgagttccgaattctccggattatctcatctggagattctgaataaaggaacgttacgtatctatccgaatggcgaagatgcttctgaccgctccaacacgatacgtatgcttttacgtggcaaaaacggtaatgtatatatggcaaaccgcatgggtaccctatatgaatatgatgccgacctgaaaaatatacttcgtagagagaagtttacacataacgtatacagtatgtgcgaagataatgaaggacagttatggttgggtatgcgtggtataggattacgtatcggggctgaccaatggtaccgatataacagtaaggataataactccttatcaaacgacaatgtctacttaatctaccgtgaccgcaaagggcggatgtggataggaacatttggcggaggattgaatctggctgtcaaaacaggcaacggttatcaattcaagcatttctttcaagacagttatggagaaaaacgggtacgcgtcatacaggaagaccgcaacggtatgatgtgggtgggtaccaacaacggtatttatatcttccatccggactcactgatcaactcccccaagaattacgtactttacaatcatgtcaatgaaacattccccagcaatgaaatccgctgtctggtgaatgatcatgaaggaaatatgtggattggaacaacgggagcaggctttgccatctgctatccgggaaatgactaccaacatctgactttcgattgttatagtattaaagacggattgcccaacggagtcatacagtcgattgttgaagatcaggacaacaaaatgtggattgcgaccgaatatggcatttcccgcttcaccctcgccaccaagcaaatagagaattattatttttcttcacatacactagggaatgtatactctgaaaataccgcttgcataaatgctgacggaagattacttttcggtacgaactacggcctggtagttctcgatgccaataaagtggaaaacatggaaaaacttgcatcgaccgtattcacagggcttcacatcaatggagcgcatatgttgcccggtatggatgattcccctctcaacgaaaccatgtcctatacaggacagttaaacttgaaacattatcaaaattcatttgtcattgccttttcaacattcaactttttaagcggagcatccaaatattcttatcggatgcctccatatgattcggaatggagcatcccttcagcacaaaatttggcaacgtaccgtaatcttcctcccggtaaataccagttgcaagtgaaagcctgcaatgtagccggcgtatggggggaagaaagtactatggagattgtcatagctcctcctttctggcagacgacctgggcctatctgatttatctggtattcattggaatcgtctgttatttcagtttccatatcatacgaaaattcaacagattacgcaatcgcatcgctgttgagaagcaattgaccgaatataagctggaattcttcaccaatatatcccacgaattccgtacaccgcttactctgattcaaggtgctctcaacaagctaatcaatatagagaatcctcccaaagagatgcaacgtcctttaaaaaccatggataaaagtactcagagaatgttacgcctcatcaatcagctacttgaattcagaaagatgcagaaaaacaaactggccttatctttggaagagacggacgtcattgctttcctttatgaaatcttcctgagtttcaaggatacaagcgagtccaaaaacatcgatttcagttttgagccgtcacaacctgcttataaaatgtttattgataaaggcaatttagacaaggttacctacaacctcctatccaatgctttcaagtatactccttctaacggaaagattatattcaaaatagatattcaggaagacaagcaacagcttcgtatacaagtcatagataacgggatcggcatacccaaagaaaaacgttctgaactgttcaagcgtttcatgcaaagcagtttctctcatagcagtgtcggagtaggtctccacttgacacacgaactggtacaggtacataaaggtaatatcagttatgatgaaaatgagggaggcggttctgtctttaccgtcctattgccgactaattctgatatctatcaggagaaagatttcctgattcccaatcagttattaaccgaagaagaggaacagcactccaaagattttctcagaaatgaaacgtcagaggatactttccagcctcctgtcgatcctttgaacaaacgcaaagttttgattatagaagatgatactgatatccgtgaattcctaagagaagaaataggagtttactttgaagttgaagtagctgctgacggaacatccggttttgaaaaagcaagtacgtatgatgctgatttaattgtttgtgacgttctgatgccgggaatgaatggatttgaagtgacacgcaaacttaaaaatgaatttaccaccagccatatccccatcatattactgactgccctcaatatagaagagaaatatcaggaaggaattgaatccggagctgatgcgtatatcacgaagccattcaatgtctctttactactggcaagaatcttcaagttaatcgagctacgggataaactgcgccaaaaatattctaacgaaccgggattggctcattccattatctgtaccaatgacaaggatcagaagttctcggtaaagctgaatgaagtattgaatgagcacatgaccgataccgatttttcggtcaatgactttgccggaataatgggactaggacgtactgtattctataaaaaagtacggggagtgaccggttattctccttacgaatatttacgtgtcatgcggatgaaaaaggctgctgaaatgttattgacagaagatctcaccatagccgaagtcgcctatagcgtaggtatcaacgatccgttctacttcagtaaatgtttcaagaaccaattcggggtatctccatctgcctatcggaaaaagctgtctgaagatgaaaatgaacccataaatgatgccgacgtatgatcttacaggttttccgtactaatttaaggggtgtttctttcattgatgtactttctttgccaatgaaaaattaatcattaagaaatcatgagaaacaaactctttctatttgtatttctgtttgcagtgctggctattgttgatagtcacgctttcgaacgcaaaaaatacaatttcaacagtgaatggcgtctgcaaatcggagactttcccgaagctaaacaatctcaattcgacgatagccggtggaaagcggtcactttaccgcatgcctttaatgaagatgaagccttcaaagtgtccatcgaacagctgacggacacagtggtatggtatcggaaacactttcggattccggcttccggtaaaaaacaaaaagtattcatcgaatttgaaggagtgcgccaagccggtgacttctatttgaacggacaatatctgggaaagcacgaaaacggagtaatggcggcaggcttcgacctgacaccttatattaaagaaggtgacaatgtactggcagtacgtacggacaatgactggatgtatcgcgaaaaaagtactaactccaagttccagtggaacgaccgtaacttcaacgcaaactacggtggtctgcccaagaatgtattcttgtacgttacagatgaagtgtatcagactcttcctttatacagtaatctgaaaactaccggagtttatatttatgctaaagacatcgacgtaaaaggacgcactgccaccatccatgcagaatcggaagtaaaaaacgacagtcgtgaaccacgccaatttagctaccaggtggtcttgctggatgctgacggcaaacaggtgaaaagcttcgaaggtgagaaagtaaccttacaaggtggcgaaacaagggtagtgaaagctgcttccaaagtaaataatctccatttctggagttggggatatgggtatctttatactgtccagacgattctaaaagacaataagaatcaagtctttgatgaagtaagtactcgtacaggttttcgcaagacacgatttgcagaaggcaaaatatggttgaatgatcgtgtgatccagatgaaaggatatgcacagcgcaccagtaatgaatggccggcggtaggcctgtccgttccggcatggcttagtgactactccaatggcctggtagtaaaaggcaatggtaatctggtacgctggatgcatgttaccccatggaaacaagacgtagagtcctgcgaccgtgtaggcctgattcaagcaatgccggcaggagattccgagaaagaccgtacaggacgccaatgggatcagcgtacagaactaatgcgcgatgcgattatctacaaccgtaataatccaagtatcttattttatgaatgtggaaacaaaggtatcagcagagagcacatgatagaaatgaaagctatccgtgatcaatacgatccttttggcggacgtgctatcggctctcgtgagatgctggacatccgtgaagccgaatatggcggagaaatgctttatatcaacaagagtgaacatcacccgatgtgggctacagaatattgtcgtgatgaaggtttgagaaaatattgggatgaatacagctatcctttccacaaagaaggagacggaccgttacatcgtaaccaacctgcaacagactacaatcacaatcaggacatgctggcgatagcaatgatccgctgttggtatgattattggcgtgagcgtccagggacaggtcgcagagtcagttccggaggggccaaaatcattttctcggataccaacacacaccaccgtggtgaagaaaactatcgcagaagtggagtaacggaccctatgcgcatcgaaaaagatgctttctttgcacatcaggtcatgtggaacggatgggtagatacggaagaagacaatacctatatcatcggtcattggaactatcccgcaaatacagtaaaaccggtctatgtcgtttctacaggtgaagaagtggaactgttcctgaacagtcagtcactaggaaaaggcaaacgcgaatacaatttcctgttcacctttgacaatgtggcttttaaagccggtaaactggaagcagtcagctacaacaaggccggtaaggaaataagccgctatgctgtaagcacggttggtgaacctgccggactgaaactgacaacgatacaaaatccggaaggattccacgcggacggagccgacctggcattaatacaggtagaagtggtagataaggatgggaaacgctgtccgcttgacaaccgtaccattcaattcgacctgaaagggaatgccgaatggcgcggaggcatcgcacaaggaaaagacaattatattcttaataccagtctccctgtggaatgtggtattaaccgtgctcttatccgcagcactacccaagccggcaagatcactctgaccgctaaggcagaagggctccccagcgctacaattacattagaaacccttcccgtcaaagttagcaacggattgagtacttatttgcctcagatgactctgaaaggtaatctggataaaggaaagactccccttaccccatcttacaaagacacaaaacgtgatatacgtattgtatccgccaaagccggagccaacaatgagactgtaaaccaaagcttcgacgataatgaaagaagcgaatggatgaatgacggcaagctcagcaccgcatggattacatatacgctcgaaaaagaagctgcaatagatgatatctgtatcaaattgaatggatggcgttcacgcagttatcctttggaagtgtttgccggcaatactatgatctggagtggagatacgaataaaagcttggggtatgttcatcttaatgtggaaaagccggtacgttccaaacaaattaccatccgtctgaaaggtaataccagcgatcaggatgctttcggacagatcactgaagttgcggcaaaagcagcaaatgatatggaactcgaagcaaaagcgaacaagaataatgctaatctgagaattattgaaatagagtttctggaagcaatcaaatagaataaaacattttctcccaccataaaggagatatgtaaaagaaggtgtcacaaaaaccatattgccccataggaacaaaagattagtacggagaaacaaccgtcaatgaaccgttcagtaagctattatgcaggctagattaatgtatccggtcagtaacaatagattgtttcatgtacgtggtcccatcagtctacgtacatgagccattgggtttacgtacgtgagccgaacggttcatgaacatggaacgaagacataaaaccgacttaacagattaatcaaaccttgcttgcatattaaggttaccgggctttgttcttaatgtaagcagcataccttggaaacattaaggtgtaaacagcgtacattgacgcccaaaatgatgtttttaacacatgcaggcgaaatcctcaagctgattatctattaactgataatcaatactttaaataaaagattcatcaaggagaggtgacaataagaatggaagatacattctattgtcaccttattatcaccctctattgtcacccctatcttctttattataaaacacttaaatcagaaaagtgacaagtgacaataacaatggataaatatttcctatgtatatgtttaaacagaaatgagtgtagtctgaaactaccagctatttctttattagtttcttaacttctttagcatagcgtttgcctaaagtaatctggcttgctgcatcaaaatgaggatccgtttcatccttcaacggagtaagtccttcggaagacacacaagcactatggggcaaaaaagtggagatctcttttatcatgtcattaaagggttttgtaccttcgggaatataaggtttctttgtccagttccattgtgctatttgtcctacgacaactggtaaatcaggcattcccaggtcattacgtaagtctgtcatcagctgaataatcttctctttatatgcttccggatgatgacaatcggcttctccctgatgccagataattgctttcaatgtaccatacttcattgcttcttttgcacgtcgtattgcttcatcataatatccgccggactgtttggcattcttaacccatgaacgaatcgaagatcctccccgtgcattgacgattaagcctaccggatgttttttagtagccatcgtcttggcaaatccatatgcaggtcctacttgttgccagctaagtccttttcctatcgtagaatagcggttcaagggattcactgcgggttcgaactgatcatctgcattcagcaggtatacattttgtagtgtatccatcacttccggtgataatttccctctccctgccatattcgactgtccaatgcaaagatacagatccagagtcttcagcggtttctcagcgtgtgcttccgatcttccccatactagcacacataaaaggaagaggccacatagataatttgttttcattattttattgattttattatcaggttaaactttattcgtacacacccctaattaaaatgaattttaatagttcctccataaggattaaagtcaaacataactttattcccatttatatacacaggtaattctttcctgccttgcttcaccagaattccattcatagtttccccttgaatcaccatcgtcaatggctcagcaaacagttttctatctaatttcaacttgggagtaattgtcataccattctttttattagagactttcaattgtatctcctccctttctttgatataagatgccacttcacagaaggtacctacccaaatctgatcttccatacttttcactttatccaaatgttcccaaaataaagaaggcgatttgaaagcatcatatccataattaatgccgtgcgtcatacctactccccaatcttccgctttcatcaaatccttcaaccatttgtcaaaccgttcgggagttgactttcctccgattgaaatttgtttagtacgtgtagcgaccctgcctttagaagccatactgactatttcttctgtcttataattatatgggtaacaataggtacgaggtacaatgccaatattagcataaatagcactatcattcttttctatctccgatttaacttgctctatagtcaatcgtttggcattcttatgtgcccagctatggctggaaacctcatgtcctttctttgacatttcacgcaactcatcccaagtcattcgaggtacctttgcagatgcaccttgttccgtataatagccgcatacccagaaagtacctctaaaaccacgtttctccaactcaggggcagctacagttgaatgttctgccaacccatcatcaaatgtataactgatagcacaagctctgtctcctttatatttggcgacatatacatgaggatcatccgaaagagtctttttaatttgttcatatacctgtttacccatagactcggcagaaacctgattaaaatgaagtttatctcccagtagttccgcttccgacatatcaatcagataagcgttcttatcttcttttgcatagcgacgcattccttcctcaacatcactattatacctcttgtttttcctggatacggtaccaaatataaatggaagttcagagtaatcttttccggttttctctgtcaggtggttacgcacataggaaactactcctttcagattctgataatattcttttccgtgctcataatcactttctccctgatgccaaacgaaagcatcaatctgataaccttgctttagtttggaaagtgtctgatcaatactcgcatcaatattggcaatcaaagaaagtaataaagattttcctttctcactggtagctgtattctctgccaaccatttcgggtcggcagaccagtaagttccccgaaaaggagtagtaacaggagcagctatggcagtgccaccgatagcccacttgataacataaaaatcttcctgaaacaactgttccaaccaataataagcaatcgcatcatatccccaagtataaggcttacttttaggatgactcaatggccaaaatggaacaaacataccatctgtacgattatgggcaatatggcaatatttgtaggctcccgcagtatacgtactatccacagccattgcctttatataatccggtaaacgattgttaggtactcgtccatccgtgtttgactgaccagctgttattataacatgtgcaggcttctgccctctcgcctgaatataacaaaagcctaatacaaaaaacaagataaaaaagagtgttctcatgatcaatgatcctttaattttatagtaatattctcctgcaaaaataagggtacttttactattcgaccatagactattgtacacaaatacaaggtcgatcattcacatcgggcactacagagaagatttaaactaccatttagaaagcttggttactcaagcttctgccgtctcattttctccctgttctttcatttcaccgcgttgatatacggacggcgctaccccaaactgagtcttaaagcacttactaaaatagaacggatcgctgatgccaaccttgtaagcaacttccgcaacagtcagattctcaccagacaataacaactcagccgcttttttcattcgtacaacccgcaaatattcattgggagaataccccgtcactccgcgcagttttctataaaataccgttcgtcctaatttcatcaattgagcaaactcatcaatagagaattccggacgagaaagattctgttccagtacaacagccaatcggtcggcaaattccttatcacggtcagtagagcatacggcagcacgaacaattcccggctcactggagaatttctcccgcaacttatcacgctgttctatcaagcggaatacgcgtgccaacagaagttttatactgaacggcttcgcaatataggcatcagcaccggcttcaattccttccagatgtttttccggagaattcaatgctgtcagcaagataatcgggatatgacttgtcgcaaaatcagatttcaatttctttgtcacttcaaatccggtcattccgggcatcagtacgtcacaaataatcaaatcagcatcataggtacgagccttctcaaatccggaagttccgtcagcagctacttcaacttcaaaataaactcctacttcttctttcaaaaattcacggatatcattatcatcttctataatcaatactttacgcttattcaaaggctctgctattttctccggttccggtagttcttccgaaagttccagtaaatgatgtgcctgcccacctgcctctttcaacaagacattaccgggaataaggaaatctttctccgaataaacacttttgtccgtcgggatacaaacggtaaagacagaacctccgccgtcattgtctttatattcaatcgtacctttatgcacctgtaccaattcataactcagatgcaaaccaactccgatactatcaccggaaaaactactctgcataaatctcttgaacaactcattttgcttctcttttggaataccaacacctgtatcagctacttgaatctgcaatgtcttcttcacttcatctaccgtaacagaaagtataatcgtaccgttcgaaggggtatatttaaaagcgttagacaacaggttataagtcactttatccagattacccttatcaagaaacatcttgtaagacggtatagacggaataaaacggaaattcatattcttttgctccgctacatcaccgaaactcaggaagatttcataaaggaaagcaatcacatccgtttcttccaaagagagcgccaacttattattctgcatcttgcggaactccaataactgattgatcagcctcaacattcgctgagtacttttatccatcgttttgagcgggtgtatcagatcacggggaatatcagcaacccgttgaatcttttccaacgctccttgaatcaaagttaacggagtacgaaattcatgggaaatattagtaaagaaaaccagcttatattctgtcaactgtttttccacattaatacgattacgcagactgttaaagttacgcacaatacggaaagtaaaatataaagttacaatcaacaacagcacatatcccaacatagcccagttcgtcttccagaaaggaggcacaatgacaatcttcaaggttgtttcactttcattccaaacacctgctccattacatgacttcacatgaagtacataagtacctgggttcaaatatttaaaagaagcaaaattcaacggagaaggtgtgctccatcccttatcatagttttccagccagtacatatactttgtacgtccgctgtccgaatagtcaaaagtagagaaatctatcaagaatgaattctgaaaatacttcaaagtaatttcatccgaataagcaagcgattgtttcaatggagaatcctccatagtaggatttatctgggtaccattcacatgcaaatctgtaaagaccaccggagaaaaagtttcgctatcctgtattttatccggatcaatgacaagcagaccgtaatttgtgccgaaaagcaattttccatctactcccacacaagcactattctcactataaacattacccaaagtataggaagaaaagaaataattttcaaaagaatgattagtcgggttaaacttagaaataccatattccgtagctacccataagtttccgttattgtcccccaaaattgattgaatcacatcattaaccaatccttcagaggttccgtaatgttcatatttcaatgaacggtaattatcttccggctcacaaagattcaagccggagccagatgtccccacccacatacgtcctttcgtatcacggtagatacatctgatttcattgctgcaaaatgtaccgtttgtataattgaacagatgataatcgtcactgtcagctatcaatgaatccggatgaaagatgcacacaccctcactggtgcccacccagatcattccattatcgtcttcttctattactcgcaccatacgcagaccaaacttctgctgtaaaaaatgacggaatttatacttgccatcagtcgtcggttctgccagttcaagcccaccgccaaaggtacctatccacatacggtctttccggtcacgaaaaagagaaaagacattattttctgataacgaagccggatccgagacttcattgcgataccatgaatctccgaccttcaatccatttccacgggttcccacccacatttcgccttgattatcttctgctatcgcataaatattggaatggaaatactgattggacattttggaatgaagattcgagtcaaacgtatataatccgcctttacgtgttccgacccaaatatccccatccggcattttagtcaacatacgaatcgtattcgagcggtcaaataattcacgggattcgggataaatacgcgaggttccttcattcagaactgaaatacgggataaaccggaatactctgaacttacccaaatacctccggcacgatcctccatcacatataacagaaaatccgaacttatatgactctgatcatttatattagccagaaaatgttctaacttatcctctgtcgtgtcataggcaaacaatccgttaccataagtagaaatccaaatgattccccgggaatcatggacaatatgataacgttcataatcaatgtatcccagtttatcttcaggtatcaactgaaattcttttcttgctccattcttggccaaaatataagtgacacatcccgtatgattatatatccagaagtcaccatgattatcacaaatcacttcaccatttctgatgttcagaccagagtccacactgatcttgcgtgtattgaaatcatagttaaaaaccccggtattggtaaggatgacccatttatcgttcaacaggaagtttcccgtaggtgacgtcttacccgcaacagcagaaagcgaaccgacttttgtcagtttttgctttgtagtctgatagcagtagatgtctccgtccgctgtcagaaaatacatatcattcttgaatgccagagaagaagtaaaatggagtaatctgtcttctaccttatactgtccgtcggatacggaaactaagccacgctgtgtcccgatccagattcgtccgccggcatcttcatttacaaactgtacccggttatccggaagatttccacgctccgtcttaaattccgtagacaccatctgtctgtctttctgatggaccattctgagacaaccattgccggaatgtctgagccatacatccccattagcagcaacaaatatagacgaataattcttttccagcgcaccagaccccgtatagtctacaaaacaggcacgttgcaaatcataacaactgaacaattccggagttgtagagatccataaaaaaccatttttgtcttcggtaaggtcataaatccgattatcagccaaagagactttatcaccgatttccggacggaaagtcagaaaagagttgccatcatagcggcttaacccatttagggtagccaaccacaagaagcctttgctatcctgatacaggtaccgaactgagttattcggaagtccgtcacttgttctcatttgtttggaacggagttcaatgccgccgtaagccgcattgaaaacaagagtcatgaacaatgtgaaaagtaatatgcgcctctgtgtcatatagattctaagattaatgataaatgccagacaaaaatagtcaagatagttgaaataataaagaaacaatccataaatagtatcaggaggatgcttgttttttaatcaaacatccccctgatatcaattctgtctaagggttctagtccatatgaaagacttccggcaatggtattgaaaccggtgaattgtccggattcacttccatgatatctgccatataatcccaccatttctgtacaatctctgtgttgcccaagtcctgcgaacctccttctccttctgttttctggaaagcaaatagaatattggtttctttatcccaatatatagaataatctgacaccccattttttgaaagcagtgcttttaattcaggccagatagcggcatgccttttttcgtattctgcttcatagcccggtttcagatacattttgaatgcttctcgtttcatggttcctatattttaaagttaatcttttatttattcactatctactgcaaagataggagctgttgtcttctgcttttcctgataatattgcacggcactgtcattcatctgaggatgctgggtgttgagcaaacgaatcatttccgcacctgcccaaagcaccggtccgtatccatgcgccgcatatacattgaccggacgataataatagaaagccggatcgaaagccataccggtgcctacgcaagtgccttccacctgtccttcttcatttatctttccggcgacggcatgccatcccaactgggcaacaggaccatacgctatcgcatcaatccaacctttattaatggcgtgtgccagacaatatacatagatagcagttgcagaagtttccagataagaatcattacggtcgagcaactggtgccaaagtccttctccactttgcaacgccgtcactccacgcacatgagcacggaaataatccatcaccttcggacgttggggataatcttccggcaatacatcgagcagttcacaagctgtcagcagcgcccatccattggcacgtgcccagcaaaaagccggatgatccgtactgctttccacccatccgtgtctgtacaatcccttttcggggataaacatacggtctgcaaattgcaggaattgcttcacggcttctgccagatatttattcttcgcttccttatcataacgactcatctgcgctaccgccggaatgcccataaacatatcatccagccaaagagtattccgctgaggacgattacgggcaaacgttccgtctgccagacgatattctttgttgatgataaaatcaaagtaattctgaattaatccgtcaaccggaagagactcgtctttcaaccgtaatttaatcatggcagtacatacggctcccgcatcatccaacgcatgaggagtcaggatttgcaacaattgcgaatcagtcttccctttttcttcatagacacgtttgaaatgcggagcgacttccgccaaaaagcggaaacgattctgaacatagtcagtataacgcttatcacctgttgtttcggcagccgctatcagagcggaataagtgacaccccattcataacttgccagacgaaaagccccgcgttccagctgcgcctcatcccccattgcagtataatccgtaatcaccttaccggtattcttatccactacacgagccggtgtctccttatctatatacgcaaaaacacgatcgatgtcttttttaacctgttcgggggtcaaatcaccataagtaccctgataagcaggttgcagtaaatgcaagggggtatttgaatcattgattactgctttctttttctgcgcacaggcaggtagtgctaccaataacgcagcaacggtcatcatacgataattcataatttactttttaggtattttacatcctctgaatatagtgccacgcaactccggaccaaaatagaatccgggctgagtaggctgattataagccacattttgagtcgcaatactgatacggtaaaccggatcttccaggaaagtatggaaacggtagtccgtaggaatggtagagacataaagcctcaaagctgtattatcggctgtacgtaacaatacttcttctcgccagtctcctacaatatctccttgcagacaaggagttgactttgttccgttattagaaagagcaccttcaaaaacagcgatacgttcacaaagtcctttctcccaattatatttactgactacattacgatccagcaactcacgcaagagatcaccatcccaccagacagccatattcgtagacaatcctctgactctggaagcaatcacttcccctttcacatttctgacacctttagaatctaaagaccacatttcaactccgggatgattaggatcaatatcagcagccatacaacgacctacatcagtattactctttatctggaaaataatttctcccgtagctgcatcccggaaagttgagccatctcttctgttctcgtggcaactccaaacctgcaatcccggacgggaaggatcaaagtgagtcagatgcatagcatcaccatgccccatgcgggtagaataaagtccggttccatcgttattgatcgtacattgtccatatacaatctcatcgcagccgtcaccatctacatcacctacacgaagattatggtttccttgtccggcataagctctgcaaccgggattattactgtcgaatacccagcggttcttcaaattcttaccatcccagtcataggcagccaatacagtacgtgtataatatccacggcacatcaccacactcggatgtactccatccaaatacgcaatacaagccagataacggtcgctacgattggcacgtccgtcgccccagtccatcagattgccacgttcgggcacataatcaatcgtttgcattgcttctccggtcagtccgttaaagatggtcagatactccgggcctgtcaagatacgtcctcgctcattccgataatccgcattcgcatcaccgatcacctttcccgttccgtccactgttccgtctccggtcttcattaccacttccgcacggccgtcaccgtccagatcgaagaccataaactgtgtataatgtgcaccggcgcgtacattgcgtcccatattgatacgccacaactgctgcccgttcaacttataacagtcaaaaatcaccggtcccgtataaccgtcatgagcgttatcatgtgcattggacggatcccatttcaaaataatctcatattcaccatccccgtctacatcaccgatactggcatcattcggagcataagtgtatgcttgtccggacggagtagtacctccctcggggcgtaccaaaggaatatttaaatatcctgtcggagcatctgccggcagttgataattgctttctgttttaccttttatagcttttaccgtatagagtgcaggttctgttccctgataagaatcctggaagaaagttgcatttttcagcggatgtttattcacctttttaccatcccggtatatatcaaaggattcgtccatcggatcagaagaaagatagcgccaagaaacgactacggttgacggattctcacgaatggcaattacgccacgtcctaaatgttctcgtttcagtttagtaaaatcatagtttggctgggcaactacaaaagtcgctattaccaacaaactaaaaaagatgcttgtacatttcatagttttatcattaatcaaagtgttcttatcatatttagaataacgtcgtgcaaaagtaagcgatatggtctacccataaaatagaatatcgtacaaatctatgtataaattgcctttttaaccatcgcactccctttccgaaggcattatggacaaatttaaatacttgtggacaatattccattgaagaggaaaaaagattcccctatctttgcccgtgaaatcaattatagtagctaattttatttataaacagtttttataccatgaagaaattactcctctcatttattacagcaactctcctgagtagcatgtctgccggttcagccggtgcgcaagagttgcccgaacaaaaggagactttggcaaccatcgtaaaagtaaacgactactttatgaaaaagtatgccgattataccctaccctcgttttttggcagagttcgccccagcaatatctggactcgcggagtatattatgaagggctgatagctttatatagcatttacccgcgcgaagattattatagctatacatacgattgggcgaatttccacaaatggggaatgcgtaatggaaacacgacccgcaatgcggatgaccaatgctgcggacaagtttacattgacctatataatatgtgtccctccgaccctaacatgatccggaatataaaagccagcatcgatatggtcgtaaatactccgcaagtaaatgattgggactggattgacgctatacaaatggcaatgccgatttatgccaagtttggcaagatgaccggcgaacaaaagtactatgacaaaatgtgggatctgtattcctatacccgcaacacagaaggagaagccggtatgtacaatgccaaagaaggattatggtggcgcgatcaggattttgatcctccttacaaagagccgaacggcaagaactgctactggtccagaggaaacggttgggtatatgcagcccttgtgcgtgtattggatgagatccccgctgacgaaacacatcgtcaggactatatcaatgacttcctgaccatgagcaaagccttgaagcaatgtcagcgtacagacggcttctggaacgtaagcctccacgatgaaagcaatttcggaggtaaagaaacttcgggcacagccttgtttgtatacggaatggcatggggaatccgcaacggattactcgaccgtaaagaatatctccctgttgcactgaaagcatggaatgcaatggtaaaagaggcagttcatccgaatggtttcttgggctatgtacaaggaacaggcaaagaaccgaaagacgggcagccggtaacttacaaaagtgttcccgattttgaagattatggtgtaggatgtttcctattagcaggtacagaagtttacaagttaaaataagagcattatttatcaggtaaatgaaaaacaaggtatttcactgcttatgctggctcacagccatcatatgcagcttgcagatgcaggcacaaaacaacattgcttctccaatgaaagatgtgaatcaggtggtagacaacacactggacagtctgaataaagcacgcacggcacgccccgttgccggagcaagccgtaaaggtaacaatccggtcttattcctggtcggcaactctaccatgcgcaccggtactttaggaaacggcaacaacggccaatggggctggggatattacgcaggagattatttcgactccaaccgaatcaccgttgagaatcatgctttgggaggaactagcagccgcaccttctacaaccgcctctggccggatgtaatcaaaggcgtgcaagccggagactgggtaatcatcgaactgggacacaatgataacggcccctatgacagcggacgtgcccgcgcctccattccgggaatcggcaaggacagtctgaatgtgacaatcaaggaaaccggagtcaaagagactgtatatacctacggagaatatatgcgccgtttcatcaacgatgtaaaagccaaaggagcacacccgattttattctccctgactccccgcaatgcctgggcagacaaagacagcaccatcattacccgtgtcaacaaaacattcggtttgtgggcaaagcaagtagcggaagaacagaatgttcctttcattgatttgaatgatatcagcgcccgcaagtttgagaaattcggcaagaataaagtgaaatatatgttctatatcgaccgcattcataccagcgcttttggtgccaaagtgaatgccgaatctgccgctgacggaatacgcgcctgcgaagggctggaattggcaaagtatctgaaacctgttgaaaaggatgaggctaccggttcgagccgcaaagaaggacgcccggtattgtttaccatcggcgacagtacggttaaaaataaagataacgataaaaacggtatgtggggatggggcagcgtgatagcagatgagtttgatctgaataagatatctgttgagaattgtgctatggcaggacgcagcgcccgtacattccttgacgaaggtcgctgggataaagtatatcatgcactccaaccgggagactttgttcttatccagttcggacacaatgacgctggagagataaataccggaaaagcccgtgccgaattgcccggctccggagaagaaagcaaagtatttttaatggagaaaacaggtaaatatcaagtcatttatactttcggctggtatctcaggaagtttatcatggacgttcaggaaaagggtgcgatacctatcgttttaagccataccccacgcaataagtggaaagacggaaagatagaacgcaacactgcctccttcggcaaatggacacgcgaagctgccgaagctaccggagcctattttatcgacctgaataaaataagtgctgacaagctcgaaaagaaaggtatcaagaaagcggcagattattataacaatgaccatacgcatacttctttgaaaggagcgcacatgaatgccaaaagcatcgcagatggactgaaaatggctgattgcccgttgaaacagtacttgaaataagagacagactcatctgatatattcataaagcggttaatgcatttcactgacaatgcattaaccgctttcttctaactattattcatccatcggaatgacctcctgcatatagatagcatcaaggctccaaagtgccgcatcatttgtactgatgctgacgcattcatccaaaggggccggaacttcgggtggaaacagtttagtgatccggaaaggaggcgcaggtgtatgttccagtcgggtgaataaatcctcccatgcttcttttgccattagtgcatcccgcttgtggtaagcagcgtatgccatcagacgggaaattcggaaacggctatgattcaattcccacgccttttgcttataacgtgccgcatggtccagccacgcgtctttccattcgggaaggtcaatcatacgtatcatttcgttcattacctcaaaaccacccataatagtcattaaatgattcgaagattccagcttgggatcacattcactggtgatgattcccgttgccggatcgaaacccagcgctttgggtcccgtaaagatacggttgggcagggctgctatacttttcattccggctacgatcttatcccggtaaacagtgttgcctgtacgctcccactccgtcatccagtttccggcatacgccagccagtccggaccgatacgcagtcgggcaggcgccgtacagggatattcactgcgaggctgtgccagccgcatagggtctaattcatatagtttctgatcggcatcctttacttcagtcatcaagtcaccgcaacgttcatcggtagtgagataataatagaaacggttccatgcagcctgactgatccgggcttctttagcaccgcatccccaatggctgacattatgtcggctgcctaatcccgcgttcggtccgatatggtaaacgtccacttcggctgtatgacgggtcatagcttctgccatacgccagatatcttcacgacctgtacgcaggaagttgtaccacaaccacatattagaagccagttccgtattgtcccaggcaaatccacctatatcataacgccaagtatgacggaccgggtcataagcatgcatcacatctccataattccaaaagccataccatttattctgctctatggctttacgataaaaatcaatatatgcatccaggcgatcttctacccgcgcacgaaaagaagtactccggtccggaaggctccatacgccgaaagcctgctgtgcatgaagatagtctggtgtgggcagcaatattcccggttctgagagtgattcagcaacatcggcaaaagccttttttcctgcataacctttctgtggaataagtgtgagtgtagtggtgcgggcaatgccataaggagtactcattccctcctgaacatcttcgtagctggcattcagatcatgagcgacattatcgtagtgacgtaagtccatcggttctccttcggggctccataaccatgctgtgatcgttgcagatgaagttttggcacccgatatttcgagggatgaaggatatgactgccaaaaatcatgcaggcagagtcccaaacctcccgtaatatcaccgacaaaagcatagcctccgctacgggtgccggagaaagttcctatccaaggattattgtcattggcacgtttgcgaatggagaaagcatcagcagagagttgagacaagcgataatcgttccatgaagcccagttatcaagaagatcacgattcttcccgtcaaaagcctcgtaaggcgggatgcgtttgccatccatctgttgctgttgcagagaaagtgtatcctctttgccgagtgtcagtttacgccgtcctgccagcggttgtaccggttcactccagacgcctccattggcacaagagaaagcgacatgacggttataaagagcttcacgcataggagcatccatacgaatgcccaaggcacgaataaaatccttattttgatctccgtcgtacacaaagctatgtacgatcttgatctgctcacttccggcgtagaagtagagacggactacgaacggaagccactcccgtccggtttcacttctgtgggtgccttccagtttgacgagtgtccgcaccttacctatacgttctactgtggccgatgtcaatcttccggtatagttagtaaaagtgatttgagaagtattttcaaggaccggttcgctttgagtgttgcatacaagacgtgctttttcaccgactttcactccttcacggaacagactgtcaatcataaaatctccctgacgagggatgtaagcggaaataattcctgtctctatgcggatactttgaggtgtttcaacaacagatagggataatttattgctacgatcatcggcagtccttgaagatgctttttcttttgacttttttccggtctttttgagtagcagtttctccgtatttttcggaataactccggctatccctttccatttcacagaaccatcgggccagtaggccaatgcccaagtatctgtcggaagcatttcacctttatcggtcatcagctgcaaagtgtgctccgggtataattctccttcattgaagggaactcccagacttaccgctttgttttgctgcggagtattaccgatccagtgtaatggtatttcagaagtttcctgcgacgaacattcataatgaaaattggcgatacgagttcgggacaaggtggtacgaaagccgaaccaaccttccgtaaggggttcggcatcgcggaaatccaccaatcgcactccatttatataataactaaccctattattttcattcgttatcttgatatgataccacttgtttgcctccaacaaatggtcggcatctgtatattctttcaagattgcgggacgggcttttgcatttgtaacagccgcttcgttgccgtcataacggcgaaaacgtgtagtagaattatgattcccaccgtatcccatatagtaaagttgcagggaataacagttcagaaagatgccattacgccatttctcacgtttccagatattatcggggtattgagggtccgaagccatccaaaaacaattcaagtcactcaagcgatcgccttctgcctcaacaacgacacacgcatcgtactcaatggttaccttgccactcatcttttcttttcgccaaagagttaagcctttgggagaaagaatttcagcggtatcaccacgaaaggttactttataatccggagattcggactctactttccagtatttatgaaactggcgggcgttgagtccggaggttttattatcttgggcgttcgatgccaaagtaataagcaagaacaaaaaaatagatatgcttttcatatgctaatttaggataaggagttccattataaggaacattctcaatggtttcacatcacaaaattagaaaataccacccgaatgataaatagaatatcattcatttaaatggatatttgttcaacaaacggtcttcttccagcaaacagcaatatcattgattgtattaaaagtgacaaatacaaaaaaaacgatctgataaccaagcctaacttgatatcagatcgattcatttatcttcagcgtatatatctatttttgaaacacaagctcacccatacggtctgccgtactaaagactatggaacaaaggccatcttttatttgcaacacttccattccagccagttgaacgatctccggttcagctccggttttactactcaagatctctaacgtggcattcgacttcacaccaaccgacaaatcaccgtcgcaggataacacatattgtcttccttccattacgttggtaatagcaacactattgacgtcggtgaacaaactccaattattggctttatttaattcaatcatgtttccccatacaaaacgctgattatcggtgctcaatacacttgatacaaccactacatcaagtgatacgctgtgtccttccaaatctgttacattcaagacgactttgccgtatttcactccctgaatgtatatcagattttcacgatacttggcggtagcataaccttcttcagaaaaagaaaactggtatccaccgcttccgctttcaatctttagtataccttcacttccttctttgatttgaatagctgtacgatcaagcttcagttcagcaaccgtatcttcgtctttgcaagacgaaaagaggctgagttgagataatatcaagacaaaagatattatataaatattaataaactgtttcatattattctaagtttatccgttttatcttttaaatttaagcgcaatagattttgtaatgtttccgtttgcatcttcaatgactgccttcacttcaagcacgccgctaaaatcagacaagtctattgagttcttatcaaactccgtcgtttcttcgccatctacaatcacatacatcttcgtgaacgatgcagcttcgggtcccactacactggctttacttccaactacaacaattgtcggcttcttcaaccaaccaaaatcaagatcagtaggttcacctgtagcaaaacatcccattccccaaaaacgtaattccgcatcagtagtcagctttccgaaattaacatcaggcaaatctccgttaggcttgcggtctctcatcaattccgcttcttccaaactaataaaatcggtttctatcacttcctcgctaccatcaaacgaattgttggatacttcgctcttcgccctgttcaccattacaatatgcttactacccgatcttgtaaccaatgataagttgttcttaaccatatgatcatatccgttgacatcagtcggaggaagcgccagaggtgactcacggtttgtcatattatagttttctccgctattgacagccgtattgctctcaaatataattccacctaaatgatgattggcataaaatcctctcaatctattgtaataagccaaactattccgtacctcatgttgagggatcacactgggtatggcaggcagtttgtcggcagccattccatagcctccggctttaaaaccggtaccgtcaccagcaacttctttggttccgggtttatacccattcaagaaagaccaacaattaattatcttcacagcctcgaagcaattgatcaaatcgaaaccatcatcactattgtaccatgcgcgacatccttcaaacacatttcccgtgcctttgccttcgccaactgaagatgagttaatgtgaccgccaaaaccatcaacattgccccccttaccaccttcggaaaccgaatcataattgttgtaagcatcacagttcaagatgtgattattgcttcctccaagcaaatagaaaccaattgccataccatcatgcgttctcaaatcttcaaatttgttattattggctccttttacaatacggaaacactctgattgcgtatgaccggtaatagtcacttgcgtaccgatgacatcaaatccctttagataaagattggaacctgtaacataaaacaccgtaatacgctgatctttcggttttacctgcgaaagatcaaaaatgggcctcccctgtttattcggattagccaaataagaaataggtttacctgcttcaccacttttattcatatgaaatacacaatgataaagtccgctattggtagttgtcatcggcacttgattggcgggaaccacatatgttcccggattgatataaactacatctcccgcaactaccacttcctgcacttttactaaagtggcaaaaggtttatctgaagttcccggattagaatcacttccctcaggatccatataatatgtcttttgtgcggctagagggactgataacatcagtcccaaaagtaagtacgttatttttgttatatctttcataattatctttttttgattgaaaaacatgctatttaatgagaagaagacttaccttgcaagtcccaaggtacgaaataagcaccattcataatcttggcttttacttctgcttgtttagcctgatcggattcatatttctgcccgacaaaatctgctatgaatgaatagtcattccaacgttttgccacacgaatcataagcggataagtttttccttcacaagggaattccaagaaggcttctttcaccaattcaatatcattatgctttttgatcttgtcctcgtcactcaaaccgtctaatttttgttctgctacaatctcctctttgatgtcttccggggtctgccacatatcgcgcttgccaagtcctaaaataccgcgaacaccgttatcggcatacgtgcggcggaatcccgcataaagtgttgtccacaatccccagttgcaattcagtccttgccattgttcgcccaatactacaccggctccgtagaagggatccacaccagtattcatcaagacggataccggctcaaaacgtcccatattattcagcgcttcaatcgccatgaaataaagatcagaagtgtgataaatcattatatatgtatcgtcatgagcaacagaatgtccgctctttctaaatccacggtatttgcgtatcgcatattccacatctttttcgatttcctgaatggctctgaaacgcgcatcagatgttttaatagccgttgcatcggcagacggattgaaagtaatatcttcaaaacgttttgatcctggcacagaagcacgcatcatatagcttccgctacggtcgaaatgattcaataacgaattctgctgattgtatttgtaatcatacataataacagattcagctgctgtcaacaccggcatctcagaatcatattgctgaccgtaattgctaccgtaacttcccgaacgcatatacttgatattagcaacatttccttgatactcagccaacgcaaaagttctgctcatttctccaagaatcgttgtagccgctttctgataatcccctttccaaagtgcgatttctgcctgtaatacgaagtatccgggaaccatcatattccatcttttatattcatcgtttgtggaagtagctccgttagctggatcaagccactcattccatgacatattgtatgtaccgtttattccatcaaagcctgtattcaacagtttgtcgcattcatcgacaagctcactcaggttcttaggagtctggctgacgatatctttcatgctttgcatcggatcgtcgaaccatatagcttgtccatatatctttgccaacatgagataagtccatgttttcaatctcaccgtactactaatcagacctctataatcatcgtcatctacggtagtaacatgtgtatccctgtattcttttgctttctgcaaataatcattgcaagcaataattacatcataatacttagcagggtcagcgtatgtgttaccgctcaaatcatcatcataattatagatgctgtaaaggtctgccggtgtattttcggtaggttccaacagctctccacgcatatcggtcagataaatagctttgtctccgatagcttgtatctttgtgatgatacccagaaaaccggaataaagctcgctgccttccttgatatatctgtcaccattcaaggtcgtatcattgtttggctcaaagaagtcactacacgaagcgaatatcatcgccaacacccccataagtattatttctatcttaaactttttcattttcattagaattttaaattaacgcccattttcactgttttgggttgcattagctttgcattatcaaaaccttgcatattctcagcataagaataagagaattcagggtccattcccaaataatcggtgaaggtcaacaggttctcgcctgtcacatatattgttcccgaacggaagaaattccaaagtgttttagagaaagtatagcttaatgtcacattcttcattctcaggtaagatgcatcttccatccagcgagaagagaaatagctgttgcccacaggatctttccatgttgccttcggcatatcggtcttctgtccttctactgtccaacggtttacggctgcaatactttggttgttggtagtagacacagcctccaattgttgtctgacagcattgtatgcgatgttgtcttttgaatatgagaactctgcagaaagagcaaatcctttatatttcaattgtgtatagaaacctccaaagtacgagggagcagcactgccaagaagaatacggtctttatcgtcaatacggttatcgccattctgatctacaaaacgtacatctccggcattataacgacgtccggtacggttactgagatttgcagcgtcagcttcagcttgtgtggaatatactccgtcagcctgataaccgtagaattggtaaggagattctcccacacggttgaccatctgcacaccattatcgtaactcaacacaatttgttcttcaccacccaatgacttgatcttatctctggagcgagtgatgtttccacctacgatccactcgaaattacgagtgcgcaccaatgaagcctgcactgacaactctatacctgtattctccaacttacctacattcgcataataaggaaccgatccataaacggatgaaagaggcatggctgagatcatatcgctgatttgattgttgtaataatcaaaagatacgttcaggcgattgtttaatacagacaaatccaatccgagattcaaagaagcattcttctccggtttcaatgatacgttcggaatattagaacgaacgatggttgacaactgcatgtaaggcactgtagaataatagtatccacccatctgtgaagagaagcgtgagttacctgtcagtccgtattcggcacgtacattcaacttattgagccatgtagcatcaagaagcggtttccatccttttcccagcaaggttactcctactgacggatatgtatagaaacgagctacatccgtaccggtagaagaagctgcatcaacagctatattcacagatgcctgtaccatattattgtaagtatagtcggcgtgtccgtaaaagtttgtccagttccagctattgatataacccaagaagcgtcttccgtcaatcgtgctgcctaatgtctggtaaaagtcattgccagtgttgcgcccttctcctgcatcatattcgtttttagtagtcatcaactgccatccggctattgcattcaactgatgaacataattgaatgttttcttataacttgcattcaagttggcgaaaaagtttgttgttacagctactccgtcgcttaccgcattatttcgcaaaccatatttatcgcttagcggcactatagtggcttcgcttgctccggggataaagagatgttcgttatcgtaattataatacagacctactgttccggtcagtgtcagttcacggaaagggttgtatgcgataccggctttcatattcagatcatattggcgattgcgagaatccaacgtgttaacgatagctaaaggattgctgacactgtaatctcggctcttgctccgtccatagaaatgcgatgcgtaagtctttaacgtatttccctcgcggtctttttcatatggactcaggaaaggagatcttgcgtaagctgccaatataggattcgtcgtaatatccatgccctgcatctgataatgtccgttcatataagccaaacctaccgttgcaaaaatattcagttgtttattgaccaatacattagcattcaataatgtatgaaaacgttccatacttgtgttatccatcaggccattctcgcggtaataccctaatgataggtcgtacttagcaatattatcaccaccttctactctaaaaagatgatcggtggaagcggtgttcttgtaaatcaaatcctgccaatctgtattattgttatacagatagttgtaacgtggatcgttcggattctgcatgaaaggaaaattgttataaaagttctgcgggtccttagaaatagtcattcccatatctgccagatactgtttgtagtcatccagtcccatcaccggcatccgcttatcattccagttgattccgtatgatccataatagcttactcgcgtctccaagtcattggatgccgtaccgtctgtttcgatcaagattacaccattggagcccattgaaccatacatggccgcctcagcacctttcaatatagtgatattctgtatatcctgcaaatgataaaactggaagatatcgcgtgtaaagccatcaatcagtgccgaaggtgttttatcgggcatgtggggcacaccgtttatcacaatcaaaggagcgttatcaccagtcaatgtgcggatccctcgcaagttataataactgccttctcccggcataccactactgcgtttcacttgtaaaccggcaacttgtcctgtcaatgcgcgatcaatcttcgtagttcccggcataaaatctttcttagcgatattagtagcagccgtatagtcctccaactgcatttccccttcccgacggaaggggagaatcatagtctcattatatttatattgattttccggaatcaaagtaatcacaatattcgaacgttctctgattagctgtttcacggagaaataccccggagcccatacagaaatctcgccagctttagaaagctccttcacttcaaactggaatgcaccttctttgtttgtagttacattcatcgtatccagtactgtgacaatggcgccttcaaccggctgatttgtcgctgacaaaatcttacctgttagtttctggcctccttgtccccatgtatttgccaccccacatacgagtagcgcagaaatactaagtattctttttatctttttcatatcctgtttatcaaggttaatacaaatctactgttggacggaaacaccaagtggtgggttccatgtcactttttgcacctttcgtaaattcaatcgttacttcaagttcttccgttttgtcaaatatgacaaccccaagatccgtagatccgtcacggtcgtacctgctatctttgtaaagttcgctatatccaccgccactacggtcatgattggaacctttcatggtagaggatggaatagggccgctttcacatttaggaatcttcttgccattcaaataaaaggttgcatttacttgcgaacgagagccgttgaatcccatatagaaattgtatggtccggcaggtattttataaggcacagccgtaaagcctgtagtagaagccttgtcttcaaccagtcgatagcatttgaacttaaaaatacctggtctgtcggtatccacaacccacaacatcatagatttacaataaacagccggtagccacggtttgggctgattggcacctacatattgttttacacgattcatttgcacattctcgccgatatctttcagataagtactgatgtaattatatccgggataatagtactttttatcttcatccgtcaattggtcaaacgtctcaaaacgttccttgattctccaaatcaatatcttgttggtcggtattttcaatgaagttatcttgtaagcaacgccgttactcaactctaccggattatcaagatctaccttattaactgttgtacgccattgttgatcaaaaacagaatagaagtcctgcgttgaagccggatcactctcattataaataaagtcttgttttacatactttttactaaagaaagctgtctggaatatccagttgttcaaaatagagtcttcacgttccatattccacgatttcaacttctcttttgcttctttcaacgcattttctatcaagtcattagatggtaccagcaatgtagcggtaatgttctctgaataaagatctaacttcttatctgcaaaatactgactcttttctgtgaatacagagtcatataccgtatttcctgttttatcaattcctataggtgtacttgcagctttatcaaatactctttgtgtacggctcaataccatttccttaaaaatagagtattcttcatccggcaaatctttcagatattccattaatgccttaggagtattgatataatcttccaaatcataaatgtaggcattgttagttttaatcacctttttcaccttcgaaccattgaaataaattcccggttccatgccatccacaggctcatcgtagattcttacagtcacatacttaccgttccacatcaacagacgctgtccatcttccagattactgggtgaaagaagagcatcagtaatgtgtgcttccgccttaaatatctcttcagcggttgcttgtccttcgctaccttctgcttttgtaacaggttggttggcattagcggtagattcattacccaccaccataatagtatacatcaggtttttctcctgccaagttttaatcacgcctgttttatcaaacagttcatacattttactataatcctgagcagtttttaaaaagtcggctgccggctcatccaccgcttgaatctccgtgttgtcaatcaccgtttcccacttggaataatgcgaatcccaagtatccgtacaggcgcagagtccaatcgaaaccaaagctgatgctatgatatatctaattttcttcatggttgttattctattacaggttcaaacaatatataatcaaaatacatacggaatttattatgcgagctggctgcaggatctaccacaactacattcaatgtgtgagaagcagtcgttgtaaattcaaacgcagtttcctctccgctcaaattggatgttaacggtgtattgaaacaatcttgtacatctcccgtctttccatcgtaaatacgtttgttatcaccacctgccagtcgtttagaatctaatctaaaattggtcaaaccagcttgactcccttctcctctttcaccgataaacttcatagacggatcgtatgcgtaatacaaagtaattctatactttccggctaaaatgggaggaatagtcaaatctaatgtaccgttgtatcctatattgaccaccaaggcatcattgttcatcaacttagtccagttgcccgaagtgttagcacctttggtgcaatatgacaaataactccagtcgcttgccaacgtaccgctaggtcccatttctattttgtaggatgaaacttgtggaacgatctcttgtctgccgatgaatttcgttaatgcagtgtacgtatcatcatcgtcacgtgaaacctgctgataaagttgtccttttcctttagcagcaatgtatgaagatacttcgggataatcacagaaatcaaaaataacaggtattggttcaaaatcggttttcactggcagatatccgtcaattggttggatatatccgtttttcacaatctcgtcagcttgttcctctatgaatttaactccattatttaatccgttttcagaaatcaagatcaagtcgtttgtagctctggtattcaacatctttctatattcccatgtttctctgtcaaaaggtttggagaatgtgcgaagagattcaagagtatgttctccatccattatatggtaagctataaacctgttcaactcattattgggaagttcataatcgtcggtcaatgctccaaccttggcagccaaagcactaaagctggtgataccttcctgtgcaaatacagcatcggatacggcaaatactgtgaaatatttacgcaattctactctcatgcctaacggaccttcgagtacggaattcacaacactcagcgaatcgctccatgctgttttctccaacgcttcacagaatatcttataattacccttgtctgaaagacgtgcgtagatagtctctactgccggactcaacacatcatcaagcacatatatacgcccattggctgtgcgtatagctaattcgctaacatgagcttctttgttaatgtaaacagatttatcgccaccttcgttaccgaaagatactttcaatgcatctcccgaaagtgttctgccaggcagttcaccgcttttcacaaaatcctcccgatcaatggagtcattgatgacatgatatgtaacaagagtgcgggcatattcatatcccaaatcttcgatagaagtgactcccttcttttcataaaagcggagaactgcatcgttagtaggtgccaacacagtgaaagcatcctctgcacgatttacagcgttgaacaaatctccatatttcaacactttcacccattcggagaaatcgtcaggacggttctggagataggttgccgcaggttgtacatcatatactttaaataccgtatccttgtacggatcatcacaggaataacaagtgatgcacaaaatcattaagcaaaatcttacaatattcttcatagtatatattaatttgcagttacatcataataaggattctgtattaaattcgggttactgtcgatctcaccctgactaataggcaaataccaagcatcggtattcttcagtaccgaacgtatccaactggcgctaaccgtagaattgttctcaatgatcatattgataaactgatctttatatttaaagttctgtgacctgccgaagcgtaaaagatcataccagcgttttccttccgcagcaaattcaagatcacgttcctgcaacaagtatccgagcatattttcttgtgatacagcattcgtctgaacacttaatgtagtgacgttggcacgggtacgtattttattgataagttccaaagcttgtgcgaaatttgcttcgccgcctttccagatcaatgcctcagctttcatcagcaatacatctgccatgcgatagagaatccagttggcatctttataagaacgagtcgtagacaatccatcctttccgccgattctgaacttaaagggaagatagccttctgtattggagttaccaataacggttcccgaagaaagaacaaacgtattgccatagccacgaacagtgttggaagtcacccattgatcagtttgttcgtcaaacaaacgcttacacattgcgttcgagaattgaagactggcaactgtcgattgtgtccaaggataaacgttagatggcgaaggatatgtactcgctgtagcatcatcgtcaggagattgattgcgtgactgatcaaagtttagttcaaatatagaaccgttgctgttgcccgggaagaagatattgtaccattgttcggggtcttccacaaatgccggacggaaagcggaagttgaattaatcagcatatctgcatatcttacacaaccatcgtaatcttcgctccacaaacacacgtctgccatcaatgcatacagtgcccatacagtgacgcgtcctttactcatgccggtccagtcttcatcatcatacatttctttagctgctcctgtggaaagtgcattctcgatatccagcttgatttgtgcgataatcgtctcttccgaagatttgggtatatcgacagcatactcgtctgtcatatagggttccagaatcaacggcacttctttaaagttacgtaccagcgtaaagtatgtccaagcgcgcataaaatatgcttccgccatatttgaattcattactgcctcatgatatgtttcatcctgcctctttacttccggtgcatatttaattatggagttcgccacattcaatatagaatagaaacctccccatttgcattcgccggatgaagaattcaactgaaaattctgtaattcctgtttcgatttacctgaataagcataaatggatgccccgcgaagttcgccccaataaattaatgtaggaaccgtcagacgcatgttttgatatccttgtgctagtacctcttccacctgctcttttgttttccagtattccggagatacctgttcgttcttaggcagtacgtctagccaatcattacaactggaagtcagcaaagttgctccggccattgctatgtatattaataatttcttcattttgttatcgtattagaaacttaagttaaaaccaaaagtatatcgtctggacacaggtgtcgttgcaccgtccgtagccaggtctgtcggtctcgacggtaggtttacttccggatcctgaccggtgtaagaagaccaagtaaacaggttgtatcctgtaacgaaacatgtcagtgaagtgatacccaatttattgcaaatgcttttcggaaatgcataattcagtgtcaactgtttcaaacgaaggaaggaagtatcttccacaaaacgatcagaacctaaatagttgaatccttcgccatacaatgcacgcggtatatctgtaatatcaccttcgttcttccatcttctcaacacagccgtactctgattggcgttaccgtgcatggactcattattcatacgagccgtattcacgactgactgtccgaaacgtccgtggaagaaagtattgatagaaaattgtttatacttgacagtcaatcccgcaccaccagtcaatgtcggattggcattacccaaatagacaatatcatattgattgataacaccgtcatgattgatatcttcgtacatcgcatctcccggctgacaggtagctgtcaggtttttcattacgattggtctaccttttgcatcattcattacatttccttcagcatcacgtgcatatgttgcatcggtgttttgatatactcccttgtaacggtatccatagaacgaaccgatagggcgtccaacttccgcacgggcagcatatgccccattctttggtgaataattctcctgtaccatattggcaggtagctcagtaatcttattttcgttgcggctaaagttcacataaccgttgatacgccagtctttattctcaaagattacgacatctgtacggaactcccaacctttgttctccattttacctgaattaaaataactaatcgatccgaaactagtggttgaaggtagtttgtagttcttttgcagcaaatctttcaccgtcttataataataatcgaatgtaaatcttaaacgaccttttaatacggaagcatccagaccataattatattcggtagaggtttcccatttcaaattatccaactgcatacgagcctgctttgtagccgacatgttcatatagtctgttcctttcacgtaggcgcccagataaacagaagcaccgctgggagcacgtccactctgcccgatactgaaacggaatttcgcttcgtccagccatttatctcttgctttttccagtaaaggctcgttctggaagttccatgcaagacctacagcagggaaataacccattctttcattacgtcccatagcagagttaccttcagcattaagagatccgtgtaccacataacgattcagcaatgtatagttcaatacccctacaaaagatacattacgtgtttccgattcgcttgaattcatgtcactaatagtagttccgactaccggatcggagagatcggaagaagcattaccgtatacttcgctattatagcctgaattgatatactgaccggtacgaaccaatacattcgcaataatattatgtttgtcattccagttcttgatatacatcaacttattctctgtctgcaaagccaattgatcggaataagcgtccgcactctgattggcatatttgttgacttgttccactcctgttacaacttgtggcagaaagcgacgtgttttaattgcacgcatattgatagaagcccaacctttataataaaatcccggtaaaatctcataatcggcacggaatgttatcttaccttcacgctgcacagttctgttgatagcttcatgtgccatagcaacaggattataattactttttccattaaacgaaccttcaaaattaggatcgtggtaagtaaagtattcatcagtcaatgcacctgtcaagtcatttacagtaaatggcgatttgttcggcattttactcaatgcttccgagcgaatagtgtttgtccagttcgcatccgtattggtctgcgaataagaaaagtctgcgccgaatttcaacttattagagaactgatagttaatgaccatagaagtatttaaacggttcatagacgtaccgatagtagtaccgatatcactcatatatcctaacgagaaacgataagttgctttttcaccaccaccattcattgaaaaactgttatcagaaaccaatgctttttggcgtacataatccaaccaattagtattttgattatactcatcataatatctccagtccggattgtcaccgattgcaggagcatcagacaacatattgaggtatttatttcccggattattcagaccgatgtatttggcagaattccagatagattcctgcataagagaagtatattccttaccattcaacatcgggatagtactcggatcttccttcattgtccatttggaggagaatgagaaacgagttttaccaaccgtaccttgttttgtcttaataaccaatacgccattggcaccctgagtaccccaaatagcagtagctgatgcatcttttaatacttcaactgaagcaatatcattaggtgagatatttaaaagagcacccaaatcttcttccgtagctgtgctgaaattgaaatcatcactgatttcagtcggataaggcacaccatcaataacaatcaacggatcggaagatgcatttaacgtacttgtaccacggattctgatagcactacggctaccggggtctccacccaatacaatatccacaccacccaattgtccttgcagcgcttcctctatagatacaacaggtgcagcggcaatcaacttttccatatcaactttctgagtagccgaaaccatttctttatccgaaatacccaaatcatttctatttaaccgacgggccgaaactactacttcatccaccgccattgattctgactccaaagtcacattgagcagagtttgccctgtatactttatacgctttgttttcattccgatataggaataaacaattgtcagatctttctctccctctgggactttcacattatattgcccgttcaggtttgtgataccaccacccaacgaacggttctggttgtttactagattgacatttacaccaaccagtggttcagcagtttttccaaacaattcggtaaccgtaccggatataaccttctgtacctgccctgccatttctatagaacaggacagaaaaatggctaccaatgtataaaagactttatttgtctgattcatgattaattagatattcagttaattaaaaacagcgtctatcaggtggaaagcaccgtccataaaagcaaatgggaaattctcgtatgatactatcttacatgcatttccgtactgaccggtggtctggttctgcaactgcaaggtgatgaaagcgccgttatcagtatacttcacaggaatattattgctgttacgatattctcccgatagccagtcaggtgatccgagatacggacagcctgatgcaaccggagcattggtaggcgtaaagaaataattgagcagatattctcgtaataagtattgatttgtaatctctccttgaagagttggtgatggcagacttaaatctatcgtacctttcactcccggaatacgatcattatccaaagcctcttttagtgcttcatttgtcggaatgaacccgataagacgtcctgccaatctgtaatcccaagcaagtacaccgtctatagtagcaaacagttcggcttgtctcattaaataggcgaatacaaaattcggatatttcgtttctccaatagaggtcaacattgtcctcaggcttgtatattccaatccatccaatttcccgaatacaccgaagtcactttcatattcatatactttaccgtttgcccaagatcctccggcatcattggtcacctcttttacttcggtgaaaagtgtaggaataacagtttgcggatcttgacctaatacactgttaaacacatagttcgttgtcattttcccatctttcacaaaccaatatgttccaccatcctgagtagcataaacagcccaaggcgtattaaagttaacatctcctactacagttccaccactgacgattcttttcaggtccgaagttgaaacagccacatcaccatcttctccggatgttgccagtgtattaccgactccatcagacatcagacgcatgtcactgatttcatatccgctatttttagtgatcaacatcgtatagtttgtagcagtggtagtgtacgcagccatctgattactctgaaagatagcatacaacgaaagcaggtaatctcttttaaggaaagacggtcccatcacggtactgaatatttcaggcatcgggaaattgcttaatccataaaaactaccgttcacacagatactcttatctttcacatcgctcaactggaaatcataatgcgaacccaaagagttggtaattccgctaatttcgtcagggaaaacgatagaacctccatatactgattgataaagcaatatcttagtaatcaacgggtccaaatcagttaaagaagaatatcctccagctttccaatatctattgaagaaagtgttgagtgcctggttggacggtgcaaagatactataggagatagaagctaattccggataaagacggaagttaggtgtcggccattccaacgcgatattcggaagcccgtttggtgaatgtgcatgcagaaaaagactatctactcctactgcttttccataatcggcagacaagtccttatcataggcataagtactgtactggctataaaagtcgaggaaatcggaataatctgattttttctttaaaacatcataaatagtttccaatggttccaacaccctgtctacattatatatatagccgttattggttatgatttggtattctttaacacttgcattcgacacattgaacccgttatctcccgtccacgtagagttaggatagaaaaattcataattcttcttggcatctatacctttagaggcaaagatgtggtgagagaatacaggcaagaaccgctctaaatgatagacggttacagtattgtttgttgatggatccacttcctttgtaataggactggtgctgtgtgtacgaaacttgtaatacattcccggttgtaaaactcccaattcatcatcgtcatcatcgtctttgcttgttgcactgtcttccgggcggaagttttcaagatcactcttgctataagagtagtagattaaatgataaccaatcagtttcttcaaatcatctgtcggtatatccttcactgaaacataaccgtgttcttccagataagcagcaaacgcatcattgtccggagccatgacagttgcgacactcttaccatcaagaataggcttaaagcctgataactctgccgcttctagaaacatggagaacttacctccatattcattagaaagaacttcccaagctgtacctttcagccattcgggtttttcataatgctcatccatcttgtcctcacaagagagaaaaaaaggtgagaggagcaataatagcagccaatgccgcttacgattcatcacatttctcataatattaaaatctgttaagtaacaatataaa

SEQ ID NO: 38 - DNA, 86170 bp, Bacteroides thetaiotaomicron
ttctataaatgcttataaaaagtataaggcacaattaaattacaaatttacgattaactatctatattcctatggagaatagtacaacaagcatggaatattgtactatttttcttcaaaacaacatcccgcagaacagccacgcactttccatctccgtcgtgcatatcatgcagcatctttcatcattgataaaaataagaatatttaatgcacaaaaatagggagaagaacgcaatgagacgggaggtaaatcgggcagatatagggggcaaatcgggcaataaagtaaaagattgtcatgttacgataattcgcagtctgctaagtcaaataaaagaaaactctctacgggttcttctgacatatagaaaactttttaccatcaatactaaaatcgcagttgagtttataataaatagttgcatcgtttattataaacggtctccccatttattataaactccagtacaccttttaagcacgtatttcttgattttatgcaacaaaaaaggctgcaaaccgtataaaaggttgcagcctcaagcttatcaccggttcacatagatgctgatttgcatatgatcccctttgtattttgttataatgttacactatttttttcggttcggttaagatgattgataaggtgcatttcgtttcattttttaatgggttgttactttattgcctgtatgactcctgcaaatatacaacaaaaaaatgcctttgtcaagtcctgcggatatttgaataattaaaaagcgacaggcagtgcaagtaactgatacatcaaagtgcgtgccatacgctcctgccctttggtgtcgggatgcaaacggtcatagccggcatcatagaaataaataagctgttcttcaaccatcggattcatacctgtcactgcattaaagtctatgacaggtattccccatatatttcctgcctccttaatagcctgcacataagcatctatatattctccgcaaccattctgatagctttcatccggctggacattcttatcgccgaagttagccaacgaacgatgcaaaggagtcagcagaacgatctgcttatccgggaaaagtttcttcagttgagtgattcctatattaatacgacctctataagtgtcttgagtcatgacaggcgtacgctttttccgcgtcaccatcttcttcatctcaccgtgagcagacagcacttgctcttcttgttccgtaaaccactcaccgataggcacactactattataatcgtttgtccccataaaaaccaggatagcatcgacttctccgccatgttctttcttcagcttttccgcctgacggggtacatcatcccactgccttccactaatgccgtaaacaaaaggagtgatccccagccattctttcagaaagtcccagtacttctttatattatcaccgtagcaattcgggtctgtgatggaatctccgatgtatcctactttcttgccttgccagggatgctgaatacaaccttgtttattttcagaaaagtcatttgttacagatgcttgctcttgtccatacgccaaacaagaggagagaaacaaaactgtgcatatgatcagaaacctgtttttcattgttttattctattaataatgaggtactcgtattcaagtatggaaatgcagcctcaaaaatagacagtttaagcgaaagtagcaagaataaaaacaagaagataaagatagtaccttcttcccccgtttgcagggcaactataatctgattgcaggacatatatagccaatgtgcagggtaactatctcctgcacgttggacatatatgtcctgcacgctgggcatatatgccctataaatacttcatatatctaatacacagacttattttgtgtacatcttcaatcggatatatccttccttcgactgatttttcaatgcaatcccgatacgtgtatatgccggagagttcacttcaatcgtttcggaagtaaacgccactttaccggatgcctcaatagctacaatcatctgttcggaatcagtagccagcagaagatgtgtatcgtccaggattttccagtcggctcgtgtcgttatggctgtttcgaatcggatcggtgttttcgctgtaaattcatcgccaactgtaaagttgccttcaccctggcggtcgtaaacgaaagtacgaatgagcttatccaaattgggggtggaataggcagaggtatagtcaatactgaatacatctttttcgttcgtaaattctttctgtagcacaacgcctttcgctttgccacccgaggactgtgttcgtccgtctactacaggaaccggatgaccgaatgatccttttatcttatatttctgaggagcgtctccgttaaagtaatcaccgggataggagttcggaccaccctgatcgccaaccatcgtttcacttcccaaagctacggcataagaaccgacatcattgtggttatgattctccgcattggttccgcccttggctgatatggccagacgacaggaagttccaccggcaggacgagcaatcaaaatacctgcctgctcataataagcgcgcaaagcatccgactcttcctgcaatacctgacggattccgtctgtcattccaacctttgcaacctgacttgtgaaaagttcgagaaggtgaagggacaagttgtttcctttgggtaaaacaggctgttcttctgcagaagtaatacccagcgcccggtcgcagtaactgagaataaacttgtccggcgacaacccgatgcgacaatccgaataggcggggcacactccttcattcatctgtatcttcttcccataccgggcgatacggacaaacttgggagtctgaaagaagtcgatctttccctgcgttgcccggtatacttcttcacgcaacagaatgtaggcacagaaaccataattataataacctacaccttcactacagtagccgtcgtcagcgtaccccttcattccatacacgttatacttttcggctgccgcaacaaagtaagcacgttcctccttatcgggcaacaaggcaagagccgcaccggtaacacccgccagacacacagagttccagttattggtagcggtgaaccaccaaaatggttttgtctcttccagacaacggtagaccggacggaaaaccttctcacggaaagcacactgcacccgtgcccttacctccggcgacagacgatcgtccagcatggtaacacactgagcaataccgtttccggcagtagcaaccaccaagtctacataataatccgttcctttataattcttcagaccgcggtcgtgggcaggaatagaccaaggcttctgactgcaaagagccaccagagctttttcgatggcagggacataacgcctcttattttcaaggcattcagccaaagtcagcctgtacagatattgataacgggcattcatcatattctctccaggcaaacgaacgttcgtcttattcaaatgcaggtacagtgaatcgacaaaagggggcatcccctgctttaacaaagcaggagcttccttttccagaagttgtttagcgtcgtcactctcttttatcttattccagaaagtcctgtccttataagacgttcctatcccctgcggtcgatcgggaagcatagctgcaatttcctgaatacggttctgcgggatagtagcattctgtttcggagcgtcttctgccatacgatacatttccgttccggcaagcaggaaagcacccggtccgtatacttctgtcatattgcgggtcactttctttgggtcggcaccgataggttgtacatatcctagtttaccgtcttcttctaccgcagaaagcagtgctttccatcctttctctactacaggcaggaacttttcctttggtaaaagtccctcgttcagtccataggcaagggcatatacgaagaaaccgctacagcttgtttctggtgatggataagcgtccggatcgagcagacttgcacgccagaacccgtcgctgctctgtaaattagcgatgcggtaacagagtttctgaaacagttcctgatagaacggacgatatttgctcttggcaggcagttcacgtagcatttctaccagtccgccaagcacccagccattgccccgtccccaaaagactttggcaccattactctctttcatatcaaaataacggtggtcacggtagaagagattttcttctttatcgaacaggaactcgtaagtcgctttgtactctttatccataaagcgaatgaatttcttatcaccagtgatattatagagtttcagataaacggggggtgccatgaaaagagcatcacaccaagtccagtgttctaatgtcgtggcatctccgtaagtcaactgaaacgaacccgaaggaggattggcgaccacccactccgtacgcgccagagtaggaacaatcatgtccttttgcttgtacttttcgtacagatacagataggtttgagcaatacaaatatcatctgcatgatacatccgtttatctacctgccaatagttacgacttcccaggcgggtcagccatttataatagaagtcatcctgatcgtccttctcggcgatctctgcccaataagcaagtcccaggaaaaaggtggcattcacccagttgagatcaccataaacagctctgttgtaatgaccgatctgccaatcggctaccctacgcatcgattgcttcacttcgagtttagtaaacgattgtgcatgtgtcgtgcataaataagctatgcttagaaaaagaatcaaaagtaatttcttcataatatattttttaatttatatgctttggatgcaccggcatagataccggtatttctaaaatcacataaaacagtctttcgctcgctggatatttcaggaatcagcaattcaactttaatacaagattgtgtctgcccaggatcagcaatatgcagttcggcattaccactgtgtccatccttaatcatcaatgcacaggctttatccacacttacagaaagctctccgttacggaatgtaccctctttataaaataccatttgccatattcccaatttcgtatgcctcactatctgcatagaatccgtattcgccagaatttcgacgggactcttcctgtagttattcatcttgcgggcagaatgaatcccaggcaccacgatataggcataggtagcattccgaggattacaaccatgattaaatcccaaagtaaagacctcttgctgctgctcatttttagattcagtatgattaatgctgtaccacgatcccgtctgtatcttcttgctcaaaaagagatttccgccggcgggaaagacataaccaattccattgtgcaatacccattcgggagaatcatagacgaaatctccttctttcaccatcgactgcttcttactttgtgacaatatgacctcctttttcgaaagcaaacattgattgatagtagtacataccggtacaccggctgtcgaattaacccccgctcccaaacaaatgatttcatcatcgaaaaagaaccaggactttttagctgcggtatttatatcagcataggtatcaagatatgaataaacagatacgccataaagactatcagagactcctcctgcaaatacggaagttcccttcgtttgccaatcaattacagttcgtggaatggtatccagttgaggagcagtcactccaggaatacgattccagttccataccggaaagatgcgggcgtactcgtccccttcggtcacgatgtttgtacatccgtcggacataaaataggttttcagattttcaccattcccatattcgcatcgcatggtacgattggaaaccatacgaacgtcaaatgtatagtggggacggacatgaagagcatagtctcctctgaaataatgagtgtgtaacggctttattccatagttggcggacttcttgccttccaatctggctataatcgcattgtattcatcaatatgtgccggggcgagctccagcattcgtttggcaaacaaggcggcatgactcttttgggtagcattattacggctcactcctcttcccaatacatcgaaaagcatgtattgtccacgtataacctgataataagtgccgcacataaaatgcctcagaaattgtattctctcatcatccaatgcatatttcgttcctttagtatatagagctacctgtgttactcctttcagtatttcgtctccataaccaccgatataaagctgcacgccatgctgaaaatagctgttgtcatgctgaaatccttctttcacagtatatgatagaggactataaacattctcaacagccgttttcaagtcaacatcattcttctgaaggcaagctctataaatccaatgtaaagcaatatccgtccggttggctccagtccatctggcaggatgtccgccgtccttccgcatacgttgcaagacctttgtctccaatacttccggaatctgccttttaccaacacgcatctgaataagcagaataccgagtttctgcggctcggcaatctgattataccaccagttattacaatgtggattacgatgatgccaatactccaagccctttactatcttatgatacaaatcttcattctgataataggaattctttggatgagtataagcaaatacaaagtcatacaaccgatccacatgaataagtggcatccagttagtacgatcccggcgggcataatctatatctataaaacatccttggacgtcatcatacagttccagagctttatcaatattcggattttctgcaaccccatcccgaatcttcttcattagaatatcaaaatcatcattctgcaaggcagacgtacaaatagagggacaaggtaaaaccaaatcccaaggactccatgccagcaataatagaattatgattttataatgtatcattttcatatatgcatgtttatcatttggagaataagggggtatgtcaaaagtaactaaattcccttcttgaaggaggagagcttagttacttttgacacaccttctcatccttaaaatacaatcaggccgaccactcaggctacttcgtatatttaacaggtttcgaccagattttatccaatacgttttcctgcggagcatacaaggtttccattataaaagaatcgcctgtaaaatcttctaaaacgtcctgtccttccttattataataagaaatttttgttgtttcttctcctcccttgttccaagttagcctggatgccactaatgtgctgtccagcaacatggaatatttgatgaccagattaccactctgcatactcttagaaacaatggaacgatttaacagatagctctggtactgtgtcccataaatggttcctgtaaagtctgtagccaatgatttattcaactcatcatcttccagccaggcggaaaaaatgatagacccctcccgcatattctctaaaagaatatccgtcctcttatttttggccaactcatatctgacagtatcactttgattcaatgcaagagcaatctttgtagatctcccgtctttcactatcggaaatgaaatcaacactctttcccacccattacgcacggttattgaatctttcgataatcgtgtaagatacatgattggaccatccttaacaaagtccttataagtcgcatccattgactcgcaagatataatggaacaaaatatcaagatgctgactgatataaatataaatttcttcataatatttgtcttttatatagcgattactgtattattttatcctccggtgttccaaagaaagtaagttctgccacattgatacgagatgttcctacattataattcttgatacaaacaaacgtcacatatctatatgcatccagatctacggaaaattcgagttcattgccgtctcttgccagttccttatcagcatcagttaacgggacaatagccgccggaataacagaaccgtcggctctgggcaatactccttgatataaccgtacccatccttcatcattttccggatcaaacttggttacattattatcatttcgtccccaaatttctatttctttcggatacagaccgtcaaatatagatgaataatcagttccatttcttcttccatagacaatcatacggctgagcttaaacttcttccctaagtccagtgtcaccgaactcggcttggtaaaatcatatcccgccgttgtgagggtcataaaagtattattgcttccaataattccgtcatacagattctttggggtattagcattcggtgccagataacctttgtattcgccaatggccaagtatcccatttttttcttatctacttcctcttcataatatggagtcagagatatctccttactttcagaaagatgtccccacctatccttcaccaccacactaaattctgaaggaacggcttccataccacgtatgggctcattaatctcttgctttttggtatataaagctccggcttccgtccattttccagtagcatccttccggtacacataaaaagtaagagtctcattgctggtgttggatgtctttatccggataccggcaaaatccggttttatttccatctccttataagcagtgatataaggcggctcttccggatttatttttacttccagaggttcagaataggcttcacccggacttacagaatacaacttcacattatattcaccagctttttcaaatccttccaccactacagagtcggcaaaatacgaagcattggtcgaacgttctcctatctctgtcatatatacagccttcatataaagaaaattcttatcactgggctgtgtaaaatagattatagactttcccggcagatttttgacaccattcaatactacctgttcaggcggagtcgtacttccatggggagaattcatatcactatcgttatcgcaagcactaggcagcaatgtgatggctagtactaaaaggctactgtatattatctttttcataaatcaaatgtcactttaattacttaccaaccataattttgaactaagttaggatcttttctcaactcaccgatatcaataggccagaaatacattttgggagtgaaatcccggacaagcactaagttctcactataataatctacatcagtttctccataacggactttccaaccggtcaatggctgtgtcaattctgttgtcgcagttttccaccgacggacatcccaaaaataatgtccttcaaatgctaactcaatacgacgctcctgcatgatgatttgtcgtagaccagtctgagtagcatacttgctgtttcctacatattggtcccaactttcttttacgccttgaagtcccgaacgttctctcaccatatcgatccatggcaataccgtagcataatcctctcctttttcatttaaagcttcggcatacatcaaatacaaatcagccatacggataacagggaacggataagtgaccgatgtaaatccggaagccgcatcggacatgaccgtcttgtagttaaccactttcttaggccaaataccagtcaggttctgagagtgatctgccggaatgggagacacatttcctcctttacgcgcattcaccgaatacaagcccgaaagtcccgtctttccttgtccgaaccaaataccgccgtcaaagcctaagctggcataatatctgtgttcacgttccagattcaatttgactgttcccgttttataattcagcataatagtattctcatatccgggctcagcttccaccggcgtgggagcctgcacttcaaatctattagcataatcccatgtcttatcttcttctataggaaccccatgtttagtataaaatgagttagtcagtccaagagaaacacccagattggttctgttcgtagcattcttagcatttctgccgggaaccaagtcacgcggcattgcctgtatctgatagttgtcataagaacccgaaccgacccatgactgagagtttgcccataccacttctttgttccacttctcagtgacagcacctcgcaaattcatcatcagcttgtcggactctgtcatgaccacagtgggatcatcaaaataatataaaccgaatcccaaatcttcgagataagtaatggcttctttacacgcttcggcagcctttacccatttctgcttcttctcctcttccgttttaaccggattaaagattttcacacctctattatctgcaattacctcataatccatatttccattgaacaatggacttgcagcggttaccagaactttcgctttcaatgctttagccatacctacggtcactcgtcccagttcttcagcttcattctctattttagccggaacatccggattagcaatcaccttgtccaaagtttctgtcacataattgaaacaactgtccaatgtctcccgataaggatgcatttcctccgtactactacttaccggaacatatcgatccataataggaatcggtccatacatcctgatcagatagaaatgataataagctttcaaaaattccacttcaccgatccatctgtttttctcgctatcatccatatccggtgtagtatgtatattctcaatcagaatattacaataagcaattccctcatataaatgtccccattgagcacaatatggtgaatcggacttttgcaatccttgggctatataccaggcgctggttcccaaatagctccggaaaacatcggaaatacaaaaatcaccggcaccaagcaaagctacattatttttgagacttccgtcactaggcatatacctgtagcaagtaaacaagactttttccgcttcttttctcaaggcgaaagcatggtcttcaatggtcggtatgttatccgggacgatattcagttcacatgatgtcaatataaacaccgacaaacatgacaatatacatattttgatttttttcataaccattctttttagaaacttacatttacaccaatattgaatacacgttgtaacggataattaagaccattacctgccaattccacatcccaatccttgaacttactcaaaacaaaaagattggtagaagacatatagagcctcagattggacataccccatttgctcacaattttttgaggtactgtatatcccagttcaaccaatttcagtcgtaagaaggaaccgtctctcatgaaccatgtactcagttctttattgttggcaacagaagtggttgacaatctgggccatgttgcataacgattgcggttactttccgaccaatagctatttgcaataaatttcactagttgattattagttttctgagacatcttcgaatctttaaagaatggagacatcttatcataatcaatccagaaagaagactgcgccgagccgtggaactggaaattgatgtcaaaacctttatagctaaatgttgatccaaagccatagttgatttccggactagtcggatgtccaataggaacttgatccaatgaattaattactccatctccattcatatcccggtatttgatatctccggctttataatcaccaaactgtacaggagagttggccacttccgcatcgtctataaatagcccttccgcaatgtatccccacttctggttgggcgagtagcctattttgtatttccaccattccttatcatacgtgttatcttcatatttcagatattcactatgcgcataggttaagtttccgcgtactatcaaaaaagcgtttttgttaaggttcttttgatactttaaatcaagatccacaccgtgtcctttggtctcgccaatgttagcatatacgtctgcctgatatcccattacgcttggaatactggctcttttctgtaatatgtcagtacgatgttctgtgaaatattcagctatcaggtcaaatccgtagaaagaagcttccaatgcgaaattagctttacgggatttttcccatccaatggcaggattagcataacgtgaaacatttacgcccggtctgctatatttgttttcatacccgaaagatgctccacctgcattcatattcacattagacagatataagaaacgttcatcgactctgccaatcttatcatttcccaccaaaccgtatgaggctcttagtttcaatttcgtaatttttgaactgagcggttggaagaatggttcgttcgaaatcatccagccaccaccgacggacggaaagaatccccatctgtgtttcttatcaaagcgttcggaagcattgtatccaaaattgaactccgtgaaatagcggtcactataggcataagtaaaacgtcccgacacacccatatttcttgaaggcaagctctcctgcaaagttttgtagtttggattcttactgtcgatatactgagtaacgataagaccacctacggaatgatcaccgaaagtctgattataactggttctcgtttcgattgtcattacattgttgacagtcttgtcaccgggactaaaatcaaggtattccgttccggagtcaggattgatgttttcgatagaatatttctctgtcatgaaatcataagaacttaaagcatagtaatatggcttatattgtctggtctgaccgtaatatgatttacgagaaacgttgaagaaaccttcaaatttcaaacctttagtgataaagttcaagtcctgcgtaacacctaatgtagcaagaagagtcgtattctcatattccttatatccttttaccatttcagcatacgggttaagataacttccgtcatcgctgtttccaaaaagaatgtgtttgatatatttatgttgttcatcggtaggatatacagcgggaaaaagtacaggattagacttcattaccatcttataaatatccgatcccgaataaataggaccttcataagtgtcaaagattccacttaagtttactcttacctgggtcgtttttgtcacattgatgttgacattagccctcatctgataagtctgaagattgatattgttgttgaagttgttcttgccgtctacgttgagcaaaccctggtctttggtatatcgcagagacacgtaatacgtagccgaatttcctccgccactgatgctcatgttggctcttccattccaggtcgagttcttcattagttgccttctccagtcatttgtaggataaatgatagaaccagatcccggaacggttctgtctattttatcatcactatacatgacaggggcggaaggatcacgtgttaagatggcttcattatgcaatttcatgtaagtgacagggtctgccaactcaatattactggtcggacgagaattacttccctctattcttacatcaaacttagtttttcctctctctccctcttttgtctttactagaacgacgccattagctcctctcgaaccgtaaagggccgttgccatggcatctttcatgattgaaaaactttcgatatcatcgggattcaaacgccctaagtccgtacttgtagattcaatgttatcaatcagaatcaaaggactggtgttaaatccgaaagatgcgataccacgtacaaaaaagctagcatcgtccgcacccggctctcctgatgtctgataagaaataataccggctacctgacctgccaatgcagttgtcatattactgctcggcactctcaggctctttggcgaaagtgtagtgatagaaccaatcacactctccttcttttgtgttccgaatgccacaatttccaccgcatccagttcatttacgttttgtgagagttggatggtaacgtttgttttccctttcagtggaaattcttgtgtgttatatccaataaagctgactaccagcacatccttttgaggagaagccatcaaaataaacttaccatccagatctgtgacagttccactggtgggattacttttaagagtaacattcgctccaggtattccttcaccgctctcatcaaagacctgcccggtaatcttaacttttgcatcactttgctgctgactcttttcatcaccagtcattttctgttgcccatcttgcgaatatgctcctatcgcgacaaagcaagctagcagaaacaaataaaacttttcaattttcataaattattagattagttaatgataaatacttgttttccatttaaaagagattctttctcatttcattcataggcttttatattttagattcaacatttttcagattacatacagaaacgtctccgattaccaacctgcgtgctcttctttgttttcactccaatcggcacttcgcttcttttcgccggtatagttccattcaatctcgtcagtgtattcttttccattatatgttgcaacggttttaattgtattcttaccttgttccaaggttacatcagccaagacatagtgcacatccgtgtagccttggcgtatacccgtcagttcttttccattaagatacacttgcggtgtacctatgttagaataaacagtgacagaagtatgttttcgttcgcggtcgatgttgcgacgctgggtcaggtagagtacgggatctttgctccagttagctttataccagtaataggagtcctttttgattttccggtcaaaagtgatcaaccccttcaagttacgggcaggtacaccgccacggctccacatcggtacaccaaagtcaaacatattccaaagataagaagcgatgatatagggatgctttgcaatgacactccattggtattcatgcgtcttggtctgaaaagtttccggatagaaagactttccccagttcagagcatcacccagatattctgtctgatggtccagatttgcatcagcaccatattccgtcaacatcagtttctgccacgggtatttctcctccagcccttttacccaaggctcgatatcctgcaactttttctcataccatccgaagtagcggttcattccctgaatatccgcattttgattgaccggatgctctgcatggccataaccatttacagatacagtgtagcggtcaggatcctctgtcttggccagattatgcagagtctgtgtcagtcctgccgtatattcgtggggctggtatacttcattgtgcaatccccatacataaatggaagggtgattgaaactttgacgaatcagttcacgaagctgagactgtgcattttcggcttcatatcctgtcacccgattcacaaaaggaatctctgcccagatgaccaatcccaaagaatcgcaacgggaatacaggtaatccgactgttgatagtgggcgaaacggacagtagtcgctccgatatccataatctgagccaagtcgaaatcatgttctttgttggtaagcgcactacccaatccccaccaatcctgatgacgggttaccccatacatcgggtatttctcaccattcaagtagaaacctttgcctggcacaatctcatatctacgaacacccaatggctgtaccacctcatcaattacttttccgtccgccagtaagcgggaaataaccttatataaataagggtccttacgtccctgccacagatgcggtttattcagtttgaaggtagaaatgtaagtctgtgttccctgcggagtgagtaccaaaggaaggcgatgggaagtgaccttcttgccattctgcgtataaatggtattttcgagtaccaagtcagcaggagtaagacttccattgtccagcttcactttcactgtgatatcggcagagcgtttcgatacattcctttgagtaatatatacacccggagaggcacaatcggtaactgtaatgttattctgttcagtaataatcagccataccggacgatagatacctccgtaaaccccaaaaagattgtgatttaccggaatcacatcagaacgtgaagcattatccgcctttaccattatctcattctcagctcccagtttcaatgcggttccaatttcaaaagcaaaggcgctgtatgctccccggtgcattccgacaagtttaccgttgacatacacttctgtgttggcgcccacaccttcaaagcgaagaaatacacgcttccctttcaactcattgccaaagaattgtgttttcctgtaataaccaactccttcatagaaagcatcagcttttacctgcatatctttagcgttccaggtatgaggcaagtttacagtttcccagtccgcattccattgagcagcgaccttcaccgggtcctgtgaaaaaggcccgcgtttgaatagccatccttcattgaaagaggtcacttcccgggcagagagtgaaagaatctgcccgataagcgctgataaaatgagtatatatttaaacttcatagaatcgtttctttatcatttatgttaaagcatctcgataaatactttttgttcctttagctgcacgaactttaagctgaattacataaggttcacccggattctttttaggaacagatacgttatattcattgcgggttgtctcaacaacagtgatatcttcaccggtagtcagcaaagtggctttttctactgtaatgcctttcggagtctttacaatcaaccgttcactataaggctgattgaatactaccatataaacttcatcgtttttaccacgtgtataatatccccagtcttgtttttcaaatccggcataatcgcaagcataaacagcttttccgtaacgattcatccacttaccaatcgctgtagccattgctttctcttcgggacggaaatcaccatctgcctgaggcccgaagttgacaaccatgtttccacccatggaaacagcgtgtacaatgcggtcaatgacttcaatcggagttttcacatagctcaatgaccagtctttgtgatatccccattgattttcgggtatagtcatgcaggcttcccagtcccactgtgtaactttgagatctttcaccggatcgggcaagcggcgttcgtagccggattcgtagtcacccatcagacgaccattgctatcaaaatgtcgctttcctttgtcatcagcacgtaagcggctattgatggcaacacccggaacgagttccttcaacatttgttctgcatgagctgtccaccaaccattctttttaacgctggcatcccacgtaccatcaaaccagaagtccttaacggtcgggtaacgtgttgccagttctttcagttgattgtcggtaaattcaaggaaacggctgaaggcgatgctatcttctttggattttatatcataacgataatccggattactccagtccatcactgagaaatagaagtgtacatcaattccttcgtcattataggctttcaccaactcgcccaatatatcacgcttatatggggtatttgctacggtatatttagtatacttactaggccacagacagaagccttcatgatgtttcgttgtaatcttgacatacttagtacccatttctttggccatctttgcccatttcttcgcatcaaatttcgtagggttccattgatccatcagtttcagccattcatcagcaggtacttttgcccagcttttcagccattcggcagctccgccatatacttttccattccactctcccccggggatagcatacagtccccagtggatgaaggcacccaaacgattgtcacggaacttctgcatggcagggtcttgccgtttaccttcattcgtagctccatatttcaaaggaatttccttctttgcttcttgagcaaacgttacagaactgacagtaatcaataataagagtaatgttattaatctgcttttcatgcgataaattattgtgtttttcatacttattttattgtctttgattctatgtattaaaacagaatgaaagcattgcaaaaataggagacctatatgacatccataaacacaaattttgcaaaaagaacatttctgcatccacatggaagatttggtcacctataatggaagatttggatacatcgcccttctttttctgcacaaatgatgttatccaacgtatagcaacctataggcagacattggggggattaatacctggtttgtcaggtattaacagctgatatatcaggtattaacaactgaattgtcggatattaatagctgatatgccggatattaatacttgagaagtcaggtaatgaaacaactactccttcctactcctgactccttgcggagcaatcccgaagaaggctttaaaggatttgctgaaataacggggagaagaaaagccgagccgaacggaaatctctgttatatttagttccggatgctctgtcagcaaagacatagcttcatccagcttcactttcaagatgaactcattcggagtcaacccggtcatttgtttaaactgcatatataatttgctacgtcccatacataattctgaagcaagcgcagtaacatcaaaatcagggttctcaaaattctctctgacaatatttacacatttcgtcagcagttctttatctttctcattaatagcttccgctacaggagattccgtaatgaccttacccgcataatgtgcaatcagacgtttcttgttttttatcaagttattgcaacgggccaccaatacctttatattaaacggcttcgttatataatcatccgctccgaacatcaaaccttctacaacatattccacagaagtctgtgctgtcaacagaacgacagaaatatgagaaagttctacattggtcttgattttatagcacaagtccttacctgacatctcaggcataatcacatcacttactatcagatccggttgtatttgttgcgccatctccagtccttcgcgtccattacacgcagtatatacattatacatcggtaagaatatatcttccagcatggacaatagttcggtattatcatctaccaaaagaatcgtaggcttatcttcttcatccatatttttctgcgattcaggttcttttatctcttccgccatcaactgtccataagaagatacagaagcttccggaataatcagtgactcccgaccttccgtcacagccatctcttcatcactgaaatgtcggtttcctaaaggtagagacaagataaacttagtaccctcaccaacagtactttctacctcaatctttccatgatgcatattcataattccttttgccaacgccaatccgatgcctgtccccaaagtaaaagaagaggaagaagaggcattatccgtctgatagaaccggtcgaatatcttcgaaatatgttcaaccggaatcccaatacccgtatcacacactgaaactacggcctgtgaagcaactttccttacttctacagttatatttcccttattggatgtatacttaaaagcattcgacaataaattaaaaatcactttctgtaactgtattggatcaaaccagacagaaatcgtttcctctacagaatcaaagcgatatgtgatctcctttttttgtgcatattcataaaaacacatataaatctgacgagtaaaagtaaccaaattctgttcttcaactctgagtttcaaataaccctgctcctgtttgcgaaaatcgagcaactcggagatcaaattccgcatatgccaggcgtttttatatatacgctgaatacgattataaacggttgtgcccaaatccatttgcatcaatacttcaatttgccccagaataagcgttaatggagtacgaaattcatgagaaatattagtaaagaagcgcaattttacttgattgagttcttcaatcctctctttttcttttcgctcaaactccaatgaagacctcagagccgcctgccgtgttttaaaacgaacaaatgcgaccatcaatgcagtcagacaaaggacataaaacagatatgcccatatggtagcataaaaaggagcggaaacatgtatattcaagcagattgcatctttcaaactctccttattttccatcgaacgaactttgagcgtatagtctccaggaggcagattggtgtaagtaaccgtagtgcccgaagtctgggtccacaccttatcgaagccatccagataatattcaaacaaacgattacggtcactattataattaaaagtagcaaattccactgttacgttattctgttgatagcttaaaaagatatccgacgttttcgccaatatctcagtcaggatgccggactcatcaccaggagctatttcgtcattgaaaataaacaatttatcaaaattcaagaagcttttgacctgagattcataaaaggaccgctcttgaaacatagccaatccattggtaccactgatataaataatcccatttttgcttcgatataaagcggaccccaaattataagtctgacgaaacaagtgataagtctcttctgtaacctctttttcacgatcaaagatagaaagccctttcccatgcaaaacaagcagacaattatcccgggcagactcgcagatataataacaataattactcggaagtactccattggtagtttcgtaagacttgaaagtatcctgtttctcctgatacttgaatatccccgcgccaatcgtactaaaataaatatctcctttattatcttcaaaaatatgcacggttttgtatcttcctaccgtcaacgtgtctttctcactatccgccatatattgagtcacttttgaagaagataaattgacgcacactatccctccgccaccaacagcaagccacatacgatgccggctatcgatcagaaacgtttcaaaagcatattcccgactgatcaatttctggacagacggatcatccgtaagcggtgagaatttctcggtcaccggatcaaaaaacaccggaccaccttgtgtcaacatcgcaatgccatccttatactcctgaatatcgttcacaatctcatgaggcaacgaagcagggtcaccggtaacatgatggagagtgtgtcccttgttcgattttaaatccagaacgaacaatcctcctaaatgagtccccgcatacaatcgattattctcctttctataaaagatcgacttgacattattactccctaatgtcccctgatctcctttatgatacatatatcgggagaaaacgccagtatccccatgataacaattcagccctccaccttcagtacagatccacacatttcctgcactatcttcagtcattttaccgactaccggaaagctgagacagtcttcacgtaaaggttcggcacaataaaagctatgattattcttatcgggattgaatacattcactcctccataataagtcccgacccaaatattaccttgcatatctttatgaagagagagaatagaagtatggcttaaagaatttgaagaacttccataacgcgtataatgactccacgtatcagtaaccggatcgtaacaatcgattcccttgaacgtacctacccaaatatgcttaaaatcatcttccagcacgcatcggacctgattatcggataattcacccattcccgaatgactaacataagcggttgtctcccgattgggagaaatacggtacaagccgttccaagctcccacccatatatttccggaactatcgcctaaaatacaattgcccttatcaagggtaagtaaaatctcttgccgaagagggtcttcacgtgatattgcgaccaagtattttctggtaaccacccatacagtctctttgtctacatagagtgctctccccacaaaacctttctgcacacgagcaaagaatgtcagctctgtaccctgtcccgtataataataaatgccgtctgcacaactcacccaaagtgtatctttcttacaaaacagtccatacacacctttctgtcgcaaacaagtgaattgctccgtataaatatccagtttaatcagatcgtttcccgaacgaatatacattcttccgtttttatctccacataattcgttaatctcattattagtcagtccatgattactttccgaaggctggaatacttttacatccttaccgttgtatctattcagtccctcagtagttcccagccagactgcccctaactcatcctgataaattgatgggatacacacctgagataatccatcagatactcccaaatgcttaaaataatgattagtggcttccgccatcaccatagataaaagacttaagagaaaggttattgttcttcgccacattttacacataattatattgcgggtagcaaaaatacaaaaaaaacataattattggttaagaatctctttaatttatacccttccagccgaaatgcagtttattcatttgacgattcttgctaaaatacagtcccacagtattttttcaaggaaaaatcaatggtgtttttaggttaaaaccatatctttgccacaaactaaaaagaataattggatgttaatcacatttacattccgcaaggatctcgttctgtaaataatctgtaagtcttcctctcattacagattatcccttacattttctccggcatattcatgtcagagttgatttctattttctaaaaaataacaactattgtaggctcaaatggttttatgcatcctcgtatgcctccatttgacgtacacctaaaacattaaaaacaatgagtaacaataatacatctatacatgatttcgatttttctttcatatgtaactacttcaagctgctgaaacgtcaaggtcccggaagtccggaagccacacgcaaagctgtaagtttcatcaacgaactgaccgatgatgctaagattgccgatatcggctgcggcacaggcggtcagacactgtttctggctgactacgtgaaaggacagattacgggcatagacctctttcccgattttatcgaaatattcaatgagaatgcggtgaaagccaattgcgccgacagagtaaaaggaatcaccggatcaatggacaatctcccgtttcagaacgaggaactcgacctgatctggtcggaaggagcaatctacaatataggattcgaacgtgggatgaacgaatggagcaaatacctgaaaaaaggcggttttatcgcagtgagcgaagcatcctggttcacttcggaacgccctgcggaaatagaagacttctggatggacgcctatccggaaatcagcgtgatcccgacatgtattgacaagatggaaagggccggatatactccaacagcccatttcatcctaccggagaactgctggacagaacattattttgccccacaagatgaagtacgggagacattcatgaaagaacacgcgggaaataaaactgcgatggatttcatgaaaggtcagcagtacgaacgaagcctgtatagtaaatataaagattactatggctacgtattctatataggacaaaaaagataatcattatctgtgccggagaagttggcaagataggacaactctccggctcttattattctttattttgcattaaaatggaaacgaaagaaataaataggcaggaatataaattacggatcgacaaagtgaccgaatatattcatcaaaacatagaccaacctctatcattgcataagatggcaggaatcgcgtgcttttctcctttccactttcatcgcgttttcacgtttctgacgggcgaaacaccgacggaatatatcaaacgcacccggattgaaaaagcagcactgctactacagaatgacaggcaactgtctgcgaccgaaattgccagtcgctgtggtttcagcagtttatcactcctcagccgcaactttaagcaacatttcaatatcactatccgtgaatttcgttcacaggaataaacacctaaaaagacatggaaaatcagattctaatttttcggacctccatcacgaagagacgcgacatcaagctcatcggaagtctcctggcaaagttcccgcaaatcacccgatggaatgtagatttcgaggactgggagaaggtattaagaatcgagtgcagcaatatcaccgcactcgagatttcggaaacactccggaatagtcatatctttgctacggagctggaataagcagttgtttcagttcctccaccccttcagaagctcctttccgaaggacgtgtatcgaacgggaagtatgtgtatccaccggcttcgggtctatcagatacacctctgctcctctcggtacataatgcagcaaacctgccgcaggatatacattgagcgatgtgccgatgataacgaatatatccgccttttctacatatcggacagctgtctcaatctccggcaccgcctctccgaaccagacaataaaaggacgcaactgagttccgtcaccagccttatcccccattttcacttcatactcttccggcttcagttcctttatataatgagggttatacgggtctctgctggaacagacctttgtcaactcaccatgcaagtgaacgatatggctgcttcctgcccgttcgtgcagattatctacattctgtgtgataaccgtcacattgaaattcttttccagctccgccagcagttcatgtccgcgattcggcttcacttccagcaattgtttccttcgtgcattatagaagttaatcaccaatgcaggatcacgctgatatccttcgggagtagctacctgctccacaggatatttatcccacaaaccgcccgcatcacgaaatgtgctgattccactttcggcactcatgcccgcacctgtcaatactaccagattcttcataaccgctcctccttattattaaaagatgtacaaatgtaatcagaatcattgaataaaagaagacttccgcccgcataatctaatccaaggtatacaagaatttaatgctgcccatacgaagacttactgccggtcatgcgaaaaactattcgtctgacagatgtgtttctttcgtctgacagttgtcagacgaaaaatcaacagttgtcagacgcaagttcaacagctgtcagacgaataaattccagcataaacaaacttaaacagtaagaacacaaagattaaatcttaggaatgaaggaattaattccttaaagaaaagagactaactttcacggatataagaatttttaaatactaaatgctaaatcattcaaataaaacgtgtacttttgcgattcataaatttgcaattgattgaaagctaaaaccatgaaggtgacatgcttcaatcttcaacaaaaacattatatggataaattcagttacgctattggcctcggaatcggtcaaaacttattaagcatgggtgcaaaaggcatcgccgtagatgactttgcacaagcaattaaagatgtattggaaggtaatcagacggctatcagccatcaggaagcccgcgaaatagtgaacaagtatttcgaagaactggaagctaagatgggcgctgccgccatcgaacaaggaaaagctttcctcgaagaaaataagaaaaagccgggcgtggttacgctacccagcggactgcaatacgaagtgatcaacgaaggcacaggcaaaaaagcgaaagctaccgatcaggtaaaatgccactacgaaggcacactgatcgacggtacactgttcgacagctctatcaagcgcggagaaccggctgtattcggcgtcaatcaggtaatcccgggatgggtggaagcattgcaactgatgcccgaaggttccaaatggaaactctatattccgtccgaccttgcttatggcgccagaggtgccggagaaatgattcctccccacagcacattggtatttgaagtagaattactcgaagtattataaataaaaaatttcaaagcaaaatgaaaaaagttagtatttttatggcaatcgccgctgctgcaagtcttgcttcttgtacagctcaagctcctaaagcaaatctgaaaacagacatcgactcactgtcttactctatcggtatggctcagactcaaggtctgaaaggctatctgacaggccgtctggacgttgatactgcttacatggcagaattcatcaaaggtttgaacgaaggtgcaaacaagactagcaagaaagacatcgcttatatggcaggtcttcagatcggtcagcagatcagcaaccagatgatgaagggtatcaaccaagaactgttcgctggtgactctaccaaaacgatcagcaaagacaacttcatggctggtttcatcgcaggtacactggaaaaaggtggcgtgatgactatggaagctgctcaggaatatactcgcacagctatggaaactatcaaagcgaaagctatggaagaaaaatacgctgacaataaagctgccggtgaaaaattccttgctgaaaacaaaactaaagaaggtgtgaaaactactgaaagcggattgcagtacaaagtaatcactgaaggtaaaggtgaaatccctgccgacacttgcaaagtgaaagtgaactataaaggtactttgatcgacggtacagaattcgacagctcttacaaacgtaacgagcctgctactttccgtgccaaccaagtaatcaaaggctggacagaagctctgactatgatgcctgtaggttctaaatgggaactttacatcccgcaagaactcgcttacggttcaagagaatcaggacagatcaaaccgttctctactctgattttcgaagttgagttggtaggtatcgaaaaagataagaaataagaaagtatctttctaaatagaaaaaggaaaggggtgcaaagtctttgcactccttttttttgctttttcctattttttttcccgtaaaagaagaataattaaaataaatctctatatttgcttactatttgataacaacaggaaattataatttattattatggaaaaaatagacaacctcgacaggcagattctagagattatttcacagaatgcccgcatccctttcaaagacgtagcagccgaatgcggagtgtcacgtgcagctatccatcaacgcgtacaaagactgatcgacttgggcgtcatcgtaggctcaggctatcatgtaaacccgaaatcactgggttacagaacttgtacatacgtgggaatcaaactggaaaaaggttctatgtacaaatcagtggtggccgagttacaaaagattccggaaattgtggaatgccatttcactaccggtccttacaccatgctgaccaaactctacgcatgcgacaacgaacacctgatggacttgctgaataacaaaatgcaagaaataccgggtgtggttgctacagaaacactgatttctctggaacagagtatcaaaaaagaaattcctatccgcgtagaaaaataacagaatggaattcctgaatgaatatcaccttgccgggttatttatcggaatttgtacctttttgattatcggcctttttcaccctgtcgtggtaaaggccgaatattattggggcaccaaatgctggtggatattcctgatactaggcattgcaggtgtcgcagcatcgctgagcatcgacaatgtcattctgtcttctctgttaggcgtatttgccttctcttcgttctggaccatcaaagaggtctttgagcaggaagatcgggtgaaaaaaggctggttccccaagaacccgaaacgcaaatataagttctgagaagagaaagtattgtagttttttattgttaggacttgcatatttcaatagaaaatactacttttgtcaccgcatccagtaaacggatacaccggacttgtagctcagttggttagagcaacagactcataatctggaggtccctggttcaagcccaggctggtccacaaactaaaaggctgattcctaacggaatacagccttttttgtttgcagaccctccagatataactctgttgctcttggttgatttactcctattttaagcagatgttgactaattgttgactaattaaaatagagctaatatgctgactattaaagctgagattaaaaggagtgaactaaaagttgacggaacttataacgtcaagattagattcacattagaccgcaaggtaaaacgcttatccaccaacctgtttgtaactcaacaagacctaactaaatccctcaaattcaaagaggacacttccattaagagagaaatagataggcttgttctctattatagggaacagtgcttaaaactgcaattagaccaaaatcattattcattggatgagataattgagttcctaaacggagagcaagagaagcaacagaccattgactttataaagttcagtcgtgagtggatagcttctactaccataaaaggagcacccaattacactactgccatcaatgctttggtacggtttgtaggtaaggaagaattggatataaatcttatcaccttagacttcttggaacagttcaaagcatttttaattggagaacgtgatgcacgtaccaagaaactaatgcagcaaggtaaacgtgtgacctctaaccgcaccctttccctctacttggtaagcatcaagaagctgttcaatgaagccaaacgtaagttcaataagaaagacaagaaccttattcttattcctaactcaccctttgaggacttcaagatacctaaacaggaagctacacgtaagagagccattccagcagacatcattaaaaaggtgtggaagctgccttataaagacatgaagaaaggatataagtccacctgccgttataacttggctaaagattgtttcattctctcattctgtcttattggaatcaattcagcagacctttacaatgctactaaaatgagagggaacactattatctataacagaaccaaaaccaaggctcgtagattggatggtgcaaagatgatggtagatattcctaagatagtgcaacctcttattgataagtacaaggatagcacaggaaaacgtctgttcaacttctatcaatattatggggatgaaaagacatttaacaaggctatcaattctggattgaaagagattggttcaatattagaagtagatgatttggagtactatgcagcgcgccattcatgggctactattgcattgaacaaagtaggcatagacaaatatatagtccatgcagcccttaatcacatagacgactcaatgaaagtgacagacatttatattgaacgtgactttgtaaatgagaacaaggctaacgccaaagttgtgaagtacgtgtttggtaagtaagctaataattcctcacttgcagcaaatgcaggtgaggattattttttaactttgtactgaattagagcaaaaagcattatggatgataatctgttcattgaatatataaactccccttatgaagagccacaagatatgctccctaagattgatgaaactatgctgactgatatggagagtagtttagaaactgatttcaaaaatgaatatcagcatgaagatgttacttctattttggagagcattgaatatatcagaatctattgtagaaacttcccatgcttcaatggcttcgattatcaaccactccaagctccatttgcatactatcgtagtagagaaatctatctaaaagaactaccctttacagaagatggattttataaattcacgtacatacaggatgcaataaaaaagttagggctaaaagctcaacctacatttgagtttattgcattcttatatcatattattaaggtgtggagcgagaatcagataaccacaagtgggacaaagattgataacattctctacttattgaaggagcaacccaataccaaattaactatgaatattaaggtaggcagtaaatccttcgagtttaacaattcattgttcattcaatctttattggagttctattcttcccatgaccttgtctctcatggtctcattgaaagagagaataagagagtgagagaacgtaccatccaatattctttggtcaaaacattgttagactatcttcccatcaaaactgataagtctgagggagtcagctttgtacaggcagaaagagacttagctttatgcactttatatctatgtaaattactaatgggtgaccctgcatacgtttgtaccaaagataacaacgctacatttgacaagttgatgagagacttcaaagactttaatattacacttcataagatgctaacctaatgatattcagcaacgtaaaaacagggatataaaacttactcttacataccctatttaagagacatatctttgcaccgctttcagaaagctggcaggcacgttgccacagactaatcactgaaagccccaaagacatgaagaacttaaatttattgttcatcgaaggtaaccgcactaaaattgacaactctaacgtagttgaatcttacaacaagattaaggcatggggattcatcgaaacaatgcctattgaatacttcccaatggaagaagctaagaataaattaggcggtagaaagttgtacagacctactattactcgtaagaaaggggaaggctctgctactatcagcaatttcgagattaaaatggttgaagtacaggaagcagactatgacaagtacgacggtgtttgtggcgatggtcagcatagaacaatagccctcatgtttgatgaattgaaagatgttacagctacttatcagccagtaaaactctctaaagagaatatggatatattggcttacatatcaatacgtaacaatggcaggaaatggtctaatgatgatttttatgcttccaatatttcaacaggagatactaatgcagactatatccttaataaaaggaaagaaggctatattcctgcattccttttcaatgtttatactcttggaacatctaatctgacagcagcacaaatcaagtcaatccaacaaggatataagaaactctctgactttagtaaagttcaaatcagcaaagatacacaagataagggagatagaatcttagcggcattagaatctaacagcttcatctctaatgataggtttactggacgttttggagcaggactgaaagcattctttactgaatgtaaggatatagaaatagttgtaaacactatcaaccatatcaataaagagaattggaataagtacttcaccccaattgcaggtcagagcatggaagccaaatcttataaggaagctctaactaaattgacagaacaaataaagaagtaacctgttcgatagcccatgtgacaggtgggcttctctactccaaattcttgggtttagcatttcagccttatagaactatctcaaattacccattatatgaactttagacatatctaagattctataattggggttacagctaacagatttttaaaagccaacaatatatgataaccaagttagatattcaagagaaagatggattccttaccatgaaggacttccctatgaactgcatctttaataaggtcaagacaggttgcggtgctactaccatagcacttaccaataacgagaattatatcattactgttccaaccacagaactgattgagaacaaatgctatccaactaaagatgcagatggtaatgtgaagttctggaagaaacatgaacgcagagcaggattaagtcctgttgttaataacctgtttggcttatatggaaatttcaccttagagctaaagaaaaaattaaaggattacttatcttctgttggagtaaagaagattatctgcacctatgacaagatagacaagttgatggagtttatcaatcctaaagactttaaactgacgattgacgaataccacaacttccttaaacaatactcattcagagacaaggctattaatggggtgttggctcactttaaagagttcaaatcctattgcttcttgtcagctactcctattccaaacaatttgaagccagcaatcttcaatgacattccagaatacatagctgattggaatacaacagatgatattactgtttatccttaccatacagacaagccttatatggtagcagccaagtttatcaagacctaccaagctaaaggttgtctgaatgtgaacggcatagagagcaaggaagcatatttcttcattaacagcgttacagagattaaagccatacttaaacagacacaactaacagaggatgattatagaattatttgtgctgacaatcctaagaatagaagaaccttagaagaatatactatatcaagttctgctgacgctcccaagaaattcaactttatcacttccaaatcatttgagggtgtggacttccattctgaaacaggattatgctttgttgtcagcaatgttcagaacagacacacattggtcagcattgatatggatatacctcaaattgtaggaagaatcagaaccaagtccaatccatttagaaataaagtagtccatatcttcaacactaaagctactgaccattacacaacatttgaagaaatggagcagattgtggataaggaagtaaaggcagcacaagaaagggctgatatgcttaataataccaaactatcagaagcggcaaccaagcaacagattaatgagattaagaaagttgggattgaatcttacctatcttatcaagagaataaatttgtcgttaatgatatggtagccaagttacagctttacagctattatattgctactgtggtttaccaatcagacaaatcattaagagaaacttatgcccaatctggaatagtaactactaaaggtaaatggcatatcgcaccagagaagtttgtcaaggaattaattgtaaagccaactttcagagaactacacaaacgatattgtgaaatcaaagcaaacccaatgacatttgacttgcaaaccattgatatagaacatgaatatccaatcttaggcagagcttaccgccaacttggagtgaaagaattaaagcgattgcgaaccatcaaatccattcaagaggctttaggtgaagcataaacctatctcataagatgattacataagtttatagtgtaacgagcgaggaggtacactacattattatcccccctcatggctctaaataaaaaagaatgctttagaaatgtagtccaacggctgacaggaataagcattcttattaatctaagaacaggcacgatgcacgattatcacagtctgccaataatttactaatactcctcatttcctttgaaagaatctttagggaaagacataggacagcctaagatgcaagcgaagaaattcacttgtgttttaggtttgttcttgttaaatccattcaatcaataaccatttaattcaatttcattatgagagatttagtaattatgccagctatggcacagcgtagagaatcattaaacatgggtgagtttgcagaagaagcaattattgtggaagaagttgcagcacccaaaagagtaaaccatttcattgaagcaaacacacaggaagtaaccttacagcacttacagcaagactgcatcattccaagttttgcatcaatggaggaaaccataagccaccaatcctttataggtgcagtagtagatgcagctaaggattactttcatggagaacagtttgatatgccagagattagaatctcacaccctatcaatggcagaataccaagtgcattaggtaagaaagcatctgaattgacagacgaagagaaaactttgttctatcagagaatgtgtttctgttttgaaattccatccattgtacatgatgaatacggtaatcgtttagcgttatccattggtggagtgagagcatataacgagattaacctatacagtaagaagtctgttgagagatttaaaatcttcataggctttcgtaatcgtgtgtgctcaaatttaatgcttactactgacggcttgcaggataagatagaagtcctaagcatacaggaactatatgcagcagcattgaatctgttccatgcttacaacccatccaaagacctgcatctgttaaggacacttgggcagatgtcaatctcaacgagtgagttctgccagataataggcaggatgagattatatcaagctcttacacccaaccaacagaaacgcttacctcgtctattattaggagacagtcagattaatgcagcttgcagagcattcgtttctgatgcgaacttcaagagtacaggggacagcattacaggctggcagctcttaaacctgctcaatggttctgtgaagtcaagttacatagataactttttggagaggaatcttaattgcacagagttcgtacaaggcattcaacgtgccaaattaggagatagtgaatacgcttggttcttgggctgagtggattgttgattgagagaggaaagggcagctattcaattagttgtcctttctttatatctaccagcttattaagacatcaaattatggatatagattatactgtgggagaagtggaactgtcctacaaacccaaattcaagaatatatataaggtagtcagttcagaggatgcttataaatatttgcttcctacatataaggagggtacaatctgttacaaagaatatttcaaagtcttgtttctaaaccaagccagccaagttttaggttacactctcatatcagagggaggaataacagatacgaccgtagatgtcagagtaattctacaagctgcattgctcaccaattcagtagctatcattcttgctcataaccacccaagtggtagcatgaaaccaagcaggcaggatatggagattactaagcaggtcaaagaagctgcaagacttatgagaattacagtaacagaccacctcatattaacagatgcaggatattatagcttcgcagacgagggagaattataataaggtagagggcactcaatttctaagttgggtgtctttatcatattcacttctactattagtgaatgttccattaataatcagtgagttagtaaatccaactcagaattaatattcacttctattcattaacttataaaacagaacattatgtcacttaaatattcaagcacaaccgcagactatcttgtttggtctgatgcaatgaacctaataaggaagttagccaaagacgagaattataaaatctcacttcttatagctttaggatgcttcacaggattaagaatatctgatattctatctctaagatggaagcagatattagatgctgacgagtttacagtaattgagaagaagacagacaaagtaaggactatcagactgaacccccaattacaacatcatattaaagagtgctacgagcatataaatcctgttggaatcaatgcgccaattcttataagtcagaaaggcactatcttcacagttcagagaatcaatatcattcttaaagaggtgaagaagaagtacaggttaaagattaagaactttagctgtcattcgcttagaaagacatttggtaggcaggtctataacatgaacagcgataatgctgaacttgccttagtaaagctgatggaactgttcaatcacagttctgtagccattactaagagatacttgggattaaggcaggaagaaatcttgcagacttatgactgtttgagcttctaatgattgggacaggattattaagatacatctttatagtggtctgaacggttctgtcccaaatcaatgaaatattgagtttagatatatctaaagtccaatcttgacagttcggcatttcagccttatagaagtaagtcaattccataagtttacagattttaggattatctcaactcttattaagcatgttacagataacacttcttaaatatccaacaatatactgacttaaagatgataattcaaggcaggtaagaatattcagaatttactctttatatgaggagaagtgaatttgatacccacatggatttagagagtttagatgcgactctgcttaaatactccattaattccctgttttgtaacacaataattactatttctccttattccatgcctattaatttagaacctttcactatctttgcaccaattccaatgaactaaggagatagagagttggaaggacatatttaacgaaaggtgttattgaaattatcttctgtttcttagattctcgcaaaatttaaaaacggtacgaagatgataacaatagcacccacacatttgatatatattcatcgcttaggtgaactatataccttttggtgtggggctattgttttatccgtaccaaaaggcaatgcgagaagcccaagaaacaggataagacaaatatagttcccacacctcttttattttaacagcttatccatagggaacagataagcactaattatcaaacactatgggtttatttggtggtatcaatgctgtaaatgaaatcaattctcttattgctcaaatagagagaaacatgaatgctttagctcctatgatagaattgaatgggatgaagcataccacacaatctaaagaattaacaaagttagtccgcagggatttggatagaattaaagacctgttgaatcaacacagttctgccagaatagctgtttacagacttaaaggcgacaaggtggattctacaacattggttggattccttgaaatgtgtcttaaacaagctgaaagtcttatataattatggatgcaaatgatattaagttaggactgttcattttagttatagtccttataggtgctttcattggctattgtttggcaagttaagacagattactaaaacagctatcacatgaaaatatttcatctattagggttagtggtactgctattatcttcttgcgatgatacttctggtacatatataatttctgaagtcgcatttaaagttaataacctgtctgaacaagagaaacagaaaactatcaatgagtttatcaatcaagaagtgttacttacagttcttaaaggaaagatagaattaacattatctaacaaaccaaccacttctaagataactctacaacgcgtgtctaataactgttattcaacgactgatggaaatataaccattaatttagaattggagaaaaagaactttgtacagaccaaatataaattgattgaatatggtggcacagatgacaagttctttagcttacatatgactttggataaacaataacaaatttattgcataagaatcaatgagaacatttagattattagcaacttcattattggttgcattgagcatgggagttagctcttgtagtgaagaattggatagccaaccaatggaatcttatccagaaggtggtgagcctttagatgtagtttgtaaagaatatggcattagtgactatgaagacatagaattactttcttactataagaacaatttggagcaagctaacttctctggcttacgagaagagaagctatggcttgcatcattcaatgtaaaagataagtcgcctattattaattggactgacgaattaccatttaataggaatcgtaagatttacaaaggctatggagaatatgaagatgtcaccattcagcagataaccatgttgcaaaccatgtactttaatccgaaggagtttgtagcatcattaagctattactttggtaaagattatggttacctcgctttactctttaggcatgatacacaaactaaagaagttcaagttaagcgtagtgaaatacttgctggatttcaatattctataataaacaatgattgttgttactcattgtctggcgatacgctctatatagcagagaaaggctttggatattccaatgtaggaactctctatacttctgaatttatatctcacgaagaagcaatatacacccatagagataataaaggcttctttgtaggaagacggaatttcaaattgggagaagatttatggcatatccaagtaccacagctaaatgatgaacctgctgatgctaagattgaggttagtgtagaagataattccaagagagtttggaagtacaatgtcaatattatacattatgatggaactaagaagaatgtaacatttgaagtggatattgacaacggtacaattaaaggagagaatgattatacttctctcattataggtaaatggaagaagacaagcggtgatgctgttgctacccatgttacttataagaatgatggcacatttgaatatacaagtacagaagatagctcttacaaggaagtgggcaagtacaagatagacggtaacaagctctatgaaatgtacagcgatgaagaagaatggattatcaatgatattctgttacttaattctatgaccttatcagtgcaggaattggaagcagacggagttacacccacaggtcagaagtactcttatcagagagtggaataaagaacttattcatactaaaagtaggcagcatttgaggaaactcttatgctgttttcttttttatataagcactacgaatgttacatactaacaacccaattctttggaatataggaaactaatatttaactttgtaccgtaggtttagctgttgactaattgttgactgataaacttccaatgagattattaatacgttgacatattgcaatttaataggatgaaatttagagcctcataatctggaggtccctggttcaagcccaggctggtccacaaaggaaatcaagcagttacgaatttcgtagctgcttttttcttgctcttgcgtaaacaatgcgtaaacaaactgtttgagttgattatgtttacgcatagaatttctatgaaactccatacaatcctaatttctctatatacggggtaatagcataagattgcgttgttttccactcatttgcctgttaaataagctcaaatatattccatttgcatatttgcaagaaaaaatgttgtaattttgtagatgcaacacatttatggtaagccatgacttcaatggtgctctttcttgaaaaagaaaagtgagtttgcctaaccttcgtgggagggtcatcccattccgatgaatcgaagcgtaaagggagtgttagtcggagggcactctatgacaaacgaaacgcgggagttgcttcaggggttgagaccgattagcataagcccggttaccagtcagcgacagaagacaacgagattgcaccgctgcatataacgacaatgtttttatccgtttaaggatagggactctgtagttatatgcagcgttttgtatatgtatgcctcacgttgcaaagcgtctgtattcagaggttatgttgaacataaactaatgaatgcaatggaaaaattaacgaaatccatgccccttttcaaagaacgtaattgttctgtctctatcgtgttggattcacgtactcgcaggaaaaatgcgtatgagttcccattatcccttcgcttcacgattgaccgcaagttcttttatcttacagtcggaagttcttttagcgagaaaaagttctcagacatctgcaatgcaaccaaatgcaagagtgagaactacaaacttcaaaaagagtggaaagatacctttgtccctaaatacaagaaagttttgagtaatctgaacaagggtggcatcctgacatttgagatggtgcgccaatgtattataggtgaggatgtggtactatctgaagaggaaacaaccaagtcacaatcgtttatcagtatatgggagcaagttatcaatggtttcaaaacagatgatggtggagcacgttttaccacggccgaaagttacgagtgtgcgctcaaatcattcaggaagatacttggagcaaatacaattaagggcttttgtatcagtgcagcagaaatccagaaatggaaagatgggatgcacaatggggttaaagacgagaatggtgcagtcgttggaaaaatcagcgacaccacagtaggcatttatctacgttgttgccgtgccgtatggaatcggtgtgtacacgaaggattcctcaaagatattccttatcctttttccaacaagaaagagaaaggtcttgtaagcatacccaaaagtgcgaagcgcaaacagaacttcttgaatgtcgctcaaatgacagaactctataacctttttgtttcaaaggaatatccagaacactggacggaagaatatacgcaacgtgcccactactcattgggactattccttgcccaatacctttgcaacggcttcaatatggctgacgcagggcgattgacatacgacaactactattacaagacagatggcaaggctttccgcttcaaccgaaagaaaacctcccgtaggagtgctgacggttcggaagtaattgttcctatcatccctcccttacaatatgtattagacgagatagcggcaccacccacccgggatggttttgtgtttcccgatatattaaaaggtgcggaaacggaagagctgcgccgtaagtacaccgtgcaggagaattcaaatgtgaaagaccgtgtcatcaagatttgccacgaggcactgcattgggacaagtccatctgcccgtccggtacatggtgccgtcactcgtttgccaccaacctgcataatgccggagtagatatggactatatctctgaaagcatggggcatgcttcatcagaccatgcaatcactcaaatatacattgagcattaccctctcgatatacagatgcagaacaactcaaagctgctaaacttgggagaaacttcagaaagggatgccttgttggctaagctggcaaatatgtccacagaagaattggctaaactattcgcataaccttttatagagtttagagtatgtttgatttcatagaacggataaaagatttcaatttgaggaaggagcatacggatatgcttattcgcgcatggaagactgagaacaaaaaagtttattcggattttgtaagacggatagaagcagtcaaaaaaggtgatatgagcattattaccgaaatgatggatgtcgctaagaactgtgttccagaagaagtacgggtattccataactggttaggagatgtcttgaatgggaaagtgaagatggcagatattacccaaagcattcaggggttatccattgagcatatccacatgatagcaaaatgccttgtctataaagaacagtggatggccatagatatgaagaccggagaggtaaaagtgacctccaagaaagtaaacggctacctgatggttcgttcgggaacaccgatagagatatggaatcgtatgtctgtagataaaagagtctatatcgtcagccagactgaggcattgatgaagaacagcaaaggatgctggatgttcagcaaccttgaaagaaagatgatatatcaggccataactttctttgcaagacttatattccttacatatgcatcggcaacaggacatttcctcgctaacctctacgaccttgtcattgagcgtaaagacaatcttccttattgcatgtattattatgttgtctttgaccacggactgacaaagatggcgatgctgctaaatcagtttctactatcagagaacattgatcagggaagtatgctaatggtgaaagattgtatcaatgccctagttctgcacagtcttgatatgggaactgaaacaaaagcatcatgggaaaagactgctgatgaatgtggagctgacatctggaaagaggttgcgtttcttcttcgtagtatgaaaggcagacgaggaaataagaaacaggtaatgaccattgatgacttgattgtcgggaacaaagccgaggtaaaacagtgcattatggaatttctggaaacaaacactgaagacatctgccttgcctatctgctcgttgttcttgttaaaaccgaacatattaaatcctcagtgaagtatatgacttttcaccgcgccatcgaacaacttacccaacgacactacggatatgatgttccccaaaagcgatatggagagatgaaggagtttaatttcaagtgttctatgcagagtgccagttataagaaagccaagaaaatcatagataggtggacaatctgttttgaggagtgtaaataacacattcctcttatttttctatccaaatctttattcttccctctttttcagttaatacatatagaatattggtcggtaagtttaaggtataaataaaccgaccaatacacagagtttcatcctctacctttgcttgtgaaatcggtttcacagagttgaaccgagacttaaaatgtttaattaccaaacaagtaaaggtatggaagaaaaattcaattttacccaattacttcaaaagcccatcgctatgatgacgggcgaagaactttgttttcttatcggcaagagtgtggagagtatagaaaaacccacatcgcaggcaacctccaaaggcaactattatggcattgagggcattgcccgtgtgttcggttgcagtgtacccacagccaaccgtattaaaaaaagtggtgttatagacaaagccatcacgcagataggacgtaagatagtggtggatgcagacctcgcactgtctttggcaaaggaagctggtagcattcacatcaaggagtgagcgtatggatgaaaattggaaacaacaactggcaacagacagttatggaaatccggttcgttccatcagtaatctccgactcatttttaccttagatgagaacctcagtcagataaggtacgatactttttgtcaggatgatgtgtgtttcaatcctttgttccgcaatgtcaatggcaataagattgatgaggagtcggtgggaaagatacaggactatctggaaagaacgtacagactacgcttgacacagaacaaagtatttgaaatactaaaaacgacctcatcggaacggagtttcaatcctgtgcaggaattcataactcaagagacatgggacggacagccccgtatagccacggctatcattgattatctgggggcggaggacatgcctctcgtcagggaacagactaaactctggtttgtggcagcggttgcgcgtgtgtttagtcccggttgtaagtttgataatgtactgactttgccgggaccacaaggtatcggaaaaagtacattcttcaagactatcagcggaaagtggttcaacgattctttctctttcgccagtggcgataaggaaaaagtagaaactattaccaatggttggattattgaaatcagtgagttaaatggtttgaaacgggcgaatgatgtagaagcggccaaggctttcttgagtcgttgtagcgactatatgcgtcctgcatacggacataaggtagtggagtttatgcgccacaatgtctttgcggccactaccaatgagacaaactttttgcaaggggacaatgggaaccgtcgatggtggattatcccagtcaaaggcaacggtcatgtatcagattggttggattgtttgcagcattccgttcctcaactttgggcagaggcatacacctattatagacaaggaatgaaactctacttgtccccagacatggaaatcgaggccaacgaaatacaaatgcagcattccaatatccttgttgacccaatcatggaggatattgaaatgtatctggagcgtgaagttcccgtgcagtatgcaagttggatgattccgacacgactggcttatcagaaaggagcatactcagaacccaattccacaatgacctcactcaatatggtttgtgcccgacagattatagaggagttacccaatgacttggtaagacgcaatacgtccaaatacacctcacaatatatcaaccgcttgatgtccatgattcctaattggaaacggagcaaacaggagaaggtcaagggtttgcatcctgcttattgtgacaagacggggaggtcaaagcatccttgggtgagggtgggtacaccgagcgaagaagtctgcgccacattaccaagtgaaccggaattaccattctaattttcaaaataagggaaaagaaaaacataatgtccctttgtccctatttcctttgaaaaaagaatagaaacataaagcagtgaaaagaaaaagttacaaaatatgcttgggacatgggacaaaaagagttgaaaatatgagaactgaagaactgatagaacgcatcagcaaacatgagcctttattggcaaaagcagtcagccacatggttgcgtatgttcaagaccgttatccctccacgtttccgagcaaggagcagactatggcggtaaacgaatacctgcatagtgttcatgcggacggtgacggcagtatgtcggaagctaattgcgagcatcgcaggattgcctcacagcgaatcactatcgctgccatccgtatacttgacaccgaacaacaggacaggcttcaggacatacttgaccatattgcatacgacaaggagtattatatgccggagagagggcaaggtatgcgctactgacttttcttttggctgtaccagttttagattatccataaacagacgaatgatgaataaagatttgagctattgtatcgtattatcatcggaacagctttcctatttggcaggaagcaagtacggcattgaccgaatgaagattttgaaccggcttatcgaagcgaccgtgttggaacaaacggagtattccaagaaaggctttgccatgacattgcaagtcggacaggctgccttgtcagaagtggaattgtcctgcaaattgggctatgacaagaagaccatctcacgtgtgatagacaagatgaatcagcttggcattgtcgcatccgttcaaagtaaccgcacgagtattcacacgcagaaatgcgtatcggcttggatgctggacggcaagcgtatcgacaaccctttttatgtccgaatgaaaaaccgcaaggacggcaacgaaaaaacggctaatcgtccatacaacaacagtattcttccaatgaaacaacagcatattttggagagcaacgcagaagcaaattgccctacccaaacgcaaacagacaacacagccgtatcggatgaaacttactcccctgatttatcgacttcaccaacatcaagcgaaactcctgttacagcttacgatgacaaaaatagaaatggttacgatgaattgaaagccgaaacaaataaccatgagcttctccacacccctacaaccacatcaggctatgagattgcaggcaatggaagcgacaacgatgctgcacaggtaaattccacttcggcatatccgactacgacattggcttctccacagcctttggcagaggaagaaccaactaatgaccaagggaatgactggcaattataaatctttcagatacagtaaaatgtactatgttatagtatgtagtgttacaagaagtgcctatgtcgcacaggctcgcttcgcttgccagtaccacataagcgtattccggcagtcgcaagctcccaccgtgctgtacttttttagataagatgtttcacctgttataatacagaaaagaatgaagaataaagataatgtcaaacagattgacgggaacaaggaagaggaaaaggataaaaaagacacaagacgaatcctgcgccttgaagccagagttacggaagacgaatatgccaaagctgcggaactcgcccaatcctgtggtttgaccatgagtgactatgtgcgcaggacggctttagggcatcgtccgcacctgcggctaactgagcgtgaagtggaagccctgtgtagcctttcggatgcgaggggcgaccttatccgtgtcgttgctgccgtgaagtccatccaagcggacaaacgagccatctatttcagcgatacccgatttgtggagcaatggatgaaagctgccacaaagctcatcaaccgttggaatcaaattgaagcctaccttaacgaataaatttccccacctgttatgattgcaaaagcagctaccatttcgcatggctcaaatgccatcagatactccgtcaataaagatcgggcagatatagtcaagaccaatcttctgcccgatgacatatcgcccgaagcgatgttcaaacgaatgatgcttgtgcagaagatgtttaccaacgagaggaagagaggcagaccgtttaccgacaatgtgataagaattgaaatttccccatccgcagaagagagcaagggttggacgatggatgactgggcacgtttggcagacgagttcatccaagcgtttgattccatagacctgtctaaaaagaccaaacgcgcttcttcaaagcagaccaacctcaaaggttcgcaatacgttgttgccctacatcgagatgccaagagtggcattctccatctgcacattgatgccaaccgtgtagatatggagggcaagataaatgacggacacctgtccggcatgagggctgtaatggctgcgaatatcatcaacgagcgttacggctgggtgcagtccgaagaaataggcatacggcacaggcaggaggtttcagactgttgcatggagatactgcgcaagatggatgagttcagttgggaacgctacgaagcggaactggtgaggcatggctatggggtacacatacagaaaaatgaggacggcacggtttacggctattccatcaagcgagggaactcaagttataggtcatccaagttgggtatcggtcgcaaccttgtcccctcaaagattatgaagacatggcagaaattgcatccgcaggagggtaaaatcaaccaaccgcaagcggaagacaagcaaacaaggacagccacaccgactgccatttccaagccacagactacaccgcaacctgtaatgaagcactattccattggcacggatgacaacaggacatttgccgtttccctatcggaagccgcagactgcatcatccgtcaggagtgttctttggaggaagcacatccattggctaagctggaagagatacagcacacggctcttctgttgtttgccggatatttggatgcagccacgagcatggcggcttcaagcggtggcggtggttctgatacaggtggctggggacgggacaaagacgaggacgaacttgaatgggcacgccgttgtgcgagaatggcgaaccgaatgtgcaagcgcaggaaagggcttcacagataatttttcaacccaatatcaaaggacatgagcataggaaaaccaaagaatgaacccatagacctgaacggtctgatgaacgagatagagaacgaccatcggataaccgtggaatcggatgccgttgataagcgcattgaggaattgcgagttgctcaaagggacttacggcaagcgaccgaagcattggaaaaggctacaatgactttgaatgaagccattgcagcccttaaatccgctactgatagttccgccaatatcgtgaccgggattaacaacgccattgtcaatgcgcaagaaaatacaaagttcaaagttagtattgcacaggaagatgtggaactgttgatgaaaaactcacaagctgttttaaccacggacgagattgtgatgaaacgccattttgagaagcaagctcaggcaatggaagcccacgagcgaagaatttcatccattctcagccgaaaccaaggcttttgggtttccgatttttgggcgaaagtgttttgctgggttattttagtgtgttttctgcttatatttatttcttattacttgaaaactcgtctgtaaagcataatattaatagacctgtatcaataatagcaaacaatacatatcacgagataagtttaatcctgtataaaccatcgaatatcaaatacttttcgtacctttgcaattggattggaggaaactctatccaagacatattagaaaaagaagaagcgttatgcttatcttgtacttgaaaacgtaggaaattttcaaattggatacaaggatagcatagtggttctcacgctatagcgtgggctgctattgttacatccgtatccaaggtttcctacgaccttcaagtaagagtgtggcatacagttccacgcttgaaccgaatattgtaaaacatcaatctgattatcaaatattaatattgggaattgtgtggtaatgataccatatagttcccaatatttgtgaggattagcctattctttcttgtgcaacctcaatggcttttcgctttaattcgtcttcaccttctatagcatccaatactttgtctgccagccatagtgtaagaagttcatttttatcaatcttgaaatactcagctaattgtattacttgtctccgtttggcatatctatcgccacgttctattttgctaaacattggagtgtctatttcaagcaaagctgccaattgcctttgtagcacaccgtgttcttctctcaactcttttattttgtctcctaataacatggtctttattcttttgagttcagtatgtgtttcgtcgaatttcgacggatttaaacattttcgacggaataggctgtatcttttcgtcgaaattcgacggattggctataatataaaccaatttcgtccatctgttctaatcaattcctcggctttcataactttcaatagatcaccaaggctgcgtagtttttgctcttcagtcttattgctaggcattacatctttgatgtattcgtagatgccatcacgtttggctccatctgatccagcattcttaagatattgcaaaaccatctgtttaattttgtccttatcaagtcctttttgcttggtgtaaccttgcaattgacgagtggctttagcaactcctaaagaaattgtataattgggagcatcgccctcaataagtcccctgttcagcaagtcttttgcaacatcttcatgtatgaatctgcctttctgcacagcatcgagagatatgcaatcccataatgatagagtgttgtcagtcttcaataaatccgtatatcgtttattgatctcgttaccatatatgcgtactacaactttcttttttgccgcatcaatctcgtagtccggcatcggaaagtgtctgcgccattgttcattaaacattttcttgatgccacgacttacggtatcaatcatattgaagtccaccattgccttgcataggcattcattgcggaaataggtctgagattcctcatttctcaaagcattttccaaagttccggggatgaaagtaccggcgttggaataatataggtagccgggattctcaacgaaattgacacgctgttgcatcgtgtaatcttgatgagcaatgcagttatgaagtgcttcgcgtatagtgtagtcatcatactgtttcattgtatctgggaaaagcgtaccaccaggcatttcacgcaaagtcagattttcaatctttgagagaatttcatctactgtcagtatgaatggaacagtgaaatgttcgtagtccaccacatcttgatttgcatccctgcgtgtccaagttacctgagcgacaacaggacgcagtttaaaggctgattcgtatttgcccaacaatatgatagcggcacgagtgatgcttccatttcttgtcagtccgcatttgccaagaaatgtctgaatatcccaagcatttacctctgattcgggaatacgactatgtacctttttaaacattttgcgggctttagctatagcaacttcgtcaaggtcatctatcgttgcatcaggaacaatctgtgcagaccaatctgtttcgccaaatattggctcatcaagaatgacattcatgcgttctgtggtcaactctacaagagaatcttcaattcgctgccatgctttgttatgagcgtaaacaggcaatttgggacgatgcttgggaatatggactacccaaaccttcttgttagtgtcatcggtaacaaactcttcaatatcaagaccttctgtcgaaagattgatacagcgttccgttaaacgaagaattgccttttgccggtcatagttataggtatcagtcccgacaatttccaaagaactgtcatgtacccctatcactaaatgtcctcctcccatattggcaatagccgacacatatgagatgatatcgtttttctcatccccacagaatgagttcttcaaattcttgaattccttccattcgcaacgagcattctcttgtggatagttgcgaaggagatattgttgtagttctgactcttgcataattacccaattatactttcactttcatcattatgtttctcagcatttctgatgacgcattctttacttgtattggcatagcagtagacacagaaatgacggcaagtattatacatgccgatgtctttgctgatcatacatccacataccttacgttgccctgtatcctttacattacgcaccttttctggtattggtggcaaattaccaaacaagtctttttctggtaatttcaatgtatgtagataatagacaagttccttatcgtcagcaaaaatgcgtttcatcaattcgccatcaatgcaacgattgtgttctatcccgtatttttcaaggtcaatatcttcagcacaagtggcgatttcaacatcccaaccatctttgtgccaagcttcacgaatcttttgaagaccttctacaatttctattcgttgagcaaggttggcttcggcattctccacattctcctttgtaaagagcatactttccttaacaagattgttttgaaccttgcgatatgcttttacatcaacgaaactgaatacaagcttatttgtgtaacctttcagtttatttccaatgtgccaaatgcgcgtcaagaggtcacgaggagcaatgtttggcgtaattattaaaggatcaaaacgccagattactttctccttaccaatcatatcagaaagtttcttgaatgtctcaactctgttttcgacagacgaaacattaggctcaaaaccttcttttacataatcgttgagtgtaacctgaaaatagtagtgtatttctctttcgtcaagctcatgaaggtatgggaggatcggctttgggttctttgtccagaaaatcaccaccttgcagtttttgaacgaaatatacattttttgctggttgaacgggttataccaagcacaataccctttagccaagcggttgaagaaccacttggcataaaaagcaggaatatcggttgaacgacttgcagagacaatgacaggagctgtagcttctacttgttcacctgtatcgttcgtgataataattttacctgttggcataacgattaaataaatcttgcattaactgctcaaagtactgtttattctcataagttccctctacgataggaggataaccacctttatcataaaaacaccaatgcttaaaatgatcaatggttgatctattatctatagggttgcccaatggattagaatagtatttaccaccaggagcataacctttttgaaatgttattacctttctggaaagcgtttctcgcatttttataggtaggtagtttcttgaaaggataaaatagttaacatttgcatcctctacaaatttagatgatgttggatgtattggtttcaggtttcgcttttcaacaccatcctgcgaaataacattatttccttgtggttgtggatacgaagtcgtatttaaacttttaatacttgaaatcagtttctcaatcttcttatacgcagcatcagttggtttcaagaagttgtcaaggatgctcaagaacgcttctggatcttgccttttactctcaagttctatagctttatcaatattttctttttgggtctttaaaccttctttacctacaatcgaataaattttactacggaattgttctggtgtataagaaccctcatctcctgcaaaattaacagcatcaagagctttgtacgctttagttgtagtaatacgtgagaaactactaaaaatatacataaaagctttaggactttgaactatattttcaagtttaacagccttatttaccgcctcaacaactttctgctgttttacaacttttgactctacattattttgattctcaataatcttagatcccaactgactttctacaataactgaagtactattgctcgctttgggtaagacagcatcctttatttctattccattaagcattcgccaaacattacttgcaaatgattgataataatccttattgccatttatcaatacagacgtaaatgtctttggcagagacgtaaaacctcttgtggcaccatagatgccataagctaacttataattacagaatcctacttgtacaaggtactctaccaagcgatcaatgttatcgcctttctgacagaatgcagcaaacgatgaaagtacatcattttcaatagcgaataagtcaaaggcggagttctcctggaaatgattaagtaatgctccaacataagcagatgcaggatttgagtcccatttatctccaagcatgttccttagaatcatacctccattatatgcctgtgccaaaggttcttctacgccattttcttccattacagatttgtactctgccataaactgggagcaaataaggttcttatagaaagaactttggtaagatgtgtccaaaatatgcaaagacagattatcatcaacattcagcaattcctcaatggcatacttttcacgttgagcattatcttttgcttccaatttacgaatggtgctattcatattgtctatgacacgagaaaacgtctctggggaaacatactctaaacaactccacaattcgtttgcatcatagactctacgaagaggaagtttgttacagaatgcgtcataaacaccccagtagtgcaaaagattcttggcatcttttgtagaaagaccttgcggattgtcagacaattttaactctaataaatttttgttccaaatggtatcttcatctattgaagaatagatttcattaaactctctgattccattcaagatagcatcgtcttgtgcctgagtgggtcttttatcaggagaatttacaacagcagaaagcgtgttacgaagttttcttgacaaagctttcaatttgccaacctcgttgctgaccgagctattagcacctattagataacaataaatgaaacctttaattctgtctagcagaacgtctctactaacatttataggttcattcttgatcttgaaatttacatatgaaggattccataagaaatcatctttttcagattgagtaaataaatctttggcaacgccaaaaaatgtttttttctctttgggtttaacatctatattaggagcataaagcttatagaacttattctctaggctttgttctgcctttgacaatacaccctgacgctcctgataactattaaaatagatacgacaatgaaaagggttaaggttgatggtatgatagcagagataggtctctactccgtcatgttccttagccttctcaaagaatccatctttatagtcatcagtttctatctcaataaccataggatagttctcaaggtcattttcttcaatctcgaaccttggatatttactgtacaatattattacttgctctttgtcgttcgcgcagacaggatagaagcgtttgttaccaaagccgcgtcttgcgtaaaatcctaagggcgaaattgactctgaagacaatatgttattgaaattcagagtacaggttggtatgtataatttcataattatcctcgttttttaggagttgacaaacctcatagtgttaatttgggaccactcgtaagactcgtatcataaagcgaagtaggtacatcatcaaaaagactggaaagattgcctgagtgcattatatacaaagctcgataggttcttgtcacggccacatatagtggatttcggtttgcatcgtcttcaacagtacattcaggaatgaaaacatgttcaaattgaagtcctttagaactatggtaggtcatcatctttggattgtctgaagaaaaatctagatccataaactgtccatacttagcttcaacgtttacaccatgattcttgaaatattcatatgcacgctctacttcatcattgtgtctaaataggatgccgacatcctccatgtttttgttttgaataagcgaaatgatggcatcatactgttcagtaatgttattgtacttgataatctttggtttttcaacaccctcttcagtacaacgctcttcaagttcgtcactttcggaatttagatactgtgcaagacgggctatctttttgggtaatcgatgattgaacacaagctgttcgacagggaacttagtaaaatactgtatatcctccattgaaacagtttgcttatctttaataaaagtataaagttgttgagccgaatcaccatacaacaataatgctttttttgccttagaacggaatagttctatatcctctttggaaaaatcttgtgcttcatccacaataatataatcagcacttggacatccagctctattctgccaatgccaatgataatcaacatttcgttgtggaatacctacctgtgaaatgccatcagccatatattgcattagtgctttagtgaacacaatgtaaagataggtacccttatgctcatcttgtatctgttttgccttccacaaggcaagaatggactttccactacctgcacaacccttaacaatgtaggagttatctgttttcttgttaatcacctttacctggtaatcatcaagttcggaatctttaacgtaaaaacttctcttagccatgattagatttatagatttatgttaaaactatcaattattatttcattgttttttgaatggcagcaaattgcccaatcatcattttgcttgtatttggtggagtgtatgacgtggataaggtttgctgtttccatcccttgcatgatagctgtcttaagaggtttcttacacagcactcgataacacaccctgctttcgtcatttgatttgtgagaatgacttacgttgaatgtttgctgcataaagcaaaagtttctacatccatcatgacaagcacacgacaatggtaaaagcgtctcaatggttctgcttttacggacatagtcatttattgcattattcatcaattgaggatagaagtatcctgaatgctcgtctttagttgttacatcaagcattataagcaaaccgttttcatgaagaaaagccgtaagtttctttgccattattgcatatgcatttgttggtaggacttttttagaaattaactcacaaaccatcttgtcacagaggataaaatgataatcgttctttccgaatgcaagtttttccacgtcttcaattgtgcctaacgtctggctaaatatacttagttcgacttgtatatttttattagggttacactctactaaatccttgagtatggctaaagcaccatcattgccatctattgctgtgatgtttatctttgtatgaggtaaatgtcttccaattgctgtaatcaagccaagaatttccccacctgtaccgcaaccgtaatccaatacactaatctcatcttgttccaacgttttcttcaggcatttattctgcaaaagattatcagcaatacaaaacatctctgcataactgcgaggaaagtaagtaccaagataaactttaagttcttcttcgttgagatcaagattatactcataacgctcatgctctggagcataaatagcttgatgttcattgaaaatctttttgtcaagccaatgtggcagaaccgtttttgattttcggaaacaaacgttcgaattagtatttgacagttcttttgattgatgttcttcgacaacaccagatgaattgtctccttcggttgcaattctctcgccttcttcccaaaagattgtagaaggtgaaatggctttaacagcatgattagtgaactttgcgagttttgcacaatgttcaccgatgccatctgcatttattgtcacaacatattcttgagttaaccttattccgtgtgctgcaaaagatgaagatgcccttgtgctgtcaagcaccttgactgtaaaattgtcgagcttgagcgataattttactatccttttcacaaaattcgaaagtgcaatactattttcgtcctcgacaacaaaagaatcaaagtttaacattatctcttttttcttttgttttttctcttcagtgtggggctcgtacttctttatatctttgaacaactctattttctcaattggctctgctggtttatcataagtagcattgctgaattccgtcaggtagaagggatttaggttgagagtttccgcaagtttaacgattccgagtgggtcaaggtcggtgtgaggacaagtgatgtcatccaacttttcaatgaaatgttcgctatcagtaatgtgaagccaagacctgttggtggcacttaaattgttctccaactctattggttgatggaaaataataaggtgtggcacatccttgatttggttcttttcaacacctaagactttaagttctttctttaccgtggaatgatttatcctagcttgttgaagaacagtctttctcgaacctcccttaataattttaccattgtatgtccattctccattttcattggcaacaacattacctccataatttttgaattctatagaaataatagcgtccttctttataaagagggcatctaactcacatccaatattatagttgcctgcgaacacacagaattcattcgaatcctcatagtgagctttgagttgctcacagagaaaccgaaactgctcacgttctgctgttgtgtcaaagtttccgactctgaatgttaaaagtcctcccattacaaaacatcaatactatttttgtaaactaaatgatctttgtttctgtgctgactttttcggttaagaattgtcagtttttgactacaaaggtacataaaatatagcaaacacttgtatgtatagatatgaatttgcaataaatgtatttactataaatcgactatcttcgtttaatcgaagtatgcttctttgctacgttatcattccacggaaggtcagacgatgagccaccagttcctgtcccgacatgaacctctgccggcccaccgaaagcaagcgtgaatgccgccccaagcaactgtgcctgtatctcgttcacctgttcctgcggatcgaatacagcattgacaaactcctcgtccgtgatctggccgttgaaatgtctttgagccacatcatagtctatctggaatttgatgttctcaaaaagttcatcaccgacccgtgtccagatgtggagcgacggattccgatagtttgagacattgatacgtacaagctcggcaccggacgagaggctgtaacgttggggattggccttgcggtcaagcaaacttatctgctttcgctgcctgtctatgagtgcatccttctccttgaattgccgttctgctgcttccgcctgatgaatggccttgtctatttctttttgatagccgtttcgcagttttccgatttctgatttatgttgttcctgcaaccgagccttttctgcctgaagttcctcaatctgtttattgagttcggctatcagcctgttcttgtcagccagttccttctttgccttggaaaggtctcccttgccgaaccatgcgaggatggtgctcctgccttcttgcgccttctccacatcggcctgcaacttggctatatcctcttcatactggattacctgctgcctgtaatattccgagttaacctgatgcttggcggtagaaccgacaattccacgctgcaacccgaacggtttcatggccttggcatagctgttctggtattcatgcaatttggtacgacgcatcacgtcatccgccgacagacggggtccggacttcgtttcatatttcttttcgccctcccgcttcctgcggatacgctcaccggttacaatgggtacgactgtggcgtgcaggtgtggggtcttctcgtccatatgcagcacgcaggacacaaggttgtcatcaccaaaggtttcctttagccatttgagattggcatcgatccaactgtccagtttgccgtcattggcaatttccatcatctgctcatgcgttccggtcagcattacgcgtattgcctttgtctggttcttgctgactttgcggcgtagcccggctgtctcgatgcggcactgtatcgcctcggtgcgattggacacgccatcgggaaatctgaccaactcacggttgagatgtgtccggtccgcatcggcattaaccggcacataaatctttcccttggcatcctttctttctatatggcatgacattccactgtcattaccgctgccacgttgcaggtggcagacagcgtattgtgtattactcatatctgttcgttattttattgttattcttgttgtaaaatcccgtccagacagccggaggcacacccgggagcctgaggaattccccggcttatgggctttttgactgccggacgcgaagcggagacagtgaaaatgccctaataagctacgggattttacaaccccattttcacgggacagcgagctgtccattgattctccttcattcgatcttccctgcatccaccagttcaagtccgaaggtgtcgatgaagctctgcaacattggattgcgttgtatcatcctcgcgagaatcatctgtggcgtgtcctccatcagcaggaagtcggcgatgtccagtccccgactacgctgttcatcggtcgccatcttttccagcaggtcggaacaggtgacacgcctgcagatagtctccagcatcgacagtcgttgccgccattcgtcggttgccttgagatcggggaaaaggatcacttcacgttctttcaatacctgcatggcctcgctgttgaaacagccgtgcattcccccggtggcaagccatacaaaatcagggatgaacagggcggcaaccagtgccgtcttctcgctttcgacaatggctacaggcttggctgacatggcagcggaagtgtccgaaagcagatgttcaccgaacaggcactgcttcatgtggaaatccggcacttttcttacagaatggacccagttgacttgactgaaaggctctttaatccggtgcccggttacggcatcgtagcccataatcttgcctgcacgcacgttacccctgacatctatctgccagaacacggtcgaaccgttccacatccttgacgtgccgactttgtaaacatggaacaaccggccggcttcctcctttcccgccactttggtgaagtaacggtacaaaggattgatgtcgtacccgcgcatggattgctccacccaatcatagggaagataagaaatctccggttcttgttctgttggcggttgttttgctacatactttactgtcgcgaatgcactgccgttcattttatggccagccgatgtttcccttgctgacggattgtcccggaagtattctttcggggaatagtgatagccacaactgtggatgtggtcgcatttacccacgtatcccgggaaagaaatctctcccgcctcgtcgatataacgggtaaagcaggacttccttccgcaccccggacagacggtcttgctgcccggtttgtatttttgaagatggaatctatattcgttcataatgttgtcggttatgtgtttctgcaaatgaataccaccatttgcagtttgcagttcttgcagtcctgcaggaatttccccttttcagtcctcgaaactgcaaaactgcaaagactgcaggctgcaacaagggatcatccgttgcagtttcgtggggatgattcattattgttttcattggattttccagatttatcatacatgattttctcgtaatgtccggcttttgatttccggagaagcctgctgtggcataactctttcaggtaattcatgacagtccgctcgctgacgcactgccgttcctttccaatgattattgctgtttttgtatcaaaggtatcaggcaacatagacagcagcaccttgggagggtcttcacaggtgtcattcgccacgaaagaacggatacgcgtgtatgattcctcaaaatagtcgttcagccgtatggcggctttcaccgatgatacatctataaactgcaggtgactttcaccggacgcgtggcgcaaaacctgaattatcaatgccagacgggctacatgagccggatgtttcatttcccggctgtccacctcggcatcatcctctatccggttgatacgctccactttcctgttccaccaggagaagaagtattccctggcctccccgtccatggacagcacatggggtattttttcttccgcttcggtgtcatagtccaacgcaaggaccttgttcaatatattctcccaacgggctgcagcgagggatgtcctttccccatcgtcgtcccggtttttccaggatgaaagtttgggggatttgggcatcacgaacaggatacggtcaagcagcccgttttcctcgaaaccttttttcagaagctcgtgtacacgcttggtctgcgtggtcccgatgatatttatacatggatgctcgatgtgtacaggaactggggagtttaccctggtaacatccaatgccccgccactccatgcagtcaggagctgttctatgagctgcccgttcgtgtaacggttggcggaattgaacatgcccatgatctcgtccaccagaatgaccacgcttctcgggttgtggtggtgggtcagtaaaagcgactcgggagtgaaatcagagactacagtacgtttcaggacaggtctcttcccgttttctcccgcggctttccatgcctccagttctgcctcgtaaaccttgaaaagggcatagtcacgttttcggatcgggcgatatgcggcctccagcggtggggtcttgcccagtccgggcctgcctaccagaatgacgtacaacgctccgctgctctgccagtctcctttgatgcggatacggtatgcgcctcccagggccgcggatacagccgacaacatggccgtcgcggtgaactcgatcttgtagttctcgtatgtggccatatcgagtatgacagactgcacggtttggggcaggacctccagcgggaatcccgttctttcaatatcctccgcctccatgcggattctgttacacagttcaagcctgccggttgccatatcacacattttttctcttgcaataggatgttacactctcggacttgttgcctgtctgtacccggcgtacatcggacttggcatacatgttcttgttaccgaccttgaccggtacgagatagcctcgtttcgcccacaggttgagcgtgccctcgcacacgttcagcaactcacggacctgttttgtattgagataagtctcctccgcttcacgcagtatcgcggctctctgttcttcctgttgcgccatgatggtacgctgcacgatggattcagcgaacattttaaggtcagcgggagtgacttccagtttcacgttcgctccctgctcgaccagactctctatggtaatcataaatatcaattttgaagtttgtgacgaccatcttcaaaagttccctggtgccccgcttccgatggcttataaaagagaagcaccgccagccctcgggaaaggattgacggtgcaaaactatacatgaattaaaagtaattgatatatagtgatttgtcttaaattatcatgacaatataagtccgtgtgacaacgtgaaaaggttataattggccttatttctatgcaatggtcatcgtgcctgtacctgggatattactgatagcctgtgccaatttccggaacagttcccggttatcgtcactttctataaggggtgccatctggtctttgccgtccttgataacgtgttttgccgttctcaggaacccgaccgactgccgtatggcgctctcgcttttcaatgacggcaaatccgggaactgcaatgtcagccccatgctgtactccttggctgtatgcataccggcaaccagatcgagttccttcaatacatagaacggtaatgcctgatgaatggcacttgtattgacggaaataaagtcgcggatatgttgtaatacaacttccttgttctcgtgatcaagataatcggcaagtggccgttcctggatttttttctttccggccacgcgttgtacaacgggttccctgacgctgtcttcggcccgagttgtaatcgtatccctgctttcttcatcggtttccatgtcagccgtgatggtctgcaaggcccattcgccgacatagcctttttcaatggcgctgttcatggcaaaatacctgtcccagtctgcccgggttcggaaaccgttcctgatggatacgtttattatctgcttgacgacaagggaacagccctgcctgtcagcattgtcagctttcggattcttcatctgtttctctatcatggaaaccatcgcctcgaagctctttccataatacagccagctcaacacgagcggtgccgaaagggtgacacccggcttggaagatttgccgctaaaaaaggactttatcctgccccagaatgtgaccggtggaatgttgtcgggcagaggattgttttcctccctctgtttcctgtacagctccacgatctgcccgggtaccgcgttctccgcgaattgcatgcctatatttgcaaggccatccgtgctgtcatcgttccaggacaattcccattcccgcctgatactggggagttgcctgaatatggctttgcagatggcaagatactgcctctcgtcaccgtttgtcatcaggcgcgagaagcggttgtattcttcacggtgcgtgttcttccactggagaatatcctccttgaattgttcgtatgtcaacttctgctcgtccatattcatattgcattatcggtggatataaaaggataggtggaaaaagaaacggtcaatccagaaggtttaccagctccttcttcatttcatcgtctatcttacggtaccgggcaaaggcacggctaccctcagagtgcccggacatggaggcaatcaggttcgggtccttgacctgcttgtacaggttcccgatgaaagtcttcctcgctgtgtgggtggtggccacctcgtacaatggtcttgccacatcctcgcgcgtcttcgggtcgagcaccctgaccatacggtcaattcccacgtatttgagaatctcctttattttcttgttgtagccgaaatgcgagaatctcgggagcagcgcttcttccaggtccttgtacctttctagtatatccaaagccttttggttaagcgggacccgtaccgtgcccgcgtgctccagcttggtcttctggggaatgtactccacacaaccgtccacgatattcgccttggtcagccggttcaggtcactgacacggcagccgatcaggcactggaacatgaagatgtcacgatagaccggatagctggcacccatgccgcttaagtcggcataatataccttgtcacgttcttcaagtgtcaggtagaacgggtctccgtacatgggctgtgcgatctggtactggtcgaaaggattatttcgtgtaaggccacgcttgatgcaccatttgatgacggtgcgtacgcggtacaggcttcccgacatgctgttctcggaacgtacctgctcgacattacggcagacctcgttctggtaaaacacgggatacatgtcaacatacttgtgctcttcctgcagccagaatttgaaatcccttatgtcatctgccgtgatggagtcaatgcaaagatggaagcccctctggtgcatgacctcatggcggaaacgctcgtaacggagtaccttgttgagattgtcaagatgatgtttccggctctcgaacgcgagtggggtctcgtcagcatatttttgtatctggtatgacaacaggtattcctctgccttgttgccgccccttgcattgatgttggggtgatggtattcttctatcagtcccttgagccagttcccgtcaactccacggctgtattccctggtaatcaggtgggtgatttgctggatatccctgtcgaaagcgttcttcttctcttccgagacaagagccacacgtggtttgtagccttgcctctccgggctccaatggttcgggttgatggacagctcgctcgcggcctttatgtccacaccaccgatatcccggacacggaaatagactcgggcaagatccgtcacgttgtttttcgccgatgtctttctgataaatgctgttactttcatgtatatatcctcctcagtttatcatttcaacaagttttcgtttcatgtcatcatctatcgtccggtaacgccggaaggccctgctgccttccacgtggcctgacatggaggctatcaggttggggtccggaacctgccggtacagattgcctacaaaggtcttgcgtgccgtgtggctgctggccacctcgtacaagggcttctgtacggtgttgtagccgtgcgtgtcaagaatggtgaccacacggtcaatgccacaatgtttcagcagttcccgtatccccagattgtaagtgttgatgggcttgaagggaagcagcttgccggtattcccgctatagcgttccagtattctgaccgccttttcatgcaatggaaccctgacggttttcgcctggcacttcttggtcttttgaggcatatactccagaaaaccgtccttgatgttctccttggtcatcctgtagagatcaccgacacgacaaccgacatagcagtggaacacgaaaatatcccggatgacagccagtttcgggcagtcgctcaggtccgcgtcgtacaggacattcctctcttccgatgtgaggtagaacgggtcgccgtaggtcggctccttgcagccataaacagcatagacttcgttatcggaatacttcattctcttgcaccagcgcaggaacgtgcagaaaaggttcatgatattgatgacggttgtgttggatagaggcttgggcttgtggttgatgagcatacggggagtataaaagtcaggatactcctggcggaacaggtattcgttggtgacatactccctgaagtcgttcatctgccccaaggtgacagtttcaacgaagagagtgaagtcagtatcgcccaataattcacgccggaactcgtgatacctggtcatcgttcgctcgaagcgggcgatgtgctccttggttctttccgcgccgtcatatttttccaggtactcgtggatacggtggagcaggttcgggtgatcacgctcgaaagcccgcgcgggatgcaggacatcctcgatgacctgtttcatccatttgccgtcagccttctccgagaaggtcttttccgctctctcgatgatggcggcgatctgttcgggcacccgcttctgttcattggccgtcacggcagtcgttcgcctgtaacataaggtatcggtatcccaatacttgtcatggaccgcgatgggggaaaccactttgatgtccacgttcttctcccgtacccggaagcagatgtttgaagtggtcgcggaacattttttcagatagacggaaattttcatttgctgtacctttttgattacatgacaaaggtaaataaattcccgaatatgttcccatatatcccgaagaaacttgcaacgaattaagacaaattaaaaagtcattcccgaatctgataccacataaagtattgaatattagaggttatatttgcacttgtttagatctttttttcattttcgactttattcgacttctcaaatatcagatattgcagttccacgcttttatgtaggttaaattcctctatgggactggagattaaatgtgtagtgtatgaacataattaaaaattggttgttagccatttgcgccattctattgatgaatggatgtgcaccacttcgaatgcctgtaatcgtcaggaatgcccctgttgaaatgtataaatacgcatacatttctccgacaaaggaattaacatcaagtacaggaggtacatatggaggacaatatggcatctatggttcttcaaccaccaaaagtgttaatccgagtgatgtaatagccggaatactaataaaagagggatatgttatattacccgaacttaaaccagaattagctaatgaaactttaatcgttaattatggtgagagtggtaggcgtaatagaggcttaggatataccatagaagtaaccatacaatttaattctgcaaaaaccaatgaaatgatatgctcttgtacggcagaaggacaaggtgaaacagaagccgatgatattcgtcaagccattagaagagcattatcaactttattcccaaagaaataaaaccaattaataatcaaataatacaacaatttatgaaaaaacttattgtatcatgtgcattaatggttattacattggtatcgtatgcccaaacctataaaatgtattctacgagaaattaccataaccaactccgtttaaatacgatgacaggtgaagtacaacaaattcaagatgatggtcaatcttgggaaatttgcagtgcgagagaagcttcaggggataaagtaggaagattttgcctttatgagacacagaatatgtggacttttataatgcttgacacatatacaggtaaaaattggcaagtccaatttagtgtaaaaggcgaagattatatgtttgctgcaccgataaacattttctctcttgcatatcctgaaacaacttcaaattggagtaataggtttcagatgttcagaactcaaaatatgtggacttttatactattagattcgtataatgggcgattatggcaagtccaatatagtacacaagatttggataatctattttgcataccaataaataaatatgagttagtttctgataacgaaaaatgtatattctccattcaaccattgacaagtatgtatcaatactatctcataaatgataatacaggagatatgtggaaattccaatggagtaccaaaggggatgattataggtggattgagaaatttaaatagctattattctcggatatgcagttagttttattcatagctttgatttgttttgttgctctttttataatagtagcaatacgaatgcacctcaaaaacaaatccaaagaattaacagaaaaattgcttcaaatatccgcttatagtgagaagtccagctacgagcaagcccaagagaggctgtctaaacttaacgatgctgtatttattgatattccggcagacttaaacaatgttttttatggtaagataatatcggcagcgcaagaaaaggatttcacaaatcattatatatcatattttcaagaagcatattcacttgttaagaaacttgaaactttcaatatcacgccatctgtaacaatctcaaacctaattcgtgactttggtaatatcaagaggcttgtcaaacaacataatgatacggtaataaattccttacttgatacacacaaggattttttcgaccattgtttgaaatatccattggataaacagcaaagacgttcaattgtttcagaggaagataattgtttagtggttagtagtgcaggtagtggaaagacctcttctattgttggaaaagtcaagtatctaacagaaatcaaagacattgcccctcatagaatcttactgattagttacacgaacaaagcagcagccgaactaacggagagaatggctaccaacggtttgaaaggctatacatttcataaattagccattgatattatcgaaaaagaaactggtgttaaaccttctatatgcgataatactgatgccttatttatagatatttatcacactctattagggaatgaggattttaagaaaagtgtagtagaatacttcatcgactaccaaaccaatgaagcagattgggaacaacgcaagaatgaaaggcgagaaaaattgtcagagcaaaagaatgtacagctaaaagcgatgtttcccgatatggacggtagaaccatatatgtgagaagtgaacaggaacaaaagatatgttttgttttatcatctcttggagtgcaattcagatatgaagagccatacgaacatcaattggcagatgaaatgcactctcaatatcgccctgatttttctatatacttcgagcaaaagggagtacccaaacgaatctatttggaacatttcggagttgatgaacacggtcttgtcccagcttggtttgcaaaagacaagaatataacatacgaagaagccaatcaaaaatataatgatggtataacttggaagaaaactgctcatgagaaatttggcactcagcttttagtgacatcaagcgcagatttccattattctgacataaaagataaactcaaaaaaatattaacagatgtgggcgtaccaattcaagagaaaacagacgaagaattatatgatttggttttgcccaaaggtagtaagcaagaaaaagcgtttatacggcttgtagttactttcgtaacattggtaaaatcaagttgtaaatcagttaaagaagttctgaagcaagcaaagaatgcaggtgatgaacgaagtgtttttatcatcaaaaacatatttcaacctgtatatgaacgttataaaagtgcattaagcgatagtaaccaaatcgattttactgatgcgattcttcaagccacagagatatgtcgtactacacatcttgttgagtatgattacatcattgtggatgagtttcaagacatatcggttgaccgttacaacttcttaaaagtattgagagagggaaatccgcctgcaaagttgtattgtgtaggtgatgattggcagtccatatatcgtttttcgggaagtgatatggctctttttaatcaatttccagaatattttggtacaacagagataaataagatagaaaccacatatagatttggagagcctttggtctctttatcatctcgttttattcaacgtaataacgcacaaataaaaaaagatatacattcattcagttctgatatgaaaacagaattggagttttgttcttacgacagacgtgattactgcaaaacaataggagaacttatagattctattccattggataaatctatatttttattgggacgctattcttttgatgattattacttgtcatttatgtatcaagggataaaagaaggtaatagattttactatgtaataggaggaagaaaaattgagttcttgacagtacataaatcaaaaggtcttgaagcagattatgtgatacttttacaatgtaataaagatacctatggctttccatcacttgtaagcgatgaccctgtgcttaattatgtcctgactaaaagtgatcagttcccatatggtgaagaaaggaggttgttttatgttgcaataacgagagcaaagttgaaaacacttgtgctatacgacaagcgtttcccatctgtatttgtagatgagtttttgcatcctgaaaaggtatcagaagaaagctatgtaaaacaccccaatgctaataaaagatggacaaggcgtgcagaccagtttttattagaactgcataatgaaggtaagagcgtaaaatacatcgctgccaaaatgggcagaagtcaaacttcaatcgtaatgcgattgaacaaacttacccaatagtcgcactaatgctatattttttcacaacgatgatgtctgtatgttgccacgttgccataatacattagaatcttttgaatatttcgtttatcttttttgtttcgtttttctcctgctcttggcatatccttgccacactcatgagtaaacttagaggcagcctatatatgccttcactcttcaaatggatacgtttcgtcgtagatttcacttagagaacggtcgttgaaaaaccagtgcggtgtgggctgtatatgcttgaccttatatccttttagcttagcagaaagcgcactaatagaagtttcttctccttcataacacactttacgctctgaaagaacggtaacagaaattgatgggtcatctttccatatgagaatatcgcctttctgcaaccccatctcatagaagttgagtggtggacgtttggcttgtgcttttgtgctggcagctttatcctcatcggtgaggtcattctgtatctcatccgtcacttcttccgtcacatcttcatgatgaaaaagctcgaggatggcttgtgcctgctccacgttgatacggaagaactcacggttctggttgatgcgctgagggtcaaaggctttatgaagggctttttcaattttgagacaatcactttttttgaccttgcacgcaaatttacactcaaacggaatgggaactcctgtggtatatagttccttcatccgtttatcaatgccttcctgtgtggtcatgcctatttttacaagtcctggcatcacagggtttgtcagaagataaactattccgtattccatatcgttgtttttttagagactattgtacagtttgtctttgtttataatgaaatcaagaactctttcaaattcgcgcatcagtatgttgccgttcttgttagtgaatatatgtgagttcattttttacttctcctatatttttgattactggcattgggatgctctggattggtcatttcgagatagccagcctcgattagtgacatgatgtatgtctgaatattcttactatggtatgtcacacctaccctttcaagaatttctttgctgctacgtggcacactgcagaagtttactatatccctctgcttatttgttattttaggacgtatagtgtcagagtctgcattgaaagtgtcagagtcggtatctaagtcggtgtcagagtatctaagtttggtgtcagagtccgcattaaaagtgtcagagtcggtatctaagtcggtgtcagagtctgcattgggttgattacttatctgcctatttatagtaatcacgaactcattagtcctgtcattattggtgaacgagacattcacgtcctccgacaaggcacgaagcataccactacctgctcctgtgtagggaagcaggtggatggcatttgtgaataggaacatattgcgtggcatggatgtgcctataacaatatcatctacggtaagtccattagggagaattccggggctgtgtatctccaccctgtcatcaaaaatgaatatgcggattggggctgtcgcattcagcgatcgatgcactaaagcatttacggtgaactcaacaaggctggtgtaaggaatctccaacacgccttgcgagttaaactcattcccaacctgtatatgacgcaagttccgggtgaagaaatccataatagtctcaaactgatgaagcagattaccctcaatatcggcatcgttcaccttgtcgcgaaattgagtaccgccaagattgttgcctacaaagcaaatacattttgcagtcatcattggaagccaacgttgggtgtacttgccaaacaataacatcgcggccactgtgattttaccatcgggacgaataaaacgcaggttacgtaacagtttctctccattgtgcccactggcaatagcagaacagacggtatctaaagaggcttcgcgaaatgcgtcgcccaccaagccttttcttgctaacaccttatcaaacttgttactaaggaaggttttgatggtaccctcgtctaaatctttgatggtagcatctcttactcctgcttcatctggcgaaaagctgccacagtcagtcatcatctcggcaagctcggcattgtcgaacactttgcgcttgtcagcaccgttcttcacccacacaattccccgattgtcatggtagggcttattcaatccttccttaatatgagccacaacaaggcttccgccatccacagaaattgtttccacatcaacaaggatggcaggaacaacattctcagatgcgatattgctaagtgtattggtggtttcctgtacttccaaataggacaaaggattgatgtttccggttttatctaccgcaccaacaaccaacgtgccaccacgtgcattactgaaagccaccagttcgcaaccgatgtcatagttgtcaaggagccgttctttgaactgcaccttactgacctcgccaagttttatctgttggataatatctatttccttcattgttcaaatgtttttggttgagcagtctacctgcatcaatattcaaagcctctgctatacgtaggaggtttcttgcgtctggctgcatagtgttcgtcacccatttggagacagtagccctgtcttttcctaattgttctgccagccacttactacttttttgttcttcgacaagtacaggaaaagccacacagttttgcttctgaaaactgcttcatctcacctatcctttttgtcggttatcaaatacttaaggtctacttgtaatatctcagcgatcagttgcaaagtatctaaattaggctgaatccgattacaagcataggcattgaccatactaaaacttttatcaagtctctttgccagccatgtttgagaaatacctttttcggataaaacagccttaattctattcaacttcattctttaatgtaattttattgcgcaaatatagtgaattatattcaacaaaccagtttgttttattatatttgcagcattaataatgattttaatacaccagtaatatgcaatcaaccgtagcattcatatctcatagaagtactcataaggattttgttagaaaaatagttgacacagtaaaacgagacaattgcattgttgacgagttcgatttttatccagcgacaaaaacggtaaatgaaatagttagaaatctaaactttgcgccgatttttgtattactaatttctaaagatgcccttgagtctgattggattaaattagaaatgtcaaaagctcgacaactttatgacacaggtgttattagagagtttatgccttttataattgaagaaggagtaaagttagaagagttaccttcatggatgactcgtgactggagtttaaatataaaaacaataacatcccccaaaattataggtcagtttattattgaaacacaacgaaaaattcgttgtgtcgggaataatgcatatggcaattggataaatacgtttattggccgtagtaatgaattagatgagtttcaaagagcgatgtacgacagtgtgtatatgcctcatcgttctttaattgtctcgggaaaaccgggaagtgggcgtactagatttatccaaaaatgtattcaggacagtagcggactatcatttatccctgaaggatttcagataaaactacctcaaaaaacatatttagacaactttatacttcaattgcacgaaggcttgggctttagtaaagcatcatatgaggatattcttaaattagatcatgaacatcaaattactaaatgtgtatcttatattaatcagataatcaacgctcattcattcttactaattgaagatgagatgagttttgtatcatatgacggaactatttctgaatggggtaaagaaattatatcccatcctgccatgatagactcgttaaagatatttataagtagtagggttaagcctagatattctgagttgagagcatatccccagataattcatataaatctttctgggtttacaaaagatgaacgcaaacgtctttttgtaaattgctgtcgttattataatgttcaactaaatgatagtgatgtcgatttttttgtggatcgtcttcagtcctctccccaacaactagaacaggcagttcgagaaattaaagataagaacgtaagatttgctaagaaagacattaaaaacctgattgcaataggagatgaagtcttttccagagttattagttggtttaaaggagatgagactgctcttactttagcaaaagtgcttgctgaagttgatatgatcagtttcgatttactcgaacaattatatgaggaagattatcctaaaatagaacagttcgtaaataattttgaatctttgtctattttagatttttacggtcctggaggcaataatattagtttggacggtggcgtttcagattatatacgtagaagtaaattagatttagatcctataatgaaaacccgtattgaagaaataatcttcaataaaatagatacggcagaagatgatctaggagaattatcaatatttttacatgacttgcggaagcagttgctgtctggcaaaggttttgcgtatgtcatgccgtctatcgttataagtacagtcattgatctttataatcagggtagctatgattcagtaaaagatatttgtttgcatgctttggaacattgttcaagttatacagaggaacctctgcaagaattgtactataggttgtgccaagttttagctcgtatgaaagatagaattttctttacatacattgacaaaattaaagataaaggtagtaaagattttctgtatggattttactatcgctataaagaggactattccaaggccgaggagtatctccttaaggctttagattttaattctaatatgcaaattgcaagacgagagttagtgaatgtttatctgaatcaagaaaaatatactaaagcccttcctttggcaaaagagaattataatcgtaaatcgaccaattcttatcatatagaagcatattttcgttgtttattaaatcattatccttggaatacagaaactgaagatacacttaatcgcctccttaaggagatggaagagaattttagtaaacgtaaggatgaacttttagcatcaatgcaattagaatactttattaaatctagaaaccacactaaggaagaaataaaagaaaagatacaagaaacgttaattgtttatcctaactcgccccaagtttatagaattaaagaagaattcgaaagagacaaaagtagattttgtaaaagttgtaattgctaagtctatgatttaaagacaggaagctaaagatgacattttagtataggtttgtcgcaaaaaaactgttttgcgacaaaatatagcctatacaaacagatataaacgagaataattacaacagttcttttcaaacctgcgtaaacaatgcgtaaacaaacggtttcagttagggggatttagtgagtttcataggagatagctaaattcgtaattgtttgatacacagtaaatattgagaaaactgaccatcgcagaatatcactttgtcgttctcataatctggaggtccctggttcaagcccaggctggtccacaaaaaaggttgtaacacaagttgttacaaccttttttttatatccggtatcggaaccgaatctattgcttcctctaatttttgccccctttcagagaatttattccatgcccaaagtatatgagaatatactagttcccacaaaattatgattttaaagatacggaagaggtaaataaaacgggcatcattaaagaaaccctagatagggactaactaaaaaggcaatagtatctccaattcccctcccttcgggaagggatggctgaaagccggggtggtaggtaaaacaaggttgtatctattttactatgaatgaaagaattgcgtattcacctaccacctccccctgcgggtactcctccttcccgaaggaggagatttaagatactaccgactttttaatcagcccaaaaaaatcccattttgaaaaccactcttggcaccaaaatgggataacacaaacaaaacaaacaatattggagcgattttcacaaacagcttccttttcttaatctatatttcataacacttattagttctctctaatgtgaaagtaatatttcaccgcaaaaatattatttctccattacatataaaaaagctatataattgtagttataaaaaataatttatttagatataaagatctatctaaaactattaagaataatttttaataatcgatcaactctttatttatcagcaatatacagtaaaaaatcatttatactgaaacaaaaaacaatccataaaagcaaacactgactttcgcattcaaaacgcaaaagcgaagcaaacaacctaaaatatttcactttataaaatcacaatcccagcatcacaaacagagtaaactactcaacaactttccattctgagatttaatttctatatttgggaaatgtccaacaagcacttatatatttatctatgactgatactatttcatatcaatacgctgctccgtctgtcttacaacgttcgtctgatcaggacgaattatttctggcaaaatacagtgaaatagaaaagaaagaagctccctgtttcttttgggggaagctgacacaaccttatatgacggcacgctgcctcattgcgttgtccaacgtggtacaatccagttttaatctgactcctgcccagctttccatgctgaaagacccgattgtgacggcaggaaatgaacgtttacgcttcgaaggattttcgaattgtgcaggcgtatatgccagagtcgatgtactgcccgacggacacgacggagagttcctggagaacggaacaacgaatgttgacttcaatgccggtatgatttctgcactgggaagcatcagcaaacaagaaaaagtagtgatgtcagtcggacctaaggaggtagggctttacaataaaggtgaaaaagtaatagaacgcaaagtaccgctgcccgtaaaatggataaaggggctgaccacggtacagatttaccagtctgttgccgaacggatgtattcattcaatcgtatacagactttgcaactctttcagacactccccaaaggaaccgtgaaatgtgactattatttggtgatgcgcggacaaaaacctgccttttcaccggtgaaaagtctgaatgccgtttgtatcggaggggtacatcgtctgcgcctgctcgaacccctgttgccgtttgctgacgagctgagagtctttgtccatccgacgatgcaatcgaccatttggcaactctatttcggtccggttcgtttcagcctttccctgtcgcgggaatgctggcgcggattctccggagaaggtgcggcattggacgccctgcttgaagacgtcccggagaaatggatagcagcgatggataaatacagttacgccaaccagcagttcaaccccactcttttcgctattgaggagcacattgatctcgataaggtggattctctgtctgcacgactggcagctatggggttactgggcttcgatctggatgataatagtttcttttatcgtcgcctgccctttaagacagagcgtatcctgagcctcaatccgcgtatgatagctgccgagaagctattggaagaagagaaagtggaaattatatcaaatgacggaaatcggaccgaagcacgtgtcgctgggagcggaggagtaagacatacggttattctggacagggaaagtgagaaagaacgctgcacctgtacctggtttagcggcaatcagggagaacggggagcctgcaaacatattttagcagtcaaaaaacgagtacaatggaagaactgaaacacgaattggagaaactagccaaaacttatgtggatactccggagaaagaagaaaagatattgattccttttatcaagcgattattagaactcccgatgaaagaaagacggaaagtgattccaactatcggagaactgcaatatgaaagaggagaaggttggatgacttgctgcgaccctgcccgaaggcgttttcttgccgcaattgagtttataagtgccaataaacgtgagatgaccatggcatacgaaatagattttgagctactctgcaaactgctccagctttaccgccccacttggttatccgacttcattaatggtgatcactcattctatagcttcaacctaaactatcaagaactcatgcagctcgtagatttggggtatataaaagagctttctccgaagctcttgggacaaatggtcccctggcagatcagaataagatcttccaacagcaaagaagaagagactttcgacagcagcccactgctgaaacgggaaatcaccttaaaagagcatatttggtacgtcttcgaatatgaatcaaatctcggctacctggacgattgcgccaagcgtgcttataaagaagggattacggtgcaggacgaaagtttcagcgcaattctctatcgtttctcgctcgacggacatctggacagaaaccggcttctgcgagcaacactttccaccttcaaccgaagttttaaaaaagacatggtaaattggtttgccggactctttgaagaattgcagccaagggcggaagaactcatatccctgcaagaagaaatcatgcaagtgttcacctctccatacaccaaaccggtgaatgtgatgttacagcaattaaaaaagattgcttccgaaggcgggttccgctatcaggagtttatcgagcgtgcgactactcttttcttttccagccccaaaaactcactgcttactatttattccatttttgagcagatcgttgccgggcaccccgaaatgaaagaagcgtgttgcatcccactctgccaactattcctgaagaaagatgaaagcctgcaaaagaaagctgccagctttatatcaaagtacggagacgcatcctcttctacattgcaagagacattgctatcttaccaatccgagatgttccagagcgtacaggatatacttgtttctttcatgaagcagcctgcggaagaaactggccttcccgaaacaaccttccaagaaaaggttcgtatttgtcgggaagacaaccgtatcccgtttcctgccaataaagaagattttctgttccagctcagccgcctgttcgacatggatgaaagttgggaaacagacacaacgattgccgccctcatcgccttccatccccagttggatgaagaagatttcagccggatggagcctgtattccaacgggcagccaacatcattatcaacagttgggcagtatacgagaactttcttgccactttcctgctggaatatcaacgtttatggacacaaaaagacactgccaaccaaggattcctaagtaaaatcttcgcacgcctggaagaaagactcaaaggaatagacgcaaacagaggagcctacgacgaacgtgctttcaagcgtcttgcagactggcagccaacttacagcaatagaacctgttttgaacctatcaaacaattgtggctggaagtaatccgtaaaatcaaaaaaggcgactcattacctttactctctactccgacacatagcccggcatacatccaggccaccgaacttgtacgacggctcgccgtttatcaggaagcgaatgcaaagccttgttcatgggactttcagctggccatagcacgctgcgctttagaagacaaggaagaagccattgctgtcgcccgacaattattaaataatgaatatctgcatctttgtctctttttattagataaagggacgcagcccgaaccaccgtacaatcatccatctgcctggcttgcagccggactggtgaaagagccggatactgaattcgaagcattcaaaaacttctcctgcaacacgctgccccacaattacctgacaggaaattacggctggaaagaaccggcacagaaagaaaatcaatatgcagcagatgtacgtctgctccagctcgatttctacaagtggcatgagtatgcagaacacaacagccaccagctttggcaagaacatctgatcatcaacagcagatacaatataggcgattccgactatatggaacgtctgttcagcttcttccccaaccaaccggaaccactggttgcacaaatcatcaactgctacatggacttcggttcaccgcaggaagagagcaaacgcagtgtagccaatgctttacgtatgttattgtcttttcactgtccgctccgggagatgagtttactgttgctgggcggaggcctgctttttactgacaaaaccgtccgttcatacgctgcggagctatgggtggaaggcatcgctaacaacagaatagacaatcaccggttaggagaaatagtagcacgaattatcaatatgggcattgttccgctaaaacgcttcaccacagaagtgtatgaaagcatatacaaacgaagcgcctttcacaatcaacaactggaagagttactcactgtattgatcggcggattgcccgacaatccggtcaccggacaaaaacagttactcgaactctacgcggaagtgcttcgcatgaacggtcattgcgtaactgacgacaaagtccgcgagcgcctggaaatgtggaaaaagaatgctaatctgaaaaaagtagttacggcattagagaggtgataggtaacaggtaataagtaataggtaatattgcttggtatcaggtttttatcatttcaggtgatcttaattgatttaaagtagactaatttataaacacggatattgttatcatatatccttcaatcaaaattataaccatgactgcactagaaacacagcttaccgagatagtagaaaaagagcaagggcagaagatcattccttttcttcagaaactgacacaggaggagcgggagagcctcattccctgcctcagccgattggaagaatactataataagtttgtccagctggaagaaaggacatacggtacgcgtgccacgtcgggacagcatcacattattgatcttgccgcccttgtgatttttcccctcaaggaatttcgcaaacacgaatgggggataaacacagcgcatctgaacgagatagctgcatggcatattcccacgtggctggatagttatttcgttgaaggtgaaggtaaggagtttggcggtttttacaatatggactacgagatattgatggactggatagaaaggggtattctcaccatttccccctctccgcagacgatagcaggttatctggttaactatatccacactacccccgtattagaaaagcgggatattacaatcaacgagcacatctggtatttgtttgaatatgactgcgggcaaaactggcacgccaatccggccaaaggatatccttattatacattccaacacttcaccgagaacggaaagctagaccgtatgcgtgtactgaaagagtctttgctggcaatcaaccggaactttaacaagaacctgtgcagctggtttgccggtatgtttacggcactcagccccagcgttgaagaacaactgacattacagccggagatgcttgccgcactatcttctccccatagccgtccgataaatatcatcctcggtcttctgaagaatctgtgcagccatccccggttcctgacagatgattttctggatcagaccactgtcctcttcgcttcggacgtaaaagctgtccatcaaaacacgctgggagttctcagtaaactggcgaaagagaaaaaagaatatcgtgataccatctgttgcgctgccgcacaagggttgatgagtcgcgacgaatctactcagaacaagatagtgaaactgattcagacatttggagaaacagagtcgcccacattgaaagaagcactctctgcttatgcagaaacaatgctgaccagcactaaaaaagagttggcagcttatctgaaagacaatgtttcagatgctttatctaccgataaagtcttgctgactactcttgacgagcaggcaagtgtcgcctccttcgactatgaaccgatgccacccatccttcgggaagacaaccggatacaggaaattacttccatcgaagacctgatatttctggccagccaaatactagattccaatgagctataccacttcgaccttttcctgaatgcgttggtagaatggaatgagcaactggaagcgaaacatatcacccaatggacacctgttcttcaacgtgcctataagttacttatcaatggcggaagttcacgcaacggaatattggattctatgatggcaacgttccttatcgactacgcaaaactattaatcaagcgtttccctgtagaagcaaaagaactgagcaccctgcacgagaaaatggtgcagaaagacgaacttcagaaaggtcagtggagatatcgcaatctgcagagaataaccatccgccaaaagagtaataaaagaacggaatttcctattcacaaacaattactgtaccggacattagaccttttggaaagtaacgagaaccgacttcccatgctatccactcctacgcatatgcctgcatttattgaccccatagttctgataaaaagactcggacaatatcagcaggccaatgccgaaccggacgatatagatatgcagatagccctgtcgaggatggcattgaataattatccctcgcaagactttccgactgttcttcaggaactgaaaggggaataccaaagtttgttttccttcttgataggagcaaaagatgcagtaccacaagctcccttcgcccatccttcatggtggatgacagcaggattgatcaaatcaccggagacggtttatactgaatttaaagatttctcttatagcaaaagctcacgcgaatttctgacgggaaacttctcatggtggactttccaaacccctcattcatatactgattatcacaacaaagtagtcaactggacatcttcaacccttagtttcaatgttccggaaggagagaacatccacatcgtcaacaaaggaaagtatgatgagagagtgagttatcactcgtatgatccgcatccgctactggtggaaatgtattcacagatagaacgttatgacgatatacaaaacgatctgccccgccttgtatggctggctcccaatacaccggaaccattgtttgtatggtgcatccgctgtgccatttatgatccgatgctaaatgaagtgagagaagttggtatcacccaagccaccatagaggcactccaccaattaaggcacgaatggcatgagacctcttatctgctggaagcgagttgtatgctggtagccgacaagacttcccgttcttatgccgccggaatatggacggaccgtgtcaacacaggatgtatagacagtgcacgtatcggcaggatactgggttcgcaccaacgtaccggatggggacctctgaaaagacttaccgacttgatacaacagcaaatgataaacgtcagcccactacacaaccgggaactggagctgctacttacatcactgattgccgaacttccggaacagcctgtcaaggaactgaagaagctgctggaaatatattcggaactgctgtctgtcaataacagcagagtaacggatgaacgtattctgcaactactcgaaatatggaagaatacggccaatctaaaaaaagtaatagtcagtatcaaccgctgaaaatccggataaatcacagaagaaggtgtgccggtattcagactatatttgcatatagggtatagttaccgttcatgcagggtatagtaacctaacatgcaggatatatatgtccaacgtacaggggatatatatccaacacgcagggcatatatgtccaacgcgcaggatatatagatccaacaaacagcgtaaaaaaggctttttattggtgctaaattcaaaaagaagtatctttggcacacaaaacccaaaggagtaatgatgatgctgaaatatagtttatttgtcttttgctttctgctggcagggtattcctgcgtatcggggcataaggagacaaagacatctgcagagaccgaaataacgtacacagactctatgtgcgcaggactcggagatacaagccccgaaggtacagcatccgactgtacatcccttgctcatgcggactccattgatgcagattctatttatacatccccctcgcagaaaaatgaatccgccagtacactgattccaaggcatcagaaaagcccgatggctctttacatggattctctgagactaataaatatagcggagctggacaacagcatcgccatcagcctaatgtacacaaaagcggataacttcaccggagaaattctttatgacgacctgtccgaagcctatctgcatcctcatgcggcgtatgccctcttaaaagcacaagaagcactgaaggtactgcatccatcttacagtctcattatttacgacgctgcacgtccgatgtcggtacagagaaaaatgtgggatgtggtcaaaggaacttccaaatacagatatgtctccaatcccaaccgtggaggcggacttcataattacggcctggcggtagacatcagcattcaggactcgctggggcgaccgttgcctatgggcacaaaggtagatcatcttggagtagaagcgcacatcaccgaagaaggcgaactgatacgcaacggaaaaatcaccgaaacagaacgtcagaaccggatattattgaggaaagtaatgaaagccgccggattccgtgcattgcccagcgaatggtggcatttcaacttctgcagccgggaagaagcccggaagaaatacaacgtaataccataaacgagtaccaccatataacgccgaatataaacaacctatgatgcaaatctcccccgaaacccagctctttatccgcgaacatcagacggatgatgtacgtgctctggccctgcaagcccggaaatacccgaatgtagatatgccgaccgccatcacacagatagcaggaaggcaagttgccgccgaaaagattccatcatggagagatacggatgatatatggtacccgaagcacctgtcactggagcaatgttcgtcagaagtcaccgcccgctacaaagcaacccttctaaaaggtaactccctgacggacctgaccggaggattcggaatagactgcgctttccttgctgccagattcaaatccgccacttacgtagaacgtcagcaggaactctgcgagatagcagcacacaactttcccatcctgaacctaaaccatatcaacgtaaagaacgaggacggagtgagttatctgcaagctatgtctccggtagactgcatcttcctcgatcctgcccgccgcaacgagcacggaggaaagacggttgccatctcagactgtgaacccgatgtagccgaactggaagaactcttactgaacaaagcggaacaggtcatggtcaaactctcgcccatgctggacttgtcattggcattgaaagagttacaacacgtacaggaagtccacatcatatctgccaataatgaatgcaaagagttactactgatactcggacaagcatcggcagaagaaatatccatccattgcgtaaatctccctaccaggggggcacaggaagaacagcatttcgtattcacccgcgaacaggagcagtgcagcgaatgcaactataccgacacactggaaaattatctctatgagccgaacgcttcactcctgaaagccggagctttccgcagcatcgcctccgcatttcctgttaaaaaactgcatcctaacagtcatctttatacttctgatgtgttggtcgagagctttcccggcagggctttccacatcattagtcagtgcagccttaataaaaaagaactaaaagaaagtctcggagacttgaaaaaagcaaatatcacagtacgtaactttccggctacggttgccgaactccgtaaacgaatcaaattgtcggaaggtggagacacttatctgtttgccagcaccttaaacaacggacaaaaagtactgatccgctgtgagaaagcctgagtctgtaatagcattacaacacagccccttcctgcaccattacatcagtatatgaaataggaacgataaaaaaggataaggatcactcagctgtccttaaaatcccagactgaatttcccgaaaaataaatgagagtgaattctaagtcctctccaaacaatatctataaaatcttacccaagtttacgaacattaacgtatccttgggtaagtttgtatatagacatacctactcttcagaagtgtatagctacttcctaa

SEQ ID NO: 39 - DNA, 76483 bp, Bacteroides thetaiotaomicron
gagagttgcagtctgattcagcctatagtcatttaagactagtgtcaaagttagttcactgcaactctacttttcaaatatacacttatattttgttgtgatatttaatactgcaaatgtaaatgtgccaaaactccccttttaacgaaatcatcctcgctacaactatctttgtggcgaggatggatttttaattaatattcccgtatttcattcttatagatttttacttctaccagcttttgggcgtttacatccgagacccaaagagtgttttggtctaccagcagcttctcgggtttcttaaaagtatatcctttgacggacttaaaactgttttcccagttccctttggttcggtcatagataaatagagacccgttttgggcagatagaatcattcgattttcatgcaacgcgatgccgcagggattgaagctcagagggagcgttttttctgtgtcaatcagtatcttctgatctcctttttctatcagtgtggtgtcgatggcttgaattttctgattgccgtattgcccgaaatcagcaagataaacgataccggtggaatcctgcaccatctgatgagaatggaaaccgttattcacatccattccatctcctttactgcggcaatagaaaggaactttctgataattctccaaagttacgtcagcttcccggtagactaacagattctttttggtacgaatcatgatatttccgtccggtgtgatagccatagcgtgagagtgtaccatctgattgattccgtctccccagttacctgtgccgatgcgtgtgatgaactccagcgtccgtacatcgaatacatctattcgggaacttatgtttgcaaggtacagccggttaccggatattccgatcgcttcaatcttatccggaaacttctgttctgcctctttatatttccagcttttgagcgaagccagatgtcggttcttgttccggtcataaagttccagactaaaagctccgctttgaatattggctacaaaaagagtatctccttttatgtaagtaggtccgggggtgaattgaccttcagccaaggcgaagtctgtggcggataactgtcgtgccgcttcgtatgaatagtaataatagcttgtatatggctctgcgggttttgtagccgggcggacttccgggttttcttcttccgagcaactacctgtgattaatgccattagtaacagacatccggtatataatttttcttttctcatgtcttctttttttttaattcaacttttctacagggattcccgttactgtatgtgcattccggtctactatgaacaatgtctgccgtgccattgacatcttttccacgttactgaaggtgtgtccttcgacagttgtgtaatccttaatcacagtccctgtctccggattgacttcggccagggcgataggctgattcttgcctgtagcaaaggagacgaacattcgtttgccgataaatgcaatgtcgtacggcgaataagaggtcagattaatgacccgttgggctttccattccacctgttcgcgcattgcctgaaggtcgaatacataaatcttcttatttccctggtgggtggtataaagtaacccgtcgttgccgattgtctgcccgtaagtacccattgcctctcccatattcgatgtccggcaataattgggcacatttttgaagctttttccggggacaatatcgtcttcgataaatacacatacccgtttcttatctcggataaacacgcatccccggtgtaccagtacatcgaaagcatgaaccgtttggttgcttccttctccccaagagcctgtgccgatggttgccaccagttcaaaagtcttttcatcaaaaatatcagtccggctttgttcgtttgtaacgtaaatcttaccgtgggctacggtcacgccgttcggtgttgcggcaaatccctttgttgcccctccttccgtccactctttcaggctttttatgtgcgtcagtttgccgttctgctcttccagaatctccagactgaaatttccgctggcattgttcacgatgtagattcggttgccatatacacagacatccttgggcgcaaaagtcgattccgtggcttggggaatatctttgtaggtgatgatgcaggagagtggtgttccttgcgcagtatcctcatcctcttctttcaatatcggcgatagtccaccgtcgattgcatccagttcagggtcttcaatgatgtatcgggaagcgttgtattttgagctgccataaagtttgccatagcggcgggtgtgcatgaatcttcgtgagtacaccggaagtttcttttcgatgcatagtttgttgtatacggtggcgcagagggtaatccatccggttcccgtttgttcgtaagtcatgtttccgctgtgcccgtagccgaggcaatgacccaactcgtgaaacgtggcgctggtgtgcgctccgtcgtctgcgtagtgttccagaaagcaccattcgttgagtccataagtttctccgcctcccagtccgtctacggttgtcactttcccgataacgaagccggagtggttgattacttttttgaggagcatatcgatgtcaataacagttttgttggcgtcactatgcagtttgcctctgtatttttccagttcttcggcaaattcctttgacgagaacatatagccgtagttcagcatcattgctaccgcttcccgggcgtgagccggataaagtggataggcccatgaaccggtctgactataggcggagaaacgtacgttgtatttggacttggtggaaagcagtttttgatagtatttgtcattacattctatttccagtttgaagtcggctgcggacaggtgtggatttgccataatctggatttcttttcctgaacgggtgatgtaacgcttgctttgcgtcagcatcggcagttccttatgaaattcagtgaaagctgggagcacatcgaactttgccagttggaatgcttcttcatatccgctgatggttgcccacacagtcacctccttgacaggacggggcgaatagaaacggataaataactcttgctgctcggtgatgctgacttgcaggggctggtttactctgaatccccgctgggtgttattgaatagaatcgtggcaggctcatcatcctgaagcattaatttgaaaacatccggagtcaggtctttctctgctatccggattattccatacgggttctctgttgtttcgctgtctgtgtctgccggcgtttctattaagtcgtctttggtgcagctttgcagtccccatatacagaaaataagaaaataggtgaaacgaaagattctgtggaatatcatatttctttttttagtttgcgggcggcaaaggtataaaaaaaatgtttatcaccattcatcctgcttcttttcccttatcttagtggcgtaataaaaaacaaacaactatgaatcaaacacgttgtatcgtaattttgtctattcttgctctttttgtagcaagcgtatctgttgccggaaatatctctctaccggatgcttctcaaaaggtttttgaaggaaaaccatgtattaactctccccgggcgattggcaattatcctgccagtcctttcctcttttatattcctactaccggtcagcggccgatggaatggagtgcggagaaacttccgaaaggattgaaactggattcgaaaacagggattatcacaggatcagtagcttctaaaggtgaatataccgtcactcttaaagctaagaacgcattggggaccagtacggaaaagctcgtgatccgcattggtgatgacctgttgctgactcctcccatgggttggaacagttggaatactttcgggcgacatctcaccgaagagttggttttgcaaactgcggatgcgctggtagccaacggaatgcgggatttaggctattcctatattaacatcgacgacttctggcagttgcccgaacggggagctgacggacatttgcagattaataaagataagttcccgcgtggaataaagtatgtggcagattatctgcacgagcgcggtttcaaactcggaatttattcggatgcaaccgataagacttgtggcggtgtatgcggcagttacggctacgaagaagtggatgcgaaagatttcgcttcgtggggtgtcgatttgttgaagtatgattattgcaatgctcctgtcgaccgggtggaggctatggagcgctatgcaaagatgggaaaggcgttgcgtggtacgggacgttccatcgtgttctccatttgtgagtggggacagcgcgaaccttggaaatgggcaaaacaggtaggcggacatttgtggcgcgtttcgggagatataggcgatgtctggaaccgggaagccaacaagttgggcgggcttcgtggtatcctgaatattcttgaaatcaatgctcctttgagtgaatatggcggtccttccggttggaatgatccggatatgctggtagttggtatcggtggtaagagtatgagtatcggatatgaatcggaaggttgcacccacgaacagtataagtctcattttgcattatggtgtatgatggcttctccattactttgcggaaatgacgtgcgaagtatgaatgacagtacattgcaggttctgttggatagggacctgattgctatcaaccaggatgtgttgggcaagcaggcggagcgcagcatccgtgcagatcattatgatatttgggtaaagccgttggctgacggtcgcaaagcggtagcttgttttaaccgggcggatactccacgtactatagaattaaattcaaaaacggtggaagacctgtctttggagcaggtgtatagccttgacagccgttctatggaaaatgctgcgaataacataatggtggacttggcgccttaccaatgcaaggtttatatctgtggaaagccgaaaaaatagtcaatgacagtactggaatgacagtaataaatctctgaggtaaaataaagaaaggttggggcataaaaaaaggagcaacgccttgctccaacctttgttaaccttaaatctaatactatgaaaaaaatcacatgacaaatgtaagtcttcttgctattccttccaaataatattcttgtatttgcgtctcttttgatttctttcacggattttcactgttatcgcacacaatgggtctgaattgaggaatctcagcctttttattaactaacaagtttgttactaacaaagttgttagtaacaaacttgttagtcattgacgatgcaatccttgcttatgtgccagtactccagttttttaatttgttattaacgctcgaaggtcttgaggacttgacaaaggcttttttatgttgtatatttgtagtcgtaataacaacaataaaactcaaatcaaaacttagaaacgaatgagaggaatcttatcttttgctgcactggctgcgatgtacttccccggatgtacaacgagtaaaaatgcggtgcattgtctcagccgatggattaaaggttgtaacccgttggtcaaagaacttataccgacaggttacttgccgtacaatcaccggtttttgacatcaaaacagtataagatcataacaaaacatctaggagatccttatgaggattagggcataagtagcccggaaatgagcaaaaggctgcaaacttttacggagtttgcagccttttttgttgcataaattcaagaaaaagagatttgaaaggcgtatcggcgtttttaataaacttgggaaccgtttctaataaacgatgaaagaatttattagaaactcaaatacggttttagtatacagtgtctatgtttttcattgtgggtaaatcgggagaaggcagtatcgtattcattggattagtatattggtaaatttgcatgactatttttacctttctctcatagaccgttttgtatgacaaagtatcatgttgcttttttgttggttatactataatgcagctaatttgtacgtaattctatttgagcaaacagaataattcgtttattcgcatatgataaataccgaaatgagtattattgctctattatatatatgtatattcggttttctaaaattataaagctatgagaaagcacacttttctatttattatctttttgtatgttggcatctgcatacaggttaaggcaacagatcaaagaggagaatatctcgtcataggtaaagatacattggaaatgcttacttgaccattgggagatagtgagactctgagtaagcaggtaaagaattgtatttcgaagcgctccttctctactgattgcgggcgggggtatgtcggtatatggagactggaaaccgacagactctattgggagaaacagcaatgaacgcactttcgaaaaaaaatattcatctgtatagtcgattgaaaataagcgaattactttaggatatttactgctttaaagccattgaaaggagacacaagggggactaaaggggactggacggtttgcgccctgttatatctttgcagagtcattcagacaaaacggaatggcaaacagataacctttatttttttaaccatttaaactttaacaattatggctttagagtatgtagtaacaaaaagagtgttcggttttgacaaggacaaaaacgaaaagtatgtagcaaagtcggttcgttccggcagagtaagtttttccaagatgtgtggcaaggtgagccgtctttgtggagttcaccgcaaggtagtggatctggtcgtcagcggtcttgtcgatatgatggcggaggacattgacgacggaaagagcgttcagatgggtgagttcggcatcttcagccctaccattcgcgctaagagtgcggatgacgagaaggaagtatcatctaagtcaatcgtccaaagaaagatccttttctatcctggaaaaatattcaagaccacgttggatgatatgagtattacccgtcgtgcggagttggatacggactatacggacggaagtagtaacaatggtagcggcagtgagaaacctaatcccggtggggacggaggcaaagatgacgaagaagccccggacccgactgtataagtcttttgtactttccttttagatattagtcagagcgggaaaggcttattgagaagtagtaaatgcacagatgatcggttatactcgattttctgtgcattttttctttatataatgccttggtgtgtctattgtttcctccttatctgctcctaaacttgcaaattcgttccaatcgtttcacagaaccttccatgttctgttttttgttctgctagtatgatttagtttatattataacttctatatttgttcacagaaacgaacaattatgaaacacggaatctatacatgcgttattctcatggcatttcttgctttatcagaaagtgtgtatgcagtggttccggttttcacggttgcgagtgacactatcaggcgggtggtgatatatttcgatcaggaagaaacagatgttgattcctgttataaaactaataatcaagaaattaatgttttagattctttgcttgaggaaagaataaattcaagatatatcactgcgctcaatgtggtcacttttgtatcgcctgacggagattcggtttataatgccgcattatctgtccgaagaaacaattcgatgagagagttcttaaggcaacgttatccgtatgttgatgtcgaaaagattaaacttacttctgaaggagaagactggtctgaacttcgtaagttggtggcgtcggattcagacttgccggaccgggaagaagtcttgatgttgatagattatcatcgggataacatcgtgaagcgaaaagaactgttgcagaagttgaatcagggaatggcttaccgatatattgtccgcaacgtgttacctaagttgagacgcgctgagattacggttgtccgcaaagttccggaaatggaaaagaatatttttgaaccggtatcttctgtctccggattgtttgtttcaaagcaggaagaggcgcttccgagcgatcaacctgataagccggagggagaaagtaaagagagtatggcttatgaggtggtagtgtcggaggcagaagggccggttgaaagtaaaacggtgcttgcagtgaagaataatctgttgtacgacttggcgttggcgccaaatctggaagtagagattccggtaggcaaaaggtggtctttaaatgctgaatacaaatgcccgtggtggctcaacagtaaacacaatttctgttatcagcttctttcgggaggagtggaaggacgttgctggttgggcaatcgtcagaagcgcaaccggttgacagggcattttgttgggctttatgctgaaggtggaatttacgatttccagtggaagggcgacggttatcggggcgattattacggagctgcgggagtgacctacgggtatgcgaggcaactggctcgccatctgtcgctcgaatttagcttcggcatcgggtatctgacaacagaatataagaaatatactccttacgagggggatatcgtgtggacaactagtggacgttataactttataggtcctaccaaggcgaaagtctctctggtatggctgataaaaagagggagataaggacgttatgcaagatacaagatacatacttcttgtgcttctgtcctcgctgctgatgctgaccggatgtagccgtcgcgaactattggatgattatcccgtaagcggggtagatataaagttagattggaacggtgttaccgataagttgccggaaggggttcgggtgattttttatccgaagagtgcggaaggcagaaagattgatacatacctttcagtaagaggtggaaaagtaaaggtgccgccggggcgttactcggtagtggcttacaactacgacactgaaacggtgcagatcagaggagaggaagcctatgagacgattgaagcatttacaggctattgcaatggtctgggaatagcgggaacggagaaaatggtatggggacctgatcccttatacgtagtgcagatcgatgatttacatatagcgaacagtgaagaagagcttctactggattggaaaccgaaattagtggtaaagacctattttttcaagatcaaggtggaaggactggaatatgtttcttcaattgtaggcagtgtggaaggtatggcgggttgttactgtttgggcagatgttgcgggatgatgtgcgatgctcctatttactttgaggcgcaagggcgttcgggtgaagtaacgggtagttttactgcttttggaatgccggaggccgcgataagccgggcaggtgacaagataaagctgacactggcttttattaaagtagataaaaccgtgcagaaagcggagattgatataacggaggtggttactaattctgagagtggaggtagtggaggaggaaatgttgatgaacctcccacggaaatagagttgccacttgatgaaaaggttaaggttgagaagccgactactaatccggatggcggaggtggtggtattggtggagatgttggtgattggggcgatgaggatgaagtggttctgcctgttgagtgagattaaacataaacaaatataacaatattaacgaattaaaaaatacaattatgaaaaagattttattggctattgcagcagttgcaacaattacaggttgttcacagagtgaagagtttgagaatccgggacaaaaggcggaaattaattttagtacagcagtaactagagcaactgcacttgatacagaaggtttacaaaatgctggtttccaggtttatgcatataatacaggaacgacagaaatgtctactactgcggttcttccgtcttcagcatggatagctaataaggcaacttatgctagtacttggtcagtagcaggaggtccgtattactggccattagatgaaaatttacagttttttgcttattctccgtcagatggagttacatatactggtcctgatggtactattgcgggatatcctaaatttacttataaagtaggggatacggctgccgatcaaaaagacttagttatttcgtccgtgttgaatcagactaaggaaacggataaaacagcaccagttgtttcgttaaattttaaacatgcattgactcaaattaatgttcaggtgattaaaggaagtacagattatacctacgaatttgcagctgataatgctgttacaataagtggcattaaaggcgaaggaacctttgcttatacaggagctgacactggcgattggacgccagaaggcactgaagcgacgtatacatatactttaggtgattttactgacgggacaagtgccattgttcctggtaatgcactgatgttgataccacaagatattactgatgctaaaataacgattaggtataacacaaagaagggcgatagctatatatttaaaggatcaaaagagattcctttgaagtctaccacagcatgggcttttggaactaaaattttgtataagctgactttaccggttggtggtgaagaagtaaagatcgaagcgacagctgctaaatgggatactgaaaagcctgaaactaccgaacctagcgtttaatgtattaatagaataatatttctcaggttatagtcttttataccagtttatgtagttttgaatttataagatcattctcgttacgacatattgcaacgagagtgattttataaatttcttccctttctcattgtcatataaaagatttcatatacatttgttggccaacaggaacaaatcaaacaccaacacaaatatatgtcatctatctgtcaaggtacttgggattgtcagaactgcccgaaagccgtagacaatgctattgctcacattattcatccaagaggctatcaccaaccagcccggaaatgtgaggaaaacttcatcctttttttgataagaggtgaggtattggttaatagtcaagaatatgcaggtacgatgctgagagcaggtgaatttattcttcaggctatcggttcaaaatttgagatgcttgccatgactgagtgcgaatgtatttattatcgtttcattcagccggaactattctgtgacttccgtttcaatcatattatgaaggaggtgtcttcaccattaatctattcaccattaaagataatccctgaattgaaatattttttggatggctctaaatcctatttgagtgaaagtaaagtttgtcgggacttgctgtcgttaaagcgcaaggaactggcatttgtattggggtactattattcagactatgatttggcaagcttggtacatccactctctaaatacacttccactttccagtacttcatccttcaaaactataagaaagtaaaaacagtggaagaacttgcccaacttggcggctatactgtcagtaccctgcggcgtatcttcaataatgtattccacgaaccggtatacgaatggatgcaggcgcgacgtaaggaaggtattttggacgagttgcttaatacaaacaacagtatctctgaaatatgctataaatatggctttgaatctctgccacacttctccaatttctgtaagaaattcttcggtgcttctccacgcatgctaagaacaaacaaaaagaccatctgataatttttcagagagaacgtcaaataatctttttttctttgtgagcatagtgcatttgttgtatattgctgctgtttcccttaaaatcagtctaatacatctttattatagagtcggatcacttcaaataaagccatgacaaggcggatacggaaattaaactttttatttcagtaaatttaaatctattgcgacacgtacaataactaggatataaatcataaatactatgtaatgagaacaaaacgagcttttaaggaattttgtgtattgggtggtttggcatcttccgtttgcggggtggctcaggaacgcccgaatattattgtcttccttgtagatgacatgggacttatggatacgtcggttccttttatcgcagatgagagtggtcagccggtgcgtcatccgctgaatgactagtatcatactccgaatatggagagactggctaaacagggtatttgtttctctactttttacgcacagagcgtgagttccccttccagagcttccatcatgaccggacagaatgcgaccaggcatggagtcactaactggattaatgctgagagcaacaaccggaatcctttcggaccgccccaatggaactggaaaggtctcagaaaagatatgcctaccatgccgagagtcctgcaacaagccggatataaaaccattcatgtaggaaaagcacatttcggctgtatgggaagcgaaggagagaatccgctgaatatcggctttgatgtaaatatcgcaggttccggcattggacatcccggcagctattatggcgaatggggatacgggcatatcaagggacagaagattagagcagttcctgacctggagaaatatcacggtacagataccttcctgagtgaagcgctgactatagaagcgaatcgggagatcaccaaagccgtagaagaaaaacgacctttctatctgaatatggcccattacgcagttcattcacctttccaggcagacaaacgtttcttgtcacgctacaccgacccggataagaacgagcaggcaagagcttttgctacattgatagaaggcatggataaatcattaggcgacatcatggaccaactcgaaaagctgggaattgccgaaaatacgctgattctctttttaggagataacggtggtgatgctccattgggagatgaacgtggctatggttcttccgctccgctgagaggtaaaaaggggacggagtttgaaggtggtatgcgtgttcctttcatcgcagcttgggccaagcctgagaagaagagcaaagtacagaagaacttgcctattgaagtaggaagtatgcagacacagttgggcacaatcatggatatctatccgactgttctgtctgtggcaggatgcgaagttccccaaaactacgtgatagacggattcgatctgaaaaagcaactgagcggtaaggtggacaagaagcgtcccgagtctttcctgatgcacttccctcacgcacaccgcggcagctacttcaccacctatcgcatgggcgactggaaactgatttattattatcttcccgagactccgaaacaacccaaagccttgctttacaatctgaaagacgatccggaagaaaggaatgagctgtctgccgcacatccggatcaatgcagagagatgattcgggaaatgtccgcccggctagaaaaggaaggagctctttatccggtggataaacaaggaaatgagttgaagccttttgtttacttttaaataggtgctactatttcaactgtctgttttgccaaagcatatctattaggcaaaacagacagaattatatatcatttgtcagatacaattgctatgaccggattggcatcctcatccaattggctcatccaatggggaatattctcatttttattgtcagattgtttttgagaagcatcaggaatactggcagcttccagaataaatccatattctcctttataactgcacaatgccgacaggtcaactttcagttcctgctctgaagtgagatcgtcaacaatgaattgctggcactttgcaaacttagtttgctgtgtttctttattatacaaaccattatagacttgtttgttttttacgtattgaaaaaatacagaatgtgtgttttccaatacataagctacgtagatactttgcggattactataccataaaggattggcggatgaatgatctgtatctgtatgaaaaaccatatatggatatagtttcctgtttttaattgtgtatatcgtgtctgtgaaggtttctctgaaacgtacttcattctcggacgaccataggctgggattatagagaggcagcagtaattctccttgctccttatctttgataatcattacccctcttcttcccagatttccaaagaaacctgctcctctttttatgatagaaaggctggatatattatccggagaagggatagagggcgattttaataaattgggaattgaatccagcttttctccaaaggagttgaggaaaagcaaagagttgctggattccaatcctatactactattacaatgggcaataatggtagagtcggaaaacgcgaaaaagtcgggtgcggcaggtatatgtggaatttgaattttcccggtcatttctcctttctgattatattttagcaactggtccggtgcgcgaaagaagtaaaaaagacctgcatcatctatccagtaatttgtcgagctatatccacttggatcatcaccgatatggcctatactgcatatatacttcccggtctgtttgtggaataagaaacattggtctttagtagcaatcacaatcttgtcttccagcagcgctatatggggattgtttcctatcaggcatacttcgttggtttccaaaggtacataacgtacagtatttccgaagtcagataactttaggctttgggaatcagttgcatccgtaagatttacaaataatgtatccctggcattctcctgatttgtgatgcatgaggttagtaagactactatccatatcagcaataatttattcatcgtatttaatttatttgattgtctggccttatgtcacaaagaaaagaataaaaaacggataatgaacaagctatctataaataattggtcagtaaaaagaaatcccccgccagctaacgccgacgggggatttatgctattaatcaaatcaagctcacgcttagtctttcagtttagcgatgatgaagtcgcggttcaggcgggcgatgttgctgatagagatgttcttcggacattcagcctcgcaagcgcgggtgttggtacagttaccgaatccgagttcgtccatcttggacaacatagctttcgcacggcgtagagcttccggtttaccttgcggaagcaagttcaactggctgacctttgccgaaacgaacaacatggcagaaccattcttacaagcagctacacaagcaccgcaaccgatacaagaagcggcatccatagcttcgtcagcgatgggcttcgggatcaggatagcgttggcatcctgcggagcacctgtacgaacgcttacgtaaccaccggcctgcatgatcttgtcataagcagtacggtctaccatcaagtccttgatgacagggaaaccggccgaacgccaaggctcaacagtgatggtgtcaccatcgttgaaacgacgcatgtaaatctggcaagtagtagcacctgttgcaggaccgtgcggatgtccgttgatgtaaagagaacacataccgcagataccttcgcggcagtcgtggtcgaatacaaccggttcttttctttcgctgatcagctgttcgttcagaatatccagcatttcgaggaaggaagtatcaccggggatatctttcatttggtaggtttcaaaagcgcctttagccttcgggcctgcttgacgccataccttcagtgtaaatgatatatttttatccattttcgtctaattcttttaaatgtttaacttcaccgattagctcttgtagttacgggtctgaaccttgatagcttcgtataccagcggttctttgatcaatacaggagccttttcatcgtcaccctgatattcccagcaagctacgtagaagaagttttcgtcatcacgttttgcttctccttcttcagtctggtattcttcacggaagtgaccaccacaactttcgttacggttcaatgcgtcgtaagcaacgagctcgcccatagtgatgaagtcatacagacggatagccttgtcgagctcaacgttcataccttccttagaaccggggataaacagattggtttcgaattccttgcggactgctttcagttcggcgatacctttcttcaggccttctgccgtacgtcccatacctacgtattcccacatgatgtgacccagtttcttgtggatagaatcaactgattctttaccctggatgctcatgaacttgtcgatcttagcctgaactgccttttctgcttcggcaaattccggaaggtcggtagagaaacgaggaacagtaatctgatctgccagatagttctggatagtgtaaggcaatacgaagtaaccgtcggccagaccttgcatcaatgcggaagcaccgaggcggtttgcaccgtggtcggagaagttacattcaccgatagcgaacagacccttgatggtagtctgcagttcgtagtctacccagataccacccattgtgtagtggatagccggataaatcatcatcggattataatatttcacaccactgatttcttttgccagttcgcccggattaacgtcagtgatttcttcatacatgtcgaagaggttaccataacgctgaagcactacatcgatgcccaggcggttgatagcttcagagaaatcgaggaatacggccagacctgtgttgttcacaccgaaacctgcgtcgcaacgttctttagctgcacggctggcaacgtcacgcggaaccaggttaccgaatgccggataacggcgttccaggtagtagtcgcggtcttcttcaggaatatcgcttcccttgatttcgcctttctgcaatttgatagcgtcttctttcttcttcggaacccagatacgaccgtcgttacgcagagattcggacatcagagtcagtttggactgcttgtcaccgtgtaccgggatacaagtcgggtgaatctgaacgtatgcggggttagcgaatacagcacccttgcggtagcaagagatagcagctgtacagttacaacccatagcgttggtagacaggaagtaagcgttaccgtaaccaccggtagcgattactacggcgtgagcagcgaaacgttccagttcgccggtgattaagttcttggcaatgataccgcgagcacgtccgtcgatgattacaacgtcctgcatttcataacgggtgaacaacttcaccgtacctacgtttacctgacggcttagtgcggagtaagcacccagcaacagctgctgaccggtctggcctttagcgtagaacgtacgtgatacctgtgcaccaccgaaagaacggttgtccagtgtaccgccgtattcgcgtgcaaaaggaacaccctgggctacgcattggtcgatgatagcgttggatacttcggccagacggtaaacgttggcttcacgtgcacgatagtcaccaccttttactgtatcgtaaaacagacggtaaacggagtcaccatcattctgataattctttgcagcattgataccaccctgtgcagcgatagagtgtgcacggcgcggagagtcctgaatacagaagttgaatactctgaaacccatttcaccgagggatgcagcagcagaagcacctgccagacccgtacccacaacgatgatatccaaacggcgtttattagcggggttcaccaatttctggtgagctttatagttggtccatttctcagccaccgggccttctggaatttttgaatctatcttgatcataatattatttacaatttaatcatttacaatttactatttagcaagcaccgccacaaaggagtgatttcacgaagaataccactactacgagtgcgaaaccgagtactacaatcgtagaatagatgttagaaatacatttccaacgattgatccataccttgttgttccatcccagtgattgcatggagctccagaaaccgtgagtcaggtggaaccacagagcaaacagccaaatgaggtagagcactacataaaccggacaagagaatgtctgctggatgtgatatgcaccgtttgccgcataagccagcgtcagtgtatcagcgtgcatgtccaggttgtgcatcagttccggcaactgcatttttgcccagaagttgaagaggtgcaaaccgaggcctacgataacgataatgcctaacaccaacatgttttgagaagcccactctacagttttcggtttgtcgactactgcatagcgttcgctaccgcgcgctgtgcgattctgcattgtcagccagaacgcgtagatgatgtgaataatgaaaagagcagccagtgctgcggtagctaccagcgcataccagtttgctcccaaaaactcacaaatcatgttgtaaccatcagccgagatgattgcaactaagttcatcgccatgtgaaatgttagaaacaggacaagggcgataccggtaacgctcatcaccactttccttcctacagatgaattacttaaccacataaatgattgaatttaaattatttaattgttagaactaaaatttcgacgttttacacctcttacagactgcaaaaataggggaaatagattgattgaccaaagaattaaagaaataattccttaatcggtgatctttccgattttttcgccattggccgctttcttgcgcaaggcgcgcggggtgtctccgaaggagtctttgcagaagtgtgcaaggtgggacagcgagtcgaaaccataccggttgcaaatctctgtaatccgcatattagagtgctgtaggtcttcgaggatgccttcccgttttttctccagcatccattcgtagacgggcacgccgtataagtttcggaagagacggcggaaggtggtggtgttatagcctcccagatgtgcgaattcttcgacgttcttcgctttgctgtaattctgcatgacaaagtattggaaactttccgtataggtgctgatcgggtagaagaaagccctcaactggggcaggggatagtaattggtgatcatatacaccatctcctgacatttcaggtcgatatatttgccgcaggcgggtgtcgattcgtcaaggtatgcggctacgtcgttgatgagatagaacaggcgcgggttcatcaccattggggtgtaggtcagcgggccttctgcctggtcgatgatttcacggtagcggttttcgcatagcaacggcagttcgttgaaccagaaaaggatgtatgatacgtccgtcagtgccagtatctcgtattttgagccgatggcttgcaggataaactgtttctcgtgtagtgtcgttccgggatgttcgtcactgttgatcagcaattcgccctcgatcataaagagcatgcagttttgcgtgcacttatccttcggaatatgctgccctctgagcagatttctgtgaataagagtactttccatcgctttggggcatcctgagcaatctgtatgttgagcacaaagtgagtcttttgacatgggttttatccgtgaatcgttgtctacagggacaaagatagtcgttttttgtgaaaataaaattctttcttccattatgttttagcagaaacggggatatgattgtctttattggttttgtttgcacaactttgaagtttcacggactcctgaatggcgttctttaatacatttttatctgccatctgcagcattttcttcatccctttacatgatatattcagaacaagtagtttcatcattagttccacctgttgaaaccaagtgtttcaaggcatgaaacaaactgtttcaagtaatgaaacttcttggaacaactgtcgatttcgttcatatgacagctcgattcaactcacttgaccgcataagttgctctgattgacctgtccgttcgaaaggtattatttcatttttcagtcaataatggatgacttctcagctgttaatacctgatttctcaattattaatagctgacatgacaatcgttaatagctgacgcgtcagatgttaatacccagtaaatcaaagtataatgtaggataaacgacctatatgccgtggtggcagagtgagagcaaacctttgctctcactctgccaccatacttgctgtaatgcttgaaatgccgatgaataaagggatacacgcgaataatgagagcgttagggcaaaactgctatctttttcacttgtagcagctgcctaagttcaagttataaatgcgacagttcagtttccgtaccagtcacttacttattatagtatttttcaagcagtttctgcatttccggatatttctcgtccgtatctccggtttctttgcgaagtctcaataagtctttcttcatctgtttgatgacaggtgcatatttcggatcgttgtatgcattatgattctcgtgcggatcattctgtaagtcatagaagtcccatgacggagtaaagtcaaagttctccgtatcagtcatgtctagatttcgggcataatagaagatcagcttgtaacggtctgaccggatggcgaagtgcgcgggacgaatagcatgattggtccagtagcgatagtagatttcttttcgccagtcggtcggcgtgttgccttccaggttgctgacgaagctgtctccttgcacattctccatctttactccggcaaattctgccagcgtcggtgcgaaatcgacattcagtatcagatcgtccagacgttttcctgcgggtaccttcttcggataacggataacgaaaggcatacgagccgattcttcataaaacatccgtttgtcgaagaagccgtgttcgcctaggaaatagccttggtcggagacgtagatgacgatggtattgtcggcgatattcatttcgtccagagcgtttaggagtttgccgatgttgtcgtcgacggtagcgccgcaacggaggtagtcacggataaacttttggtaggaagcacgtctggcggccgtccgttgcatcccttcggtgctgaacggcagtccggggtagcgacaccaccacttgtcggggtcctgtgatgcgatgcgccagcggcgttccagctcttccagtgtctgtcctttgaaagaacggccgttggtttccggtccccagtccagcaggttttcgggttcggggaaggtgacgccgtcgtagagatgctccatgcgtatcgggtagtcgtagggttcgtgcgttgctttgaaatggcagcacatcaggaagggttggttgccgtcctgctctttcatccatcggatggctttctcggtgacgaggtcggtggagaagccgagcacccgttcgccgaactggtggttgccgggccacgggtcggtgctctctatgaaagtcgggtcacggtattcgccttgatcgtagaagatggagtagtagtcgaatccttgcggttgcgactggatatgccatttgccgacgagtccggtgtggtatccgttggcttgtagcagggtggcaagggtggggatggaggtgtccagtgagtccgcaagggtgtacagtctgttccggtgactgtatagaccggtgaggatactggcacggctgggtgctgagatagagttggtgcagaaacagttgtcgagcactaccccttcttttgccagccggcggatgttggcgttgtcggcatattctgccagtactccgccatagatgccccaggcttgggaggtgtggtcgtcactcaggataaaaaggatgttggggcgttgtccggcaggttgagcgccttgcaggtgcgtcatggttccggctgccagcagaccggtaagtacgagtttattcatatacgtatagatgttgcatttcttcaaaagtcagtctaagttagacggttgctttcatgtagataaatgatcatatgaactgattttatgcctaaagatagtgattgttattcactttgtattataatccggaaaacttttgcgatttaatgtaattgattccggtaaaacacttaattccctttttaaaaggatgtttttgttttacatctctcaataagaaactttatgttgatttttggaagtattatagtgatttttgaacatttgttttctttgcctgtacctacttttgcgatcaaaacccattaattatcaattattatgctactaccaagaaaaattgtatttttccttctcttgtttgtcggattatcgttgtatgcgcaacaaaactgcttcattagttcgtatgtacggggtaatttctacaatcgcggacgtatttctgccgagagtttaagggcgagtgatgatttgatttttctgaacgtccgtcccaataaagacgggtcgctttcgtttgagaatccccgtatctttgagaatgggaaaggagtgactagttgggaggaattgataaagtctgtccgtgcggatgtgaaaggaacaaagacaaaacttcgtctgggcgctgccagtggcgagtggaaagcgatggttgcagatgaggcggcccgtgttgcatttgccaaaaacataaagaagatactggaaaagaataagctcgatggcatcgatctggattttgaatgggcggagactgaaaaagagtatgaagattacagtctggctattctgaagatgagagaggtattgggagataaatatgtgttcagcgtatccctgcatcctgtgtgttataagattagtaaagaggcgattgctgcggtcgatttcatttcttatcagtgttacggtccttcgccggttcgcttcccgatggagaaatactgttcggatatacagatggcgttggcttatggcattccaaaggaaaagctggtggcaggcgttcctttctatggcgtgacaaaagatggctcaaagaagactgaggcttacttcagttttgtgcaggacgggctgattacggggccggcacaaaacgaagtaacctataaaggagacgtgtatgtctttgacgggcaaaataatatccgtgccaagacacgttatgcgatggaccagcagctcaaaggaatgatgagctgggacttggctacggatatgccgctgaatgacagcagatcgttgtttaagacgatggtggaggagttggggaggtgaactgcttcagataatctgaaggagagacaccaaactcatccttaaaacattgacggaagtagcctgtactgttcattcctattttataggctatttccgagatattatattttccttcgaggagtaaccgttccgcattctgcatttttactttccggatgtactcgttcgtagaaagtccggtcagtgctttcattttccggtagagcgtagaaccgctcatacacatcttgtcggacagataagtgatgtcgatcttttccgaagaaaggttatcctcaaccagttgcgtgattttctcaatgaattcgttatccagtttgctgagcgcctcggtgattatggaacgcttttcatccaaatgagaattggggttatgattcgttccggtctgctggaattgagcaatcagtttctttctcgaatcaagcagattgttgatgcggcttcgcagcagtgaagcactgaaaggcttggtcagataagaatccgctcccacttcgtatccttcttctttatcctgcaatgaatctttggccgttagcaggatgacagggatgtggctggtacgcacatcctcttttagttgacggcatagcgtgatgccatccattaccggcatcatgatatcgcttactataatatcgggaatacggttgagagcctgctgtttcccttcctcaccgttgctgcctgtgattacttcgaaagagtcggagaaagattcggcgatgtatttctgtatatcttcattgtcttctacaatcagcaggataggtttgctcgtttccggttccgtattttgagaatcttccggaacagcttctgatatcatttcctcctctgtttgcttcgtagagtctccatgcaaagcgttggggtagatattgtctgttaataagctgatatagaaagtacttccttcgttctgtatgctttccacccggatttcgccttcgtgcagttctacaagatttcggactaaagccagtccgatacctgtgccggatgcctgatgcttgccgctttcctgatagtaacggtcgaaaacatgaggcaaggcttccgcagagattccgtatcccgtatcactgactttaatctccgtataagtgaccccgtttcgtgtggtgggatacaagctcaaggttatttttccctgttccgtatatttgatggcattggaaatcagattatcaaggataatggtgatgatttctttgtcaaagaacagaggcatctcttctttttctatttgaatctgaaagtcaatcgctttcttttggttgagttctttgtatttgagtccgatttcatgaatcaggggcacaatgttgcctttacaaacacatagctttttgttctgcgtttccgttttccggaactcaagaatctgattgatcaggttgagcagccggagggcactcaggtggatgacagaaagtttctgcgcctgtctggtcggcagtgacgtgtctttctgcatatcttccagcggaccgaggatcagggtcagtggtgtgcgcagctcatgagtgatgttagtatagaatcgcaggcgttcctgattcaattcttgttcttgttcgtggtttttcttttccagggtatagagactttcgaggtctattttcttcttataggcatggataatagtataaataatgctgatagtgatcagaatataaataagttttgcccaccatgtcagccagagaggagggttgatatgtatcctgagagaggtcgtgtcctccgaccagtcctgattgtgcaggcgggcttttaccagaaactcatacttgccgggaggaatattacggaaggtgacgctgttttgctcgttgatcgtataccatgagttttcaagtcctttcagcatataggcatattccacctggttggccagtgaatagtcctgtacgttgaaagtaagattaaaactattttgttcatgagtcaattctatctctccttcggagatgggaatagcggtttcgttcttctcccgacttgtgagtcgtccgggaattctcactttagtgataaccacaggaggaatctgcggactgtttatggcaatatcggggttgaagaaacacaatccgttgatagagccgaaatagatgagcccgttatggtctttggtaacgcatccgctgatgaaacttccttgtgggatgttgttggagtgatcgtaggtatagaaacattttttagaggtgatatagcaactgataccggtattggtacttgcccagatgttgccgttcttatcttcactgatagctcttatgtgtgtattgggcagtccttcttttctttgaaaaacctgatagtcaaaattacgggctgaaggaaaacataccagtccctcaccggtggcaagccacatctggcctttgctgcttcggtatatctgattaatcgtattggaacaaaaaccttcgtattggttgaacttcctgaccagttgcatatccggcgtatatatcccgactcctcctccgaaagttcctatccagaaacgtccttcactgtcttgggcaatgctgcgtacaaagttttccagcaactggctgttggaggtgtcataatgatgaatcaccttcttgctggcaaggtctataacgaacacccctgcgtgagtccctatccatatctttttattcttgtcttcatagaagacgcgtacgtcgagaagctcattcttttccagttcgatgatctgaaacttcttcagtcttgtattgtaatagctgatgttgcccagataggtgccgaaccataggttgccttccgagtctttcagcgaacaaagcactgagttggacaggagttctctgttttctttattgtaaatggccacccgttttccgttttcgaatacgttaatacctcctccgtcagttcctatccacaattttccttgtccgtcatcgcagacgctgctaacgactttgttgctcagcgaactttcattcatttgggtgggtgaatagctccatgtatggaatgtgggaggagcattgctgataaaattgattcctcctccccaagtccctatccagatattattaaaagagtcttgaaagatataccgtgcgctggcgttggacaaactgtagttattgtccccttcgcggataaactcaaagcgtatttgttcgggcagcagaaactgattttgctgtaagtccagtatcatgattccgttcagttctgttgcaatccagagtttgttgtctttgagttgtttgatggagaagatatagcttgacaatgctccgtgaatattccccgggttgttatgaaagttggtaaatgtttctgtattggcattgaacagggctagtcctttgctggttccgatccatatatttccgttggtatctttatagatacaacgcacatcgttccccggaaggctgttcgggttttgaggatcatggacgaagtgcttcacggatttgtcattcagggagaggatgctcaacccgccttctacgtgtccgatgtatagtttgccatcctcagcctccgtggctgtccaggtctgctcagagggaagggcgggtactgtgcttttgttataatgagtgaatttcccggtagcgatgtccagatactctatacctctgtaataagtacatacccataaccctttgccggcttgtacggatgaggtaatgtgagtgacatcgttcgttatcagactttgcgggtcttccggattatattggtagacgctgaaactttgtgtctcgtaattataagcgttgagtcctgcccgctgggtggctatccagataacaggctgcacgggatcggtgtacacttcattgagttcgttgccggtaatgctttgaacagaagaagattgctcctctttatagtaggtgataaagcgggttccgtcaaacttattcagcccttcttcggtggcgaaccacagaaatccctgcttgtcctgcgtgatactcaatacataattgttggataagccttgttctattcccaatctttggatgaggtaagggtgggctgccacaaatgtggcggatagcaggaggaagaaagccgcaatgtatgttttcatcgtttcagatattatgtattccttgatattcactctcaaaagtacaaataaatcttgtatttagtatagacaaatgattcattgcatgattttctaccctttctgcatgatttttacagcgaataaaataaaacaactgtaattttgcaatcaatcaaataaccgaatctaatacttgcagaaaatggaatctgattctttacacgaacatgataaaagctggaaggcattttttattaccactctgttcatcttgtgtacagcgaacgtttatgcgcagtcatccgatacaatcttttcccgatatttccgttatgcgcagaacttcgcagatgcgtaccctcgcgagaaagtgagtcttcatttggataatgcaagttattaccttggtgatacgatttggttcaaagcgtatgtagtgacggctgaacaaaacttaccgacgacgatcagcaaacctttgtatgtagaattactggaccagttgggaaatgtcgtagagcggcaaattattcagcttacggatggggagggaacgggacaaatcattttgaacaataccttctttaccggttattatgaaatgcgtgcctatacaaagtggatgcttgcttttgataacccttcctgtttttcccgtgtattacccgtctatcggaaacggctgagcgatgaagagactcctcggagtatagctacctatcgtatggacgcttcgatgaaacagaggccgaaggataaagagaagaagtttacagtccgcttttttccggagggtggacaactggttaaaggcatatcttcgattgtagcttttgaagccaccagccgtgacaaaggagctgctgatgtagagggaacagtggttttgccgagtggtgaagaactggcgcatatccgttcattgcatgacgggatgggttactttgagtataagcccgaagaaaaggcgggtgtggcaaaaattgattatgaaggctccacttatcagtttgaccttccggaagctcttccacaaggatatgtactccgaatcgataaccggcgggaaatgttggatatcactgtagcccgcagttcacaggcaatgaaagacacactggctgtttttgtatcttctcaggggcgaccttacaaatgtatgacactggactttgaagatgaattgaactgccaattccggatttcgactaaagaactaccgcccggagtgcaacagatatctctggtcaatctgaaaggggaaacgttatgcgagcgtttttgttatgtgatgccgcgttcttccatgctccttgcctgtaaaacggatcacgccctgtatcgtccttttgagccggtgacttgccggattaaagtgagagatcatctgaatcgtccggtacaggccaatctttctgtatctatccgcaacggtgtagagtctgattttcgggaatacgatcattccatttatacggatttgttgcttgtctccgatctgaaaggctatattcatcaacccggtttttattttgagaaccagtctgccgaacgtttcaaaatgttggatgtccttctgttggtacgtggctggcggaagtatgacctttcccgactgataggtaaacgtcctttcttgcctcggtatcttccggagacctcgctgaccctgtatggacaggtcgaatcttatttcggtaaggcgttacggaatgtcggggtgagtattcttgcgcgcagggattcggtctctattgcaggtatgacaaaaacggattcattggggtattttagtgcgccggtagatggttttagcggttctatggatgctctcatacagacacggaacgagggaaagaagtggaacaagcaggcagtcgtgaagttgttccgtaattttgagccttccttacggaagcttgattattatgagctgaatccggaatggaaagaggcgggtgatttgaaacagttgttggacaccttggatattgcttataaagattctgtattcggaccggatcatcatttgctggatgaagtggtggtgaacgccaagcgtctgaacttgttattgaagcaaactgaacgctttgaaaaagagattctgggttattataatataacgcaggtggtagataaaatgcgtgataaaggagaagcggtgtacaatctgcctatgctgttgaaggaattaaatcctaatttcagattgagtgattcgctgagcctgcactataataactcaagagttttatttatagtcaacggcggggttttatcttatggtaaaacggattatgtgttggacaaagatgtggatgctattaaatctatcatgctttattatgatcaggcagggggggaatctgtttttgtgatgaacaagcagagtaatagagtgacgaaatttacagcaaataatttttggagtggtcgctggcaggatggagatttgagtgatttgtctttgcaggatgctataggtgcggattccggaccagatgcactttggggtgagaaagatagaaagactatgaagaaaggtccgttgcagaaatcgtcagtagtagtttgctccatcactacgattgatgactgggacccgaacaaaacttataaagcccggcgcgggattcgtcatacctatatacaaggatataatgagcccttggaattttattcaccagcttatcctgatggtgctcctctctatacggaagattctcgccgcacactatactggaatccgaatgtgaaaacgaataaaaagggtgaagtagtcattcaatgctataactccgataattcggcaccgttaataataaatgtagagacattgtataaaggtagtccgtcatcattgaatatctactctatagattattaaactcgatctatattattcatattcatataaagtcctgttaaagaggaagaaaggagttgtgtttcttgcagccaacgtgtgtaaatcgtttatgaatgattctctacgttttttgaatgatttttataatgtaaaatctacactcattcgtatctttgctgtagataacaacgaaataaactaatattatgaaaatgaaaactaatataatctttaaaaaactaaagtcattcgtcaatcgatgtctttttcctgattatatgtgctgttttatcttcctgcgtttataacgctgatatgccaataaagaatttttagtgaaccaataatttaatatgtaaaaagaaaaacgttatgaaaagactatttcttcccttattagggtttttgtcgttggtgctgatgtgctgtaatgacaacaaggaatcaggtacggattcctatgacccgaacaaacctgtcactattgactattttacgccggacaccggtcgggtagcagagaaagtgattattataggtaataactttggaaatgacaaatctgcggtaaccgtattatttactgataatatggaaaaggagaacaaggctgccgtagtgggagtagataatactacgatttattgtatggcaccacgtcaggcagaaggtttcaataagattacggttaaggtgaatgatcagactgtggtggctgatgagacttttaagtattctgtttctgagaatgtatctactattgccggtgattttgtacaagctgatggtgccggtaaagatggaagtctggctgaggcaacttttgggcagatgtttggtgtagcttgcattgatgaacagtcgggtattgtaggtcaggcatggaataataatagtgtgcgttatatttctatagacgaagatgctgtaattactatccaaagcggtcctgtggttgggaaagtggcggtatctaatgataaaacattggcttatggtgctactattaatggtgctaataccgtttatgtttataagaaatcgcaggcatgggttccttctcgactaagtgatatcagttcaggtaccgatgtttgggctgtggctttgaatggtgataatcaatggttgtattatgtaacggctaatggtcgtttgggacgtattgaagtagataatccgactcataatgagattttgtttgaacataatgattttagtggtggtccttttgcttacattgcttatagtgcttttgaagattgtttctatgtaactactgataaaaataagattctgaaagtttgggtaaaagaagatggtacacatgcttacgagcagattaaccagaataatacaggaactacagacggttttttggctgatgaagcaaaattccagtatttacgtggtcttacaatagatgaagatggtaatattttcgtttgtcagggggataatagtcacgtaatacgtaaaatcgcttatgatgagaatatggagaaaagatatgtaactactgtattgggtacatccactgtacatggaaccgatgatggttcacctgatattgctttatttaatggacctcaagatattagctatgacgggaatggtggttactggattgctatgcgctacgagccggcattaagaaagtattcaatagaataaacacattaatcagaatttaatcatgaaaaaaataataagcatcttatttataatatgcagtctcttttcttctatggcatacgctcagggagggttgacatattccggtactgtcatcggtgaagatggatttgaacttataggcgtgagtgttgctgtaaaaggaacctccattggtgtaattactgatctggatggaaagttccgtttaaacaatattcctcccaagtctaccattgttttctcttatgtaggttttgagaataaagaagttaaaataacagagtctaaagagcgtgagactattgtcttgaaacaaagtatcagtagtttggatgaagtagtggtagtaggtcgtggttctcagcgtaaagtttctgttgtaggagctattacttctgttgatccggcacagttgcaggttcccgccacttctgtatccaatatgcttcaaggtcgtgtgccgggtatcattggtgtgactcgtagtggtgagccgggcaataacttctctgagttctgggtacgcggtatcagtacatttggtgcaaacgcttcagcattgattttgattgacggtgtggaaggagacttgaatacacttgaccctgccgatattgaaagtttctcagttttgaaagatgcttcggcaactgccgtatatggtgtgcgtggtgccaatggcgtagtaattgtaactaccaagagaggtaaagccggtaagttaactgttaacttcaagacaaatgccacatattcctattctccccgcatgccggagtatgtagatgcagtgggctatgcaaaccttgctaatgaagcacgtgttgtcagaggtaagaatccgatttatactaattctgaaatccaactgttccgttccggtctcgatccggatctttatccgaatgtgaattggagagatgtgattctgaatgactatgtgattgacaatcaacatcacctgagtctttctggtggtggtaccaatgcacgttattatgtaagtatgggtatcatgaaccaaggagctgttttcaaacaagataagtcggtaagtaaacataatactaatgtggattaccatcaatataatttcagagcgaacgtagacgccaatatgactaaaacaactctactctctttgaatatggaaacgattatcactaaacgtaattctccgggatatggtgataataacaatgcattatggtcggcgcaagctaatcttccggcaacaatcgttccggtgaaatactccaatggtactcttccatcatttggtagaaactcggatgaggtttctccttatgtacagttgaactatacagggtataagatcagtgaaacacaggccacccgtatgaatgccagtctgaatcagaagttggatttcatcacaaaaggattgtctgcaagaggcgtattctcatttaactataccggctactttgaccagtatcgtaccaagactccggacttatattacgccacaggaagaaagcagaatggagcattgatctctaaacgtacatcgagtgctactgatatgacttacagcgattatcgccgcattgcccgtcagtattattttgaaggaaatatcaattacgaaagaatctttggcgaagaccatcgtgtgaccggattacttaatgcctaccgtcaggaaaataaagactcttatctgaataatgatgatgacgacaccacattggatgaaagaattcgttccattcctaaacgttatcaggctatttctgctcgtgctacttattcttataaggatacttatatgtttgaattcaatgtaggatataccggttccgagcaattcaagaaaggcaaccgctacgggtggttcccggcagtagctttgggatgggtgcctactcagtatgaatggacgcgtgaaaaacttccgttcctcgatttcttcaaactcagagcttctttgggtaaagtaggtaatgaccgtatcaagaaaatccgcttcccgtacctttctactgtgtctaccgattatagctcagtaacatggcctggtagcaccgttggcgagagccgcgtaggtgccaatgacttgaactgggaagagacaaccaaaatggatattggtgtagacctgaaaatgtttaatgacaaagtggaactgactgccgacatctttaaggataaaaacaaaggtatcttccagcaacgtgccaacattcctgaagaagcaggttttgtaaccaatccgtataccaacatcggtggaatggaatcatggggatttgatggaaacataacgttcaaccataatttcaccaaagattttggaatgacagttcgtggcaactggacattcgcccgcaataacgtaacctattgggagcaatcaggcgtagtatatccttatcagtcttttgtagacgttccttatggagtgcaacgcggtttgatatctttaggtttgttcaaagatcaggcagatattgaaagtagtcctgttcaaacctattcttctgatgtgcgtccaggtgacattaagtataaagatgtcaatggtgatggtgttatcaatgatgatgatattgtaccgttatcctattcgaatactccgactcttcagtatggttttgctgctgaattcagatacaaacagtttactgccagcattttctttgaaggtgtaggtaaagtgcaatatttctatggggggtcaggatactatccgtttgcttgggaaacgcgaggcaatgtacttaacattgtagctgatcaaaagaatcgctggacaccgagagaatattccggtgacgctagtacggaaaatccgaacgcgcgtttcccgcgtctgacttatggtgagaataagaacaataaccgcccatctaccttttggttggcagatggccgctatttcagattgaaaaatatcgagttgtcttatagattcaccagcgcatggttgcgagataagattagtgtacagaacgctaccttgagccttgtaggcgaaaacctgcacgtatgggataaggtgaaactttgggacccggagcaggcatcgtcaaacggtgccgtgtatcctctgcaacggaaattcacccttcagcttaatgtgacgttttaatcccgtttcaattgtaacattatcataaatcgtataattatgaatttcagaaaaatatattgcatagccgctatggcactgatgtgttgcacaggaagtatgtttacctcctgtgacgactacctggatgtagactcatacttcgatgagatttttgagctagactctgtatttaaacgtaaggaatatctggaagaatatatcaatggtgccggaaagttattacctaatgaaggagacttgtggaccaatgcttggtcgccttatcagggagcttcggacgagaactttacatcatggaatgactcccgtcataaagctatccagctgatggtggacgaagtgactccacagagtgatttctataataactatggtacttggtataaaggtattcgtaaagccaacctcgtcttggaaagaatcaatgaatgtgaggatattactacgagcgatttgcgtgactttatgggacgttgttatttcttgagagcttatttctattataaactggtagaggcttacggacctgtgcccattgtgcctgagatggcttatgatgtggatgccagtgcggaaagcatgtcattggaaagagagacatacgagaattgtattaactatatctgcgagaatttcgagaaagcatacgaatatcttccttccagccgtacgtctaccctagtcaatctgcctacttcgggagcggcattggcattgatgggaagagtaagactgatcgaagcaagtccttggtacaacggaaatgagttttatgctgattggaagcgttcggacggtaccaactttatgcctcaagtcaaagacgaatccaaatggggaacagccgctcttcttgccaaacgtttgattaagggttcggaagctggtagctttaaatataagctgcacactgttgagagaaaactagacacaaaaccgctaccggagaatgtgcctgacgaaaactatcctaatggagcgggaggtatagatgcgcttcgttcttatgcttttatgttcaatggtgaaactccggcttataataatgacgagtttatttatatgtgcggctactctagtacagctggcgactctccggcatggattgctactcctacgagcctgggtggtggtaatgggttgaatattacttatgcgactgtgaaagctttccgtatggaagacggtagcgacatcaataactcaccactttatcccacaaattactgggaagccattggtggtagttcacagtctttctctgactatacacttccgtccgatgctgctaagatgtttgataagatggaaatgcgtttctatgccagcgtaggttttaaccattgctactggagcggactttcttacatcggaaccgaaggtaatcagactaagcagacagttacttactatgctaatggtactgctgcaccgtcgtccgatcatcctgaagattataaccacactggttttacctgcaagaagtacattcattatgtagaggatcagctgaaaggtatgatgaagtcgaaaactttcccgatcatgcgttatgcagaggtgctgctcaactatgtggaagcattgaatgagttgggaagtaatacatataccgacgaagagaatgggattacagtgagccgtgatgtagacgagatggtgaaatactttaatatggttcgctatagagccggtttgccgggcattacagcggatgatgcaagggatgtgactacgatgcgggatttgattaagcgtgaaagacgggtggagtttttctgtgaaggcagacgttatcacgatttgcgtagatggggagatgcaatcgatgcatacaatgagcctgtaacaggtatgaacattgctgcacgtagcacagaccgtaaagcattccatacggaaacagtgatcaataatactcgttcgcatcgtgtattctcttataaagattacttcctgcctatccctcgtacaacgatggataagaacccgaaactggttcagaatccgggatggtaattttgcacacgaagtacagaattaataattaagtaaaaaacgtttgttatgaatatcaataaaatactatatccgatacttttgttattggtcgttttaagtagctgtgattatgaaagcccgcttgataaggagcaatataagaagacactctatctgatcggcgcttccagcaatcttgtgactaaagaacttgcttatagcagtgaagtgcaggaaggattcattacagtgggtgtaagtggctctcttttgattgacgggaatgtggatgtgactctggaaagccataacagtgtaattgactggtataataaaaagttcaagttccttgcgactgatatcaaatatcagggacttgctaccagtgcttttgaggtaccttcttatactactacattgaaagccggcgaaacttatgcgagagttccctttaaagttaaaacagaaggtctggagtgcgattcgctctatgcgataactttcaagattgcttcttcttctgccggttatgagatcaaccagaaggactcggcacttattgtatccttcaatctggtaaataaatactcaggtaattacatcttcaaagctcttcggcacgaactggatagtaatgatgaaatagttgcatccacttctattactatagtcagaacattgaaagctacagaagaaaatgcagtgcgtttctataacgagcaacaggcagaaacaactgccaatatcaagaaacatgctgttgtactgaaagttgatgctggtaacaatgtcactatctcggcatgggaggactttgacttgattgatggtacatgtacttataatcagaactcgaaagtctttaatgtagattataagtatactgcggatggcaagacttatcagatggtgggtacgtttacctatcaggatgaagatgcaggtagcaactaaatgagcttataaatctggtaactgaattaggttatcagcaaggtagaaaaaggtgttgctttaagtcgatgaaataataactggcaggtttaaggaattcttaaacctgccagtttgtttttattcagccttataatttgtgacattgcaagatttgtggtagtttttggtcgttttgtattccctaaagttagccgtaatcacgtatttttgtactatcactttaaaaattataaaaaacaaatttcacgatgaactataaattactgtcagtcgccttagcttttttatatataggtatggtaggcggatgttcccaacccgcccccgacctgcgttatcagattgaagtggacaaacctctgcagacaatggaacacttcggcgcttccgatgcctggagtatgcatatccttggcttgtggccgcaggagaaacaaaaccagatagccgactggcttttcagcacagagaacgatgcgaatggaaaaccgaaaggaatcggcttgtctctgtggcgtttcaacgtcggggcgggcagtacggaacaaggggaagccagtcagatcggttcttcgtggatgcgtaccgaatgttttctgcaagccgacggaacctacgactggaacaagcaacaggggcaacgcaactttctgaaactggcaaaagaacggggcgtcactaaattcctcgcatttctgaattcccctcccgtatattatactcagaacggtctggctaccaataccggtcgtggaggaaccgccaatctgaagccggaatgttacgagaaatatgcccgtttcctggccgatgtagtagaaggaatagagaagcacgacggaataaagttcaactatatctgtcctttcaacgaaccggacgggcattggaactgggtaggaccgaagcaggaaggctctccggcaaccaatcgggaagtagcccggaccgtccgtttgctgagccgggagtttgtgaaccggaaaatggatacacagattatggtgaacgagtcttcggactatcgctgtatgctccgtacccatcagacggactggcagcgtggctatcagattcaggctttcttctgcccggacagtgtggatacgtatttgggtgatacgcccaatgtgccccgactgatgcttggtcatagttactggacaacgactcctctgagtgaactgcgtgccatgcgctgccaactgcgtgaagctctggataaatacaacgtcggcttctggcagtcagaaacctgtatcatggggaatgacgaagagataggcggcggtcacggcttcgaccgtacgatgaagacagcactttacgttgcccgtatcatccatcatgacatcgtatatgcgggagcgaagagctggcagtggtggcgtgccatcggcggcgattataaagacgggctgattcgggaatacacgaatgatgacttgaaggatggtcgggtagaagactccaaactcatgtgggctttgggtaattatagtcgcttcatccgtccgggagctgtccgcctgtcggtttctgctttcgatcaagcggggaatttaatccccggaggcgatacggaccaaaaaggactgatgtgttctgcttatcaaaatgcggacggctcatacgctgttgttctcattaactatgcgcaggaagacaaagagttttcaatcaataagataaatggcaagaaaactcgatggcaggtgtatcgcacttcggatgtagaaggagaagatctgctacccgttgagaaagtgaagagtggaagaacagtccggattccggcacgttcgattataactttattgaatcaatcgctttaatataagagtcaattatgggtttgtccggtcgaataaaaggccggtatgtcgcctttttcttttttaaagtattacatttgtacgcccgtccattgctaaccaaggcaatggacgggcgcaatgcataaaaaaggaggcatttcatggacaatagaggtaatattgtcatttatcagacaaaagacgggaaaacgtcgattgatgtgaagttggaggatgaaacagtgtggctgactcaggctcaaatggcagaattgttccaaacggacagaacttcaatagtgaagcatgttaataacatctataagtcggaagaattggtgaaggattcaacatgtgcaaaaattgcacatgttcagatagaggacatctctcattgcttttcttgttctgatgcagcatctctcacccttattgaagccatatttttctgtctttcccttattttacggtgtcttctacttccggcttaccataataccccggcatcggaacataaaccggactctgacgagtattgatattctgcaacttcttttcttctttcagccgtttgatatgtcgggcggcagtggtaagcgtaagtttgcaaagtccttgaaagtccgagcgggtcagtatttggttattactgaaatacgcggtcagcagtctgtctatctcttcgttggagcgtggcactgagtgtaacttcagtttactgcgttccactttgacgacactcaccgaacttctcagttttttatccgccttgaagccgatgtttgctttgagtttcatttggtttgctttcagcttgggcgaggtgatcggttccagactgttcagctttacctgaaagtagccgatgccgtcgaggtgaacacgttccccttcccggaggcgtgatcccataaagtggctcagtgattcgaggaccgcttttacatctccttcggtcagcgaagtcgcttgttgtatttctttggcgagatagtcggtgtcgatatgctgaaagttgactacccgtgcgtggtagagttccttgtcttcttcgtccttccgggcaggagacttgtagagttcaaattgtattgccatgatactgtttattgtattttatttctttttcttcttctttgtttcggctgtcagtttcttgatactgtcaaaatatgcctcttctacaggcgacagggttttgacatgatattttcggtattcgcccagagctttttgtttggcttgttcgtgagagatcgtgcctgcgttctgcaaaacttgctctccggtggtcgataagatgaggtccaggtgatgtatatagtccgacatatacatgggcgaacgtttgatagcttgtatttctgcgaagtcgaagtatccggaaaccaggttgttcaatatcttcagttccttttcattgagatagtttttagctatcagcacatcttctttccggggttgttcgccgggaaatgtggccagtcccataaatggcttttctgcatccgctcgttcgaagatcacttctgctgctgtgtggccgtgggcggcatagtgtaacttattctgcacgattttgaaaaaccggatggattcgtctgcctttgggtcatagtctacactggtggcatacaagtcgagaacctgccggtagagtactttttcagatgaacggatatcgcgtatacggttgagtagttcgtaccagtaaccgccgccgcctatttctttcagacgttggtcgtccatggcgaaacctttgatcagatattctttcagacgttcggtagcccagcggcggaagtgggtggcaactcgtgattttactctatatcccaatgatatgatcatatcaagattatagaaaggtatacttctttctacctttcttgtgccttctattcgaacctgtcggaatatctgacaggttgaattttcctctaattcaccttcttcaaagatgtgctttatatgttcaactatgttagtacgggaagtttggaatagttcactcatttgttgttgtgacagccaaacgttctcattctccaaacggacttcaagttgtgtccttccgtcttctgtccggtatatgatgatttcaccgttgtttttctctatttcgtccattgctttacatcgttataacatattcgtcgtttcttgtttgttataaagatatagctacctttgatctgcaaaactaatcattagtttccggacttggacagaactcgggttatatagtgattgtctgcttgctgtcaagcgttcatacataagttatcctgcctttatctttggtttatgatgcctgcattgttggatgaaggtgcttgcatcattagttgttcacggccgtggtaagcgttgctcacgtccgtgaagagcgttgatcacggccgtggtaagagctgctcacggtcgtgaacaactagctatatcagtagcaaagataaactataatagggagataaacaaagtattcctgcttcttttgggtattcgtgcagcttgttctttgtgcagaggcaataagaaagggaaatcattcttgtatctcgtgcgatgaaggaacatagtctgttggttgtagacggttttgttcatctcccttctatttactcattttacttccttaatggtattcttattaggaaaatatgcctatatttgtggcgtatcttctaaacaaagatatgttttattgatttggagataacgtttttattatctgctttgagaaatctggtaaattttgcgtctgcagataataggcggtcagtctccacgttcatttcgtatataaatttgttatatacttctaatgggcgtggagctattgcttattattcagacgcgggcttaccagagcctctcatggggtaatatagtaatagtttccgcgccttcttcatgaaggtatgcgaatacacaaacaaataaaaaatagtagtgatgaatgattctacttgtccccgtccctgcctgatgaagcttgatttacaaagctccaccaataaacttgcctttttgaaagacaactggcccagctttggacagattgaaagtatcgaccgattatcggaaacagaattacgatgtaccctttgcctgttggatgtggtgctggctgctttggctaaagatgaatgtttctgtccgaatcgggaaatcattcgtttggtattgacacgtacctatgtgcagaataggtgtgagctatgcgagacagaagaaatacgttcgaagttgatgaagggcttttgtacatgggaaaagaagaacggattgagcaggaagaacgaaatccggagaagaggaatttctgttttttatggtgccatactgcgcatgctatcgaaagtaaacgggaaacaagagtagacgggatttgcccgaagataaaaggtgcttgaagtgaaagattcttgaggtgaaagatgaaagatcgggtgatagattgaaagatcatctttcatcatcggaagccccgatgaataaggagtttggcgaccaatggtgaaagatgacagatgaaagtttgttttttcgtcaggaggtgattgcgtttattctactactatctgcttatccttatactggaagtgtgcaatgcctaaatcattcagtacattcagtagagtctttatcggaacattccggctgaagcggaaatggactcgtttgtgtaaaaggtctgcagaatggcagatgacgctgatattataccaggttcctatattttgcagtacggttatcatttcggtgttgtcataataaaactcgtctttggtccatccttctttttcagtctgcgtggctttcgtcagacggatgtcaccgctagtggtcaatgtggcgcattgtccgggtactatttctttctcaaggggagaggctgctttgccgacctttactcgtccttgatacagggtgacggcgggggcattgccgggataggcatttacgtcgaatacggtgcccagcacttgtgtctgcattttatcggcggagacgatgaaggggcggtgggcgtctttggtcacttcgaagcgtgcttctccggtgaggtttacggtgcggtttccctgagaggaaaactctttggggtattccagacggctgtttgcacttaaaaggacgtgacttccgtcctccaatgtgaggcgggtggtcgtggcgggcggggtagatacgatgattctgccgttctcttcgatagtggtaatttgttccggtgcatggagggcggtgaagatttcgatgttctgctggatgccgtccttgcctgtgatgtgccaaggggaccaaagtaacaataacagggcaatggctgctgccacaccaccggataaacagatgcggagataaagtttgcgcttctgctgtgcctgccgttgcaggaatgtggtccattcttcccggacttcgtccggcagaggcagatcacccaacgcttcaccaaaggcattttgcagacggcgtgtttctgcgttttcggagaatggggtacggtcgtctgttgtcagttcacaatggtcgctgtctgctgtcagtccgtagccggaaccttcttcttctttgctggtacgtttttctttttcttccatagcgtatcctccttctttattctttcatggcttcgcgtagtgtacgcaatgctttggatatatgtttttttaccgtgtcgggactgatgccgagttgttgggcgacttcccgataggtgagatgttcgtaatagcatagccgcaggatggtgcaagtcggttccggcaggcttcgggctatcgtttccgctttctgcaacagtgcttcgtgttcccgatagttactttttacatcggccagcgttgcttcgtagagtgctttcgcattgtcccgttccacttgcagatgcttcatccggttgaggcaggtgttgcggactgctgtataaatccagcctccgcggtcggcctcgtccaattggtcgaagtgtttccaagcctgctccatcacttcgcttacgatgtcccgtgcttcctctccgtcgcccatcagttgtgaggcataacggaccattcgcgggtacatttccgtaaacatttgcccgaaggcttctcgttttgtctggtttttatggaacaggaacattctttatctggattctgaagctgcaaaaatagtacttttccccgagttcgactaaaaaatcagtagtaactttaatgtgttcacctaccacctccccctacgggtactcctccttcccgaaggaggagattgggaatactattgactttttagtcagcctctcttgtgatggaaccgacttgttggtcatctttgtgaaaccgggaattacaaacgtgacttttcgcttgctccggctccggttcctttatatttgctcttcgtggcgttgaactgatagctcagccggatgccgaaacgctgctgatcggtataatcacggttggaactgaaggtacggtcgccatagatggtgaagtatctgtagccggtgtgaaagatgtctttcgcggttaccgatactttcagcgcctggtctttcaggaatgatttggtcagttgggcatctactcttccttcggttttccagatggcgtaactttgtttggcgccgggcgccagttctcctttgatgttgaagaaccaacctttagggaaactgaagttgttatcaaaaatgaaatagaatcgcggttcattccagttctgggtaatgcctatggaggttgcgtgagagttgaaccagtcaataccggtggtgaactgaggctgccatatgccgatctttggcgaaaggacgatgctgcctccgtatcggttggaatgcggaatgcttgctctgccgaacagcaatacaccgggatggttgatgtcgtcatacggtcgggtgtagctggtgtacatattccagcaatggtcgtagttgaggctgaagttgatccatttccatccggcatcaaagaaagtcgcacgatgtatctgaggaacgagaaacgggtctccgctctggtaggagtacttgttctgataggtgacggcgctggtgagcatgtcataactgggactgtatttcagcgtccggtgagaaagggcgaagaaccagttgccggaggtgtatctgatgctgactaccggtatccagtcgcgataggtggggctttggtcgtcttggtgaatccctttctcgtagtaatctgtttgttgaaattcatagcgcagtccggcaaggatgttgaactttcccaatggcaggctgtagtcgatgaagccggagagcatcgtttgtttgatgcggtcgtcggcatcggcggagaagccgctttggagaaatacgtcgtggcggttggtgaatgtctcttctgtgccgaaactgagtttgcctttccagagtggggcggtgagcaggagcttggcggcatagaggtggttgcgtacgcggttgctcgaagtggcgtcttcggttccgttgttttcggcatattgacggatgcggtcccggccgtacaggtagtcggcgttgaagtcgatgttccatttgccgaaagtgccgttgtagtatccgttggctgcctgccaccagccggtgtgggcatctgtttggcggagagcgtgcaggtggtctacttctttgccatcttgcaggatgagggtggtcccttcattggtagtatgtgcattgcctatgttcgtgccgggcatatagcgcataccgaatgactggtcttcgtcgatttcgtagttgaatcccagttcgccgttgaaggtgcggtaggtttgtttgcttttgttttctgtcgattggttccagtcggacgaagcataaatgtcctggctggagatgttggttgtgtgattgttgatttccgcaaagtctccttttacgaaaatatccagtccgccggtacggtagttcagggatatgccttcgttgccgatcggttcgtgtccttgcgagtagtcggtgtagaaactgccgctcattccctgtccgcgtttgcggatggtgcgcagacggatgacggcgcctaccgaagagccatattgtacgcccggtgtagtgatgatttctgccgatagtatttcattggcttgcagacggtccagttcggtcttgtctctgactttgcggccgttgatatagatttcaggagtgcctctgcccagtacggtaaattctccgtccgagccggtgacaaaagggaggtgggagatcatttctttggccgatcccatcagtgaaaggggtgttccggctatattggccttcagcgttccgcctttccgttctatcagcgggcgggaggcggtgacgactacttctttcagtaactctgtgtcgggttgcaggcggatggtgttttgttgccggcaggggatgatttgcgggcgatatcctatgtaggtcgctttcagcagacagtcttctcccgctaccgggggcagatggaaggagccgtcttcttcggtcacgcttccggcaaggaaactggaatcggcggcaagggcgagaatgttgacaaagggcaggggggctcctttttcgtcatatactttgccttctgtggcgatggctttgtccgatttcttccgctgcacgacgaaatactcttcccgttcgatgcaaaggaagggtttgccggccagtacaaggtcgatggcttcgcgttccgtcttttcgcggatgctgacggtcacccgataactttctgttccgttgtaggtgaagaggatgttttttcctcctgccttttccaactgcttcagtgcttcgggcaggctttcgttctttagctctagtgaaaatttcttgatggcggtctgcgcctgcaaaggggaaagggcaaaaaataaaccgtatcccatcagtaaccagctgattgctgtccaagtaaaaccaaactgtcgtatcatacttctgttttaatgattttacttatactacaaccaaggtgtctgatcgggtacggtttatccgttttatttttcgatgtttatttcaacttcttctgatactctcccgaacggaagatttccaatgctttctgcacgctttcgttcgttgtattcatgacgcggaaatattcgttcatatcccagaggtcacgggctatcagtgctttgagctgtgtcttgatcagcggaagtgccttctgatactgctcttcgttaaacttcaccccttctttctcacccatttcgcggagggtggcgagcatatcgtcgtcaataacaaacttttcgttgaagctgtcgaacttcttatatttatcggccagttccttgcggtggtcttcgatgaatttcattgtgaatttgatgatgactcctttgccgaccagtttccggtgatagtccgtgtagagtgtcgtatcaatcggaacgaagtagtccggcatgatgccacctccgccgtagacggtacgtttcagtttcttggtctgcactttcaatgagtcggggaagtggatgctgtcggcattcatcagttctccgtggttgaagcggtctatcaggtctttattgtaatcggtcgagctgtcataaggcttttggatgcaacgaccggcaggggtgtagtaccgtgcaatggtcagtcggatcatggagccgtccggcaggtcgataggacgttgcaccagtcctttgccgaaagaacgtcggcctacgatgatacctctgtcccaatcctgcactgcgccgctcacgatttcgctggcggaagcggtgtattcgtctaccagtacgatgaggcggccgtcacggaactctccgtttcctttggcgaagaactcgctgcgctgtgcggtccggccttcggtgtaaacaatcagttccttctgtccgaggaattcgttggcaaggtcgatggcggcgttcagatatcctccgccgttgccttgcaggtcgaggatgaggtctttcatgccttgcttttgcaggtctttcattgctttcttaaattcttcggcggtggttgcgccaaagcggttgatgcggatgtatccgatctttggctgaatcatgtaggaagcgtcgagactcaggataggtatcttatctcttttcacggtgaacacgagcgggtcttgtactccacggcggacgatggtcaggttgactttcgaacctttcgggccacgcaggcgcttcatgatatcttccgtgctcatttttactcctgcgatggcggagtcgttgacggcaatgatgcggtcgccggcaaggatgcccactttctcggaggggccgttgctgacgggttgtacgacgagcagggtgtcctcgatcatctggaactgtacgccgatgccttcgaagttgccttgaagcggttcgttcatcttcttcacttcttcggcatccgagtaagtggagtgcgggtcgagctgtgccagcatcttgatgatagcttcttctaccagtttgtcttcatctactttgtctacgtagaagttggaaattgcgaattccgccatttggagtttgcgcatggcggcagagccgaaactttgggcctgtgcagcagacgttgccaacagacaaaccaggagggcgtatactttaatcttcttcatcatcattaattattatttcaagtttcgcaagttacctttgcgttatccaaactatcttcattcccctgaggctgactttaaagtcagcctcaatagagatactaccgactttcaatttatctccattccttcggggataaactggctgatatctttgttgtaagtcagcagctcgcgtacaatcgttgagctgacgcaggtcagttccggttctgtgaagagcaggatggtttcgatgcccgccagtttgcggttaatgtcggcaatcgtttcctcgtactcgaaatccttgaccgtgcggatgccgcgaacgatgaattgtgcttctacctgttgggcaaagtctatcgtcagacagtcgtaagacatcactttgatgcggggattgtccttgtagagattccggatcatttcttctcttttctcgatggggaaataggtattcttgttttcgttgataccgatcccgatgattatctcgtccataaaggtgagtgcacgttccactaccgaataatgaccgatggtgaaggggtcgaatgtacccggaaatattgcttttctcatgatgccaagtcttcttctataaccagattgtctataataaagttctgtcgttccattgtattcttgcccatgtagaactccagcagttcttttacggcatctgtcttacgcaatgtcacttgttccaggcgcatatccttgccgataaagtgcttgaattcgtccggtgatatttctcccagtcccttgaatcgggtgatttccgggttggggcttagttcgttgatggcgttcacccgttcgtcctcgctgtagcagtacaccgttttcttcttgttgcgcacgcggaataacggcgtttgcagaatatatacgtgacctttcttgatgaggtcggggaagaattgcaggaagaacgtgatgagcagcagacggatgtgcataccgtccacatcggcatcggtggcaacgatcactttgttgtaacggagtccttctatgccgtcttctatatttaacgcagcttgcagcaggttgaactcttcgttttcgtagactacctttttcgtcagtccgaacgagttcagcggtttaccgcgaaggctgaatactgcctgagtgtttacgtcacggcttttggtgatggaaccgctcgccgagtctccctcggtgatgaagatgcaggagtcttcttccattcctttccctttcgggtcgttgaggtggatgcggcagtcgcgcaacttgcggttgtgcaggttggccttcttggcacgttcgcgtgccagcttcgtgacgcctgcgatggctttccgttccttttccgattcctgtatcttttgctgcattacttccgctacgtccgcgtttttgtgcaggaagttgtctacttccaacttgatgaagtcgcctacgtatttgttgactgtcacgccgccgggagtcatgttggtagatcccagtttcgttttggtctggctttcgaagatcggctcttccacattgacggcgatggcggcaaccagtccgttacggatgtcggtatagtccatgttcttgttgaagaactctttgatggtacgggcgatatgttctttgaaagcactctgatgggtacccccctgtgtggtgtgctgaccgttgacgaaggagtaatactcttctccgtactgtccggtgtgagtgaaggcgatttcgatgtcttctcctttcaggtggacgatgggatagaggccggttgccgtcatgttgtcgttcagcaggtctaccagaccgttgcgcgacaggatgcggtgaccgttgtaaatgatggcgagtcccgtgttgaggtacgtatagttacgcaacatggtctcgataaattcgggcttgaagcagtagttgacgaacagcgtattgtccggttcgaagaagataaaggttccgttgtcctcttcggtgtcctgcgtcacgtcggtctgcaggtttcctttggagaatgtggcgatacgcactttaccgtcacggtaactgcgtacttcaaaacgagagctcaatgcgttgacggctttcacaccgacaccgttcagtccgacgcttttcttaaatgccttgctgtcgtatttaccacccgtgttcagtacgcttacggcttctaccagctttccctgcgggatgcctcgtccgtagtcgcgtacgctgacgcggaggttctcttcaacggtaatttcgattttcttaccggcttgcattttgaactcgtcgatactgttgtcaatgacttctttgaggaggacatagattccgtcttcggcgtgcgcgccatcgcccagcctaccgatgtacataccggggcgtgtgcgcacatgttccatgtcgctcaggtggcggatgttgtcgtcagtgtactctactgcattgttgttgtctacagatatcaattcgttctcttccatagctgttatttaatctctttggtgaacgcacggcggcgcttatgttgcttagtctcaaagtaatcccattgtgcctggacttttccgttcagttccagttcggggttgctttccgcaaagataaaacctaatttttgataaaccggaattaaatcggaaaataacaaagcgttaacacctttattctggtactccggtttgactgctacaagcagcaggtcaagcattttggcacggcgtttcatgaacagtgctttcagcagatagaaccatcctagagggagcagacggccgtgtgacttttgcagggcctcggcaagagacggcatggagatgcctacgcataccagcttgtcgtcggcgtcggtaatgagggtaaccatccgtaagtcgagaatcgggagatacatctttacgtactggttgatttgccgttgcgtcagcggggagtagccgtagagcgggctgtatgcttcgttcatcagttcgaagatttcctgtccgtagtctttggctatttttcttccggaggtgtatttctttatcttcaggttgtattttcgttgaatcagttcggagatacgcttgtgcttgtcggggatggcatcggggatgtagattttgtattccacccagtcggcgtctttctcgaaaccgagtctctccatgtgtacggggtagtacgggtggttgtagatagtagccattgtgctgagttggtcgaatccttcgatcagcattccttccgcatcgaaatcggtgaatcccagaggacctgtgatgtgggtcatgccgcgctcttttccccagtcttcgacggtcttgatgagtgcggatgatacttcggggtcatcaatgaaatctatccatccgaaacggacgttcttgcattcccacttttcgttggcgcggttattgatgatagcggccacacgacctacgattttgtcgtcccggtatgccaggaagtaatctgcttcacagaactcgaatgccgcattcttctttttgttgaatgtgttgagcatatcgtcgtaaaggtcgggcacggaatatggattgcccttatacatcctgtaattaaagcgaataaacttcttaagttctctctttgtagagactttcttgattgtaatagccatatctcgtatttatgattgaggggcaaagatacgtgataatctttaaattacaacgctacgggtgggaaaaactgtacagggggaggcccgattccggaaaataaaaaggtagtgaatcgttgcttggactgatatttggagtacctttgtcagaaataactataacacaaatggaactgcagattattcagaataaaatatatgagatcagagggcagaaggtgatgctcgatttcgatttggcggaattgtatgcaacagaaacccgcttgttaaagcgtgccgtaagacgtaacattgaccgttttcctattgactttatgtttgaactctcgacagaagaggctaactctttgttatccagtagggtatcccaaaatgggacaccccagtataacttcagtgcttacaagccgtttgcttttaccgaacagggtgtagccatgctttcaagtgtcctgcattcggaagtagccattagggtaaatatcaatattatgcgtgcttttgtcagtatccgccaatatgtattggctagtgaagccaagaatgaagaaatagaagagctgaaacagcgcatacaagagttggagaatcaaggttgcaaagctttcgcaatgatcaatcagataggtgaggaaacattggaggcaatcaacgaccttagcgaagatacccgcaaagaattggacggcatctatttagctttatcgcaattggctgataaacagaaacaagtaccccagcataagaaacgtaaaccgattggtttcgttcattatgataaggaagagtgagaggccggcaaatttagttagatgcaaagcagtaaacattgccggcaaagtcacaaactatcattctgtttcccgatacggctatcgttgagaaaactggtgctccgaagtacaacttgtctttgataatccctgttgactggtcgatggcgtataaatacccgtcggaagctccgatatagacaattccttgtgaagatacagggcttgtttctactcccgcctgcggcgtagaagaataaggagcagtgtatacaagagaaggcaaagtctcggctctccatttgatgaaaagagtcggtttgtcgagagcgaaaactccacggtctgcgctgccgaagataatctcttgttcggttacgagtggagtagatgtcacgtccagattggcggacagttccttttgctggagtactttaccggtttgaggttctatcaggaaaaagcttttggaggagatgagccataattttccgtctttgtagaccggagaagcacctcggttgccgagtccgttgtcggagagcttccagagttgtttgccagtgcggatgtcgttgccatacagtcctccccattgggtaccactgattagtacgtctccggcgatggttaacgtggtggtcgagccttcccgttgtttccagtccgtgttggtccatatcacttttcctgttttcaggtcgtaggctgaaagtccggcaccgattccggcatagacgattcctttgtcaattgtcagtccttcggtcagatagggatagttctttaagttgatgtattgttgccacagtggttttccggatgctgcgtcgagggcgtacagattgcaggaggcatcctgggctacaacgattccattttcgcaggcaatggtattctttaccgagttttccgtgcggaacttccatagttgtttgccggaatggaagtcgaatgcacagatataagtgttgagcgacgtgttatcattggtagtggcaatgaatactctttgtccggcgatgaggggggaggtcatgaagatgttacttcctgtgttcgctgtccattgtagttgcagggggagtttgatttgggagtcatttattccaccggagtgacttgcgttctgaagtagggtattccagtccttccctgcgatagcagtcgatttgaaatctttctgataaaggaactgactggtggcagtcgcttcctttccgtcgttgaaggatgaagtcactgtcaggttcagtttctttccgttttcgttagcgggtatttgaatatttccgctccagttccagtcggtgaggggcgacaggttgcctttggctatttcccggttgtcttccggattgctcagcacataagaaacagacgatgtttttgcctgtgagttataggtgttgaccgagaccggaagctgatagccggtttccggatgtatgggggctgcttgattcttcatcggagaaacaatagcgatttgcggttcgatgaaagtataacgcagttgcgttgtgaggtgatcgttggcatctatctttatgtctctgaatgaagaaggggagtgatcgatgcctcctttgtccagtgtgccggtgcagatggtataaatgcctttctgattgcggacgtagttgtagtgcatatgtccgtaaatttgtgctttcgtgttgaaggtacgaaagtcgaggatatcctttttgtctgccttgaatacgaagttatcgccgggagtaaacaggtcgtggttaaaaagaacaagcgcctgatctttcttcatcagggcgaggtcattcttcagccagttgtatacatccctttgcgtgtaatcggtcgggttgtctccgtggtcgatgggagtaacgacataatgcacgttgccgacatcgaacgaataccatgtcgggccataaatcgattcataaagttcttcgccgtagttgcctttcaccaggtcgtggttgcctatgcagtaatagacggggcagtccattgtttgtgcattcacaatttgattgtgcactgtgagtcccggttcgtagcagatgtctccggtatgaatcagaaaagccggttgttcgttctttatgtattgttgtaggtcggtgacccaacgccccactcctccggtcacttccgtgtcggtgatatggataaaggagtgttctctgcccttggtccgttcgctttcggtcactataaaatcatagcttttcctgtcctccttgacagggaggtagaattgctgtgtctcgaatccggcaggcgtagtgatgctgataaatcgggttttctcgaatcccgataaggagaaccggccttttctatctgtttttactacgttcattccgtctgttaccatcactccctccagcggtttgtctcctttgtcgaatgtgcccgattgattgatgtcgacatagacggttcctttaaattgtgcgcacagcggaagatatagtaaaaatgacaagagtattacggatagtcttttcatgatcggttctctgttttattaggcacagatgacacggattaacgcggtttttaattgaccgatctcttaaatccgtgaaatccgtgtcatccgtgcctaaatttatgatataaattaattatgctgatacttatcgtatttgtttcatctcttcgttgtatctcgcttcttccttacacaaaggcttgtaccaggtttttctgagtatgagcgtggtaatcagaagcaaagcgatagaactccagagccctaactgttcgcggacaacgaggtacattggaatgatggtaagcgtacattgccagatgattcctatcgccacattgaaggcatctcttttgaagtttttattcgcctgaatatgcgggtaacgggcgattgctttctcctgaatcggcttccagcatccccatgggcgtacattgacgtagaagttgatcagagtctcttcatctgtagccggagcactgtaagtcccgatgatacatccgatcagagagacgccgaacagtacggggaagaaataaagtacccatgcatccggaacggtaaatttcatcacaatagcggccactactccggcagtcattccccagaagtaaccttcaccgttgaaacgccaccaatgccatttcagtacgttggctgcgatgtatcctccgaacagtgcaccaacaatccactgaaagatttcattgatatctttcaggaagaatccgatgacggtgctcaccaccactactgcaacggaaatgacatagctgctgcgtatctgtgtcttcacactcgctttcgggttgatgtatttcagataaatatcatttacgatatatgcaggggctgcattgacggtagaagcaaaggtcgacatgaaagctgccagtagacctgccaataataatcctgcaaatcctgccggaacatatcgtgtgatcagatggggaagaattgtctcaaagtccgtgcgggtcacctccatctgtgtcagtccgccgtcttccttgaagaaatagatggcaagtaatgcaaatcccataatcatcagatagcgtggaattaacagcacgacggatacggaaccgctcatcatcgccgcttctttgggagatttgcaggacagaattttctgcatatcatagttgggcgcaggccctgccatactcatgaagatgcctttgagcaacgccatcatgacaaagatacctatcagactgtaaggttcgttcgccattcgttcggtcagcaaactcatccggctgctccagtcaatatcgagcgtccatccgaagaaaggggaatcccatccggcaggtacaaaggagtgtatcatatccggcgccaccatctgcataccgatcactacgataacgatgcctgccaccgtcatgataaggaactgtacgacatctgtccatacgatgctcagcattccccccaacatgacgtagaaggtggcgatagctgtgaagaagataccgtatacatgcggaacatactccggtgataccgtgaaaggaatgtagggtgaaatgacttcccagggaataaagatttccatgaatttgcctattcctatgaatccgtaactcagaaatccgagtacgcttaataacgcaaatacgacaacgatggtatgagagagtgtcgctcccttgcctttaccgaagcgggttttgatccattcggctccggtgagcacattggaacgccgcaaccacaccgacagataaaccatgaggaatatctgattgaataccggccacagccagggaatccagagacttttgaatccgtaggcaaatgcccagtaaaccattagcatcgtaccggtgatgtcgaacattccggatgcattggacaggccaagcatatagaagggcagtgatttgcctcccaggaaataggagtccatattctgtgcggctcgcttcttcagtatgagtccgatgacaatcatggcaatgaggtaggcgcagatgatcagaagatcggatgtgtgtaatttcatgttgctattttgattaggttttgtacattaataatctatcaggtacaaaagtaggtcgaatgtggggaagaaacaaatattattttaactcatactgatactatttatctgacttctcaggctttaatagctgacacgtcaggtgttaatacttgacgtgtcagctgttaataccctgcaactcagttgttaacatccatcatgcagaatggaacatcctgaaagacagatgataatactgctttcggaactataatacaacggcattttccgacatcacgagcttattggcttctatgatatcgtatatgcttttcacggaagtcgtggaacggagtctgtcttccggtgtatgccggcagtaatcgattagtcgttcgatcgtagaagtcgctacgtgcatccgtgtgtcggaggaagcatagtagatgtataccgttccgtcttcatccgcgatccatccgttggagaatagcacgttggatacatctccggttctttcttctcccacaggtgccatgaagtaacctcccggctgggctatcaccttccttggatcatctaaagacgtcatatacagatataggacatatctgagcccggcagcacaggcacggactccgtgtgccagatgtagccatccttggggagtcttgatgggatgaggcccttcaccgtttttcacttctttgatcgtgtgataatggcgctgttctatgacgatttccttcttgatcactgcatgagtgatatcgtctatcaatgcccatgaaataccgcctccgctgcctgcatcgatgaatccgtcctgcggacgggtgtacaatgcatattttccgtctacgaactctgggtgcagcactacattccgttgctggctttgggagacgaggttgggcaggcgttcccagtttttaaggtccctgctgcgtatgattcctgctgctgcaatggccgaggtgaggtctcctgcgggtgcgtccggatctttgctttccgagcagaagataccgtatatccatccgtcctcgtgttttgtcagacgcatatcgtagacgttcgtttcttccggatataggtccggcagttgtaccggatattcccaaaagcggaagttgtcgataccattgggactttctgcgatggcgaagaatgatttgcggtcatgtccttctacccgtgccataacaagatatttcccgttgaatttgatagcgcctgcattgaatacggcgttaatgccgaaacgttccatcagatagggatttgtttccggattgaagtcgtatctccactccagcggagggtgctctgctgtcagaatgggatatttgtatcgttcaaaaacaccattgccgggcagtatcttttcattttcacgtgagatgagctcatcatattctttcgtgagaatatgtagtctgttatcatatctattcatatcaattcataaaattagagtaaagcatcggcttgcgatcctttttgtattacttgacaggacaaaagagactgtttgcaagccagacatacctgagatatacggtgttgtagggacagtctctttgtacttttgtcattttgaaagtatgggggtactttcaaaaaatacatgtgtcaagtctataaactattgtttggtaatcatataagagcggatggtgcaattgggttctaagaagctgacccagtaccaaccatcttccactttatcgatccggcaatcttctatcggatatttcacttttttgtccactgcatttcttgttactttatacagtaccgcatcacctttgttgcctttcgtcaaatcacctgtaaactgaactgcaaaaccgctggcataagttcctgttccttttataacaatttcggacatattgaactcttccgaatgagtaatggaacccactgtcgaggtagagacagactgataagaagatgaccccgctattaagtaacgatatgatggattctccagataaagatcgtcgatatagactatattgatgctgattgcctctccttcctggtctttgattgttaccgtcttgttgaaacgatatcttttaagaccttcgatgataacatctgttccattttccgctatcgtgcatttcagataagtggcggaaccattatttgtgcaggtatagcctccgttaccgtccagaatcttgattgtcaaaggttcaccgactgtcaaataagcaatttcttcactattgtcaactacaagtttctttattacttttactgaaaattctgcactcttgttcagtctgtcggtcactgtaactgttgcattgcctggtgccagagattctatctgtatatgtccttcttcatctactgtagctttcacgacagactctttgtcaactgttactttgtagcctctgtttcctgtataaacattgactgtcttgttttcacccggatacattgttgtagccgaattggacaaaaccagttcacttaactgatcgacgatgactttgacattggtactcattttagcccagtcggtaatagataagtcggtactaccggccttcagagctgttactttaattttgttaccttcggcaatggcggttgctacatcttcattggaacttgtaattttataattgccgttgccttgaactatttgaatgattccttccggggtctcatccagattaatgatcaactcctgcgtatttggcactaagtcgtgataggatggatcatcgtcattacagccggagaaaacagtagcggctgcaagcaggaatcctgccaaatataatagatttcttttcatgatattcattgtttatttagactatttattcagcttcaatatctttcattttaccagtgatggttactacactaaacttagggactgtaatggagcgcaatccgctgagagatggatttacttttttgcgttgccacttaactccttcatctgatgtatatgagatcatggtctgaaactcttttccttcaatttccagtttggtttcgaaggccttgcttgtagaattgtttaccagtacgatcgtataattgtcgtccttgatgtaagctgtcatcaacagttctttcgggaatgcttcttcgtcaccttcgggagcaacagtcttgatatccacacgtcggcttccttccgggataaacttagtaaattgtccgtaactgtagtagcgggacgctctttcataattggttccgggaagtgcttcttccagtctgatcaacgcttcattattcgtacaaggacgtgcacctgcccaccagataaatgcgttcaggttggaaactgccagataattatggaaagtagtagcccattgcatcgcgtttttccaggatggatcgtatgtgtctgtagaactggtttccgtattccataaatgaatattattttcagcgcagagtggtgattgtacaaactcagtgttgccaattaatgtgtatccgtgagctgctgcaataatgttggagttaaccagatcgggacaggctttcaagccattttcaagaaaagtgactcctgctttccaccacgagtgctctccaaagataatcttcatgtcttgataacctgctttatctaaagccgggcgaagattcttctggcagaagttagccagattggtataactccagctacaaccgttccatcccgttccactgctgttaggctcattagatggtgatattgcatatatctcaatgccgaacttttcagtgtatgctttgatgaagtcaatcagatagttagcatatgcatcttccgcaccggacgccaggctaccgcctgagggctttccgttagatttcatagttccgggaggactccaggtagagaatataaatttcacatctttatattttttctgcaggatatctaccagccacatttgacctaattgtacttgttcgccacatccggaaccgttaaagtctctccagtaatcattgatcatagagggatcgttggctgcaagattgaaggtacggttcattccgaagtcaatgacgtttgtggtagggttctgatagtgtggaaatacctcacctctgaaaatattcagcttcaagccattttctccgaaaagatcattgactacatcttcgcgcatcatgttgttccatatacgatgtgaccactctgcaaaggcacatccgaagccatcgattatctgatgttcgtgcccttctccgaactgtactttgatgacagcttctgtggtgggttcggctgagaatccgtcatcctcgtctgtttcttctaccgggtccggaatgtagacgtcactgtgactcagacttccatcgtcacaagagtatccaatgaatagaaagagggatacgaataataatgaatatatctttttcatgttgtttctttattaagttaatcttgctaggttttttatttccataaactggtttgttccatggcagtattattgtttagttcacttgtcggtataggataataaaggtgtttttcctggaagttttccgcaccttgttttccattcgccttgaagatcaactgaatttcgctgggcgaataccaacgtttcaaatcgtcaaaacgatgtccttccgcaaagaactccaataagcattggtgttctatttcattcattaattcagcttgtgcaaaagtcttttccgtaagtcctgctctttggcggatttgctttaaagcatagttggcaccatccggatcattggttttggcgcatgcttcagcataaagcaacagtacctcggcaaagcgcattacgcgcaaattgctggaccttccttctttgttgcccatgttgtccggtgccttgtcatccacataatatgcagtatttttctttatcaggaacttacctgctgtcccattgacgttgaaacttggtgctccgcctgccatttttccttcattgccttcccaaagatcatccatggagtaattatttccataccatttctcgttaggaactttatctccatagttggcagcatcaaaaaagaggctggcatacatacgtttgtcaaacttggtatctgcatcactcggacgtgtttcttttgtaaactctcctacgatcagggagttcggcattaatttagcccatccgccggattttaccggaccgataaactgaggaatatagcaacctaaacagataccgctttcattgctccaggagtagtctccgtccggactgtatgccagttcaaatacggattctttattgaactcttcttcatttgtgaaattcttttcgaagttgtccatcaattcgtaagaataaggagctttcagtaatgtacctaatagctgtttggcttccggatatttgtgttgggtggcatatactttgcccagcattgcaatagctgcacctttagttatgcgttctttggcagtagagcgttctactggcaggttgcatttgatggcgttatccagatcttcttctacttgtgcccataatgcagcttctgtagcagcggctttattggtttcatcttcgttggatggaatcagtctcaaaggcacttctttgtaattgttgactaacaggaagtattgatagccacgcagaaagagtgcttcgcctttgatcatcgagcggtcttcttcagtaatacctgatgcaggtatctgatcaatataccgcagtacgatgttggcacgctggatgcctgaataaagcgctccgtaaggatcatttccggtagagggcgagttcaggaagtttgcaatattccacatcggaacttcttctcctttgattgtgtagatatcgtcaccacgaccgtttaagtttagccagccgtcaaatgcgccgaagtatccgtacatggctccttttatcggagaataggcggctgccaaagcactttctgcatctgctttatctttccagaagttgctttccgtgaagtaattggggtccgacagattcaaaaagctggattcgttgcacgatgtcagcgctccggaaaaaagagctgccatgcacatatatgataaccaatttcttttcatgttcataaactgtttaatgtttaatattaatttaaggtattacaggttgacttgtattccgaaagaaatagtacggggcaatggatagcgtccctggtcgatacctcttgagaatacattgtaagcaacacctgcgacagaactttcacccaggtcgggggtatagccggaatatttggtcaatgtgaacaggttctccattgaagtgtatattcttacgttttcaagtttgattttctttgtcagaactttgggtaatgtatagccaatgtccaatgttttcaaacgtatgtacgagccgtcttccagccatctgtcggtgtatgcccatttgttgtctgcaccgtcagtcttagagaaacgaggaatatcagtgttctgattgtccggtctccatgaattggccaatacggtactcatgtttccgttgaagtttcctgattccaggcgataacggggataattatatatcttgttgcctaccattccgtcaaagaaaaggttaaagtcgaagttgttccattcgccgccgagtcttatgccaaaagtgaaatcggggaacggacttcctacgtcatgctggtcatctgtgtttattttgccgtcaccgttccagtctttgtagcggacatcaccaacttgtgcagcgggctggatgagttcaccgtctttgtttttataattagcgatctcttctgccgagcggaataatccgtctgtttcgatcaggttgaaatatgacatcggatgcccttctgcaaacatattgataccgcgaccaccggcaccgtgtgcgctgtatccggagatcatcaggttttgtccgcctaatgttattttggtcacttcattcttgtcggctgcgatattggcaccgatgtaatagttgaacttttccttgatggcaccgcgatagttgaccgcaagttcgaatcctttgttccgtacttgtcccgcattctgaatagagtttccgctgataccggtagatgcggtagaaggaataggtaatagcacatcatttgtattcttaacgtaagcatcagcagtaagcgtcaatcgtccgtttagcagactgacatctaaaccgatgttataggtctccgtattttcccatgttaaattggcgggtgagattgcctgcacatatggcatagaaccaaaccaaggcgaattattcatcacatagttcatgccgtccgatactacactttgtgtcggatagtagctggtcatctcctgattaccgagtttaccataactaaaacgcagcttcaactgatcgaatacattctctaaaggtttaaagaatttttcgcggttgatgttccatccaatagaagcagaagggaatgcaccatattgatgtccacttctgaaacgtgaagaaccgtcacggcgaatagatgccgagaataaataacggtcgtcaaaggaatacatgacacgtccgaacagagataccaatgcaagttcattcagcgaactggatgctttcaggttggaaggatctacattgcccggcattgtttcaatgaactggggcatatctccatttttaccataaaggctgtaacttttgtctttctgggcagagtatccggcaaggagtgacaaattgtgtttgccgaatgtacggtcataattcagggtgttttctaatacccatgattcccatgttgacgatttttcttcaaggtcgggcttgtcgtttttaccgaatgttcctaaatcgtatacatccttgtaataacgccacttagtatgctcttttctgatacctacattgagtttgtactttagtcctttgatgatttcagcctgtaaataagcattgaggaaaatcttggttgtttctgtccgttcgtcgttgactgtcatttcagccaatggattcggtaaattgatgtcattggaagtaccccagcctcctgcgtttgtaggatcgtataccggtactactgacgggaactgaaagatatcgaacatggtatcctgatgaatgtatccactaccttttgtcagatttacaatcatagattcacctattgtcaagcgattgtcgaagaatgaataatcgcttttcaaacggatattataagattcatgatcagtgttgcgcagtatcccttctttattaaggtagctgactgacgaactgtaagaaccgtttttggaaccgccgctgatggtagcattggctttataagtcatggcagtacgcagcattacgtcttgccagtctgtgccttctccaatgaaaggggtagctccattttctgcaccataaccgtcgcctgctaatttgtagtagcgtgcgaagcggctgtattcttctccattaaaaactttcagtgttttgggagtctggctgactcctgtgaagaaattgacatctaatttagtcggcatgtctttacgaccgcttttagtggtaatcagtacaacaccacctgctgcacgtgaaccgtagattgctgccgcggcagcatcttttaaaacttcgatagaggaaatatcgttaggatcgaccatactgatatctccaaatgctccgtctactacataaagtggattgttgttggataaagaactgataccacgtacattgatcgtcatacttccattgggatcaccactggaactggctactgatactccgggtattttcccttgtagggctgtggctgcgttagaagcaacctgaccgttaagttcttttgcactaaccgaacctacagcccccgaaagatgactcttcttcactgtaccataaccaatcactactacttgttccagagcgatattatcttcttccatagatacattgattggagttccggacgtgacagctttttctatttgtttcatacctattgttgagaatatcagtatattccctttattcgctttgatggagtatttaccatccatgtctgttactgtgccggtgtctttacctttcactctgactgtgactcctggtaagggttcatttgttgtagcttctgttaccattccttttatttcaatatcctgggctgccagtggaatgctagtcaggcaaagaaaaaagaatagtagaaaataaatttttcttctcataatttattgtattagattataaactctattcaattgttgattgatccatggaaacttcaaccaataactgatgatgcaaaagtaggcgataatgctccgtcagacaagtagtattttatcatttactaatacaattctatcgtattgtattttaatttgaataaacaaaagataagatgtcctatcagaatgtttgaatgctgctttaatcagttggattgcttattaagaatgtcaaaagagtacattttatgattgaagttatattatgttgtgttaccgggggacaaaggtataaggatatgtatgttgatgcaagtattattcggtaattaacagctgtggaggtgtgatttctattacttataggaaataaaactattatgactgctcattttgttacttataagaaatagtatttataatctcctatcttatgagcgtggatagataaataaaaaaggagaagccagttattttagcttctccttttcccatcctattaatcatcctgaatgattatttgaaaacaatctccatgggtctacctatccaaacttgtggttgttctaaatgaaagatgcgggcgatagtggacgccacatcgtattgcatcatgcttacatcgtcaaaccggagtcctttcttaatattcttgccggatatgatgaaagcagtttccatttcttgcattgtttttccgccatgacctttatcgatacctccatggtcggaagttaatatgaaaatggtatcatccagcattcccgcgtcttttaccgcctgaacgatttggccgacatacacatccagttctttaagtttctcataatattccggtgtgtcgtgtccggcagtgtgtccggtgtggtcggggccgtcgtagcagatggcaacaagagcggggtgtttctccttaatataagaagaagccatattgcccagttctttcggagtcttgttgcagtcggcaacatgatagtgataacttaaagacagcgtatctactaaatatttaattccttcccattcatacaggcagccgatttccgcttccgggcgggcatcgcgcagtaattggaaaacagtagggaagataccattcttatttaatacacgtgagggaagttccggtgttttagatccccattcggtgtatccgtgaagttccggtcccgctcccatgaacatggatgcccagttgatggcactggaagaggggagggcagaacgctttttcagtgtgtaagctccgtcctccatcagtttctttacgttcggcatatctgctttgggaaggctgtaggctccccagccgtccaaaccgatgaaaacaacatgtttagctttgtcttttcctttggcatggcaggagaaagtgaaactgaagaggagtgcgaatgtagcaagtagtgttaaaaaggtttgtttattcatgatacttttatttatatggttaatgttttattcgttattgaatcaaaggccataactaatgatgagcaaaggtaagactattttaagggggagacaaatataatattagcagatactaatacttttatggtatttcttttaaaattttgtcttttgcttggcgttgtttctttggctgtcaaattctgtcgttgactatttgtctataatattgaccgttttaatgattcttctgctcaaatatgaatatcctttcggcttggctacaataatatccttacagttttataataaaccgtttgagcgtttttaataaatagttgaagggtttattataaacggtatccaagtttattaaaaactatttttgggaaatttctgagtaaccttggaattatataaacaaaaagggagaaaatcagtgctgattttctcccttttccattcctttatagatggaaacagatgccttattgactgctgttatgtcttatattttatacgtttcatattgcttttcttctttttactaccttcaaagatacaaaataaaaaaggaaaagtcaagagctggctgtgataaaacagtttccggtgtgaatggacaatagtttccagtgcgactggaaactattataagacgctgattctcacttattctttatgataagaatgatctttcggaaactcttctccttcccatgcttttttcgaagtccaggattgtgaagcatccgtccaaaagggatcatcggcagacagacctagcgggaggaaagcaagcgatgccatatacaagctgccgttattagtgtaataatcggagataccgggctgggaaccgttgaatcccagtgtcagaaagcctgctgtattgaagttgcggccgtctccgaacatacgttggatgacagccgtcatggctgcgcgtacctgtccgtttgataattcttcgggaagccagttgcgccacgcaagcagcgctaatgtctgcaaagagccggtacggtaagtgatagaacgtccgaaaacaggtagcgtaccttccggagagatgaggcgttcgaggattactccgaatcgttgggcacgtctgatcgcttcatggaagttgcagccgggcatatttcctatcttctcacgtttgccggcttcggtgattatctccagtgcttctatatacataggatgtatgacgaagctattgtaataatcgaatgcgaaacgaggtccgtccgaataccagccgtcacctacataccattcttctatcttgcgcagagaggaactgatgcggtaagtgtcactgggcgcaccagctttccgaaggaaggactcgacggtggcgctgaacaacagccagttgctataggaaggatcgacccgtctgagatccgtaaattcggcgatataccgctgcttggtgatgctgtccaatggcatccataaggcatcataacttctcaggaaactttctgccaggaaggcggcatccaccaaggtctgattctcctgacgccataacagataatcgggggaagcgggatctaccgcgttagcatagcttttcaatgcccattcccgcagttgtttgcgttggagtccttccggagtttcatcgtcgggcaatgacagccacggtgccagtcccgccattagacgaccgaagcattccatataagtgacgttctgattgcgcccgtcccatgtcggacttaattctacgagcatattctgtttcagcagaccttcgctcatgttgcttaatacaggagcagccatccggtacattacgtcgcaccagatttctctgtcacttttctctgttttctttttggcactgatactttctgtcgggatcagcagaatcattaatagtaagatccaatgaagtcttttcatgtattgccttatttttaagattaaatctacggctatggaggcatagctgaagcgtatggcaaaggtagaattattccgacagcagggcaaatacaattttagcattaactaatacttttgcgttatttatcagatgctgatactttcttatacaaaatgaccggtaaataatgcttgtcaccggatttgtcatacatttgtccggtaaacaaaattattactatgaaaaggaattggataggtagcagcatgatagttgcactctttgctttattggcaagcggatgcggtcatagtcaacggacgctggagtttcgtggaatctgtgtagatgacccgcagggagaaaatggattatataacccgggcaggggattccggctggaaaccgcggtggatgtgctgcacgaaaaagacactcctaccgaagaactgaatgaattgtctgctaaatatgtagcagatagtgtttcactctcacagagctacttttatctgacttatttaataggtaaagaactgtctgaagaaaacttccggaccatgcaggcatattttgatgaactgcaaaagcaaggaaaaaaggccgtactgcgctttgcctacgaacgcgactttatgggacggtcgcctgtcggtcctaccggcgaacagatactggcgcacttggatcaattaaaacctttcctggagaaaaataaagacctgattctggtcgtacaagccggaatgattggcgcgtggggcgaatggcacagttcggttcagggactggaaaactcggaagaaacaaaggctgccgtattggaaaaactgctttctgtggttcctgcggagagaaatgtacaagtcagactcccggaatttaagaacctgctgaaagataaaccggaactttataagagactttctttccatgatgacttcattgtcatacgccccgacagatgggatgccgatatgcacgaagggacaccgaagttcgatcagatagtggcggaatctccttacctcgtagtagacggtgaactgccctggggattctggagcgtgggcgctgatccggacagtccttctgccggatggattattgacggtatgcaggcggcgagacgtttattcctccagcattatacttcgctaagtatcatacataattataaggagcaacatcccaacaaccggtttgacgagaataatccgcccgaatattccatggtggtctggaagaaaacgatgataacggaagactcccttctccagcatcatatgccggtgtccgacagttacttccggaagaaagacggaacgaaggtaaaacgcaatatgttcgattatatacgtgatcatctgggttaccggattgagcttcaatcacttcagcttccctccaaattcgtgagtggaaaggagaacgtcttgaaactgagcttgaagaacagaggttttgccaccgtatttggtgaacatcctgtttattttgtattgattgatgatgcaggagaggttacggaatttccgaccgatgccaatccaaagaactggcaaccgttcgaaccaaaggattctgcttatacttcgctgatgcatacagtggatgtatctcttgaactccctgcctcggtgactgccggaacttataagttaggtctgtggataccggacggatcggacagactcagatataatcctcgttatgccatccattgtgccaatggggatacggactggtggatttctaaggatggaaagtatggcgtgaatgtattgactgcggttgaagtggaataaatgatttgtttctatgataaaagtgaaaggcttcgggtatgattaccggtagccttttattgttgggtatggattactttattaagaattataaatcagtaccaccgtatacgctacatagcaaagtatcataatgcttccttctatccgtgtaatggtccgcttggcaaagaacagcccgaacagccagagcagaatgctggaacctaccagtgtgaacaggtcgaagtttgtaattccgctaagatggaggggagtgatactggcgctgcaccccaatacaaagaagatattgaagagattactgccgattacatttccgatagccatttccggattctttttcagtgcggcgacgatggaagtggcaagctccggcagggaagttcctccggctaccagcgttaatccgataatggattcgctgactcccatgctgcgggcaatccctgtagctccgttgacgaacagctgacctccatagatgagtgccgccagtccgccaatgatatagagaatggatttccaccacgaaagcagcttgatctcttcttccggtgccgtgtgttccggtgctgccggttccggtgcagcggaagattttgggaaagcgatggcaaacgtataccccatgaagatggcgaagaagcagagtaaaagcagaccgtctactctgttcagtatattttctgtggcattatcgaggaatatgtcattggcgcatatcagcaataccacagacgaaaggatacagagcggtatctcttttcgtaaagtgttccgggtgatgataatcggagcgaacagtgccgtacatcccacgatcatcagcgtattgaatatgttacttcctactacattacctatggcaatgtccgcgcttcctttcagggctgaagcgacactcaccgtcagttccggagcggacgtgccgaaagcgacaatggtcagtccgataacgatggaaggtatgcggaaacgtttggctacggaagcggcaccgtctgtcagtccgttagctcctagtaaaatgagaattaatcctccgataagtaatagtatattcataatttttctcttttggggcaaagataatcatttagggaattgttatgtcaaaaacaatccgtatgtttgccatgtttattaaaaagtgaaattaaagttaattcacctaacttggaatcattctatatggatatgaaaaaaataaaacggtttgcattgctgctcataatggcttcccttgcagtcaatgtacaggcgcaactggagcaggcagtcaagaagattttcgccggagatacagtagcaacgcatccagtctctttgcatcgggattctgattctgcccgtgtggcaaatctgcagaaatcattggaagaagcgcggctcaatgaagccaatatgcgtatggagatggagcagatgaggcttcagatgctgtccgccgattcggtgaaattctcccagcaacggcagcgtatcgactcactgcgtcaattcacgaaaggaataccggtagttgccgaaggggataccctgttttatctttttacaaaacggggcggatacactccccagcaacgggcacagatgaccggtgccgctatcgaagagataggaaagcgttttaatctccgtcccgattccgtttccatcgaccattcggatattgtttccgacctgatgtatggcaataaagtattgttatctcttacagatcaggatgctttgtgggaaggagtctcccgtgactcccttgccaaagagaggcggcagaatgtaatcaccaaactgcatgagatgaaagcggagcacagcatttggcgaatggcgaagcgtatcctttattttctgttggtgattgtcggtcagtatctccttttccgtctgaccaactgggcatttcgcaaactgaaagtacgtatcctgcgtctgaaagatacaaagataaagcctgtgtctatccagggatatgagttgctggatgctcaaaaacaagccaatctgttagtctttttggcaggcatcggacgttatatccttatggggatacaactgttgattactgtccctttgatttttatcatcttcccgcagaccgaaggactggcataccgcttgctgggttatatctggaatccgattcggaaaatctttgtggatataatagactatgtccccaatctgtttacaattgttgttatctggtatgcggtgaagtatctggtacgtatggtgctttatctggctcgtgagatagaagcggggcgtcttaaattcaacggtttttacccggattgggccatgccgaccttccacatcgtccggttcctgctctacgcatttatgatcgcgatgatttacccttatctgccgggttctgattctggggtattccaagggatttcggtctttgtcggattgattgtctctcttggatcaagtaccgttatcggaaatattattgccgggctggtgattacctatatgcgcccgttcaagatgggcgaccggattaaactgaacgataccaccggcgatatcatagagaagacgccgcttgtcacccgtatccgcactccgaaaaatgaggtggtgacggtgcccaactcttttatcatgtcttcacataccgtgaattatagtacatcggcacgggagtatggcttgattatccattcggaggtatccatcggttatgatgtcccctggcgccaggtcaatcagatactgattgatgctgcgttgaatacgcccggagtagtggatgacccgcgcccgttcgtgctggaaacttcgttgagcgactggtatccggtgtatcagatcaatgcttatatcaaggaggcgcataagatgtctcagatttattctgatttgcatcagactattcaggataagtttaatgaagcgggaattgagattatgtctccgcattacatggctgtccgtgatgggaacgcaacgacgactcccaagaatgatctaagcaagagtaacactgcggatactgctagtcagagtaacaaatcagaataatataagctcgttacttaatgaacttgtgattttctttgcatctgtcggggcaaaggagtactataataaatcagggcgcccccttcatcgcgaaggagacgccctttgtcgtgtgtgttttttctgagagtagaatttctttctttaatagagaacttatttttttcgggttactgtataaagtacatttccttttttatctatcatacgcaggttaagctccttcttgtcgatagagcaaacggagaaacccggttcggggctacagaattttgtaccttcgatgggttctaccttgcgtgcgagagaggcggcggagttgactacatagtcaatgtcgcttcccggtacacggatatgctggaagttgtggatatgaccgcagatgtacatatctacgttgtgcttgcgcaggatgctgtctacgcgtttctgcatatcaagccgctcgctttcctctttcggggtgtaggcatagatggggtgatggccggctacgatgatccagtcctccttggcacttgccagtacagattccagccatgacagctgtttgctgatgtcctgcttgcaggcatccggatatttatcgctttcattgcggtatttatcaatcagcggagtggtgtctatccagacgatgcggatagtagctcctttttcttcgaataccttggtgtagtaacggtcgggcatcgaccagcggcggctgatgttcgtatagtccagtactgcctgagtgcttccacggtattcgtggttgcctaagatggagaaccagtcgatcatcagttcggggtgggagtagataagctcgtagttggtcatccacaaagggtcgttcacgctacgcactccgtcgaagtggtgaacgtctccggtggctaatacaaattcgggacctatctcttcgcccattgtgcccatcagttcggcgattggcttttggtcatagtagccgttgcgacctaaatcattggctacatagaagttaaacttcttgtcaaagatggaataatccgtgagctgtgcgtgggcgaatgtaaagacggaaaggaaaagaagaatgaataagctttttatcttcatattatat

SEQ ID NO: 40 - DNA, 72751 bp, Bacteroides thetaiotaomicron
cgccatacccctgccttatccatgataaacgatatgttcttattatgatcatcggatatacctgcgacataattaaataccattctgataaatatctgatctttgtcttcctggggaagtttcagagattaatggtactaacaataattcatatatggaattagtcaaccatcttattcgtgaagtggggcttttaccgtatattgatacatatactgcatcttgggaagatcggtttgtatgtgaagtttttaaagttaatattggagaaagaaaaccttgtgtcttacatactgctcaatcacaggtattaaagaagttattagaagggaaaagcgttgcggtgagtgctcctacaagttttggtaaaagttttgttattgatgcatttattgcgattaaacaaccaattaatgttgtaatattagtacctacggttgctcttgcagatgaaacaagaagacgaatttgccgaaaattctctcatcaatataaaataattacaacaacagatgtagaacttgcggagaaaaacatattggtatttccgcaagaaagagcttttgcctatatagataaacttccttcaattgatattctaatcgttgatgagttttataaggcaagtacaaattttgatcttgaaagaagctccactttactcagttcaatggtagaactcggaaagaaagctaaacaaagatattatcttgccccaaatatccatgaaatagaagaaaatgtattcactgaagggatgacatttctgcgtatggattttaagaccgttgtaacgcatgcatggcggttatataaaagcagaccaaagaatgaagataaacagagttttaagacacgtaaacttattgaattaataaatacaggtataggtaaagctttgatatataccggcacatataagggaattgaagaagtaacaacaattcttaacagaaatttatataataaagactctgaactgcttgctaatttttctgattggctggaatgcaattatggagaaaagtatattcttaaagatttagtcaaacatggtattggtattcataatggtcagctacatcgttctcttagtcaaattcaaataaaactatttgaagaacagaatgggttagattatttggtatcgacctcgtctataattgaaggagtaaatactcaagcagagagtgtcgttttatggtcaaataagaacggggctcataagattgattattttacctttcgcaacatcattggacgcgcaggcagaatgtttcgttattttgtaggtcgtgtctatatgcttgaagagccaccaagtcaagaaaatactaaattgagattagagtttcctgatgatgtagtaaaaaaacttgatggaaatgaccccggtataaaattgaataatgaacaatatgtaaaaattcaacgatatcaagatgaaatgatagaacttcttggaacggatatttggcatagaattgaaagaataccacaaatcagaagttgtaaaccatcaatgttaaagataattgcggaaaaattgaaaactgattccaattggccaacaaattgcgatgctttacaaaacaataatacatgggaatggagggatgctttaggagatatcatagaaattttggaatatcatcgaaaaggacatttacggtattatgcatgtgcatgtagtaatggatggaaaatgactataaaagagctatataacacagtaaaagattatggtattacatatgaggatatatttacatttgaaagatatgtatcctttaatctctcatctattattgcggtaattaatattatacgtcaagaactttatcctaattcctcaaatatcgccaattttgtatataaagcatcaaatgcctttttacctaaaattgtatttcaacttgaagaatacggattaccgaggatgattagtaaaaagatacaaaatgcaggtcttataaatcttgaagacgattctaaagagattacaatcgttatacaggaatttaacacgataggaattgaataccttgaacaaaaaatacctaatctccattcatttgacaaatatatattaaaacattttatgaacggaattcgttgcataacgacaaatcaaaagaattaaataatagccatattattacctctatattttttgagatatgatatggctatttagataaggatccatatagaaattctttcgtataattttcatttgatatcttcaacagtacgcagtttttccgttctgtataaacatcacgtatgtttgccgcttctcttgtgagagaacctttcctaccagccacatgcggaacaggtaggtgttgtaggtgttcagccgaaaagcaatcagaataatgatttcaggcgcgtacacgtccgcgtacagcccgttttcaagctgcatgtagcggcacaccttgtagtcgttcagcacgtcagacttgcggacggctttgatgacggcgttcactgccgggacggtcgtatggaacagtccggctatttcggtggcggtcatccacacatcgttaccggttacgctgaccgccttgtcctctatgatgattatgtcacgtttcatggctcctcttttttagatggtgcaacctgcaaattcctcgacgttgtttaaccttgcggcaaggttttccatatcctgattgagtttttctttggttatcttcgcgtaaatctgcgtcgtctttatgctcttgtgtccaagcatggagctgaccgtttcgatgggtacgccgttggaaaggaaaactgtcgtggctgccgtgtggcggctttgatgccacgtgatatgcttggtgatgccgcaacgcttggcgacggcacggataccggcaaggcacgtgttataatgcggaacggggaatatcctgccgttctcgcatagcccacggtatttgccgattatgcggttggcgatgtcaagcaggcggatgttggacaccacgcccgttttcttgcggttgatgtttatccactcgtgttcgtcgaaataggtacggatattctcttccgtgaggttgcgcatatccgcgaacgacaatccggtgaacgcacagaacaggtagaggtcgcggtacagttcctgtttggcgtttttcagtttcccctccatcagcaggcgtatttcgtctttggtcaggaaactgcgtgtcgtttcctccttcttgatttcatactcgcggaacgggtcgcgtgtcagccactcgttgttgatggctatgaacaccattgtccgtagcgggcagacgtacagccacacggtattggtgcagcagtgcttgtccgtgcgcaggaacatctcgaagtcggagatgaaagcgggagtaagctcttttagggcgatgtccttcacatggtagcggatgtcgaggaactcttgcaggtgcttgtaaacgacacggtacttttccagtgtaccttttgctttcatgcctgcttccacctgtttctcatagttctcgttgtgccgacggaacacctgcatcagcgtgtggtagcggtgttccagtccgagaaaggcgttctttaccttctccgccgtgacgaagttgtcacgctccatgatttcctgatagtgtctgttgatgcgcacccgcatcttgtcaagcatacggttcgtttcgagtgccgccgcgcttctgcccgtgacacgtccccctttggtgtcccacagcttcggatcgacactcaacttgcaactgaactgcgtctggctgccgtccaccgtgatgcgtcccatgacgggaaccgtcccgtcctttttcactacctgacgcttgaggtagtagattactgaaaatgtactcttcatcgttcttaatttttggatttcaaaattagttggtgaagagtccggtgtcggtacgcaaaacggggaggaacggcgcaatcttttttccgtaaccgtatttgttacgtgagttgtgggtaactcactataacatagtgtcttgtttcgccattcgtacccgtttgtcgcattttcggacatggttacgaacaagtaacgttgcggcgtcaagatttggcttcggcaaggattgtaatggcttcacgaattatcgccactttaactaaaacccttgtaactcaattctatcactatatctttccgcatttcacttttttgtagtaactttgcgcaaataaaatcgcaatgatacatacattcaaatgaaacaaagacgaaaatttatactattctatttaagcattatatgcctattctcatgcactgccccataccccaacacaatactgcgggtggaaaatattattaaagaatatccagatagtgcattaaccattttagactctctgagtgagagtatcacaaaggaatcacaatcagcaagaatgtactattacctgctgttaacagaggcacgtgacagatgttacgtgcctcatacgtctgattctctaatgttatccgtcactgattattatgaaagagaaaatgataaggacaaactgataaaatcctattattacacaggcagagtataccttgatcttcatgaaggtcctacagcactttcttatttccacaaagcttttgatatctctacagatagcaagaactacgctttattggggcgaatatacagccaaatgggaactctatttgcctatgaaggtctcacagaggaagtactacaagcttatcgaaacgcttatcactacttacaactaggcaaagacagtcttactagcgcttatgcactacgagatttaggaagagcattcaatttacttgagataacagacagcacaatctattattataacaaagcataccaattagctaatagcaatggagacatacaaagggaagtaaatattctcgaagaattggcaggcatctatattcaaatgggaaaatatgacgaagcattgaaaacgctacaagaaacaaatagtaaatggcaagatgagaaagatataaattatgatgtttggggaaatttctatgtaagtataggacaaaaagattcagcagcctattacttcaagaaaaatataggacataataatgtatattcagacataggagcctatcggaatttatatgaaatagaaaaagaacgtggcaactatgaagaaggattagcatatctggagaaatatacagaatgttctgatagcatttacgacatatccaacacagaatctttgcgaaaaataaaggctttgtatgattaccaacatattgagaaagaaaaagaatatttgcgcaagaaaaatgcagaacaacgagcatggatcatctttattgttattgccatcgttttaggagttatcatccttattcgatataatagaaacaggaaagctatgattcgggaacaagagaaaaaacttcatgagattaacgaacaacaatatcggaaaagccaactatatatagaagaaaacaagaaaaaaattgaagaattaaaagaaaaggtaaaatcgttcgaacaggaaaacaatgatttacaacaaaaacttttacttgcaaaaaaggaaaagctagaacaaaccaatcaagctatcgaaacatcacaaagagaacaagcattacttgaggaagcgcttagaaggtctgatatttatgcttattgttatcgtgcgatagaagattcctcgatcagactcaccgaaacagaatggaaagaactagaaaatatcattaatgatacatatgacaatttcaccaacaagttattcatactgcatccctctattaccaagatggaactacgtatttgtttactgttaaaaattaaaattccagtttctacaatttcacaattggtatgtcgtacacaaagcgctgtatctatgagcagaaaacagctttataagaagatattcaataaagaagggacacccgcaaacctagatgacttcattgtctctttttaaaaagatgaactaaatctctgatattccacacaaagaagaaatacccgcattcagaatcttcagtttcacccgcaaacgccctgtcggaaggggatagcggctgaaggcacagttttacaactccattcttgaagctttatgaagggagtaaggtgcttcagtcctttcagtccccaaaaacaatttcgaacttgataccgttcaagatatcagatggtacctctcagtgtgtcagaaagtaccattccgcaggtcagccagtaccattccgcaagtcagccagcaccattcaaggagttggaaatctccccatattttattcattcctacacaggctttccgctaattactatccgagtcactgtgtataatgaataaactctgccaacagttgaaatagaacctgcatttacctcaaacagagcctgtattcaagataaacagagcctgtatccaaggcaaacagaccctctgtttgatcagaacacactcttcgcttgattgatctgaaataagccggcagctcgccaactttcacctcggaggcgaacagactttagctcggcgatgaatgaagttcagctcagggcttacaaaatttagcccgtatgtcagggctgaaagaactgaaaccacctgccccctttcaaagtatgtcagagacggggttgtaaagcagtgttttcagccgctatccccttctgacagggagcttgcggacgaaactgaaaaagctgaatgcagattacaggataataatagcatagaataaaagtcatacatctttcattcaattgttgtacatctccgccccaaacgttatacatcatcaacctaactgtagtactgaaacccagcaactgaagtacttctcacaaccaagtcatgtactatatatcacaacccatactttgtgtcagaaatcaaaaaatagtcatctgctgtttacaagtttgtcaaccgcaacaaatataacgattttattaatcataacttataaacagttcaaattcaacctatttataagtcgtaacttataaaatcgcccgaataacaaaagccgcaatccatctctcccgtataagaagagatgagattgcggctcactatggactaaatagccgtaaagctataagctgatttcaaataaaattacagaccaaaagctgccttgatcttatccacgtagtccagtttctcccatgtaaagagttctacttctacggtcttattgccctcatagcgggagaagaacgttttcgataccacttgcggctcacgtcccatgtggccataagcggcagtttcctgatagatcgggttacgaagtttcagacgctcttcgatagctttcggacgaaggtcgaacaactggtcgattacacgggcaatctcgccatcggtcatattcacgtggctacgcccgtaagtgtccacgaagatgttgatcgggcgtgctacaccgatagcatagctcacctgtacaagcatttcgtcggcaacacctgccgcaaccatattcttagcaatgtgacgggcagcataagcggcactacggtccaccttgctggggtcttttccggagaaagcaccaccaccgtgagcgcctttgccaccgtaagtatccacaataatcttgcggcctgtcagaccggtatctccgtgaggaccaccgatcacgaactttccggtcggattgacgtgatagacgatctgatcattgaacaatgccagtactttatcatgatggatagaagcaatgacacggggcatcaggatttcgataacgtcacgacggatgatagacagcatttcttcgtcagctttgagctgtgcttcggcagagtcatcagccggctgaataaagtcatcgtgttgcgtagaaacaacaatagtatcaatacggacaggagttccgttgtcgtcatattcaatcgtcacctggctcttggcgtccggacggaggtaggtcatcaccttttcttcgcggcggatatcagccagcacctgcagaatgcggtgtgccagatcaagcgaaagcggcatatagttttctgtctcgttcgttgcatagccgaacatcatgccctgatcgcccgcaccctgttccatcgggtcctgacgctctacgccacggttgatgtcgggactttgctcatgaatggcagaaagcacaccgcaagagttactttcgaacatgtactctcctttagtgtaaccgattttcttaatcacttcacgtgcgatgagctggaggtcaacgtacgctttagttttcacttcacccgctaatactacctgtccggtagttactagtgtttcgcaagctactttagaactggggtcgtaagccaacagtttgtcaagcacggcgtccgatatttgatcggctaccttgtcggggtgtccttccgacaccgattcggatgtaaataagtatcccatctttttaaattaaagattataaattgaaaattaaaattgggaaaataaagaggggaggaagagagctgcggaagcattgccgaaaaggcgtcaacaagacgtgttttagcatttttttccgtggttgcaagctgctcaaatctgtccacactttcatttcggggacaaagataggtattattcggagattatatttatctttgggcaatgtttaacacatatatacaggaaattggtatgagaacaattacattaatgcaatatgtattttccattatccttctggtcatcatcttcctcgtcatggattatttctggaaaggagacgaattttcatggacgtatgagtttgcaaaaggaggaatcggcggaactatcatctgccttctgaaccgtcatttattcctccgccatcctaatcctaaacagaaaaaaatatgattatcaacaataaattaagaactctttttgtactggcgctttatataggattcaccattgccatttacgccattgtatgccacttcctgaagattgagtttcaggatattcacttgttatatgcagtattggtgggctgtgtggcttatctgccgaggtttatcgccgaaaagaaaagtaaaaagtaaaaggataagcaaggggaagagaatgctgtattatttttctatctgcgccagcagcaccttcattgcctttcccaataccggatgcaccagttcgggggcaatctccgttaaggggcgcatcacgaagtcacgttccgccatcaaagggtgggggaggttgagtgctgctccggaaggagaagtaaccgaaagtatcagatcatcataaagcagcaggtctatatcaatcagccggtcgctatatacgccaccgacagacttatgcgtacgtcccagttcccgttcgatctcctgcgtcttctgcagtacttccagaggcgacagttccgtttctacacacgccgccgcattcaagaaactatgctccgaatcgaatccccaaggggcagtgatgtaaaaagcagacagggaaatgactttccctacctgctcctctatcttttgcacggcagtccggagattctgttctttatctcccagattagtgccgagacttatatacactttcgccattaccggtctattctaccttaaactcccgctccctgtccaaaggaacaaagaactctactttgccacatttcgggcagacgtataagtcgaatgcttcgcgattctggaataactcaaacaagtttccaaaaatgcccgtgttcattccttcatgaaactcatattttccggaataaaccatcctgacctgacaacgcagacagtcgatagaccgcccgctgtcatcactctcttccgccggagtcatatccaatatcttatcgtccggaaagctgtaattacagttccagcagatttcaaagctatcttctacttcttcgtggcatttgggacagattttcatagcggtatcttttcgtttatttatccagaatcagcatcgcatcaccgtatgtaccgaagcgataaccttccttcaacgctacatgataagcatccatcacctgttcgtaaccaccgaaagcggccacaatcatcagcagtgtagacaacggcatatggaagttggaaatcatcgaattggccacagtaaactcatacggagggaagataaacttgttggtccagccttcaaattctttcaaatgtccgtcggtgctcaccgcactttcgatagcacgcatcacagttgtacctaccgcacacacgtttttacccttatccttggcacggttgaccgtattgacagcttccgcgtttacaatcatctgctcggagtccatcttatgcttcgtcaagtcttctacgtcgatatcacggaagttgcccagaccggcatgcaaggtgatataagcgaaatcaatacctttgatttccagacgcttcatcagctcacggctaaagtgcaggctggctgtcggagcagttaccgcaccttcgttcttggcgaagatggactggaaacgttccgaatcttccggctctacaggacggttgatgatggaatggggcaggggagtctcacccagagcatagagggctttcttgaactcatcgtgcggtccgtcataaaggaaacggagcgtacggccgcgggaagtggtgttgtctattacttccgctaccatcgagtcgtcggcaccgaaatacaacttgttgccgatacggattttacgggcaggatctaccagcacatcccacagacggagttcttcgttcagctcacgcaacaggaatacttcgatacgagctcccgtcttctccttattaccatacagacgtgccgggaatacctttgtatcgttgaatataaatacgtctttatcatcaaagtagttcaaaacatccttgaacatcttgtgttcaatctctccagtacgacggtgcaacaccatcaagcgcgactcatctctatacttcgtaggatgcaaagcgattttatcctcgggtaacttaaatttgaattgtgatagcttcatatctattccttattacgttaattattatcttcgtcgttttctatttcctgccggtcgatccactctttaaagtgttcggggtccaggcaatcttccagacggacatcccccacacgtgtgcggatcagttccgtcagatgggctccgctctgaagcgcttcgccgatgtcacgggccagggcacggatatacgtccctttgctgcacaccacgcggattcggatcgtcggttccggatcgtccagacggcattcaagcaactctatctcatcaataacaagttgcttcgcctttagttccacctcttcgcctttacgtgccagctcataagcgcgcttgccgtccaccatgcaggcggaaaaggcagggggcacctgctcgatggcaccaaggaagtgcgtcagtgtttcttccaccagctcccgggtgatatgtccggtagggtaggtggcatctatttcatgttccaggtcgtacgagggagtggtagcgcccagccggagcgtggctacatattccttggtatgatactgaaattcttctattcgtttcgtagccttgccggtgcagaggatcatcactcccgtggcgagaggatcgagcgttccggcatgacctactttcagttttttcactcctatccggcggcagatatgatagcggacgtgtcctactaccttaaatgatgtccagccgagaggtttattgaaaaacagtacttctccttttttaaaattcacgttatagagttataaataacgagttgtgagtgggagtaaaatgactcacgacttacaactgcgtaataattactgccaatcccgctattgcacaatagatggcaaagtagatcagctttcctttcttcacaatattaatcatccacttgcaggcaagacaaccggctacaaaagccgccagaaagccaacaatcaatgataacgcagggatatcccccactacatcttcacctttcatcatctttacactatcaagcaacgcttccccgagaatgggagggatcaccatcagaaaagagaactgcgccagttttgccttgttatctcccaacagaagtcccgtagcaatagtagatcccgaacgggacagccccggcaacaccgcacaagcctgtgccagaccaatgataaaggcatctttcatcgaaatcttatccttttggcgtggcttataatagtacgagaatgacagcagggcagcagtcagcaacagcatgcagcctacaatcatcagtcccgaaccgaaaatagcttctacataatctttaaagaatacgcctacaataccaatcggtatcatcgaaatcacgatattgatcacataacgagtctcatcgttcatctggaacttgaataatcctttaaaaatccagtcaatctctttccacagaatcaccagcgtactacatacggtagctacatgcacgacaatcgtaaatgccagattctcttccccttgtatcccaaacaatgccgatccgatggccagatggccactgctgcttacaggcaaatactctgtcaatccctgaatcaatccgaggatcattgcttccaaccaactcataatttctttttattattcttttgttttaggtttacgcaacactgcgtatatcatcgatataaagccaaacaggcaaacaacaggtgctaccttgattctgcgtacactgaaaatatccggttcgaaaaccgtttcggacgacgtaggtcccgtcatcaatagaaatccgataatgacaatcgccatccctatcgcgagcaagataaagttcactttatcgaaggcaaatttctgtttgtcagacataagcttattttgttacaagttactaaatttccaactatatgttattctcctaaatataatataaggtattggctttcatcctcagatatttattcatcgagatgtaggcacacaaccacgttatcacaattccgaataccagcacgctgccgcagacaatgagcatcacttcgggggtgatgacctgaatcagctcctgctcgtacgtcaccgcccagtaggcagttcccatcagaatggcatcggcaagcatacctgccaatacgccgctccacacgtttttccgcaggaaaggtccgcggataaaactccagctggcccccaccagcttcatggtatgaatgaggaatcgcttagagtagatggcaagccgtatcgtattgttaatcagtgcaaaggatataaaggtgagcaccaccgccagcgccagcagcacaaggctgatgttccgtatattctcattgacggcatcgatcagctctttccggtagagcacatcctgtatgttagagttcttcttgatcattttctctatcttcgcgatactgtcggaattggcgtaatcggagtgaagcttgatttcaagggaggccgtgaaagggttatagccaagaaactcttcgggatcggtgcccatcgcctccgtctgctctttcagagcctgttttttggagatgtactcggactgtttcacaaaaggttcctgattcagtttcttctggagtttcagaatatccgcctccttcatgtcatcactgatgagaacggagaagctgatattttcgcggacgtatacagacatattgtgcgccgtgagcacaaagaacacaaccagccccaacagcaacaacaccaatgtcgtactgatactggacgttatgaattgcatatcgaacagtgacttcgacttatatctgtttttatttcccatgcgctatctttttttccggaatacgtaaatcatcgaactgctccgttctttccgccccaacgtgctgaaccacgcaagcgtccccgcatacatccctttgaggaaactgcacgaactgccgcgatgtttctcgctcaacatcgatacatagaacgcatcaaacggcatcggatgacgagccgccataatgaatccatgacgggaagccagctgctgaatagtgacgggagtgaaatgccagagatggcgggggacatcgtatgccgcccaatattcaccgtaacgtcctgcatcataggaagagcagttgggcactgccacaatgagcatccctttctctgtcagcagttcacgaagcatttcccatgtttcattgaggtgttccagatgctccatcacgtgccaaagggtgatcacatcaaagctaccgggagcaaactctttcaaagccgattcgggttttacgtccagatcgaaatgctcctttgcaaaagcacgtgcctgcggacttttctccactgcttccaccttccatccacggcgtgccatggtgtcggcgaagtatccggttcccgtcccgatatcgagcaaacgccctcttttacggtgtgcttcccttgctaccaggcgcgctttgcgacccagcatataggaacgtacataatggtagatggtattcatcgcgcctttgcgcgtatcagtgtgggaaatgtaatcgggagtctcgtaatacttgcctatctctgcttctaccggcacaccttgcgtgaacgtaaatccgcagtcttcacacgaacacagttcaaactgttcgcccgaagcataaaaatccgtacaagtcatgacgcgtttcaagtgcgtactgccacacaccggacaagcatttataatgagtttctccattaatttctaagcaaaattaagtgctgcctcgattcacaagacaacactattcccgaatttggtgcaaagaaacaaataaaaagtgatggattgggctttcgttaagtacttttaataatataacgttactctgacatttatttcaaagtgtatctcaaaacaggagatgaaattaaatgtgaatcaactttcctcaatcagaacagtgatttctcagtgcatgaagaatggataggaatcatctcgtagaatcagaaatatacaacacaagtacggactgaactggaaaaacggaaggattcgcgattggcatatttccaaattacacagatttcactttatagcgatcaataaaacacagataagatcaaaaacataaattccgaatatgtatttcatcatttaactttcaatctaacattttcaaactcttctgtaactgacgacatccggagcaaaacaagcactcaaagtacctttttacccgttcctttaaatgaaacgaagtgcttctcaccgaccaacgagtcgttcctttaaaaccaacgaagcttttctttaaatgaaacgtctcctaacattggtagttatcatgcatatttcacctatttatatccaaaagcaagatcattcctgcatattcttgcagctttttatgcagtatttcttctatcaggataagtctgaacatcccctttttaaaagtaatcttcaaaatagaacatataatttgtgagggtattcatgcgggaacgtatcttctaatttaataggctaccacaagctatgatatcaattacagcggattttttctccaccattaaaatatctcaaatgaaaattctagttaatttcagtgtcataacctatttgtgtaaaagctgatttatctaattacttatctttgatgtatacccatattcgtggatcttgtccatgatagccatcaggcatatcatctggatatgaaatacctaatattctactaactctcttttcactcagcgcttttttcccttccaaataaaaaagaatatatttatctttgtaattcatagcattggtaggtaaaatttaccccctgacaggcaactgccaggggaatagtcaatactattgatacgtatatcaaagaaataatcacttttctcataatcaccaaaatgaaaaatttactttatttcaacccatcctctacttcaatgaataaattaagtgattcatctatttcaagatccacaaccttttgactctcgaaaagtcaaattgttcgtgccatcaaaccatgacagctgtaatatcatcttctgatgtagcaattcattttccatctttctgaacttcccaatagcaatatgtcattatacgattcccactatcaaattccataagaataattgagtaattacctccatcagaactactatatacgatgttacaacctatattcttttttaattcagtattaaaattcatattatctaaataaatcaattttcacatagctcctcgaataaaaggtaccccaacatgagtatatatatcgtttcatgtcagggtaacacttattaatgcaagaggccaatctatatcaaaatatctataattatttcatatttataatcttccttatttggaatactacaaaccagataataataataatcgtaaataaatgaggtataagttctgtaccataataccaataatcatcttgcatatctgagacatttttaaccatagtcccaaaaacaaaattaattaattgaaaaaataatgcacctaaacttagtagcactgcaactactctgaaaataattttcaatatgttattgtccataatttatttgtatatttggattttgtattaaccatgaatctaagattggcataagttgattccaagttataccattgttagcattccaaaaacttccactatcaatccaatctctatgcctatattgatacccttcattgcttttctttcttattttataattcgcattaggaatatctctgctaccatctattggaagacttaatccttgtacccaatcattagtaatcgtagcatcaatcaaaaatgttccaaccgagcccatcaattcagaaggcaaccatgtatttagatgaattgagaaatcaacattccaaccttgctcttttaaatatcgaataataccttctgaaaaagcacctcccatactatgagaaataattcggaatacatcctcttgtggattcatacccattatcaattgtttgtaattttctttagcatatgcatatccatctaaatttcttaaaaaggtagaactacgcaaatagttaaaatcaaagtcggtgaaataggcactttgatcattaaaaaagttttttgcacctttaacaaaagaactatttactcctccccaataagtgccacctcctctaggagatccaaaccctaaatacccattaacaaaaataatcttctgcccatcggggtcaatacaattatgtggtgtatttaatccatatacatacgaactaattgaataatacttctcactcatcggatcaaccgcatgccatctaccaagcgctgcatcatacatacgcgccccataatcataccaatcaagaccattcttcctatcaagttctttaccgttatacttacgaatgtttatctactaatgtactctctgcaaatgacacctcataaggataatagtgattagtccggacaactgttccatcaaactttgctaccacacggctattaccctgatgatcctgaagataaaaagaatactgcccatcttcaatatagccaacttcatttaaactgctgtaattctaatcccacttaaaaaaacgtcgtattctctcttctttatcataaacccctttattataaatataccttaccctttttgataaagaatctcttaagtcactcgaataaactgcatcattatgcattattctaaatttctgtgggatattattaatattcaagaagcaaaaagtcgaatcgctaaacagcttatacatagacatccaaatatccttatccggtaaattctgaagaaatgaatggggaggttcactatcatatttcaaggatttaaaatcatgaggggcaatagcaactggaagtgaatccctcaaaaccaattttaatgtatccggtccatttattacagcatagcacatactcctcgctgaattcctcgataatagcaaaacggaatcagtctgatttcttacaaatatttctcctgagaatctttctacataattcttcagactatcaatctcaagttcaaaaaggtccggaatatatgaactgggaacaataatatcgtgcgaagtcaatcccatcaatgcagttttctcctggggtatatctccagaaaaatacgaccaaagttccggatattcaaatagacgataataattaggcaacatctttactaagatatgtttatcttcatattttcgaagagccaacagccaatcacgacctctgtttaaacataaattttcatgaaagttagagtccgaaacaaaacctctctcaaacaattctgtgcgtgacatttcaggctcatctaattcgataaagcaaagatatctttctttatactttatcactctggaaggtaactcagcaccatcagaaccaggagaatctgattcaccgatataataaagtgaattagaatctgtcgaaaacacttcatctatttctatatatgtcgtaagtaaatagccactatctatcagcacttccacctgttttgctacacgctgatgaatatcttccaaagaaggggaggggggtatgcatccccccagtataattaatagaacaacatagactaattttctcataagcatatcatttacgttttatatattgcaataaatctgtagcatcatatacacgaatagaatttacccgacttgcatttttggtatattcatatatcatatcctttttatcagtactcacacggttatctttcatatacacagcattcttacgttgtggcttagctaagttaaaatcattaccagctccacctttcgttcctccgggcaaatgagaatgaatatctataactttttctcctttcacagaaagtttattttgagcatatacaccattatctaccccatatggatctcgatctgtcgcaacaacagctgttcttgtaccattatcatcataaacatctaacttccattcaacagttgtgtgatcagcagcaaatttaaaaacagtagcagctgtctccaaatcttgagtacttccataagatttcttcacccgattttccttctgctctttcgcctgcatactatgcatttccccaagtaacccctgatttacagttactgaaatagaacgatcactggaaagatataaattatctgttgagcctttacctctcttatcaataggagtctcattaaataatcttcctgatctgctgataacataatcatcctttccgtctaagtctatcctcaacacaggattgttcttacaataagtatacggactccaactataatacttctcactcatcggatcaaccgcatgccatctaccaagcgctgcatcatacatacacgccccataatcataccaatcaagaccattcttcctatccagctccttaccgttatactaataaggctgcacagcattacttaccgaacttgatagcagaccgccaaacggataataatggttcacttcttcaacattaccactctggtctacaaccacacggttattacccaaatgatcctggacaaaatagtgatacttagaatcggccagtgtaacatagccagcttctgtaagcaacttgacagggattccattttcatagatcacattgccgcaataatcagttactgtagtatcactccctatgatatgcgtcgtacgaagttttattccatcagcatcataaagataagaaatgacatgaccgttttcaaattctatgcgactcggtaaatttataaaattatattggatatcagccaacttttcactcaaataatatcacacagaaatgtacacaaacaaaatagaggatgtgataacacatcctctaaatattttcataaatttcaaatagacaactattatcagaataaatacactatcactattttgatttaggtagatattcatctatttcatctggatggtcacgtaagtattcttttataaaagacggtaaccattcataaggggtaagagaatcatataatacttcctgaataaacttttgaagttgctttggatttcccttcatcaacacgtcatttaaaagcactccgtaaccaccggcaccaatgcagacttttatatcaggcctcctttcaccgtttatcggttttaatcttataagtgaacttaccctaagatcgatataagaatcgggattggcaggtttcaactgattaaccagagtcaaaaagcgattgataatcttcctatcacgaataattgttttatggctatcatttccaaatacaatgtgcaaacaatcggtgataggaacatctgtatccacatctcctataaaccaaaaatttacattttccacttcgttactatcaattaaaaattgattgcttttacatgatgttataaacagtaatagcaaaaacaatgaaccaccataaaaacattttttatggttcagaagtccatacagctttattccttttctcatattcctgtgttttttgtctatcaatcacatttgaagtaacgcctttcgttattacagttttcccattatggtttcttcttgtaacttgaccggaacgggtttctccattagcccttgaggttttctgttcagaaccagttatcacccgcctttcttcttttgtctgatattgcgaatcgctacctcgtgctctatttacttcatactcttgagtatttgttttatgttccaaagcatgatctgcttcatggtcaaatacggtagccggagaattgactattccattatctttttgcgatccccagttactcttccaataaatacttccagccccacgtgcggcattgggattatatgagttctcaaacaccgcttccatcacatttacctttatattggtattctctacaattgctaccgtagaggctccacctccgtttcctgccttcaatccattcgctttattatattgataagcagtaattacagattgtacaaatgaatttggatgagttatgtcaccaccactatatgaatatgaaacctttttcccagcatcattattataccaaataactactgtatttccgtccgggtcaatatgatttatcggattacccatacaataagtatacggactccaactataatacttctcactcatcggatcaaccgcatgccatctacccaatgcagcatcatacatacgcgccccataatcataccaatcaagaccattcttcctatccagctccttaccgttatacttataaggctgcacagcattacttaccgaacttgatagcagaccgccaaacggataataatggttcacttcttcaacattaccactctggtctacaaccacacggttattacccaaatgatcctggacaaaatagtgatacttagaatcggccagtgtaacatagccagcttctgtaagcaacttgacagggattccattttcatagatcacattgccgcaataatcagttactgtagtatcactccctatgatatgcgtcgtacgaagttttattccatcagcatcataaagataagaaatgacatgaccgttttcaaattctatacgactcggtaaatttaaacaattatattggatattcaatattttcttgttcaaatctttcgtcatattaccattttcatcatattcatattcagcttctttgtttactccgtctttgaaatcaaagccattgccgtaaacagaatttgtagccctatctgatactgattttagttggttcccattataggacattgccagatcatctatcaagccgtatccggtagatgaagtctgtccggaacgtttgatccctaaaatattactcatcttatcgtatccggttacttgttcattgaagcgattctgattttgaacgagaacactgccttctccatacaccgcattcgtcaaacgattcaaattatcataagtaaagtggtagcctctcattatatcatcttcacccgatttccaaaccatactgctgatattaccattgtaatatggaatacccgttccgtccgtataatgcaatacttgctcaaaagatgaaccagtgataccagttagccaactacgaatattatacgaataagacgtattcaacagaccgttatggaacgtcttccgggataagcgtcccaaatcatcatacacattgtcaataagaatcacttcctgagcatctcccaaacgatgcagcgcctttacaagacgttcggcgtgatcatactcataggtataactgtcactcaaaatctcatttccagccccggtctgacggtgtaaatgccgcaaggcgttcccattaaaatcataggaaaagaaatcacggtccataccacctaaatggttgtcagaaacagtttgagaaaggcgaccacgatcatcataatacatcactgagtaattgtagggagaatccactccatattcaccattacgatactgatcgtatgcatccgtatgcaacttagctattcctgtcaacattcctttagcaccggatgacgtagcggcaaaaccttcttcatgggtatatctaaattcatctcttgccgaaagatctgtccgatacataaagtcatagttatcataataattgattacctgaactaatggtttcggccccactaatcctgccataagacttccactaaactgataccccccatattcagtacttcctacgtattgacaaacataccaattcgacaatccactaaaaataggttttaaataaggattatcaaacggatcaatcgcaactttacatactccctgcaagcatacacgaccgaatgcatccggaatactaaatttccattctcctcttttacgttcctcgccattctggctaaatataagattgttgtttacattatagacatagtattcccatgaaattcctggaagctttttagccatgaggtttcccgccacatcatatttatacaaatatccatacatatcgagtttttctgcaggaatattacctacactcaactgatcggacaatgcaggaggaagaacagcacaaagttttcccaaatcatcataaatatagtaagtatccgacaattgcttatcccctttcagtcttgattctatacgacgttccagaacggttctttccaaacggtctttaaattcaaacaaagtgactccatcttcatcctctgagcgtgtaacaagcaagcttccattttcatactgtttacttacactaatatttaatgcttctcttgccccattgatcaattgaaaaccgaaacaacctaaagtatcattaccagcgatattaacgtactcatctattttcaatgatctgccattttcacgccatactctccccggattatgctgtttaattactttttccaaaggagaattttcgtaggtaaaggttaaatacggataagcatctcctccataagtattgcgtgccaattctccacaagaagctacagatatgaaatcacctgtgttttgtgtcgttacagctggcaaccatgtattggctttacgcccccacccatcatattcttgtagggttactaaatctttatgactaggactcacaccttgttgtaccgtttctttcgaacgccccagcccatcatagtaattaaccacaagcataccttcttccttatttcctgtcctactcttgaaaacagaaacagcatttttgccaaaacgttcgggcaatagatcatttccccaatttattgcaggaaaaggaatagccggcatcggctgttcttccggagcaagtccttttgtctctattgacagagtcatgatataaaataaaggaagtggtcgaattgagtccatcggcaagaccggatctattggcggaaaaggatcaatcggcggaaaaggctttattggttcatgcgggtcgatcggtttaatatcaaaagtattagttttcaatacacttgcagcattcacaccattatcatcaggaacaagaatatctttgttcttttctattacagtcgatgtcaaacaatatgtaccggcaaataacaaaagagtatcagtgaaactcactgatgataaagaatccggatcaacacttttcgcattctgataatacacctgattagtgagcaaattatcatctgttatttttaattgacattccaattgtcccggaactttctccatttccattcccatagtgaaataattagacttaaaagaaatatataatggttctttcacacgaaacaagtagtttgcgcaactcactgacgatgtatcagaaatgtttatatggtccagatgttttgttttaaccatatccctcttcaacgtgtcatattcgagcttacctatctcattctgcaaagaattctgcgcaggtatttctatcgaaaatcctgatagcaaaattagaagtaatattattttatgcaatttcatagttgtcctcctttctctatggctacttctccactttcaatcttggagccataataataattgtaatcatatatatttaatatccgtttttgataatctccatctttaaattccataatataattctctgtcaggcgacccagaaaatcatatttataaaacacagtgattccattaggctttgtttctgagcccaaacgcaactcatttgtatatttgtaaatatagaaatgcgttccggatatcttatgcctgatattttctatttttagcaaattagttgcagagatatcggatgaagagaaatccttcacattcattcccaatgcttcttccacttgattaagagtggcattttctatccgtgatattaaccgttgaccttcagctccccatatcaatacaacgggcgttgactcttcgtgaagatatataggattcccataaccatccacagcctgcacagtgtaatgtttatgcacataaccatctctatctgtactaatctgctttatataaggtataggacccatatactgatatacctcttttaaataagagccgcctgtctgttcttttttactagaaaccggagatagtatatgtgcttcttccatccatttatattccggtaaagttgcagcataaacatattctgtcagagtactttttccatcgctgtttctaccggctatttggcttaactgcttatacttattatattgatacgccttttctataacaaatgccgtatttcccgattgaggataaagagtttctataacagagtcggtcagataagcatgtgtatatgtacgagttaaagtccccacttttcctagcatgaaattgtctaaatctgtacaaaagaacaacaccatttgatcagctgttacaaatgagcctggagttacctctttgtatcggtaattcaccttctttcgcaaacgatcattgacatcatagtattcttcagacaacaactttcctctctccatagaacgactgctaaatggcattgtataagagttcccttcaaacatagaataaaaagcaagctcgtcataatgagtattaccataaatatcctcattatagttagagtaatgacgcacaatataaccttgcgacttattatctttgtcgaacgcttcttcaattacacaagaataacctacatccggtgtattcagattagtaactgatgggaaaaaacctccctttgatttgagatataacgatattgcattcttaggatcaggctccttatctccatccttaagagtatacaccatctcattaacaggaagacttttcaatattccactactttttccaaatcggtcacgggtattcgaatagtaatattgcttggcaccaagcacattatcttcattatccagattggtaatacgccgaatacgcaaaccgcctgcagtaccacttttgtctgttaatgacatcaaagaaggagctaccacttttgaatagttgttcaattcatattcaaaacggctttttccacctgttggataaatgacttccgtcaagacctctgccaaagtatattgcaaactactataagtctgagaaaaattaggtatctcggcaaaagcaacacttcctcctgtataatatccccacgaatcggcaatcgggcgtacataatcatttggcatacgtttttccgaattataaagaaaacgatattcaggtacgcgacctccggtcaaattctcaggtatattataccaagtaagaaaataaaatccatgtgggtgccatacatagttagggatcaaatccggattccctgaacgttccgtaattaaagacaatttagtacgattattccttgcatagtcaaaatatatagttttcaaagccttggagttctttcctttcacataaatacaatgaagaattttatgttgtagttttgatttaatcgattgacgcaatgttgcctgatcggtattatcaatttggtttcctaaaaacagagtaaattgattagccgggtcttcaaaattcatgttatctatatcctgacggtcataatttgcattgtctttccatgccaaataactatcaacaaacttatctccatatccgtattcattgtaataattgaattccaatatctcgttaggtgtttttatagtctttaaattaactgggaaaagcagatacccagtcatccctgaacgcccactttgtataccactataagtgcatggtatgttggtcaccactttctgttggggtacataacgaagatcacacatgatagctgaagtgtcataactgaattctattacccgcttgtctacggttgttattttggacaacctccaggtagtagctattaaatcactgttatagcgggcataataaggaatactatattcagtagcgttgattccaccaaattcatacctgcatccatcaggagtaatcagcgtaaatttattgaaaaaacgattgtttcttgtgcttgctccccatctacttacatcaagacgttttccgacttccgacaaactaagaaagccttccccatcaacaggattaaattccacacgtatatcctgatcagaaacaacattccactctccattaccggcatagtagaaatttccagaataaccacaaacactaaacgaaaattcgtcagcagttaattcataataatcattttccgtgctttgtatatgcatcgtttctgctttaaactgttcattactgatatttttcaatttagaagcatgtgcataataacccggagcatatccatttgattgacatttctcatcatacattccacgaacagaacgtgtaatatagccgcctgctataagattccatccaagtccaagacaaccagactgggaattaggctttaccgaagccaaatgataacttgcagcaagtgataacgaatagttaccagctttcaattcataaataggcacggatatatccggaactcccgtatataaactaactggaacttttccatattctcccaaaccggctatttccggactgggtacatttttaataggtatttgttgctgacctatacagttgaaactgaatattgccagaaaaacaaatactgatagtagtctttttttcatattctttgatatataatagtttcttaaataaaatcacaatactaagaaactccctgcccgataaagtagcgcgcatattcccatgacagggagttcccgttaattacttctcttacagattcatcgcattagcacccaatacgcctgccacagccgacgctaccgcgataaccaccttcaggatcatatcccatacagatctcttcattgccatcatttacctcctttcttgttctgtaaatagtttagtttactctgtgtttcttccgtgtcttctgccgcaaattctttaaattcctgctcggcatcaaagcacggacacgccttcatccactcttccggttctatctctccattaccgttcctgtccggcgagagatcccgatgcccgcacacccggcagctggggaatacctccagcagctgatgaatcagcagccgaagcgtagcacgctgttccggtgtccgggtgtctgccgggcgtccccgacagtccagaccgccttcatagcagattccgatactgctggcattaaaaccttttgcgtgtgcaccgatgcgttcgacagggcgggtaagatgcaccgttccgtctttgcggatgtagtagtgatagcctgttccgttgaaaccacggcggcggtgcatcaggtccaaagcctccggagaaagcgtacgattcccctgcgtggcggtacaatgcaccacgatcaaattgataattctcatgtgaataagtgattactagttagttaagtttccgatttagtttagtcgttcgttcttatattttgtgttgtgacgaaaggttatactgtcgggtccggtgcttcctcaccacctccttcgccaccatcgccgccacccggcttatttgtatttccactgccggaagccggagtgtctgtacggtcgaagcgcacacacttcgcaccggtcaccaaagagcgggtagcggtagtccgatcggggttcttggtgaagttgggaaggaaacggaccgtaagagaagcttgcgcagccgacacttcttccgaagtctccacccctttaccgttggatttcatcaccatgcggaaagtcccgaaaccgtcaagcgacacgctttccgatgcttgtagatgctgccccatcacagtcaccaggttatcaagcgtattcttcacatcacccggggagagagacgagtaagcggcaatctctttagcaatctgcgaagtgctgatattagccgtgtatatcacacggggatgaaacatttttttgtgatttttgtcttccagaacagactggaatgacttgtacaatactgccataatcgtaatagtttttttgtgttaataatttcgtttagttttgtcctcaagcttaatgacattgcaaagataggagcattattcagactgacctaatcattttttcaaagtgcgttcataaattaattaattatactcagcaggtagtgcccgggcaatctgatctttccattgctcccccggatggtattaaatcctttccaaacagggtttccaatagctccgaagttacttttaagaataatggcatattgttcggaaggcggaactttgtaaagccgcaggttatctgtcagtccctggaagttacgctgcacaccatcgcatggcggttgcagacagtcaatatcttcctgtgtcacagccgttctacttttcaaatattttcctccttcatctcctccttgaggagggttagggaggtggtttactttgttttgatttatttttatttgttttcttttgttttgtgtacccgatgttgcaatttcatcctccattgttacagaatcgaagcttgatgttaccgtacaggcggtcttgtgatcagcatcaccgtttaacgcttccgcacattcgctatccaaagaatcatccgtactacttttaccgctctgagacgaacggtatgaggtgatttcttccgattccagcaggcagtagtccggctctatcagcgcactgctacgccgcttggtgatgaaaagatactgccgctggatgtcggcggaagtcaggatgttgtattgccggaaaagtccggcatcaaacaagccatattccacggacagactgatgatacgcttcacatcatccagttccgtactgtaaaggctgtccacaagctcctcgtaaaattcgtcaccgacagagatataataccctttcccggcatagatgtacgacagcgtttccaccagtgtggcaaaggcagaatcaccttcacgtctcataattcggcgcaccatccgatcgtgcataaagctggtgctcatggggaaataatccagtccccgttttattcttcccatagcgtattcagtttttctttttcttgtttccgtgagatactttctgccacaacctgacgggcatgaagaataagaagcatccgcaaagcggggtctttcacctcggttatcaccggataagaaacaggtttgttttcaaatgatgtacatcgtctcaaatcacgacgcttgcgggtgtttgccttgcgacactccttgcaataattgtcaagggtcccggtgcgtttgtttgtataaaaggcctcatgcggtagctcccgtttgcagcacccgcaaatgtgcagagattgattcattaaaggttccatattgattttgcgttttaaagttttcatgcttaaatatttgtttatgtgattatcggacatatagttcctgcatattggggatatatggccagcgtattggatctatagctcctgtatgcaggatatatagatgctgtaaaccgactcaatatcactggtgttcatccgatacagaatcttccggaagggggtggatgaggcattttacaacctttcataaactttttgccgtttttcatggttattctatttttaatttatatttttgaaacatatttctaagtttgctgctacaaagataaagcagttttctcacataaaacaaacggttttagaaattaacgctaaaaaattatataactgactatcaatgaacgaataagaagttccaacatctttacactaatttaaaacaagaataaaatggatacatttctagatgtttcgggaatagtaaagcgcgccaagcaggcgctcaactttaaaaaggacagtgaactggccagttacttaggtgtttcacgtgcaacattatccaactggtgcgccagaaaccggattgactttcatctgctgctcaacaaaatgagagatgtagacctcaattggctgctggttgggaagggtacccccagacatcaaaccaagttatgcaaaagcgatttagcaagcggtgaggtccagatgattcacaaccctaaaacagtagaggcgttggacgaccgcagcgttgccctatatgatattacagctgccgccaatctgaaaacgttgctcaccaacaagcgacagtatatggtaggaaagatacagattccaagcattcccttatgtgacggagccgtctacatcagtggcgacagcatgtatccgatactgaaatcgggagacatcgtaggctttaaagagattaacagtttcagcaaccttatttacggcgaaatgtatctggtttcgtttactatcgaaggagacgagtacctggcggtgaagtatgtgaaccgctcggaaaaggaaggatgcctcaagctggtaagctacaacgctcatcacgacccaatggatatccctttcagcaccatcaatgcaatggcaatcgtgaaattctccatccgcagacacatgatgatgtaatttgaatgacgcttcttttgctccggaaagaggaaaagggcaaagtttaaacgaagtgaaccccgaaagtttattgtctgactttcggggttcatttcattttgaaataccttctttaatatattgcatgggctgactaaaaagtcggcagtatctcaaatctcctccttcgggaaggaggggaatttatgatactatcgatttttaatcagtcccgacatcgagaataatatactagacttcttcgcctttcagcgtagccgaactggcttccgtcacccgcacattgacaaaatcgccgatacggtgcgtgcctctgtcgaacaccaccacccgattctgctccgtgcggccgaacaactgatcgcgcgaacgtttggaaacgccttctacaagcacttcatacgtcttgccgatgcaacgttgattggactccgcggacagacggttctgcaaagcgataatctcattcagacggcgaactttcacgtcttcgggcacattatcttcaagatgcttcgacgcatacgtccccggacgttcggaatatttgaacataaaagcggcatcatagccacattcctccatcagagaaagcgagagctgatggtcctcttccgtttcggaatggaaaccggagaagatatcggtagtcagtccgcaatcgggaatgatacgcttgatagcggctacccggtccagataccactcacgggtatatttgcggttcatcagtttcaagatgcgggagctgccgctctgcacagggaggtggatatgcttgcacacattcggcacttgggcgatcacttccagcgtttcatcgctcatatccttcggatgggaagtcgtgaaacggatgcgcacgcccggagcagcttcggccaccatacggagcagcatcgggaaggtaaccacttcgcccgtcggcttctcgaaccggtaagagttgacattctgccccagcagggtaacttccttataacctttggcaacaaggtcggccacttcattcagaatactttccacatcacggctgcgttcgcgtccgcgtgtataaggcacgatacagtaggtgcagaagttattgcatccgcgcatgatggatacaaatccggaaatgtggttgccgcagatacgcgacggaatcacatcacggtaagtctcggtcgtcgaaaggtctacgttgatcgctttctcgccggcctctaccgcggcaatcagctcaggcaacgtcaggtaagcatccggaccgaccaccagatcgacatgatggttcgtaatcagatcatccttcacccgttccgccatacagcccagtacgcctacaatcagggccttcttctttttcttcagcgagtggaaaaactccaggcggttcagaatcttctgctccgcattgtcacggatagagcaggtattcataaacactgcgtcggcctcttccagcgtttcggctaccgaatagcccgccatctgcatcaccgaagcgatcacctcactgtccgccacgttcatctggcagccataagtctcgataaacaacttcttgttgtcatcagcagttgcggatttaaagtccgctcccgttaattcgttcatattcaaatcttgttttaaatttatccgcaaagatacggcttcgaattcaataagcggtaaaatggtacgaaaataacgcaaaaacttgtagttcaggcattattctgataattaatgttaatgaaataaacatttacggggcatatccttgctaaatttaattttatttttcacatttgtgcaatgaaagaaacattagattttttcatagttaaggtttaggttaaaaaaattaaggggagctgtgaagctgcccttttttcataacaaaatgttagctcaaaccagatataatgtgtaactttggcagattaactatttagaagtgaaacagaatggaagattttttgaaatttctcctgatagcaggtgtcattcttgtgggaatattcaaagaggtgagcaagaacaacaagtcgaaaaaggctcagaataaacgccccgtcccgcctgcaccgtctccggtcgaagtagatcctgatgctattcccatacccgaattctgggggagaggcagcagggctttggacgaactgctccagcccatacctatggaacaaccggctcccaaaccaacgccaaagaaaaagaaaaaagaagaagtatctgtggctgcatccatagcaaacagttccgcacaagataaacgaaacacgaagcaaggttcccactatgaccatccggaacccgccggcgaggaagatttctccatccattccgtagaagaagcccgccgcgctattatctggggagaaatcctgcagcgaaagtattaagtgataagtattaaccaacaaatatcaaccgcatttaacgcgaaattatactatttatgtcattcaatcgtatttcggcagcagaagctgcaagcctgatcaaacatggctacaacatcggtctgagcggatttactcccgccggaactgcaaaggctgttacagctgaacttgcaaaaattgcagaagcggaacatgccaaaggtaatccatttcaagtaggaatttttacaggtgcttctaccggagaatcttgtgacggcgttatgtctcgcgcaaaggccatccgctaccgcgccccttataccaccaactccgacttccgcaaagccgtgaataacggtgaaattgcctacaacgacatccatctgtcgcaaatggcacaggaagtgcgctatggcttcatgggcaaagtgaacgtagccatcatcgaagcctgcgaagtgactccggacggaaagatttatctgactgctgccggtggtatttctccgactatctgccgcctggcggaccagatcatcgttgagttgaacgccgcacacagcaaatcctgcatgggtctgcacgacgtgtacgaaccgctcgacccgccttaccgccgcgaaatccccatctacaagccgagtgaccgcatcggattgccttatattcaggtagacccgaaaaagatcgtaggcgtagtagaaaccaactggccggacgaagcacgctcatttgccgatgccgatccgttgactgacaaaatcggtcagaacgttgccgacttcctcgctgccgacatgaagcgtggcatcattccgtctactttccttccgctgcagtcgggcgtaggaaatatcgctaacgctgtgctcggtgcactgggacgtgacaagacgattcccgcattcgaaatgtacacagaggttatccagaactccgtcatcggattgatccgtgaaggacgcatcaaattcggtagcgcctgctcactgactgttaccaacgactgtctggaaggtatttacaacgatatggatttcttccgcgacaagctggttctccgcccgtcggaaatctcaaacaatccggaagtggttcgccgactgggtattatctctatcaatacagctatcgaagtggacttgtacggtaacgtaaactctactcatatcggtggaacgaagatgatgaacggtatcggtggctcgggagacttcacccgcaatgcttatatctctatcttcacttgtccgtctgttgccaaagaaggtaagatcagtgctatcgtcccgatggtttctcacctcgaccacagcgaacactccgtgaatatcattatcaccgagcaaggtgtagccgacctgcgtggcaagagcccgaaggaacgtgcacaagccatcatcgaaaactgtgcacatcccgactataaacagcttctctgggattatctcaaactggccggtggcagggcgcagactccacacgctatccaggccgcactcggtatgcacgccgaactggccaagagcggggatatgaagaatacgaattgggcggagtatgccagataaggcatgaaacgtctgtcgttcatactatcattcatcgtttgtatttgcgttgcaaatacaaacgatgttttttcgcaaaaaagggaactgcaacagttcaagggcaaggtgaccaatttgcagggagagcctgtgcgtgctgtaagcatctatattccgggaaccggcagatatacttcctcggacatgaatggagacttttctgtagaggccaaacataaagagacactccgtttctcacatataggtatgaaagatgtgctgatacaattggataaagattttccatcggaacttcttgtgcgaatgaagccggatacttttcaaattaataatatatttattcagaaaaagcaaatcatcaaggttaagcccgaagatatgcctgagcaaacgatgattaattttataatcaacggtcccgacttcccgggaggattaagcgggttcgatgaatttatcaagaaaaacatacaatacccggaagaagcttttcaggcaggagaagagggacaagtcaccgtagagttcaccatcgacgtaaacggatatgtcagcgatgcaaaagttaccaaaagcgtatctgccagcttggataaagaagcattacgcatcatcgaatccatgccacgatggaaatcaggtatgcaactggggcgtcctgtagcagtccgtatgtctgttcctataaactttgtcattgagcaagactaccaagtcattgattcgttacaggtaaaaacaaatacgtaagctggcatccgcaacaacaaagtgctacttacatggaactgtcgccaataaatggaacggataattaccttctgcaacagtcatcccgtttgcagcataacactcactattcgggtccggcagattttgttgctgttgcaagaactcaatagagataaaagcaggttccgctttctgcacagctttcctactctgcttaacatgttccttcgtaagtcccgtacttttggactttaccgttgaccgtgaagctaccaaaggctgagacggaacttccacctcccgatagacagtatccacccgctcgcgtacgacaatcaccgtatctgctacagcaagtctctccaaaccagcttcctgcctgtctgaagtggtcgaaatcccatagcctattatcccacccaacaaacacgcggccaccagccaccagggagaaattcctgagcgctttccacctttcacttcaaaagtttccctttcgggcggttcctgcttcgctttcatctttccgtccttctgtctctctctgagattctgtgcaaaagcagcataagcaacaggagggtgaactgatttttcctgctcatattgctctttagcagcatgaatcaactgttgcatttcctgagactcttccagtctttctaaatcatcacttttcatattcatctatttttgggggttataatctgataaagaacgctgcaatactttcaaagtataatataagcgagactttaccgtaccttccggacaacacaggatttgcgcaatctcctgtaccggaagctcttcttcataacgcagcgtatatgctgcccgttgttcatctgtcaaccctgcaagtactttcttcaactgccggtcgaaaacctgacgatcatgtgccacctcaaactcaagcgaggaatagctatcttcttcattggtatatgactgttgtaaacgatactcgtctactatatcacgatggcggtactcatttttgcaaagattatacgccatcgcaaacgcccatgtagagaactgttttccatgctgataactacctcttgcctcataaacacgaagaaacaactcttgcagaaaatcatccgccaacgctccgtctgccgacagcatccgcataaagaaacctttaaaccggggagcataacggcagtaaagctcttcgaatgctttctcactgttcctgaatgcaaagcgttccattagctgttcgtctgtttcgtcgtggctgaaagaagtgaatagcatcatggctctaccatttctattaattgttgatattctttccggtgctcttccttaaatgaacgaactataacagaagttagtccttttttttccatatctcttacatgatcaaaaattctattaaacaacttcaaatgttcggcagtctttgcatctacccaagacttatttacaaaacacccatcatccatacgatccacaatatctaataacaacttcttcagcctcaaatattgattcttgtctccacttgtacgatagaattgtaaaaggggaagaaaagaaagaacataggaatcttcaccacgtgaaatatccgtaataataggggactgtaaataatcaagcaaataaacctgttcataatttcttcttaaaatagccatattatcatatggttttaaggaatatctgaataccaatccttcagagtagaggaagtctttcatttccactacgtcttgtctacttgcagaatattgagaaatatatacaggacgctgctctttctccgcaaaataccatgcaccgggacattttacctttccccggtcgggaagggtatttacatctattccttttgtcttccaaaagtcgctctcttcctccggattcatcaactcacttaaatctactacttccacatccttgaacaaccctgctccatactgaagcaatacgctgtaggcccattcgggaccggttcccgcaagaatagcattccttttcagccctacaaattcattataataataagtcaggatacttcgtgaatataatccgctgtcaaaccattcgcgtgctatttccctcaccttatctatctgtccatgccgttgataataccacatatcatctctgtaatccctttcacaatcccgtctcaaataaacaatcttctccttgattgcctctcttttgtccttgtcagaaatcataacctcatcatccaatactttataatacacccgtgtatcaggaatgtactttttcattttcttaagtaaacgaggctgttctttcttccatagcaatgtgtcttcatcccaaattcctttgcacgcaagatagtaattctcccacgctttttcatttctcacatctttatcgatttctaacttccatgcatctttttgaacttgaaaccattcttttccacaaggaataaagcctaccaaatcgggttccaaacgtagctcaagacgttcagttctcaaggtatctattttctgggcaaacaaagcctgctcaaaacctatcaagaggaataatatatatataagtcttttcatagtctttatgagaagaacgattagaaattaatacttttaagataccgttcacgtacttcctcattgtaataatccgctttcttaatgatagattccaataaagcatgaagcttatcataatgagtcacatcacctgattccttataaaactggagaagggacttgaaagccggtacataatatatgctaagcatttttactcctttcaaatcaagacaaacattcgtcaacgtctcaggataaaaagactcgtataagtaatctaacagataagtattctcataattgcgacgcatgatagccagattatcataaggtttggcagaatatctcattaacagaccttcagtatataaatggtctttcagcagatctttcacagcttcattggttgagacagagatataaatgggacggttggtatatttggcaatatgctctatacgttttttgatttcatttgcaaatgttgccgtaggagttttacttttataaaattcagggtcagtatctttgaactccggtatgcctaattcctccgtaagcctgttcatagaaaatgaaggaaggattaaacctgaaaggattacttttttatcatcaaacaatccctttccatattgaagcagataacttccaaacagcgtccaattaacatcagtaaatatcaatgcgtccttttcggcagaagtcaattcattataggtataatttaaagactgaacaggatatgcacctgattgataccaccgggtagaaatgtctttcagcctatccttattgctaaaagacaagcccatataaacaggataatgcatcacagcatcaggccacttatctataatttcatcaaaagtcatatcattttttccaaaaggtaaaatcatattctgtatcaaggcataagtagcagtattgggtatctcttttttcattttgtccatcatctcattgatttccttttctatatcatcgccgggagtaagcgatttgagtgtttgaatcgttcgtgcataggacatccatgctttttcatctttagggttttcatagatcttctgtttccattcccgggcctgattctgaattacaggaatctgagatgcaatagagtccgggacccagcttgccttgttttgagaataaacctgtgctgtacaatagcacaataagacaagtaacaagtatttgatagttttcattattcactcttttattaaattcaacattgcttaattagaaccgttctgacaaagcatacacgcgagcaaagcaaacgttcaaataaaagagtactttttttcagcagatatttatcatttctatcaacaaccttattcaatgctcctttcaatgtccgataatcacctcacaaaccttatcctgaaacgccctcgccttggcagccgaaagcacattctgattcataatggcaaaagccaaggtatgtccgttcttcatcttcagataaccggcaagggcattgatcgccgtaaacgaaccggtctttgcatggacatttctgaatgcgggagtattcttcattctgtttttcagcgttccgtctattccggcaacaggaagggacttatacagtttctgaaaaacatcggattgtgaataggcatatttcagaaaatcgaccaacagggcaggagacaggtaattataattagacaatccgcaaccatccgcaatcttatagtctttcggatcgtgcccgaggttacgaaccagtttcataatctcaacaatgccatcctccgccgtcacacgtttctttcctgtagcttgtgacgcaatccggcaaagcattgcttccgcattcaaattatcactttccttcatcaactgattcaagaccttctgcaccggagtctcccagcgagccatctgctctgctccatcggacggtaattcggtaaaaccgtacgattcgggaaccacgattcctttagcacggagacgttctaaaaaagcgtgcataaagaagctccctgaatcatagacatttatcaaatcctttctaaacgtaggaacattgcctgttacgatcagattattcccattggtcaaccagtctctcgataatgaatattttccggcagaaggagtacgtgtctttgtccggttcgtcagggtataataagaagacacaggcttgcaggaaacgcttgccgtatctccttgtagagagccgggaaccaccgtcacttccacagcacccttacaaaacatcaacggagacatataaggctgataagcctccggagtatcatcccatgcccatccgtgcccccaataaagggaatctttcatcgaaacatcgccatacacctgtccgttgattaccgaaaaagggaaggtgattacttcttcgatcaatgaatccatcatcaaactgtcaaattccggatcgaatccaccgacaacatacaagttgccttgcaacgtatcatgctctatcaccccgtcgtgccagacttccgtacggaaaggattgtccgcatcgggacgggagagggctgtaatagccgtgagcagcttcatggtagaagccgggcgggagagtttcgtatcacgataagtatataatgacttcttcgctgtcaggtcatacacggatatgccgacttcggatgcttcgggaagcattcttttgattagtgaatcaatctgagaaagatttgcctgcccccatacggatgtgggcaacagggcaactgataaaaccaaaaacaacaaatacttcttcatcaaccttctacattaacctacattaactttcatgctacttcagcttcttccgtatctcgaatatcacggctatccgcttatgctcaatcttataatgcttcccggaaaatctctcctaccgtaggatgagggaaaacaaccttcttccatgcggcggcagtcaatccaagctcaatggcagtaccggcaagagtgatgatttccgaagcaggattgcccagcacgtgtgctccgattatccgttcctgttcatccagcagtactttgcagaccccgttcacgccttcattctccgccacaaaacgaccggaataagccatcggaagtttcaccaccttataagtaattccttttgctgaggccgattcttccgtctctccgactcctgcaatctccggattcgtataaacaacgccggggatagcccggtaactcattgcatcttccttacccaaaatagaatgtacggcaacctcagcctcacggacagccgtatgagccaacaaagaaaagcctgtcagatcaccgcagacataaacgccggacagcgaagtctgcatcttctcattgaccttgatagcgccacgcccggttttatccagattcagattttcgagtccgaaacctttcgtcacaggtcggcgtccaacgctcatcaatagcttttctgctataacactgccctttccttctgcattctcgtatgaaacaaccgcaccctcttccgtctgtgataaagcgacaactttagtgctgagcaggaatttaatgccccgctttgcatattcggcacgaagcaatgcagacagttccttatccattcctcccaaaatctcatccatcatctcaatcaccgttacctgcacaccgagactattaaaaaatgatgcaaactccataccgatcactccaccgcctacaatggcaagggaggcaggcagctccttactgtccagcgcatcccgatgcgtccagtaattcaccgtttccacgccggtaataggagggatgaaggtttcggagcctgtacaaaggatcagattttccgcattgtatgtttcttcgccacagcgaactgtatttttatctatgatctgcgcctctcccgtcaccatcgcgacattattggaggtcaactttgcctttacacccaataccagtttgcgcaccactttacttttacgggcaatgatcttcggcaagtcaaaagagacttcggagacattcaccgcatatttcgaggaatgacgtgcactgtcgtaagtctttgccgaatacaacagcgttttcgtcgggatgcatccttcattcaggcagacacctcccaaattattcttctcgataaggagtacactcaaaccggctttgccggcagcttcggcggctgtatatcctgcgggaccgccaccgatgataatgacttggtatttcataggtataaaatttattgttccattctctttttaatcaactccacaaattcacgttccttgacaggcatcaccgaagcaaactttccgtttccatactctatcaagacataattcgtcaccgaaaactttccgaatttcatggaatgatacttccggatagctgtgatttcggcaataggaattacttttttacgcataaaacgtccagtggatatctccagaactccatcagtagatacagtgtaaaccgtatgaataatctgttcgatgactacaataagcaggagcattagtagcactgccggcaagatatatttacaccacaaagcgcccacggcatttacagtaagcaccaccagcagaaaatactggtaccaggcgatgcgggcatgaaaaattcgattcattttgtcagatttttgcgtgcaaggtagcaaatttatgaattagtgacaacgaaaagaacaacgaagtgacttattttgtagctttgcggtgagaaataaacaaaattatggtaagaaaattcgatttcctcgttatcggctccggaattgccggtatgagttttgcgctcaaagtggcgcacaaaggtaaagttgctcttatctgtaaaagcgggctggaagaagccaatacgtacttcgcacaaggaggagtggcgtccgtcaccaacctgctggtggataatttcgacaaacacattgaagacacgatgattgccggcgactggatcagtgaccgtggcgcagtagaaaaagtagtgcgcgaagcgcctgcgcaaattgaagaactgatcaaatggggcgtggacttcgacaaaaacgagaaaggcgaatttgacttgcaccgcgagggaggacactccgagttccgcattcttcaccataaagataatacgggagcagagattcaggacagcctgatcaaagccgtgcaaaggcatccgaacatcgaggtgatcgaaaaccagtttgccgttgaaatactgacccaacatcatctgggagtaactgttacccgccagacaccggacatcaaatgctacggtgcctacatcctcgacccgaaaaccggaaaagtagatacctacctcgccaaagtgactcttatggccaccggtggagtaggagctgtttataaaacgaccaccaatccgctagtcgctaccggagacggtatcgccatggtctaccgtgccaaaggtacagtgaaggatatggagtttgtgcaattccaccccaccgccctgtaccatccgggcgaccgcccttcgttcctgattacggaagcgatgcgtggctacggtggcgtactccgcacaatggacggcaaggagttcatgcaaaaatacgatccccgtctttcactcgctccgcgcgatatcgtagcccgtgctattgacaacgaaatgaaaaatcggggtgatgaccatgtttatcttgacgtcacccacaaagacccggaagagacaaagaagcactttcccaatatttacgagaaatgcctcagcttgggcatcgacatcaccaaagattacattccggtagctccggcagcccactatctttgcggcggtatccttgtagacctgaacggacagtcttctatcgaacgcctctacgcagtgggagagtgctcctgcaccggtctccacggtggtaaccgtctggcttccaactcactgatcgaagctgtcgtatatgccgacgctgccgccaagcatagcctgagagttgtagaccagtatgcctacaacgaagccatccccgaatggaacgacgagggaacccgttcaccggaagagatggtactgatcacgcaaagcatgaaggaagttaaccagattatgagtacttatgtaggtattgtccgcagcgaccttcgtctgaaacgtgcctgggaccgactggatatcatttacgaagaaactgaaagcctgttcaaacgcagcgtagcctccagagagatttgcgaattgcgtaatatggtcaacgtaggatatctgattatgcgtcaggcaatggaacgcaaagaaagccgcggattgcattatacgattgattatccacacgctaaaaaataatcatgaaaacattaactagactatttattcttttattcgttatggcaggtgtaagttcctgctatacaggtatcccattgaaacaaggcaaatcggaaaacaaccgaacttacgaagtcagctatttgttcgagcatgacggagtcaaagtctatcgatttatggatatgggaaactatgtgtactttaccacaaagggagatgtgaccagtatcaaaaatgactctacgaaagaaaggactgtaacgatctacagagatgatacagtcagataatgaaatgtcttaataaataaaagtgccgcttgcaatcatatgcaagcggcacttttattatctaataaacacctcttattattaatagttttctttcttcacctcgaaataagcctgcggatgcaaacatgccgggcaaacttcaggagcttccttaccgatttcgatataaccgcagttacggcattgccataccacttcgccttctttagcgaatacagtcatattttcgatgttgttcatgaaagccaggtatctttcttcgtggcctttctcagcgattgagatattgcggtacatagcagcaatcatcgggaaaccttcctgttctgccacatcagcgaaatgaggataatccagtgaccattcttcgtgttcgccggcagcggcagcgcgaagattttcgagtgtattaccgatcacaccagccggatagctggcagtaatttctaccataccaccttccaggaacttgaacatacgtttagcgtgttccttttcctgatcagctgtctctgtgaagattgctgaaatttgttcgtaaccttccttctttgcaacacttgcaaaataagtgtaacgcattctagcctgtgattctcctgcgaatgaagtcagcagattcttctctgtctgggttcctttaatacttttagtcataattctaatctatatttaaattggttattaccaaacgtaacttgtcgtactatttataacgcaaatataagcgatttgttcgtaataagctcccttttcttgatgaataaaaactatcgattcatagataaaacctatcaacaatcaaatagcatgttgctaaacatacttatctcgattattttgcgtaattttgcaacctctactttgcaaaagagcaaattatatataataattcacagaaatgaagttatttgaatttaaacccaaattggtttcttgtttaaagaattattcgaaagaaacgtttatggcggacctgatggcaggcgtcattgtcggcatcgtagcacttccactggccatcgccttcggtattgcttcgggagtatcgcccgagaaaggtattatcactgctattattgccggattcatcatctctctgctgggaggaagcaaagtccagatcggcggaccgacaggagctttcattgtgatcatctacggcatcatccagcaatatggcgaagccggactgattgtggcgacgcttatggcaggtgttctccttatattattaggagtgttcaagctcggagccgttatcaagtttattccgtatcccattatcgtcggtttcaccagcggtattgccgttaccatttttactacgcagattgccgatatcttcggcctgtctttcggaggtgaaaaagtaccgggagactttgtcgggaaatggatgatttatttccgtcatttcgataccgtgaattggtggaataccattgtaagtattgtcagcatcattatcattgcaatcactccccggttttctaaaaaaattcccggatcgctgattgccattattgtagtgacagtggccgtctatctgatgaagacttatggcggaatagattgcattccgaccatcggcgaccgtttcaccattaagtcagaattgccggatgccgttgtaccggctttggattgggaagctatcaaaaatctgtttccggtagctatcactattgcagtgctgggagctattgaatcactcttgtctgccaccgtagccgatggtgtgataggcgaccgtcatgattccaacacggaactaatcgcacagggtgcggcaaatatcgtagcgccattgttcggaggtatccccgctaccggagctattgcccgtacgatgacgaatatcaacaatggaggtaagacgccgattgcaggtattatccatgcgattgtccttcttctgattcttcttttcctgatgccgctggcacagtatattccgatggcttgccttgccggagtactggtcatcgtatcttataatatgagcggctggcgcgtcttcaaggctttactgaagaatccgaaatccgatgtcaccgtactgctgattactttcttcctcactgttatcttcgacttgacagttgccatcgaagtaggactgatcatcgcctgcgtactcttcatgaaacgtgtcatggaaactactgaaatctccgtcattacggatgagatcgacccgaataaagaatcggatatcgccgtcaacgaagaaaacatcatgatccctaaaggagtggaagtatatgagatcaacggcccttacttcttcggtatcgctacaaagttcgaagaaacgatggcgcagctgggagaccgtccgaatgtacgcatcatccgtatgcgtaaagttccgttcatcgactccacaggtattcataatctaactacactttgcgaaatgtcgcagaaagaaaagattaccgtcattctttccggagtcaatgagaaagtatataaggtactggagaaatccggattctatgaattgctgggaaaagaaaatatctgcccgaacttcaagatagcgctggatagagcggaagaagtcatgaaataaagagattccaacataaagaaagagccattttatctcctgcttttcgggattaaaatggctctttttattttaagagaggagagattaccgctccactaaacttttaaaaacaagccacgtttatacatcattctcaacaggaagaaaagaataagataattagcaaaagtaagccatacgggataataatctccgatgtattgtttcaacccgtaactgaccgaatcagcaatgcaacggaagttcaccacttcgcccaacagataagccgtgatggaattcataccatacactttcagccagttcaacccgcggctgtgtcctttatagtcaatccaataataaaataatgccatcaacagaaagcaataaccaccggatagtaatgtcatactacctgtccacaaacgcttaatgatgggcatctgcaaactccaaagcatcgccagccctactaaaagcacaccaatgaccgacagagtctgtaccacctttttacggttcgctttcccttctttcataatctttccggcaaaagctccgagcatgacagtcactccgaatgtcagactgctccatatccatgtgtaattgtaataaggtgaaaagctccacgttccgtcttcattccagaaaacaccatctctgaaacgacctaagacacatctgtccacctgttcggcaaagtttccagccggtgtgaagtcacccaaaaatgtcatgggaatccagtatatgaaaagcaacaataaagtgattcctatctgccacctgaatgaaaaatgtaactgaatgactgccgcaatgagatagccgacagcaatagactgcaaagtatttgaatagagataaatatgactgctgtccagtccaagcagatttccctgaacaatcattccgaaaataaacagcagaaacacccgcctcagaatcctccgatagacgagccagtaactgccggacataccgacgtactttgacagtgaaaacggcatcgaagcgcctgtcataaagaggaacaacggcatcacaagatcccaaaaacggaatccctcccacacttcatgatcaaactgataaaggatatcattgagaaacggcaagttcaactgtcgtaccaacgccgcaaacaccggctgaaagaagacaagaagaaacaggtcaaagccacgaaggatatccaacgatgccaaacgggttgtgtttttctcagataatttattcatcgcatttataaatttaagttttcatcactcttccttacttcacgggataaatggtgaaagtaaatgtttgctttcccaacggaaccagatacggcggcaacacccccggtccgcatgtagcagtacctacacctgcctgcttagcatccaaatgtacggtaatcctgccattacgttccaagtcattgatatgaagtgccttctccaataataaatcagagaaagggagagcactaaactggaatggagaatcagactctatccagcagccttttccgctgtcgtctgccagcttcacccaacgtacatcggtgcggtttcccgtcgactgggggataacataataatggaacatcttttcgggcgttgtagtatagatacctattttaccagactggtttctgtcaatgtatgtttcgtgttcaccacgtcccagataagtcacatttccataggtatcgttcatttcaaacgttaatcccagtcgtgctattgatttcacccatgtcgtgtccggctgaaaagtagtctgtactttcaaagatccattgtgattcagcgtatattccaatgtggcatctcctactttcttcccagtcacattcaatatatttacctgtgcggtagcggatgtcttactttctttcagagaaaccaccttttgggtcaatgtatgcaatccggcttttctccatagttttgcacccattctgtcccgattatcattatccgttgccggacggaacaggcttatagtgaccggactagccaacaactcttctccgtccagacaaagagacttcaaagcgcctgtgttttcatcgacttcaaatgtcgtttttccggcttcagaaggttttccattccatacttttccggatgcaggaagcacaaactggtcataagcaatttcccaagcggtgtccactaaaggagtggactttttacgtgtccagcccaaatcaagataagcttcacggatagtcttgggaagctgcaccgcccctaaagtaagctccaccgttgcatgcggctcacatgccacctccttgttgccttctgccaaaacagtaccatcatctcccgtcaccttccaatgcaggatatattcattcaaatcagagaagtcgaaccagttcttcacacgaaccgtcagattctttttatcaatcagtgtgctctttatattctgatagatcttctttacttccagcaaatgcggatgaggttcccggacagcatttaccaacccattgcaacagaagtttccaaagctgggcacatctttcggcccgtaatctcctccgtatgtccaataccatttaccatccttgtctacttcacggaacgactgatctacccagtcccagatacaacctccttgtgccatcggctcattttcgaagacctcccagtattctttcattccgccgcagctattgcccattgcatgcaaatactcgcaaagaatgaaaggacgataaatatccttgcgtgccacataatttctgatcacatccacactgcgatacatccggcaatagatatcggtattatagttttcttccgcacgttcgtattgtaccggacggtttttctccaccgatttcagccagtcatacgtacgttcgaaattgattccgttgccggcttcattaccgagcgaccagatgacaacagagggatgattcttcgaacgttcatacatacggcgtgtacggtctatatgggcaggaagccacgtactgtcctttgcaagagaggcaggaccataacccataccgtgcgattcaatattagcctcatcaatcacataaagtccgtaacggtcgcaaagctgataccagtagggatgtgccggataatgcgagttgcgtaccgtattgatgttatgctgtttcattaacctgatatcctgttccatcagttctttgcttactgtacgtccgagttgcgaatgttcgtgccggttaacacctttcaccaatacaggcacaccgtttatacagaaacgtccgttctttatctcagaagttctgaacccgacttttgttccggttatttccgtaacctttcctccggcatctttcaactccaacaacaaggtataaagttcgggatgctccgcattccatcttctcacatcaggaaggcgctgttcatcgaatacgatcagattgcccgatccatgtgattccagcttccggcttccttccagcactgtcttgtccgaagcatctttcaatgtataagcaatggaggacgttcccgaagccgttcctccgactgccacctccagttcgaagataccctctttgtaatgttctttttcgagaagggaagtcaccttgtaatcggcaatatattgttcgggagtgctgtaaagatacacatcccgttcaataccactcaatcgccacatatcctgacattccaaatatgctcccgaactccagcgatatacttcaagcgcaatcgtattttctccgtcggtgagcttgtccgtgatatcccattcggcagcagtcttggaaccttgattgtatccgagaaactcaccgtttacccatacataataaaacgatatcactccttcacagcagagtaccacacgacgtccttcccatccggcaggcactttaaaagtccgccgataagaaccgacctcgttctctttgtaaggtaccaaaggaggattctttttgaaattaaacatcttatcatcaaactcgtacgtctcattcacataaatagccgtaccatatccctgacgttcccagtttcccggcacctttatatctgcccatccacctgtatagtacgacggcttataaaaatcttttggacgagtgtccggattcttcacccaatggaacttccactgcccgttcagactcatataataaggtgactgctcgaatgtgcctttctccacctccgaagcatctgcataaggccatacataagtatgaggatcgagcttgttcaatcctacggcatactggctctgccattcaggctgttgctgttgtgccgtagtggaaatgatagcgggcgccgccagcatcattaagaaaaatggtttcaacaaattattcatttttatcattctatcatcacttcatcaaaatgcactcttgcctcctgcccgggacggacatggttatcaggacattttcctatcccttttgccgttacccttatatagcgggtttcaacgcctcccaaacttatcgatatatcctcaatataattaccttcacggaaaatctcttccggagtaaaggtccgttctcctgccttatcgaaagttttattatcaccggataccgcaatctctatcaagcgcggtttatgtacagccataccataactggttatgcaaccaatagtgaaggtattcaccttctccatcttctccatatctatagtaaaagagatagaatcattattcgtccaagaacaccattcaaagtccgaatacttcaggcttccacgtatcccgttagtcagaagtttctcattcggattacatcccgacacaggtttggcggttgccagattccaacgaacaggaagcgtcagtgtctttcccatttgtctgcctttcacaaaagtagcacttttaagattcaatgtctcttttacggccaatttttctttataaagaggtgaagtagctataggttcactgccatctgtcgtataatgtatttctgcatccggccggatacattccagtttcactttcagtgctccatcttcgggagtcaccgtgtgctgaatattatacatcgaacgggcatagacaattccttttgccgtcagatgttcattataaatatccattgctttcagaaatgaagtccaatcctttttctccggctgtgtccatgctatctccgccaatgcagccagacggggaaatactaaataatccacgtcttcaggtttattgcagaactctgtccacatggatgcctgcacgcccatgagtaaagaagcgtactccggcttccagtctgcctgcaccggttcataatcataaatatccttcaacgtattattaccaaagtaggtttgaggttcaaaccattgcggtccctgataacgaatcagatacatgatacgtgcgggtgtcatgatgaacggatgcccttgctccgctgctttcagagcagccgttcccagtcctctccatccctggatgataacgccttcgggcaggaaactactgttggtcagttcgtcccagccaatcacttttcgtcctttgctgcacacgtagtcactcatccgtttcataaagtaaccttgcaagtcttcttcattgtccagatgttcatttttcatccgtgcctgacaaagcgggcacttttcccaatatcctttttgcgcttcatcacctcccagatggatatagcgggaaggaaacaaagccatcacttcatccagaacattctgcaaaaaagtaaaggcactatcttttcccgcacagtagatcactcctgaattgcctccacccaaacccgggatcaccccgatataactctttactatcggacaggtcaattccggataagcagccaatgcagcattactatgggcaggcatatcaatctcgggaataatttctatctgccgttcggcagcgtaagccaccatctcctttacatcctcctgtgtatagaatcctccgataggcgtaggttctcccggttccggattgcgccggaaatagaaaggaacatccatacggttgacccgccaggctcctgtttccgtcagacggggatatttcttgatttccagcctccagccgttgtcatccgtcagatgaaaatggagagtattgattttgagcatcgccatacaatcgatgatacgcaaaacgttctctttaggaataaagaatcgggcgacatccaacatcagtgcccgataaccaaagcgtggttcatcctgaatagtcactgtgggaatattccagtcaaggcactttgcccgttgattgccttcgatagcaggtggcagcagtaaacggatcgtctgcaatgcgtagaaaaatcctttcgtatcggaagctttcaccaaaatctgctgcggggtaacttccagcaggtatgcttcactttttagagaagagtcagtcgtaaaacgaacatgactcttctcactgctacccattgtcaactgaggaattatccctgagctttttttaaataagtctataaagttacgggcgataaccgcctgttcatggttttctacggaaaagactgtcttgtcggaaaaggtaaagttacccttgcccggtactacacgtaccggacaaggaactattgaaataggggatggtgttaagttatcagcgcttgcccccgctataggtgccagtagcatgagaatgattaagatgtatttcgtcatgatagtcagttttattattattccttgtctctctcaggggagaaacggaccggatcattatactgttcctgcagtttttccatttctactttcagttcttcggcgatggattcatattcgggttgaccgtaaaggttgtgcatctccgtaggatcagcctgcaggtcgtaaagttcccaccagttgatgttattataaaaatgaatcagtttatagcgttcggtacgtatgccgtaatggcgtttcaccatgtgttcggcaggatattcatagaaatgataatataaggctgtccgccagtcctgaggatgttcgcctttcagcaacggaacaagtgacactccgtggatgtcttcgggcacaggagctccggcaagttcgaggaaggtaggggcatagtcgatgttctgcaccatttccgtgatctttcccctgcggtcaaagcctttcggcaggcgcatgataagaggagtacgcatggactcttcgtacatgaaacgtttgtcaaaccaaccatgctcacccatgtagaagccttgatcggaagtataaactaccagtgtattgtccagtaatcccttctttttcagatagtcgaatactctaccgacattgtcatccaatgatttcaccgtcttcatatagtcgcgcatataacgctggaatttccagttggcaagttctttcccctgcaggttctgccggtagaaatcggctatgatcggatcataaaacttatcccatgcggcacgctgtgctttgtccatccgtccgatatacttttcatacaaggctttcaggcgggagtctttatcaggacgcagcattttaagatcgtagatcatatccatatctttggcaatgctcatttcctgtgaggcggcagccggacgtccctcataatcgtcgaagaaattatccggtaacgggaaggtcttatcttcatacaaagccagattacacgtatctgccaaccagttgcgatgaatcgctttgtgatgaatcaacaggcaaaaaggtttatcaagatcacgtttgtgttccatccagtcaatggcatcatcggtaatcagatttgtgatatatccgtgcttccggatggtgtcgttgttctgtgtaatgaaatccggattgtagtaatcgccctgaccgggaactatttcccagtagttaaatccggaaggaaggctttcaagatgccatttgcctaccaatgcggtctgatatccggctttttgcaacaatttggggaatgtctgttgagcactatcgaatacacaagtggtgttatcatagaatttgttggcacaactgtgcttgcccgttatcatgcaggcacggctgggtccgctcagagaattagccacaaagctgttggtaaagagtactccttcttccgctatgcggtcaagattgggagtttccatatatcgggtatcatagcaactcatcatttgtgctgtatgatcatcggtcatgatatagacgatgttcagtggcttctgtgcagcctctttttttaccgaagtacaactacaagctgcagcagccaatccggtgacaggaattatataagtatacttcattttatttattcattgatttaaaagaaatcatccggagaatacttgcgggattccccggatgattgataatacggattattgattaatagaacttagtaccatttttagctttacccagttcataatctgctaccgtagctttattgatgtatgtacgaacccaatcaatctccagacgagggatagcgtcgttttccttatctcgctcataattattgtaacttgcgaatccggaatcccagccggcatcaggagaccatactccgcctgtttctgttccaccgccaagtccccatttattaggtgcacccatagtgaggatgaacttaagtcccttctcattctttgcattcgtaaaggtccactcctcttcggtacattcgctcttcttcaaggttacggtttcttctccgttgatacctattgcaacttccgtatccgaacgccactctacccaataaatattccattcagtcatattgattgtattattagcagttttggttttattatcagttgtagtaggaccggtatggaatgtctgatgtgctctgtctccggttacaggaccgacaggattttcaagaatatctatttccgaataagatttctgaccggcagattcatcagaaaccagccagatacccatattaaagccattcttctgcccacgaagacgggcacggatttccattctgcaaccttctgatatcaactgactgttggacttccacggagaacccgttccacaaccatagaaagctgctgtaccataatctctttgccctgatgcaggagccgtagcatttgacggtactttcatttctatcattcgcagatagccgtcgtccgtaatctttgagaactgttcgtttatacaagcagcatggttctgaacgatcacggtattacgtgccgccaggaacagaggtactttattaccaaaagagttgccattgttccacatgtcgcccgaatttcccacactatggaattcccacgcattatagaatttccagcctgctgcagccaagtccgcattaggatgcgcatccaactccttcattaaaacagcatcgccatattgctcaaccacagccgtctgccttccactggaagcaaacgggatccccggatgatcatatacccagcgttcgtcaagaagtttactaccctttcctgcttcgaggtctttcatgatgatttccattttatcattatccagcggatacataacagaaatagttgtaaaattcagtaccaacgtttcgtgctgtgtaggactgaggttatgtttcgtcttcacttttgcctctgccaaagtttcacctgcgtttactgtcaatgtaacaggaggcaacgtttcatagagactcttttgatcatcaggaatagtgatgttaatatccatatcgtctttcaccggaacaggagtctgcacctgaatagtaaactcatcaccttcattaattatattatccgaattgttcttcagtgacactactgtataatagtggtcggagaccaccaccgtttgagtaggattagtcatggcatagccacgcacgaaggcagtcacgttcacagttaatttctgtttcggttcaagaccactttccacaatcggcaatttaatatcgaagctactcacccctttggggaccgtaaccatcgaaggaaaatctttaaatgcgattttcgatacatccatttccccgtctttagcggtcagatacacatcaaaatcttcattagtcgtcaattgcggattcttttcatcattaactttgacggtaagagtcagttcttctcccatcacaaagctttttccacttgcttctataatcaacggtacagtctccggcaatggttctaccgcatcgtcatcacaacctgcaaatcctgttgcaagcaggcaaacgggtaaaaatgtatataatattctttttatcataatagtatagtttataaaatgaggtatttattcacttacattctcccaacccggattttgacgtaactggcgatttaattgtagttcatcctgtggaatcggcaataaatagtcccgtttcagatcgaaaaggtatccattaggcaagtattgctgcaatgggtccatccaaccctcattatccttcaatacgagctttagtgactcttgtccctcgggtgaaaaactccggtacagaatcccctctttacccagataggcacctctgccgcggccatctattcctttcagagttccggcacctgcccaacgcatcaaatcatccagacggaacccttgaagagccagttccgaacgccgctcacggcgaatctcctgaataacaggactaattcccgtaaatgggaaattgggatcggttgtcggagtaatatatttcacacctgctctttcacgcaacgcttttatcgtttttgcggctacattatcatcatatttattgagttctgctgctgcttccgcatagcagagcaatccttccgcatagcggaacataataatggctgtttcactgttaccgtctacataagttgtatcgatgcccatccgaatatgaaatcctgtaacgtttttactgttcccgttgccattcaaactcggagatacgatatcatcattcttcagttttatttcttccttagtacctgtaggatcataagctctgacgttcattggcttagaagcagtagctcctgcattcgagcgatatttacagcctgtatgcatcactgtagcaagaagccgcgcatcccgatctttaaacatttgattgaaatccttaaatttcagttcagcaggatcaataaaagtaccatcggtatacaaataattatcaaccaaagattttgataatcctgccgggccgtcggtattgaccacaccactggaaagtaagcctcccaaagcattgaagataccatcattcaaagagtactttttccagaaaacagcctcttgaatcccagagagatctttcttattaaacaaatgtgcaaaagcgtcttccgcactgatagcttccttatcagaatcctttgtattcaaggtcagaccggcagggaaaagttgctgatcaccccagttcaatacttcctgataaaattctgcggaattatcctctttggcgaactctgttcctttgtgatatttttcccatgaaccttcgtaaagcgctacccgcatagcgagaataatagccgcctccttgttaatacgcaatccttgatatttactacgggaaaacagacttgcccgagtttcgggaagctcgcctatagcagccttcagatcgctcagaatgaaccgtgccacatccgaacgcttagtagccggaatttgtaaaccggcaactgtggcattcccatcccaaaaatcatccataataggtatatccccaaagcgggttagcaaataaaagtgccagtaagcccgtaagaaataagcttctcctcgcaaagattgtatctcggctgtttcctctatttcaggaacacaataatagtagaagaaatagttgacatcacgcaggttctcataccccttcttccagtcggacgagccgctgaacaaattattttcaccattcaggcgcatatcatacttttccgccagaatattgtcgctgttcacctcttctcccctgacacccattccatactgtgccggagcgggcaatgccgggtataaagcattgatatagttctctacctgttcccgtcctgacaggaaggtagtgttatctggctgcgtcaatggtttccggtccagaaagtcggaacaagcagacagcatcagtcccataaaagcagttagaataattatcttctttttcataatagttcctctctaattaaaatgtgacatcaattccaaatacaaagttccggttcataggatatacacgtccgttaccattggcattcaatggtgaagtaagtgccggggcagtgtcattactgccgcctacccatccgttcacctgattcagtgtttccggatcaaactgtttcggcaatttagaaacagtaaacaggttatcacaagtgacgtatactctcaaattactcagtccgatatgttgcaccagctgaggcttgaacgaataagacaccgtcagattctttaggcgcatataagctgcattcagcaagtaacgggtggtattgtagcctgtattggctgccagagtctgtttatcatccgtcagacgtggtaaatatccttcaggattctgagcattgaaatggtccagatgttccttgaaatagctatttccaccaaagaaataagctgcaccggagatggggaattgccgtttggccaccccttggaaaagagcagatacttcaaatcctttatagcctgcattcaggttgaatccaaaagaatatttgggagtagcattaccgatcactttcaggtcaccgtgatctgccagtgtacccttgcccgaatcgacttttccgtcgtgatttgaatctatatatttcacatcgcctcgttgccacttatcacccggcttaaagaaactaaggtctaccgttttgaggtattcatccacttcacggttggttcggaagaggtcatcggcctggaatccccagatttcgccgatatccattccctcatagtaacctttgttacgtgccagaccggtatgattattgtaaagcaggccttcgggattattatatttcgtaactacagccttataatcggaaatattgaacccgataccgtagctaaagccacatttcagtctatcctgccagttgaccgataattcccagccacgattgcgcaaagttgcattatttattttcgaacggtcttcagtattaataccgctgatagaaggtattgcctcagccggaccgatcatatcgcgggttgtacgctgataaatatcggcagttacagaaagtcggtttctgaacagcatcaggtcaataccaagattggcattatccactttctcccatgtgatataaggactgatcattttaggtgttctggcaagtactcctttggacggagtatcacttactcccggcagtaaccaagagtcgggagaatcaggaaccagattcataaatccaagatagtcatacaatccggcaccattctgattacccagacgtccataagacacacgtagcttcaactgggagaacggaaggttccatcccttgaaataatcggtacgtgccatatcataaccggcggagaaagaagggaagaatccccaacgatgtcccggagcaaaacgggaagaaccgtcatagcgtccgctaaattccaggaaatatacctcctgatagttccagttcaacttggcatacatacccatcgtggcccagtgagtgcggtcttcattgccggaaaggttaccattggcattggcaaacgagaaaatgtcactggtcagcagaccgtctttataagtataaccgtcagagttttcctgcagttccatctgaaaacctgccattgccctaaaggtatggtcgccccagccaaaaatataagaagagagtatattcggagaaagataatagtcgaaggcattcccacgggtgtaagatccccagcgggaatttttccagttcatacccggatatacgtatccctgcttggtcgacttatctatcgataactctccgtcgggtttttcgtaagtaggataaccacgtttgaagctattatcttccacatcgaaacggactttcatttctcctacaatatcccatccttggagcggagtgatggtagcggagaaagacatagcatcggaaatacggttttctacataatgtgattctttcagataacggaactctgaagcatcattatatttcgactcaatgggataatgagtcggggcattcggtatagtctgaccaatggttccataaaagatggtttggttcgccatcggacgcttcagaatattcaatgtcaggttgttgttgaagttgaacttcaaccatttattagcattaatctgaaatttcgtattcacattgtatttactcaggttatcatctaccttatccatcagaccttcctgataaatatagcctaaacctacataatagctgaccttatcagaaccgccggatatactcagattgtgggaatgacgaatggaagcatccttaaaataataatcaaaccagtcggtattggcatataccgcatcctttgatgatgcccagttggtcttattctgattaggttcgatacccggaaattccgtggaataaggattcttcataaacccttccatcttttctatgagtgcgtcagaaatctcgtgtttcttgccatcattatcattgcgttcgtttatataatgagcaaactccagagagttcatcattttgggcatattgataggtgaactgaagccgactgttccattgtaagagacacgtgttttatcctttccaccgcttttggtagtaacaataatcacaccataggcagcacgggcaccataaacagcagctgcagaagcatctttcaatatactgatcgtttcaatatcgttaggattcacattctgaaggctctgctcaactccgtcgatcagcacataaggttctcctttattaatagaacccgtaccacgaatattgaacttgatttcagcacccatttcaccgccgacaccatcagcgactgcatctgttgaaaaattcaagcctgcgacattaccctgaagggcactggtcaagtccgttaccggacgactggcgattgcttccgaacttaccgtagcaacggcagccgtaatagtgctgcgcttctgcttgtccatacctacaaccactacctcatcgagcacctttgcatcttctcttaatacgaaacggttaccttcaagtttcttcactttcacttcaagaggagaataacctacataagaaatggacaatgtcgtgccgactttacctttcagagagaaatttccgtcaaaatcggtcaaagtcccttctttggcccctttcaccatgattgtggctccgataatagattcaccactatcatccaccacttgtcctttaatcatttgttgctgtgcaaacgctcctaaagggaataataggaggagcatcagaagactaacaaaacaactttgttttttcatctgtttcctttttttcataatactacatttaataataaagattcatactttcactagctaacaataagtttcaatcttcgacaaaaatacaaccacagcataaaaggaaacattcaaaaatcatcaattaaaattcaataatgatcaaaagaaccctgtgcaatccgctaaatgatcattattgatagagaagtgatcaaaaacaaatgccaatagatggtgattcacttcccgtgcagtgacaaacaaactgttttttaggcaaaaacccgcattttttagaaacaggacgttttgcagccaatcaattgcaggcataagacagaacgttatcaatcattatcaagttaatagacagcacaatacaggttactatattctcaaagtattctcatcgtgatgagaaaaaattctcaccacagtgagaaaaaatactcatgcctatgagaatattttctcattgcagtgagaattttttctcatttcggtgagaatcgaagtgtctgtactaacctgctaatggtcaactactcatttactacacaattttattcatttccgagtcaagaaggagctaacaaggcatttttatcgatttttgaaagcctattgaacaaaattgaaaaagagtcagaacatggataaggaagaaaaggagtacttttgcacgtactcctttaaattaatttattatgaagaaactttattctttttttatctgcacacttttctccctttccgcatcatcaataggaactgttgattataccaaaggactctctgtctggttcgatactcccaacaatctcgacgggcaagctatctggctacgtgcttccggttcaggagccaatcctgacaaaacgtgggaaagtcgttcacttcctatcggaaacggtagtctgggagcgaacatcttagggtcggtggctgccgaacgcatcactctcaatgagaaaactctctggaaaggaggaccgaatacttcgaaaggagcggaatattactgggacgtaaacaaacaatcggcaggagtattaaaagaaatccgccaggcatttctggatgaagacaaagaaaaagccgcccaactcacccggaacaacttcaacggtttagcagcttacgaagagaaagatgaaactccattccgtttcggttcgttcaccacgatgggagaactttatgtggaaaccggactcaatgaactcagaatgagtaactatcgccgtatcttgtcattagattctgccatggttgtggtgcagttcgataaagatggagtgcaatatcaacggaaatatttcatttcctatccggacagcgtcatggtaatgaaattcaccgccaaccaatccggaaaacagaaccttatattgagctattgccccaacagcgaagcaaaaagtaacctcagggcagacggaaaagacggactggtatataccggagtactcgataacaacggtatgaagtttgccttccgaatcaaagctatccacaaaggaggaactctggaagctgaaaacgaccgccttatcgtaaaaggcgctgacgaagtggtatttctgctcacagcggacaccgattataaaatgaacttcaatcccgatttcaaagacccgaaaacgtatgtaggcaacgatccggaacaaaccacccgaatcatgatggaccaagcagtacaaaaaggatatgatgaactgtaccgtaatcatgaagccgaccatacggcgctgttcaaccgggtacggctgcaactcaatccggatataagcagtcccaacctccccacctaccaacgtctggctaattataaaaaaggaaccccggattatcaactggaacagttgtactatcaattcgggcgttacctgctgatagccagttcgcgccccggcaatatgcccgccaatctgcaaggtatgtggcacaacaatctggacggtccctggagagtggattatcacaataacattaatatccagatgaactactggcctgcctgctccgccaacctttcggaatgcacatggcctttgatagactttatacgcagcctggtgaaacccggtgaacaaacggcacaagcctacttcaacgcacgcggatggacggcatccatctctgccaatatcttcggatttacagcgcctttatccagcaatatgatgtcatggaacctgaatcccaccgcaggcccatggcttgccacacacatctgggaatattatgactatacccgtgataagaaattcctgaaagagatcgggtatgaccttatcaaaagcagtgcacaatttgcagtggaccatttatggcataaacccgacggcacttataccgctgctccttccacctctcccgaacacggaccgatagacgagggagtaacctttgcacatgccgtagtgcgtgaaatactattggacgctatccaagccagcaaagaactggggatcgactccaaagaacgcaaacaatgggaaaagatactggataaattagttccctaccgcatcggacgttacgggcagttaatggaatggtcgaccgacatagacgaccctgaagacgaacaccgccatgtgaaccatctcttcggattgcacccgggacataccatttcgcccatcacgacccccaaacttgcagaagccgcaaaagtggtattggaacaccgcggagacggagccaccggatggagcatgggatggaaacttaaccagtgggcacgccttcaggacggaaaccatgcttataagttatacggcaatctgttgaaaaacggaacactggacaatttatgggatacccacgcgcctttccagattgacggaaactttggaggtacggcaggaataaccgaaatgctgttgcaaagccacatgggatttatccaattgttgccagccttgccggatgcctggaagaacggttcgataaccggcatctgtgccaaaggcaatttcgaaatttccatttcatggaaagaagggcaactggacaaagcaaccattctttccgggtcaggaactccctgcaatgtaagatacggagataaaactctctcattcagcaccgtgaaagggaagaaatatgaaatcactttagtaggaaatctgttaaaactgctgtaaacagcacctatttcatcatatattcagcaaaaaccggctgaatatatgatgaaagtattatctttggtaaaccaaaccaaggatcaatgtgccaatctcagacgatccgctaacctacttttacatgaaaacaagattgcttactttaccagggattatagctattatactattgataactaccctccctctccgcgcagaacattactactataagcaaatctccctcaaagaaggactgccgtccaatgtacgctgcatcctcagagacgaacagggtttcatctggataggcaccaaagcaggactgggaaagttcgacggacaccaactgaagagatacaaacaccaggcgaatgatccgcactcgcttcttcacaacctgatctaccaaatagcggaagacaaacaacataacatctggatactgaccgaaaaaggaattgcacgctatcagcaacagagcaacaacttcactttccctacagacgaagaagggaattacattactgcctattccttctgcctcgttccggatggaatcctgttcggtggcaaagacagaatctataagtacagctataaggactcttcgctgagactccttcaatatttcaatgccaactcttttaaaatcaccgctctcagtgtatgggactcaaagacgctgctctgttgcagccgatggaccggcttatatctcgtggacctgcaaaccggagagcacagacgcccgccctttgactgcggaccggaaatcacaagtatgataaccgattctaaaaatagaatctggattgccccctacagcggtggactgcgctgctactcacgcgacggcaaactatcggcttcgtacactacccataactcctcactcagcaacgacatcgtattgagcctcgccgaaagagaagaacaactgtggataggaacagacgggggaggcatcaatatcctccatcccgaaaccggagaaatctcccaactggagtatattccgggccgtgagaactattctctgcctgccaactccattctctgccttcacaacgattacaacaacaatgtatgggcaggaagcacctgcaacggattgatcagcatccgggaagtatcaatgaaaacctatacggacgtagtgccgggcaacgaccgcggattgagcaacggcactgtacggagcctttaccggcaatcgccggatagcatctggattggcaccgatgggggaggcatcaaccttttcagcccgcacaccgaaaagtttacccattattcgtctacttggggagataaggtggcattcatcagtggctttacacccggaaaactactgatctcgcttttctccaaaggagtctttgtcttcaaccccgccacaggagagaagcaacctttcaccatcatcgacaaagaaacgactacacggctctgcaaccgtggaaagtccgtcaacttatatcaaaatacgcccaacaccgtgttattcctgggagaccacatctaccagtatcacctcaaagagaagaaattcagcaccatcaccgaagaggaagggaaagatattgtgggtacccttgtcccgttcgatcatcaagagaacctgacctatatcaatgatatcaaacatatctatgaactggacgaccagacctcccggctgaaaaccgtttttgaatgctacacggatacagtgatcagttccgtatcccatgatgaacagggacatttctggatcggaagcaatttcggacttatccactacgaccctgtcttaaaaagccggactcttgtccctaccaatctgttcaccgaaattaatatggtactgtgcgaccagaaaggcaaagtatggataggcgttgacaatatgcttttcgcctacttcatcaaagaacagaagtttgtacttttcggagaatcgaacggagccatacaaaacgaatatctccctaatgcacggttggtgaacgaacaaggggatgcctacataggcggtgtgaagggtatgctgcgcatcgacggacaacttcttctgaacacatcggaaatgccggaacttcaattgctggatattaccatcaatggcgaatcggcgaatcatgaatggtacaaccatccggcaaaaatctcggtaccctggaacagcaatatatccatccgcatcatgtcgagggaagaagacatcttccggcaaaagatttacaggtatcagatagaaggattgaacaacgaatataccgaatcatacaatccggaactggtgatccgatcactgcttccgggaagttatagaatcatggcttcgtgcactgcaaaagacggtagctggattcccgaccaacaagtactggaactaaccgtacttccgccctggtaccggacatggtggtttagcctgacttgtgccgtactcgtttctatagcaatcatcgaaactttccgaagaacggtgaagcgcaacgaagagaaattgaaatgggcaatgaaggaacacgagaaacaaacgtatgaagaaaaagtacgtttccttatcaatatcagccatgaactccgcactccgttgacacttattcatgcgccgctcaaccggatactgaaatctttgtcttccgaagatccccaatatctgccgctaaaagctatttatcgtcaggcccaacgaatgaagaacctgataaacatggtgctcgacgtacgcaaaatggaggtcggtgagagcaaactgcttattcaaccgcatcccctcaaccactggattgagcacgtatcacaagatttcatcagtgaaggagaagcaaagaacgtacgcatccgttaccagctcgatccgcagattgaaacagtaagtttcgataaggacaaatgcgaaatcatcttaagcaatctgctgatcaatgcgctcaaacatagtcctcaggatacggaaataaccattgcctcggaattgcttcccgaaacaggaagagtacgtatctccatcatcgatcagggatgcggattgaaacaggtagatacacataaactctttacccgcttctatcagggaacaggagaacaaagtggaaccggaatcggattgtcttactcaaaaattctggtcgaacagcatggcggctctatcggtgcacaagataaccccgaagcgggggctatcttctttttcgagctaccgttgaagcaagaatcagaagagattatctgccagccgaaagcgtatctgaacgaactgatacttagtgataatctgaagcaggcaaccgataaagaaactttcgatacaactccatacaccatcctggtggtggatgacaatccggatatgacagactttctaaaaaagacactggaagagtctttcaaacgggtaatcattgccgctgatggggtggaggctctccagcttatcaaaagtcacattccggatatcattgtcagcgatgtgatgatgccgcggatgaacggatacgagctgtgcataaacatcaaagaagatattacgatcagccatattcccattatcttgctcacggcacgagatgataaacaaagtctcatcagcggttataagaatggagcagatgcctacctgacaaaaccttttgaagtagaaatgctgatggagataatcagtaaccgtctgaaaaacagggaatacattaagaaaaggtatttgcatacgggcataatacctgtcccgaaagagaccactttcagccaggtagacgagagcttcttacttaaagtgaacaaaacaatccaggagaatctgagtaataccaatctggacattcagttcatttgcaaggaaataggtttaagccgtacttcgctttacactaaactgaaagcacttaccgggataggagcaaatgattacatcaataaattccgaatagaaaaagcacttacgttaattgccaataccgaaatgacatttacggaaatttcagaagaggtcggatttacatctcccagttatttcagcactgctttcaagcagtacacaggggagacaccgactcaatacaaagaaaaaacaagtaaaatataatatcatcataatctgaagacaatatttatcaaaaaacaaaaggagaaagcgaagttagagtaaatcgaccaaaatctgtcagagaatgactaaatagtattattccatatttaaattaggttgtaattttgccctatacctaagtgaagtatttgtcaaatcctaattaataaaacaatagtatgaaaaaacattttctgatttttacaatctcgcttctatttttctcgcttgcacaaggcaaagtaaagctccctgccatgatgggagatcatatggtactccaacaaaacagttccgttaagctgtggggatgggcagacggcaaaaaggtgactgtcaccacctcttggaataaccgtacttataaggtatcgacagacgatgagggagcctggctggtcaaagtggatactcctgccgggagttttactccttattctattaccatcagtgacgggatccgggtcacgctatcggatatattaataggagaggtatggatatgctccggtcagtctaacatggaaatgaccatgaaaggaaacatgggacaacccatcgaccattcgctggaaactcttctgaacgcaggcaactaccgcgaccgtatccgttttatcactgtcccccgaaccaaaggagtgaaagaacggacagactttgaaggagcgaaatgggaagtttcttcgcccgaaaccactatggattgcagtgccgcaggttacttctttgcccgacaactgacggaaacgcttcatctccccgtaggactggtcatcaacagttggggaggttcacgaatcgaggcatggatgacagaagaaacgctcgcctccgtgaaaggcgcaaatatagaagccgccaaaaatccaaagttagatacgaacagccggctgcaatgtctgtataatatcatgttactgcctgtgaaaaactatacggcacgcggatttctatggtatcagggagagtcgaatctattcaactatcagatctatgctccgatgatgactgcgatggtgcagctctggagaaatgtatgggaaacaccggatatgcctttttattatgtccagattgctccgcacaaatacggaaacagccggaatataaattccgccttattgcaggaagcacaaatgaaagcattacagacaatccccaactccggaatgattcctacgatagatgtcggcgacgagttctgcattcatccccctcagaaaaatgtagtaggactccggctggccaatctcgcactgactaaaacatacggtctccataaattcccatctaccggaccgatgatgacaaaggtggaatattcaaagaacaaagcgatcgtcacactcgacaatgccccttccggactggcaccgggcaactgtgaattggaaggtttcgaaatagcaggagccgacaagaagttctatccggcaaaagcacggattgcaggtcgcacaagaaatgtggaagtatggagcgatcaggtcgcccaaccggtagccgtacggtatgctttccgtaattatgtaggaaacatcactttacgcaatacattggggatcgctgctttcccgttccggacggatacatgggatgatgtaaagtaagagcctgattagcctgtgtgcagggtatatatgtcctgcgtacaggagctatatatccaacgcgcaggagctatatatccaatatgttgggcatatagctcctgtatgtaactaataaattctatctgacgtaagtctccttttccatataataaatagcttctcctctatccccgttctccaaatctgtcagttctaccttaaacacataataaggcaaagtattattcctgtttttaggcatatcgactgtcaacagataggcatttccccactcgtcaggagcgaaatattcttttatctcttgcttcatgagtataggaactttttcaccgttgatccagacaacagctttcaactgttccggctcaggggccagaattgcttctttaggctttccggctttcatccatgcctgcgtacgtgtcagactcataggacggacatacacctgataagcaggtgttgcacccgggattctgaaagcacgcagtccataggcttccatacgatgatattgtatgttgagcgttgtgtcgcgatcggcgataaaatcccatccccaaaattccagtcgttgatccttctccggtagggtagaattggcgatgatgtattcatccatattcaatgcacccatcgaatgatattttcccttggggatgcgtatgctgtaatttccatttttgtctgtcagcgttaccgatacctcactgaagtccggacgtgcccaactgacggaaacattgtccagcggatgattatcataatcggtcacacgcccattgatcgttacagagtccgttattacttgagaagtttgagctaccaagctactattaaatccgattataagtatgagtaataataaatt

SEQ ID NO: 41 - DNA, 65860 bp, Bacteroides thetaiotaomicron
acctttgtttgctatataaacattgcaattagcaggatttaacttttagaaggtcatgtgaagacttatcctcaggccggacttgtcaatatcgggcgaatccctatatgtgagccgccagacgtagtctaaacgtaataccttgaaaatgttttcaatacccacacccgcctccacgtaaggtgtttttcccattgtacgggtacttgctatcggaaaagcgaacaaaccgtctgtcatatccggattattcttatcactcaaatgcccataaagtccacgacaggaaactatttccctccatttcagttttttcaacaatgggatacgattgaacaaccacccgttgaggaaataggtgacgtcccacgaaaagtattcatcattcataaactccatagcattcattaacgaataggattccggctgaatggtgtaggaaaggttcgcattcggcataatgagcaacggaaagggaactttatcccataccttccctgctttcagaataatatccgtatagccgaaagcggaaaatcagaaacgtttctgtatacccgcttcggtatgattataggtgtaatcacttcccagtactccttttccggcaatggtgtgcgacagtgtaaacaccggagcatccagcgatacagggaagcggttccattgtgtctgaaagaatttctcgttcggggcatagcgcagcttcaactccgccgcactggtagagaagtctttaaccggagagtaaacctcaccgtctttccgcagaaaaggaatcaggtagctcgattcatccgtccgcctgcgtgccgttagctggaaggagaaaccggaataaaactcattggtatagctcatttccgcttgccggtaatagccgatacgatcatctttctcacgcttcaaggcaaggaagacattgtctttgcttgtgtacagatagttttgtccgtattggttaacgtccgattcataacgtactttcagtgaatggatgggaaattcattggcatattcctttttctttttaaaggagtattctacttccgccagtcctttcagcctttcgtctttgaagccataagcgatatagcctttgccgaacagatgagggttgagccatgcggtcgtcattccaccagcacggatacgcggtccttccagcgtattcccgctgatggtggcattcatgggaccgatatagaaaagaggggcttctttagaggtcgggatgtatccggtgaagagaatggatagcaccttttccgtccaataatagaccggatagccacgcagttgcgccatcaggcggtctacggagttctcctgttgcgagatggctgcttgcggacggttctccgcccagaaggtttcgggtcgggacagcgcttcggtttcttcgatgatacgttccggtttggtgaaggctttatcggcttcctcggtcggaaggaaagaataatgactgtaatccgccactcgacgggcaaagataccatcctgtccttcggtcagtttgaattctacggtgatactttcatggtcgagcagacgagtaccgtcttctgcccgcttaaattcctgttcaagcagcatataatcgacaaagttcagattgatcttcttcgggaagttaagtacggcacgtttgacaaagtaggtagagtcgagcgtgacatacaagtgcccgttaaaaccgaaagattcggaattaaagggggtgaaagcaaggtctgcacaggtttcaccgccgatctgcaaggtatccatcagataatatttgtagaatcctgtcccgatgcgggataaggggctgacgaacttattggtgaacagggagatgttgttctcgtaaatgtccacgtctttaaagacttcattaatagcagcctgcataccttgtttggaaaggaattcatcgactcctgcctgcttgcgtcctttcacccactgcttttcggaatgaggagatttgcggtagtagtccgtagcaagaagttcacgggcagatacggtcagtatcggttttccggtgacggcagaggtgtctacatattctgtcaggaaatcaaatttgcggtatagccatttcttctgtttctcttcgtcgaagttgttcagcgcaaaggtagtcttctcataacggtcgcgctgccagaagtctttctcattaggagaatggtcgtcacgatgttctatcatccgacggacaaactccacagcgggattgtctttcttacggtaatgctcgcgtttaggcttcaccaatacttcgttgagcgcatatgtagcgggagaaagtgctactttatacgaaagattacgtgccggatggatcagccggctatattcattatagcctacggttgagatcacaagcactccttcggagcgatgggttttgaaataaaagcgtccgtcacttccggtagtcgttccttcggtcgtgtttttcagacgtacagatacataagataagggttctctggtcagagaatcagtcaccacaccctgcactatgtattgggcacttagcggaatactgatagccaataaaagaaagagcgctactgcacctttaattattaatctcatatcttataccttaacatcctattgaattgagcggggcaaaggtaggagggatttcagaacaaaaaaaggtctatatagcggaagaactgttctcgtttgacatttgatcaaggaaaaagaatacggaatctggtcaatccgtcggcataagtccgcagagagaaggtacagccgtgacgcatcagaacctcccggataaagatcagtccgattccctgaccattgggcttggtggagaagaacgggctgaacagcttcgcttccacctctttgctgattcccttaccgttgtccaccacttcgatagtggcaggagaaagggtgcggacgataatctcgccatccttttcgatgctttccgcagcattcttgatgatgtttaccagtacctgttcgaagagggaggcatccatttttacctctttcagtgtttcgtctatctccagacgaagttttatgttccggtcggcacacataccttccataaaacgcttgcaggtaaatgcgaggtcattcaggtcgacaggcgtgagcgtcggttcgggaatcttcactacatcggcaaaacgggtgatgaaacggctcatagagaaacagcgttcgatacatacacgcatgacatcgcaaatatcatccatgccttcttcggcagaaagcgcctgctctactgtatccagtgtggaggttattccggcagtagtgttgttcacttcgtgggcaatcatgcggatcaccttctcgtaggctttcttctctgccttcatcacttcgtccgtcagactttctatcaggaagaaggggtgctgaaatccacggtcaataaaagaggaatgcgtacatctataaatattcgaatcattcagacggacggtagccgtttctcctttcggcacatttgccaactcggcggcaagcggagaatctatctcgttcatctttttgcccaagacatcttcctgacggacacccagcattttctgcgccatcgggttcagctcggaaaggtcctcgtccaatgtggtgaggatgactcccatcggagaggctttaatcagcaggtcaaggaagttattctgttcgcgaagacggagacgttcattctttagttgctccatcatccggttgaagacgttcacaatacggtcggcttcatattgccccacgggacttaaccggctgctgaaatcctgttcgcgcaacagttccataccgcttccgatagagttcagcggtttcacaattttacgatagaaaaacgggagataacacaggataaaaaggaccaacccctctcctatatagaaatagatcaggttcaaccggcttgaaaggaaaagcaatccaccccccaagaccagaagcaggaaaacgagtataccaaaaaatccttttatacgcataataatagtaaggtctatctgctaaacactgattccaaacttctccaaacgacggtaaagggcggcacgactgatgccaagcgctgtagctacctgactcaaatttcccttatgacgctccaaagcctgcaaaatcgtctgccgttctatttcatccagagtcataccagcaaaggatgcgccttcggcgactttctgatcttcgtgacggatatactgagcatcaaagtcggcggcatcaagcgtcggctttccattgaccagaatcgtacgttctaccagattcttcaattcacggatatttcccggataaggtaagcgactcagaaactgcaaggcatccgccgaaaattcggtgcgaggaaaaccgttggcctctgcctgacgatcggcaaagtgacgtgccagcaagggaatatcctcccgacgctcacgcaaagccggcagtctgacggtaatcagattaatacggtaaaacaaatcttcgcggaaagtacgttcgcccaccatcttgcgtaaatcggcattggtagcggagacgacacgaatatccgtcttacggggacggctgtctcccaatacttcaaacgtctgatcttgtaacacccgcaagagcttcacttgacaagaagggtcgagatcaccgatctcgtccagaaagatggttcctttgttcgccatctcaaagcgtccgatacggtcggaggaagcatccgtaaaagctcctttcttatggccgaacatttcactttcgaacagactttgggagattcctcccaagttcactttgacaaaaggctgtttggcacgctggctgttgatgtgtatcgcctcggctatcagttccttgcccgtcccactttctccggtgatcagtacggaagcattcgtctttgctatacgggcaatggtgttcagtacttccgtcagtccctgactacggccgatgatatgacgacggtcgaaagcgtcattctgttcctgcgttgtctctttgggagagcctgccagttccaaagccgtctcgatacgttgcaacaatgccgcattattccaaggtttggtgataaaatcgaaggctcctgcctgcataccttgcacggcaagctgtatgcttccccaggcggtcatcagtatcaccggagtttccggacggaatattttcacttgcctgagcaaagtcagcccttcttcacctgtagtagaaagggtgaagttcatatccattaagattaaatccggtgctacggaacgcaccacctccatagcttctcggggaccggaaaccgtttgtgcttcatatccagcccgcttcaacataaaactgagtgaagagcgtaccgcactgtcgtcgtctattattaaaatcatagtttaaattacttgtgacaaagatattgtaaatactcaatacaagcaacaaatagcccgattaatccctattgccgcactatttcatcaaaatctgcttccaactccgtgttagcctggaaatcccagagagtcagactacggatctgataaaagtaataccagtaataataaagttcggagatgtgcttccggcgcgcctcgtctttggcgttctgggcgtcatttaaatccagcgtgttgattttacctatcaggaaggtttcaatactggttttgtaacgttgctgagctatgccatccgcctctttggctatctccaattgctgtgcctgattattgaaatgctctaccagcaagaatatgtcctgattgaagttgatctgttcctgccggatcttcgaaagcactacatcgcggttgcttttcgctacccgtacctttccgcgtctctttccccagtccagaatcggaatctgaacgcctacctgcacaatctgattatcctgcaagttcctgtagacactggaaagttcacgactctctcccgtatatcctacactagcaaacaaattaatgctacgcagattaccacgtgccgtagctaccgcataatcggcctccaactgacggcgacgaatattctgggcaaaagaattacgttccagcgctttattcaaaaccatattatattccattttaccacaatctaccgactcgggaacgacaggacggaggatttcatcctctcccactcccagaaaggcacgaagctggaacatcttggcattcagatcactttcggcttcggtcaacgcagcctttgcattcaatgccgaaagttttaactggagaagttcattttccgaaatctgtcccatcttgcgtttagctatagccacttcgtaaagctgattggcattcgtcaagttctgacgggcggttccaagagtctccttcgccaacagcagatcaaaataataggtaatagcccgcatcgtcacttcttcggtagctgtgataaattccgctttcgcttcggcatatcgcacaggttctatacgcctgttccacttcacattattcacaccaagaataggttgggtcagttttaaagtaacaggaacggacatcagatggcgatcaccgctattacccagttgctttaggtagtcgagggaagaggttagtgaaagttgtccaccggtaagccagatattctggtcgatggaaagttcaccggaaagacctaaggcgctgttgcggacaaagctgtaagaaccgtccggattctgataggagccgtaagatttattgtaattaggcagtgttcctttcagattgatttccggaagaagatcggcacggaatgtgcgatattcccaataagatgttttcaactcattcaaggcaacggcagcgtcaacagactgcatacgcgccatagcgatagcttcgttcaaggtgatttccctctctttctgtgccgacactgccaaaggcagacagattgcagccagaacaaacaatatacttttctttttcattgtacacggtattttccagtcagatagaatcaaaccatgtgccaaaagaataatacatttactatcaatcggttagagaaatgtatcagtgttcattttcggacactatgcacagaaatgaacgttcagtcttattcgcagaaattcgggatacgtacagtaaagcgagttcccctgcctacttcggaagtcacaaagatcgttcctctcagacgttcgacaatcgtctggcagatactcaatccaagaccggctccctgtgtaaagttgtccaccttatagaatcgttcgaagatatgacggataccttcttcggaaatgccgactcccgtatcttccacaaagattcgggtatattcgggatcttcatcttcctcatatccgaaagtaatggaaccgtaagtcgtaaacttggcagcattattgatcagattattgacgacttgttggagacggacattatctgtcaccaggtattttttctcattatcgggcatacgaagcaacagttccactctcggaggcatattcagttgttgagaatcatgcactgtcttcagcagcagaggcaaattatgattggcaaacataaattccattgttcctgactcgatacgcgacagatcgagaatatcattaatcaatgcaagtaacaatccgcaattcttattgatcgttgctataaattgccctatttcctcttctgtaaagccgcttgtatcgctcaacaagtcggagaaaccgacaatagcattcagtggtgtacggatttcatgactcatattggcaaggaaagcagatttcagtttgtcagcctgaagtgccttatcacgcgcctccctcatttcctgttctgctgtcttataacgttggatactttggcatacacctaatatattatatagcgaatctctcgtcagaccggaaataacagaggaacggtattcccaccattcatattctccattggcattgcgctgacggaaattcaaacgggtattggtttcttttcccgccaatgttttatcaaagagaatacgcatttccttcaaatcctccggataaaccatacgatccatttcgtcgcgggtgatggaagtaatcgactcatcataaccaaaacgaacaagaaaaccttgcggaaagatgaaactattactctccacatcaaactgccaagggtaaatagaactttcctccacggccatgtcaaagaaacgtttctgcatttcttcatccgatacgttgcgtgccgaaagtgccataccggtaatctgcccgcctgaatgaatcggaacaacttccccggaaaccgggaaataatgttcgctatgtacttctttcataaaagccccatcgggaataatgacactctgcccagtctctcccaccttcttcaatatcttgtaaaggatatcctgaccgttatagtatattttgaaaatactgcccgccatcattccttcataattctgtccgcccgattctgagggtaaatgaaggatcttcagcagagaacggttggtaaagtgaatatgaagatcagtatcatatgtgatcacaccgtcgcgtatggaatggaagatattatcaaactcattccgctgttccaccagtttattctgcaccaacaagcgggtctgggcatgtatccgtcgcttagcttcacgacggttgacacgaatgagccacacgatagagacgatcaacaatgccaggatagatggataaagaagaataaacaataatttatatctttcccaatacggctgattaacaacactgccactggaggaaaccttatccgggtctatatgaaagaagtccagctgtttataatcgtaaataaatccctgttccgtctccgtcacacccagtttcaagggagattcccccttcaacactcgcgatgccttctttgcagcagacatcgcagaggtataggcgtctgcgtcatatgccgcaaatacaccgttcatcagccccacattctgactggagaagaccggtgctttggagttcttgcctacaaacgaaaggaacggtgaccatttgggagcaaccacaacccgagcataactattgcggggataacagatagccgcaataatatgattggttgattcatgctgggtattgtagagtttcatcttgtaatccggattctcttcctgaaaaagctgccattcttgtttgaagtcctcacgtcccttattactcagaaaactgttgtcaatcacacatatcacttctttccgttggggaaataccttttgtgcctgctttaagatcacataaaaatcgggattagcggtgaatccgcatacattgggaagactcgctataagttctttatcgggatatttgattccgaaaaacacaaccggaacttggtaaggcaacgaatcgccggaagagaaaagagtgtaaaaagcctcatcgctggctgtgataatcatatccgtctttctgtcacgggcacgctgacaaaaacgctgcataatcactttctccgaactgaatgaccaaaaatcggcatccaaatattcagtagtaatatttactttcagtccattctctttgaatcccttggtcagcccctcattcaggtcgttgtgccaaggggtttgcgaggtataagattgaataaaaagtatgttgtatgtatgttctgctgccgccgcccgggcaaaaacaacgaagaacaaaacaacaaacaaacagtaatattgtcggttcataagcaaaaaacagcattgttttcaacattttgcctacaaagataagttattatattgaaaacaatgcaaatagcttcagttttttattcctcgcgtaaggcttctgccggctgtatacggatcgcctgccgggcggggaaccaaatgcctatgagtatcatcaaagccatcaaaagacttgtcacacaaaaagtgataagaaaacgaatgatactccactctataccaccttccgtcagttccagataacctatattataacaaataattgcagcaggcaaagcagccagtgccagtagcaacaagccttctttattaagacgatgccagagtcccatgcgggtggaaccgactgcgacacgaagtccgagttctccacgacgatgctgggtacgaaaccagaatgtaccgactattcccaacaggatattcaccaacaaaaagcccatcatccaaaaccgcgtctgcatctgattgacattggtacgattataatcctcacgtatcatctcgtaatcgtgtaccttcagtataaaaagatttcccacactgaactgggtatccgactgttccatcagacgctccggaaagccgggagccgtattcggctttacacgcaggcaaacttccgtattgagcggatacaggtcatcattaatctcggccaattgtgcttccgtaagaggaatagccatatagcgatcgctgtaatttggccaaaaatcattgtaacgtaccttagtcgatacggcagctattttataaacgtctgtagaatcatccacattcacgacttcttttcccaacaacgtacggtcacccttataaccgtcaggccatatattctcgctgagaaccgcatttccgttttttatagcctgcattaaaggctgatatccctgtccatccgcactttgataacggaacacctgaaaaaactccggtgttaccggacgtctcaacggactgcgcaccagcgtatcaaggcgaaaacggatgccggaattacttcctatatacggacgtgcattcactgatatcgagacagcctctacttccggcaagcgacggagtcggttagtcagttcaacaatgtcctgtcccgtcgtcgtttccttctgccctctcggaatataagaatcactcttattgtttttcagactgagttccagatagtaagtattggtgatgtcatatcccagcggttcgtaataagtacgcgctgttgcatacgtccaatcgacaatataccacaacaccacgaaaacaatcagcaattctgcccacagccacccgttcgagcgacgttcgttccatatttgttttaacagttgcatcttcttaaaaattagtttgttgaatgtttcggttatctctcattgatggcatccacaatatttgtccgtgtcactctccatgccggaatagcagcactcaataaattaagtgcaaagcaggcaaaaaatgcgagcaagaacacaaccgggtcaaacagcagatccatacacatggtccgcaaatccgtcacaccattacccataaagtcaatggaaaacagcatacttcccaaaaagaaagttgcgccataactcagaattaatccgagcactccacccaacagtgaataaagcatattctcagaaagtacctgtatcatcagttcgcgtctgggcgcaccgaaagcttttcgaacaccgatttcagaaaggcgtttgcgcatacgcgacaatgtcagtccggaaaggttgacagcaggtacgatcaacagaatgattaacgttattatatactgacggacagcctgcttcacagccggaggattattggctgaatatcgttgcgccgccacaaaataagtatccggctggtcacgatagagcaattcataatccggataaccttccatatatctgtccctgagacgttcagcttccatacggattgccggaaagtcatcctgagatttagccagaatgtagacactcaccattcccataattccatattcaccccaactggcggtaaacgcatctgttgaacttaaaggaatccaaatctgggcataagcataccgtgccagtttggatacgggacgcacaactccacaaatcatataagcggagtgatttaaaaggaatgtttttccgactacatccgatgttccgaacaattgccgggctatatcctcagatattactgctttggttgcaccggcatcaaaagtagccttatcaaacggatatcccgaaaggaaatcgaacttaaatactttccagaaatcatcatccacctgcaatacactgcaactaaccttctctcccgctggcttggcagccagcatcgtttccgagaaactgctggttatagtaactgcttcaggggcagccatttctttaaaacaggctttcgctgtcttataagaaacaggtccgttactctgccagttctcgtttgttttatactgaaatcccgcatacctgaaaatcaacatacggtcacgatagctttccggagcaaagggtgcaatagtagcacgcaatgtgatcacaatcaccataatcatagcaatagccaatgccgtacctatgatagagatagaagaaagtaacttattctccttcaacaggtgaaatgcttgtttgaaatagagttttatcattgtaatctcattatcttctcattcattttcatacttatcagaatccccagcctttcgtgctcacatccgggcatttcaggcctttatgattgattctgcctactccgtcacgcttcagagaagctctgtctgccttgccggacaatttgatatttccgactccatccactttggctttcacagtattgcagtttacattgacattcatattccctaccccgtctaccattaattccaactcatcacaatggagctttttcacctcacagtttcccactccatcgagtttgaaagttacatttttcagtttcagggtttctttagcattgaagttgccgacaccatcgatctttacactcttcaaatcaggggctgtgatatagaacgtcaggttcttaacgttttttacattcttctgcttatattcgataaccaatgtttctccttttaccgttacttttgttttatcgacatattcaaaaggaccttccatccgacaggaataagtatcggactgagtgaaaataatgttacctaccgaccgcagattgatagcggaaaattcgcctactttacaatcttcactcacattttgtgcccaaagcgggcaaagggctacacttaataataccgcaacagcagttataaaaatattctttgtcatgattagcttttttagagtttaaaaggggattactgtacctgacggccatcgaagaaacggatagttcttgaagtctgtttcgcctgttcttcattatgcgtcaccataacgatagttcggccgtcttccttattcagccgatggagaagttccatgacttcggcacccatcttagaatccagattaccggtaggttcatcggccagaattatctccggatgaccgataattgcacgcgctatggccacacgctgacactgaccaccggaaagctgtgtcggaaagtgattcatacgatgactcaatccgactttttccagtacctccttcgccaaacgcttgcgttcaccgctgccgatacgacgatagagtaacggtaactcaacgttatccatcacattgagtgaattaatcagatggaaagactggaatacaaagcccagtgttttgttacggaaagccgccagttgcttatctttcattccctcagtgtgcgtaccgttaatttcaacagttcctgttgtgggtgcatcaagcagtcccataatattcaacaaagtagatttgccacatccggacggccccataatgcttagaaattctccgcggtctacggtcagattcacgttttccagtgctaccgtttcaatctcgtccgtacggtaaatcttagagagagaagtcaatgttatcataactataagtatttaatttagatcgtttttatctcattttcagcttattcttgttcttataagagctcatatcactgactaccactacatctcccggttgtaagccactcaccacttccacatattcaaagttggaatcgcccagctgtactttacgtttcaccagttcgtcatcagatgtccggacaaaaagatcatactcaccacgtcccacatagaaagaagcgtttgccatccgcatcacatcttcctttacggcattcatcacataaacgtccgttttcagtcccgaacgtaaacggtggttattatcgtctttcaactgcactgtaaaagaaatgactccgtttttagacaggggtgtcacactgctgaccgttccttccagtttgtcattgcctatcttcacaaccgctttccctccggcagctacccggtcaccgtaggtatcggctatttcaccttctactttaaaatggcttaagtctgagatgatggccacctgtccgccttgcgaaatctgagcaccgatctgattattaatgtaggtaagaatcgctttacgcggagaccgaatctgggcatcgtccagtgtacgcttcatttcggcaagacttttacggaagatattgaaatccagttcctgcactttcagttcggcagccgctacttctttttcgttcttatattgttgttggagctgttcgtattccagttgtgctacgttatagctcaattctgcctgacgcactttatctgttgttcccgctcccagactgtccagatagtgttcgttccgaagttccactttcatgcggctcaatttcatggcagagaccttaatctgcatcgccatatcggaaagtttcgtctgattattgacgcgaagctgatccagcttatagcagcgcatctgttcttcgtcaagcagttttttatattccgtttccgtgctctgaaggtcgagtttcagaatcggagtgccgatttccacactatcccctccttttctgtatacctcaacgatacgactgttaatgggagaattgatgatttcttcaaatgcagggactaccttaccggaggcgctgacactaacttcaatcattcccttatcaactgtagaaagtaccagatccttcttttccactcctgtccgcatgacagatataagtacaccgataacaactataccggccactcctatcgatgaataacggatgatctttttattgcgttctttgttacgcacttctttgggtatttctctgtccatatctaagtatttacaatttcactttcagttgttttaccttttattataccaaatctatgccaaaagcataatcaactgattaacagagaataataaaaaagagaaggtgtccgatatcggacaccttgtacgaatttaccgttcaaaaaaacatggtgtcactatactgttgttatagtgtcactatctccttgtaatagtgtcactataccgaccggatagtgacaccatcgcaaaacggtgctatactatttcttttgagtttggttgcggttcttgtttggccggttgcggctcctgcatgaggtctttcccccaatgggtagttgcctcaattgcttcccggtcacggatctctttcgccttgcgggcatagacaatcattctcatggactgatcataggtgaagtaattccatacccagttcaacaacaccactactttattgcgtactcccagaatagagcgcagatgtactaccagccacattacccaggcaaaccatccctgcatcttcaccttgctgaattccgccacggcacgattacgcccgacagtcgccatcgaccccaagttacgataatgaaaaggcttcatctcttttcctttttccaggcggatcagattctttgccagcaattccccttgttggatggcaacttgtgccagttgaggatgtccgttcggataatcttcgtcaccggaaagaatacataagtcaccaatggcaaatacattattcgttccttctacccgattgaaggcatctactttgatacggcctccacgaccgattacggacgtattcatattcccaaaagaaactccggtcactccacttacccaaataaaagtacgggtagcaatctcactgccgtcttcaagtgtcaccttatggtcacggtaatccgtgacacgcttatttaaaagaatgttgactcccatttcacggaggaactgttctgcatgactagatgagtcttcggacattccggcaagtagccgcgaacccgcttctatcagataaatatgcatcagactactgggcatatcgggataatcattcggcaatacaaatttcttcatttccgaaagtactcccgccacttccactcccgtggcaccaccacctacgacaacgatattcagcaactcctgctgttcttgtttgttggagcaggtcacagcacgctccaagttggcgagaagcgcatttctgagccccatagcttcggacacgtttttcattggcatggcctcctcttcgatatgtttattaccgaagaaattggtcgtcgtacctgcggcaagaaccagatagtcgtattccgccttccctatggaagtctgtatcatgttcttttcggggaaaacagcacgtacttccgccatacggaaataaaaatctttccgatgctggaatatcttgcggaaagggaaggaaatggaagtcggttccatacctgccgaggccacctgataaattaacggagggaactgatgatagttgttcttatctatcaacacaacttgaaagcctgattttttcagcttattagccaacttcaagccaccgaaaccaccgcctacaatgacgacccgtttcttactgtcctttgcaatatttagactcatatattaatcatgttttatcatacataataacacatgagtatggcataaagttttctaacgcagacgcaaacgatctcctacctccggaatatattctccgtccttacgattcatcttgtacagattcttgagacggataccatatttctgcgagatggcatgcatagaatcgccgtctttcacaatatatacagtatgaggcttggatgctttcttctttttactcttcagatagataatatctccgttcaccaaagtataatcacgctgcaagtcgttatacttcaccaacttcttccagctgatatcaaattccttacctaaatccttgaaagtatccccactacgggctacgatataggcgatatcattggcgatatacaccggatgcggactcagcagccacgggttctttcgcaacttgcgttccgagtagacacctttgctgtcatatttatacaggtcgtaatcttcgataatcgtaatcagtcgattggcataggaagggtctgtggcgtatcctgcctttttcaatccgcgtgcccatcctttgtaatcggtgatatcgagtttgaaaaggaaggcataacgggcacctcttttcagaaagtcggaatggtcttcgtacgattcgcggggatgcttgtaggcacggaagcattcattgcgggcatcgtcgtcatgacgtaccgaacgtccgcgccaactgccgccacacttaataccgaagtgattattactcttgcgtgccaactggctgtttccggctccgctttcaagcaatccctgtgccagagtgatgcttgcgggaattttgtgaagcttcatctgctccacagccaagtcactatacttatttatatattctacataacgtgcattccgtctttgtgcctgtactcctacggcaaagaagataatggcagttagaaagactagtctatacaatttgttctccattttaacttatatgtggattatcggacacaaaaatctgaaaaataattgggattatcaatctcttttctaactttgtaacattaataatgtagaactaacctatttaccgatatgaaggacctcacaattaccgctataatcaaagtatatcaatacgatgaactgaacgaagctgaccggtcattaatgaaaacagccatggaagcaaccgcccgcagttatgctccttattcgcatttctcggtaggcgccgccgcactgctgaacaacggaaccattgtgacgggaaccaatcaggagaacgcagcttacccgtcgggactttgtgcggaacgtactaccctgttctatgccaactcgcagtatcccgaccaaccggtaaatactctcgctatcgcagcaagaaccgaaaaggactttatagaaactcctattcctccttgtggcgcctgccgccaagtgattctggaaacggaaaaacgatacggccagcctatccgcattctgctatacggcagagaatgtatctacgaagtaaaaagtatcggcgatttactaccgctgtcatttgacgcatcagccatggaggaataaattatgttacaacagtatcacaccaaactaaaaggaacactcgctctcacagattcttatctgacagagaaagctttgcaaaaagaaaaaggactctataagtttatatgggtccgccaaggaagcattacagtagaaatcgaccatcaggagatggtactttcaaaagatgacgttatctcactgactcatctgcagcatcttgaatttaagtccatagatggtgaatatatgactttgctgttcaacagcaacttctattgtatctatggaaacgaccacgaagtgtcgtgcagcggcttccttttcaacggctcgtcccaccttgtccgctttacactgaacgaagaagaacgccggcaactggaccagattaccgaagccatggaaaacgagttcaccgtttccgacagcctgcaggaagaaatgctgcgtatcctgctgaagcgtttcatcatccaatgcacccgaatcgcccgtcagcgactggatatcacgcgcgaaaaggaatccggcttcgagattgtccgccaatactacaacctagtagacgagcattaccggaccaaaaagcaggtacaggactatgccgatatgcttcacaagtcaccgaagacactttcgaacatattctcaacatgtaaactgccttctccgctaagggtcatccacgaacgggtggaagcggaagccaaacgcctcctgctctacagcaataagagcgcgaaagaaattgccgatatcctgggatttgaagaccaggcttctttcagccgttttttcaaaaacatgacaggacagagtgccgtacagttcagaaatacggaagttgggaagaattgataagtgaagcggaagtattgccatttcgggggtatgcagaaagcacgacctttgcggtataaagttaaacccataaaaagaccgcaaaatgaaagagaaatttattgctttgcttaccttcacttccagcttgaagaatttcggaattaagtttatccgtgtagctatcttagtcgtattcgtatggatcggtggactgaaatatttccactacgaagccgacggaattgttccttttgtagccaacagtcccttcatgagcttcttctatgcgaaagatgctcctgaatacaaagaccacaaaaatccggaaggagccttcgttccggaaaaccgcgcctggcacgaagccaatcgcacttatactttctcctatggattaggagcgctcatcatgagtatcggtattctggtattcctgggcattttcttcccgaaagtagcgctggtaggtgatacgctcgccatcattatgacgttgggtacactatccttccttgtcaccacgcccgaagtctgggttccgaatctgggtggagatgaatttggcttcccgctattgtccggtgccggaagactggttatcaaagatatcgttattctcgcaggagccgtagtgcttctttcagactcgtcacaacgcgtactcaaaacactgaaaaaaagctgattctgtccgctacggacacctttgcttcccggatatgacgcaaaacaaatatactcttcatgtgttataatagctgagtataaatcgttaatgaaaggaagttatgaaacaatatgatgcaattattatagggttcggcaaggcaggaaaaacactggctgccgaactttccaacagaggatggcaggtcgctgtcgtcgaacagtccgatgaaatgtacggaggggcttgccctaacgtagcctgtataccaaccaaaactttgattcacgaatcagagatttccaccctgctttatcacaatgattttgataagcagagtaacatgtataggcaggcgattgccagaaaaaacaaacttacctcttttttaagagaaaataactacgagaaattaagcaaacgccctaatgtgactatttacacaggtaaagggtctctcgtttcagccaatacggtgaaggttgctcttcccgaagaagaaatcgaactgcagggaaaagagatttttatcaataccggctctacacctattattcccagtatagagggtattcagcaaagtcgaaatgtgtacaccagtaccactcttctggaattggatattctgccaaagcacctgattattgtaggcggaggctatatcggactggagtttgcttcgatgtacgccggcttcggaagtaaagtgactcttctcgaagcaggaaacagattcatgccccgcaatgattcggatattgcgaaaagcgttcgggaagtgatggagaagaaaggagtcgagattcgtctgaatgtccgtactcaatcgatccatgatacgcacgacggggtaactctgacttattcggatacttcggacggcactccttactttgtagacggtgatgcgatccttattgccacaggccgcaaaccaatgattgaaggactgaacctgcaagcagccggtgtagaagtcgatgcgcacggggcaattgtagtcaatgaccaattacataccaatgcccctcatatatgggcaatgggagatgtaaaaggaggagcgcaatttacctatgtctcactggatgattttcgtattatccgggatcagcttttcggggacaagaaacgtgacatcaacgacagggatcctctgccttatgctgtatttatcgatccgccattggcacatatcggaattacggaagaggaggcactgagaaaagggtattcttttaaagtctcccgactgccggcaacctccgttgtccgttcgcgtaccttgcaacagactgatgggatgctaaaggctattatcaatagccatagcggtaagattatgggatgtaccatgttctgtaccgatgctccggaactgatcaatatggttgcaatggctatgaagacgggacagacttctacgttcctgcgtgacttcatcttcacacatccgagtatgagcgaggggttgaatcaattatttgacgtataatgtaaagggagggactaaaacgtgcaggaatacgttaataaccttattatgtctttccactaatctgagcctatttttatggcaataacagttatccccagtcgcacatttgagtaatacttagatgtacgactggggaaaatgatttatgcaagaaaaacaagaaagaccggcattaaacactcaaatgaatcaaatactcatatctatcatttaaaacagactcaaaacagagcctctgaatcgagtaaacagagcctctgaatggactaaacaaagcctctgattcaaccgaacagaacctctgaaatacatcttttttagctaaaaaacggtgatatataaaagaaagtactatctttgcacccaagttaaactatatacttaccacaatgagaatttctaagtaagacaacacttctagtaaacatcacttttcatccatgctttttctttatcgttaagcatcacgaaattcgtgttgtttagccagtattgtgtttgtcgttcccttgtcccgtgattatcctcacccagttttcaacctcaaacccaatagaccatcatgcctattagtattcaacaaatcagctatatccatccggataaagaagtattattcagtgaccttaactttgccatcagtaaagggcagaagttaggattagtcggcaacaacggctgtggcaaatctaccctgctgcaaattattgccggacaattagcaccctcttccggcgtcatcgtccgaccggacgacctctattatattccccaacatttcgggcaatatgattcgttgaccatcgcgcaagccttacagatagaccataagcagaaagcactacatgctatccttgcgggagatgcctcaatcgaaaatttcagcatattgaacgacgactggaatatagaagaacgttccgtcgccgccctcgattcgtggggattgggccaattcccactatcctacccaatgaatctgctcagcggaggagaaaagacacgcgtattcctcgcaggtatggacattcataatccatccgtcatactgatggatgaaccgaccaatcatctcgattcgtcaggcagacaacgtctgtatgactgggtggaaaaatggcgttccacgctgttggtagtaagccatgaccgtacactgctgaatcttcttcccgaaatatgtgaactggaaaagcatcagatcagctattacggtggaaactatgaattttacaaagaacaaaaaacactgatgcaagaagccctgcaacaacgcatcgaagaaaaagaaaaagcgctccgcaccgcccgcaaggtagcccgcgaaacagctgaacggagggataaacagaatgtacgtggtgaaaaaagaaacctgaaaaaaggtgttccgcgtattgtactgaacggtttgcaaagcaaatcggaaaagagcactgccaaactaaccggtgcccatcaggagaaagccgagaagttaactgacgagcgtaaccaactccgaagttcactctcgccgacagctgcactaaagactgactttaacaattccggacttcataccggtaaaatactggttacggcagaggagattaacttcggttatcatcccgatcagccacaactttggcaagctcctctcagcttccagctgaaaagcggggaccgccttcgtatagaaggaggcaacggcagcggaaaaacaactctgctgaaaatcataaccggacaacttcaaccactgaaaggcacgctcatacaggcaaatttcacctatgtatatctgaatcaggaatattcgatcatcaatgatcgaaacagtattttggaacaagcctatgccttcaatggccgcaacctgccggagcacgaaataaagattattctgaaccgatatttatttccggcttccgaatgggataaatcttgccggaagctaagcggcggagagaaaatgagacttgccttttgttgcctgatgatcagtaataatatgcccgatatgtttatactggacgaaccgaccaataacctggatatacaaagcatcgaaattattaccgctaccatcaaaaactatgcaggtactgtgatagccatctcacacgataattatttcattcaggagattggagtggaacaaagtatatttttaagttaatctattcatattttatccggtaaaccctacatatatcgatacagtttttataacttcgcagcgcgaagaaaatagaaaaatataaaatgaatcaaacagctgaatccctgtggtttgtcttttacaaagacgaactactacttgaaaaggaggggaacggtacatttgccattccctgcggagaaattcctcctatcctgatcaaagacaagactacagtacacaatatcaccacactggaaggaagaaactgcaaagcttattccgtatcccaacctattgaagagacagagcaatatgcaatgatagggcttcgcgcttcttacgaataccttccgctgggacattatcaggcagcaggcaaagcccacgaaatactgcattgggacagaaacagtctgttctgctcggcttgcggcactccgatggaacaaaaggaatctatcatgaaacgctgtccgaactgtggccgtgaagtgtatccggctatctcgacagccatccttgttttagtgcgcaaaggcgactccatacttctcgttcatgcccgcaactttaaaggcagattcaacagccttgtagccggattcctcgaaacaggcgaaacactggaagaatgtgtagcccgcgaagtgaaagaggaaaccggactggacgtgaagaatatcacttatttcggcaaccagccctggccctaccccagcggattaatggtaggattcattgccgattatgccggaggagaaatcaaattgcaagaagaggaattaagctccggtgatttctatacaagagataatttgccggaacttccacgaaagttgagcctggcacggaaaatgatcgactggtggctggaatgctcccataaataaacagacatggagaacatcatcaaaggaatccgccgatattatccggtatctgacagctcactggaaatgcttttcagccacatgaaaaagctggaattgccaaagaaacacttactgatacacggcggagtatcagatcgtcacgtctactttattgagaaaggattttgccgctcctattgcctgcgtgacggtgaagaaatcacgatctggttctcacgcgaaggcgatatcacttttgcgatgaaagacttataccacaaccaaccgggatacgaatatgtagagttactggaagattgcgaactatatgccatacgcattgatgaattaaatcagatttatgaaacaaatatcgaaattgccaactggggacgcattatccatcaggaatgtctgctctacatggacatacaccacataaaccgactatacctaccggccaaagaacgctacgaacaacttctacgcgaacagccggatgtaattcaccgtgcccaactgggatatatagcttcctttcttgggatgactccacaacatttaagccgcctgcgctccgaatcctgagttctttttaatctatgtgaatttttatatcacagaaaaactgtacttttacagccgaatacaaaaaagaaacagataaacatcgtgatcaacacattaacatctttacgaatattctttgccttgatggtattcggagcacattgctatgttctggatacaagtttcgatgcccacttctttaaagaaggatttgtcggagtcagtttcttttttgtcctcagcgggtttattattgcctacaattatcaggaaaaactactgacaaaaacgactactaaacgcacgttctgggtagcacgtattgcccgcatttatcccctgcatctacttacactattaattgccgcatgtataggaggatatgttcaatatagcgatacgacggactggatcaaacactttgtcgcctctacctttctgttacagcccttcttcccctctgccgattattttttctctttcaacagtccttcatggagcttggggtgcgaacagttattttatttctgctttcctttcgtgattcctttcttaagcagcaggcgaaaactattggttgtactctcaatctgtcttccggtcatgctggcaggtatgtatctgactgccgacgaacaaatcaaagcatattggtatgtcaatcccatcacccgcctgccggatttttttgtgggagtattactttatcagatctatcagtcattacacaataaaaaaatttcttcctccacgggaacattgttggaagtagcatccgtcgctttatttcttcttttttatctttgtgccgcagatatacctaaagtataccgttattcttgctattactggttacctgtttctctgatgatactcatctttgccttccagaagggaggtatatcccggctattatccaatcggtttctgataataggtggagaaatcagctatagtttctacctgatacatttgtttattatactcacatatacgaaaatggcagcgctctatcaatggcaggtgtcatggatgatcagtgttcccctcattttcggtatcaccattatacttagtttactttcttactattatttcgaaaagcccgccaataaatgggtaaaacgaatactaactaaaaaacaatcataaatcaaccccatggaattattaaaaaagacaccacgaattgaagtagtagatgccctcagaggatttgcagttatggccatcctcttggtacataatctggaacatttcattttccccgtttatccggaaagttctcccgaatggcttagcattttagatgccggagtgtttaatgcagtattttcactgttcgccggaaaatcttatgccatattcgcactgcttttcggatttactttctatatccaatcgcataatcagcagttgaaaggcaaagatttcggctaccgttttttatggagactggttttacttgccggttttgccactcttaacgcggctttctttccggctggagatgttttgcttctgtttgttgttgtcggtatcatattatttattgtacgcaaatggagcgataaggctattttaatcaccgctatcttattttcattacagcctattgaatggttccattatataatgagtctgttcaatcctgcctacaccctgcccgatctgaatgtcggagccatgtatagcgaagtggcagattacaccaaaaacggaactttttgggaattcctcattggcaacgtcacattaggacagaaagcgagcttattctgggccattggtgccggacgcttcttacagactgccggacttttcctgttcggtctgtacatcggacgcaaagaactgttcgtcacttccgagtctcatctaaaattctggaccaaagcactgatcattgcagctatcagtttcgctccgctttactctttgaaagagcagatcatgcaaagtgacagcagcctgattcaacagaccgtagggacagctttcgatatgtggcagaaattcgcatttaccatcgtactgattgcttccttcatcttactttatcagaaggctaagttccagaaaaccgtttccaacctgcgcttttacggaaaaatgagtctgactaactacatcacacaatctattatgggagctatcatctacttcccattcggattttatctagctccctattgcggatatacgctcagtctgattatcggaatcattctgttcctattgcaggtacagttctgtaaatggtggctgtcgaagcacaaacaaggaccattggaaaccatctggcacaaatggacttggttgggagctaagaaataatgaagaaagcaggccacgaagtacacacaaactacaaacgaacaacttatgaaaatgaaacgttacgtatcactctaaagcatcaacaaaaccgtgtatccccgtagcctgcatgtttaaattgagatgatttagatagaacaagatttccataagaaggattagcaagggaacttaaagaatgcaaaggaaatgaaagaccgatgaaaaggcggttacataaaagaaacgcctccataatcttcgagactatggaggcgttatttattatttctctattctgaaatatcagaagaagaacggaatcaaatacctaatgacttcttcactgcttcaatcttttccattgcagcagcatcagcagaagcgaaacagttgcgacaacccatttctccttgtacttccatatagaatttgatcttcggttctgttcccgacgggcgaactgaaactttgcttccatcttcagtgaagtattggagcacattagatgtttccggcatatcaaggtcagtcaccttgccttctgcatctgtctgtttcagcgtcttatagtctttgctcaaaatcaccttggagccacccagttctttcggaggattagcacggaagttttccatcatagctttgatttcttcagcaccgctcttgcccggtttcactacgttcactgtgaattctttggagaatccatattctacgtagatatccagcaacaactggtacaatgacttaccgttatcttttgcccatgcagctacttctgcaatcagacagcaagctgatacggcatctttatcacgtacgaagtcttcggcaaggaagccgtaactctcttcaccaccaccgatatatttctttttgccttcacgcagacggatttcacgtgcgatccacttgaatccggtgtagcagtcgagcatttcgatgttattcttatcagcaatcttcttgataagttcggtagtaacgatagtcttcacacagaactcattacccttgatcttacccaattgtttgtactgagtcagaatatagtaaagatacatcatacaagtctggttaccgttgatcagtacccattctcccttgtcgtccttgcaggcgatacctacacggtcggcatccggatcggaagccatcacaagatcggcatcaatttctttagccagattgacagccatagaaagcgcttcggcattttccggattcggagatattactgtcgggaagttaccgtctttgatcatctgttcgggaacagtaaatacattttcgaatccccacatcttcaaagcgcgcggaatcaacatcatacctgtaccgtgaatcggagtataaacgatcttcatatccttatgacgggcgatagcttccggatcaatagaaactgtcttcaccatatcgaggtaaatcttgtcaatatcttcaccgatgatctgaatcagatccgggttccccttgaacttgatatcagcagcggaagcgatattattcacttcatcaatgataccagcatcgtgcggagccagtacttgcgcaccatcatcccagtatgctttgtaaccgttgtattctttcggattgtgagaagcagtcaggataataccgctctggcaaccgaggtgacggattgcgaaagacatctccggagtcggacgcatatcatcaaacagatatactttgatgccattagctgagaaaatgttggctgaagtttcagcgaacagacggctgttgttacgacagtcgtgaccaaccactacagaaatctgaggcagatctttgaagttcttcttcagatagttggaaaggccctgtgtagcagcacctaccgtatagatattcatgcggttgctacctactcccatgataccacgcaaaccacccgttccaaattcaagatctttgtagaatgcttcgatcaattcggttttatcttcgttctccaacatgcgtttcacttcagcctgagtttcggcatcataagccggggtcagccatttttcggctttctcagtgacctgcttgataagttcctgattttccatttcgattattgtttattggttaatgattatttctctattctctgtcaatccttgaatatatgccaagtcttgagcacacaaatgtaaaagaataagtttataaatcctagttatttaatgaataattgacaactatttcaccaaatatctctctcctgtctgcttcacatattcctccagaaactccttcggatatcccggacgaatgacaccggcaggctgtccgatagaattccgttcaaattgtccgtccttcacgcgcttcactactccgtcgttgtacttcacaatcaggaaagtgcccagttgcttccaagtatcaaaagtactctgggcggtcatattagtatagttagtcaggaaagcgattgcggcattcttatcttttgccagcaatttggcagccatttcttcaataccttcctgcgcattattaaaggtcgtttccatctctttctgagttgcacgcacgtcaccgatcatcagatcataacgtggatagaccatattagacacccagttgaaaatccagaaagcggaattccaggagaaagtgatgtaatctgcgccatctacacgtgtatagcataacggagctttcgtcgtacagcaataaacaggagtaaatacggccatattcgcatcgtccactccaaaccaaagaactccgcctatggggtccggcttgttggcacgcatttgtgcaacaaatacgaagccactttgttgagtcgaaatcggacgttcgttaaaatactccttatcacctaccttgaaattcagtggagaaaggcggtacggggttttataaggaccggcaccgaaatcattggaaatatcaagcggtgttccttcgtagtggtcacgcatcatatctttcacgtcctgtacggaaagtttacggttcggctttacgaaaagaggcatcggagtatctgtctttccttcgatataaggaagatagtcatttccatggtcagtatatttattgaaatagctccacacacgggcttcgcagaagcgacgggcaccgaaatcaaggggcgcataagcctcagcaaagctgaaatccttgttcactccattgaagtaacctttctcgcgagcgaaggaaatcacatccggagaagtgatacagttttctttgtcgttcatgtcaaactgatgaatacgggattgattggcatgagccgaaatacagtcatccggtacacgtacagccacccagacggcaccacgtacccccggccccttaccgatcatttccataatccagatttcattcggatcggcaatcgtaaacgattcccctccactataatagccatattgctgtaccaaatcagtcatgatacggatcgcctcgcgagcagaacgtgaacgttgcaatccgatataaatcagacttccgtagtcgatgattccggtagaatctgccagttccggacgtccgccgaaggtggtttcaccgatagtcacttgaaattcattcatattgccagtcacattataagtctggcgtgcctgttcgatttcgcccaaatacttacccgtatcccattcatagactttcaacatcgtccctttgggatatgtagcagccggataatgataaagctcaccaaacaggccatacgagtcggccgaataggaaacaatagtcgaaccgtcagtcgaagcatttttgccgacaatcaggttcgtacaagcgaaagaattcgccaaagccgccaaaaacaggacagcagatagaatgattcttttcttcatatataatacattttaatagtttaccaaacaaaggtttccttcgaaacggtctgatttccacaagcatccgtgacagtcatttctacggtatgcttgccgcctttcttcacatgtttcgggtcaagcacacattcccagtaagactttacaatattgggacgaccgaaaagtgcatattcaccgtcaatcgttccccgataggaagcgatacctgctccttcatctttcagccgatagacaatctttccgtttcgtccccacaagttcttgttaacaggtataatttccggaggaacagtgtccaaagcaaccgtatatgtgcccagttcacgaatagatgctttcataaatccatcttcgtacttccctcctacgctgtatttagtccctttaggggtcactcgcgccacgtaatatttcgtagtgtccgccactggtttgcgccgcaatccgattcgcaattcacagcttgcatgtagcgggaccggcttatcattcaactgataggtaaatgcgaccgctccgctatccgcttttatctgatattgaagaggtacattatcatatagcattcccttcggaacaaccagactcaaccccggttcctgcagataattcgtcttatcccaggcaaagaagtatttttcccgatgattcaatggttcaatcggctgtttcttgccacgtaccgtaaagtgatagcgggaagtattgccaaaagcatctttcaatgtatattgaaactgataatcccgttcttcgtcaatcgttaccaaaccacggttatcgttcgaggctttcaacaaccgtaatgtatttccgggatcaataaaggatttcatgtactgcccatacgtccaggagtttatcattcggttttcttcctgcgaaaagcggtctacggtgctacggaacacttctgtaccatctactgtaagtactacggaatacactccataatgattatttaccccgtccatgtagtcatacgctttgatacctgtgccgattaccccccatgcttccaccggatgttcactgttcggcagaatcgttttattttcctgacttccactgaccactcctttgccaagctgcggaaaaagcatgattccatccgctttcggggcacgtgtatctttcagattctttttaaagaaaggcataggatcgatatagtctcccgtctccgtctcgaacacatccagatgaagatgcggtccgaatgagtatccggtattcccactcaacgcaatccgctgtccggctttcaccggatattcatcgggttcggggatgatttctacttcccagttctcattttcatattgaagtttctttaccctttcggcaataggagacagaaaagcgctcaaatggcggttgatagtggaatagccgttgtgatagcagacgtcaagcacataccccgaaccattggtaacacgtatacgtgagatatacccgtcagcaagtgcccgaaccggtttgccgattgttcctcccgtcttaaaatctaatccgccatgaaagtgattggaacgaatttctccgaagtttccactcaatgtaaggggaaagtcgaaaggtggcacaaaggcagcctgctttttttcctgtgcatacccctccacgcaacaggccaataataaagcagcaatatatcttttcattatcttcttcacttttttactcctgcaaatgtacattattccaactagattacgaaatatccgggaagaatgatagcagatgaacctagttaataattccttttattattatattcgcaactaaactgtaatcattatattattaatattattacttttgcggctgtttttaataataattaaaagtaaaaggacttaatgagaatgtatgtaaaggtaatggcagcggtcattgcatgtatattgctgagtggagaagcgtactcagcacttgcaactacccctgctacagaaaatctgagttggttcaaaaagaaaaagaaaaaaaattcagaagaagagagagtaaaaagcgactacgagaaattagtggaaggcagcagtgttaaaaaagggatgtttgccgtttatcaaaaaaagaacgattattattttgaggttcccacatcattgctagggcgcgatttacttgttgtcaacaagttacaacgagtaccggctgaattgaacgatgctggagtaaaccggggtgtaaattatgaaaatcaaatgatttgcatggaatgggacaaagcaaccgggaaactgatgttccgccaacaacgcccgttacctctggctcctcagacggatgctattttccgttcggttaaggacaattttatatcaccgcttattgccgcattcaagatagaggctgtcaatcaggactctacagcattggtgatcaagatcaacgacatctatgacggtacggaaaccagcattaataatgtatttaccaatatcaatctgggaacatcggctattaaaaatctatcacgtatcttatccgtgaaatcctttccgaacaatgtagttgccacttccgagctaactactaaagtgacggaaggaacaacaagcgtatatgtaacggtagaagtcagttcttctatccttctgctacctgaaactccaatgatgggacgttttgataatcagaaaataggttatttcaccaatccgctattgagtttcagcgatgcacagcaaagaacggataaaaagcagtttatcacccgttggcgtatggaacccaaaccggaagaccgggaggcttacctgaaaggaaaggtggtagaacccgccaaaccaatcgtattctatattgacaattccacaccttatcaatggcgcaaatatataaaaagaggtattgaagactggcagatcgcttttgaaaaagccggattcaagaatgcaatcatcgccattgaagttaccgatagtatggaaatagatatggatgacgtgaactattccgtactgacctacgcagcttcagaaaagaagaatgcgatgggaccttctttgttagacccccgttccggagagattctggaagcagacatcatgtggtggcacaatgtgctctctatggtaagcgaatggattacagtacagaccggaactgtttgcccggaagcacgcagcgtgcagttgccggattcactattgggtgatgctatccgctttgttgcctgccacgaggtagggcactctttgggattgcgtcacaacatgatgggatcggcagcgttcccaactgattccttacgttccgcaacgttcacttcccgattaaattccaccgcttcttctattatggactatgcccgcttcaactacatagcccaaccgggagatggcgtgaaggttctttccccgcatatcggtccttacgatatctttgccatcgaatatggatatcgctggtacggaaaaaatagtccggaagaagaaaaagatatcttatttgatttcctgagcaagcataccgaccgtctttataaatatagtgaagcacaggatgtacgtgatgccgttgatccacgtgcacagaatgaagatttaggcgatgatcccgtacgttcttccttacttggcattgacaacctgaaacgcatcgttccgcaaatccttcaatggactactaccggagaaaaagggcagacttacgaagaagcctcacgcctctattacgcaattatcaatcaatggaacaactatctgtatcacgtactggccaacattggtggcatctatatcgaaaatacagtcataggagatggtgtacagacctacacattcgttgagaaagagaagcaacaggcttccttgaagtttctgacagatgaagtactgacttatcctaaatggttgttcgatacggaagtaggaaaatatacctatttgctccgtaacaccccggttggacaacaagaaaacgccccgacgcagatactgaagaatgcacaagcctacatcctttgggacttgcttggcaacacccgtctgatgcgtatgattgaaaatgaatcagtcaatggaaaaaaagcgtttaccgtagtggaactaatggacggactccacaagaatattttcggcattaccgaacgaggaggtattcccaatgtgatggaacgctctttgcaaaaaaactttctggatgcattactcacagctgccgcagagcccgaagctgtgaaaatcaataaaaagattgcagacgatcatttcttgctcgatcatgccactcctttctgcagctgctatgcggccgaacaacgttcgctccgacaggaagataaaatgggagctcaccgagttctcaacttctacggcagccaactgaatcgtatctcggatgcaatatccgtgaaacgcggagagttactgcggattaagaaattattgcagagccgcctcggaacgtctgatacagcaacacgttatcattacgaagatatgattttacgtatcaatacagctttaggtattaaataattcgattcaatcacttacgtttatttacaattaatgaataaaaaacatctttgcattattatatgcttccttgttaacgcactggcaatggccagtgcggctaatcgcactatcaccggggtagtaatctccggtgaagataacgaaccgttgattggtgcttcggtctacgttcatacggatgaactgaaaaaggcaggagcatcccagacatcgctaggtactattacagatatcgatggtaaattctctctttccgttccggataaagtaacccgtattcattgtagctacatcggatttgaagaacaagttatagttcttcagggcgacaaaaaaagctaccgaatcgtacttcaaacttcagcacatacattgggagatgtagttgtaacaggatatcaaaccctagaacgtagaaaattaacagctgcgatctctaaagttgaagtttcggatgctatggtaggtgctgcaaaaagtattgaccaggcgctgacaggtcaaatagccggtgtatccgtaacaaacacttccggtgcaccaggatcacctgccaaaattcgtattcgtggtactgcatcaatgaacggaacacaagacccattgtgggtactggatggaattcctctggaaggaacagatattcccaaaatggacaataaatcttctgataatgatattgtcaacatcggtcaatcatcaatcgccggattaagtccaaacgatatcgaaagcattaccatactgaaagatgcagcagcaaccgccatttatggtgctcgcgctgctaatggtgtaattgtagttactacaaaaagaggtaaaacaggaaagcctgttgtcaattttaatacaaaattaacctatactcctaatttggagacctcccgccttaatctcctaaattctgaggaaaaagtaaacttggaacttcaaatgatgaaagaagcacctttcaataaatggggattttatccgatacctgtatattcagaaaaaggaggagtagcggctatattaaaacaatacaatctaatggatatttatcgggagaaaggctgggaagggcttactcctgaagctcaaaacgcaatcaaccgtttaaaaagtattaatactgattggaatgatatactattcagagatgccattactcaagaatataatatcagcatttccggaggtagcgaaaaggtgacttattataactcccttggctacactctcgaaaacgggaatattccgggagtaagcttaagtcgttttaatctgacgagcaaaacttcttatcaaatcaataaattactgaaagtaggtgtttctatttttgcaaatagacgtaaaaacaccacttttctgacagatacctatgggcttactaaccctgtctattattcccgtattgccaatccttatttcgaaccattcgacaataataacaattacctgtatgattacgatgtcgtaacaggtagcatacccgatcttttacaaggatataatattctggaagaacgtgaaaataccagtaataaatcagttactaccgctattaatagtattttcgatatagaacttcgctttaacgaccagtggaaagttacttcacaagtcggtgtacaatgggatcaactatcccgggaagaatatgccggtactaacagtttcaatctgcgtaaccaacgtgaaaactctgcatattacaaaggaaacgaccgtatatatctcataccggaaggcgggatgctcaaatcgaccaattctacgacttcccaaattacatggaaagttcagggtgaatacaagaacacattcaatgacatccacaatatacaaataatggcgggatcagaaatccgtaaaaattggtacgaaaatcaagcatctaccggatatggatatgacccaaaaacattaacgttcaaaaacctagaattcagagattccaaacaagccaatgaatggaaattaaagaccaaaagttttaaggaaaatgcttttgcgtctttctacgccaatggttcttacacactgatggattgctacactctgggaggtagcgtccgcatggatggctccgatctcttcggtgtagataaaaaatatcgttatttacctatttactcagtcagtggactgtggcgtatctcaaacgaaccgttaattaatcagttcaaatggattgataaccttgctctccgtttgtcttatggtttacaagggaacattgacaaaaacacttcaccctttatcgttggtacttatggaaatataagtatcttgcccggttcaaatgaagagagcatcactatcaatagtgctccgaacagtaaattacgctgggaaaaaacagcctcttataataccggaatagatttctctgtatttaatcaggctatcaacctaagtgtagactattattacagaaaaggcaccgatctcattggtaacaaaatgctaccattggaaaatggatttaccagtatggctgtcaactgggcaagtatgaagaatcaaggtatcgaaataaacttgcaaacacgtaacattgcaactaaagatttctcatggtatacttcatttaactttgcatacaacaaaaataaggttttgaaagtgatgactgaaaaggatcaagtaactccaagtctggaagggtatccggttggcgctattttcaccctaaaaaccaaagggataaaatcagagacaggacagatatacattgaaaataaagatggagaagctgtcactattgaggagctattccaaatggcagacaaaggaaatttagacggagaatacagcattggcgtagataaagaaacagagagaggtttttatagttatgccggaacgtccgatgctccctacaccggaggattcatgaatacatttaattaccgtaactgggaactgaacttaaatttctcctataacttaggtgcacatgtaaaaacagatcctacttattacatagcagatcccgatccgggacgcaatatgaatagagatatattggatagatggacgccagaaaataaaaacggaaagtttcctgcattaactagcctaaatactaatccggctgactattatttattcagcactcggagagatctctacaaatcgctggatatatgggtcaaaaagttaagttacatacgtttacagaacatacgcctggcctatcattttccttccgagtggctgcataaactaaacatcggtggagcaactgtaggtttggaagcacgaaatctctttgtttttggttccagttacaaaaactacatggatccggagtcaatgagcaatctttattcaacgccggttcctaaatcagttactttcaatctaagtcttaacttttaaacaagaaaaatatatatgatcaaaaaaatatatttcataatggttgtcataggaagcatcctgctatcttcatgtgacagctacctggatattcaacctgtaggacaagtaatccctactacactaacagaatatcgtgctttactgactaccgcttacggactaaaactcatcgacaaatccgtcactgaatttcgcacagacatagctatggtaacagataacagtaattctcaaaatttctactcagagattgaaaagtggaatgatatgagtcccaaagatggaacccgggaatttggctgggcagtatattatagtgtgatttattatgcaaatgctataatagcaaataaagataatataaaagaaggcagtcaggaagacattgatcaactcgttggagaagcttatttattaagaggttacatgcactttattcttgctaacctatatggacaaccttatactaaagagggagcaccagagaccaaatccattcccataaaatgggaccttgatctagaagtggtactgccacgaaacaccgtaaaagaggtctatactgctattctatccgacatagaatcggcccgcggcttaatgcatcaaaaagaatgggaagccgtatatgcttaccgcttctccaccctatctgtggatgcaatggaatcacgtgtacgcctgtacatgggaaactggaaagaagcctatgatgcggcagaacgcatattagttcaaaaatccacattagaagacctcaatgatccggaagccaaacttcccaataattatacatcagcagaaatgattactgcttatgagtttttcaatgatgacgttacttcagcatccatattgatacctgcgttcatggaaaaatatgatgctaataaggatctccgccggaacaaatactatagtttaagtggagataagtacatctcgaaaaaaagcggaaaagcagagcataactgtactttccgtacaggagaaatttatttgaacgctgccgaagcagctgcacaaatgaataaattgcccgaagctcgtacccgcctgctacaattgatggaaaagcgatacactccggaaggttatgcagaaaagaaaaaagctgtggacgctatgaatcaagcagatttaattaaagaaattctggaagaacgggctcttgaacttgctttcgaaggtcatcgttggttcgatctacgtcgtaccacccgtccacgaattgaaaaagtgttgaacggacaagcttatctattagaacaagatgattcacgttatacactacgcattccacaaagtgctattgctgcaaatccgggtttattaaattgaccgaattatatataagcattctgctcttaaacatccccttgcgaataacaacgtaaggggatttttcgtacattggtccatgttaaacctttaatatataacaatatgatcatcggagtacccaaagaaatcaagaacaacgagaaccgggtaggcatgacaccttccggagttgccgaagttgtgaagcaaggtcaccaagtatatatccagcatacggcaggtatcaatagtggttttccggatgaagcatatctgtctgtcggtgcacaggtgcttccgacaatagaagatgtctatgccacagcagatatgattgtaaaggttaaagagcctatcgcgcccgaataccatctgatcagaaaaggacagttattgttcacttacttccattttgcttccgataaggaactgactcttgccatgattgacaataagtcgatctgtctggcatacgaaactgtagaaaaggaagaccattcattacccctgcttatccctatgagtgaggtagccggacgcatgtccattcaggaaggagcacgctttttggaaaagccgcaaggaggaaaaggtatccttctgggaggagtccccggtgtaaagcctgccaaagtattgattctcggaggcggtattgtcggaagtaatgcagcgcagatggctgcgggaatgggtgcggatgttacagttgcagatattaatctgtcacgcctgcgctatctcagcgagacattaccgaaaaatgtcaagacgctgtacgcatccgaattaaggataaaaaaggaattgccggatgttgatctggtcatcggttccgtgctgattccgggggataaagcgcctcatctgattacccgaaatatacttgcaatgatgcagcccggtacggtacttgtggatgtagcgatagatcagggaggatgtttcgaaacgtcacaccccacgacccacagtgcacctacctatgtgatagacggtatcgttcattatgccgtagccaatattccgggagctgtaccttatacttctacgctggctttgaccaatgctactctcccttatgtcattgctttagcaaataaaggatggaaaaaagcttgtaaagacgacccggcactagcactcggcttgaatgtagtggaaggaaaagtggtatataaagcagtagcggatgtattcgatctaaaatatgaaaatataaacctataaattgattaagcagccaactttctgaagtagtaaagttctgaagtagtcaggttttccaaacccactacttcggaacttgtttttttaccaatatttcttctccgctgcccgctgcatagcctccaccaattcattcatgacttccgctactgactgctgacgggaaacaatagccgacacctgccctatctccagttcgccttcttccagatccccttcaaagatacctttcttcgcacgacctctcccaagaagagtccgcaattcttcggcagaagcaccgccatcctcagccctctccacagcatcccggaaattattccgcactaaacgtgtcggagccagtttcttcaataataatttagtatctccttctcccaaacccagacaatattctttgaagaccgggctggctgaactttcatccgtcaacgcaaagcgagtaccgatttgtaccccttctgctcccagcaccatggcagcaaagataccttctcccgtaccgatacctcctgcagcgatcaaaggcaaagtggtcgcactacgtaccgcaggaatcaagcagaaagtggtagtttcttcacgcccgttatgtccgccggcttcgaaaccttcagcgactaccgcatctactcccgcctcttcacatttcatcgcgaaacgggaagaggaaacgacatgagctacgataataccacgttcgtgcagccatccggtccatgctttaggatttccggcagaagtgaaaacgatcttgacgccctcttcggcaacaatcgccatgatttcttcaatctgaggatacatcaagggaatattgactccaaagggacggtctgtagccgcacggcatttccggatatgttcacgaagagtctccggatgcatagagcctgcgccaagcagtcccaatcctcccgcattacttactgcggaagcgagacgccaaccgctacaccacaccatgccaccttgaataataggatactgaataccgaaaagagaagtaattctgttcataaattaatcgtttttcaatgtgctaatctgataacatggaacatgagacatgtccatatttaataaaacagtttcagcgggcaatctgttcaatggggcgattgatcagtacagtcgtcgaatcgccataggttctcaacacttccaacgtacgctcccgacgttcttttccttttttatcccagaagtttttggtaaaaaccgccatcagatcaagtcctccgatagttcctccattgatgtacacgccgctgcctccaaacaaaggaatcggactatccatcactaccgaattaaccatcattccattcgcccgctcgctcaactgacggaaacgtaccccgctcgcccgtatctcctccaatgatttgcggactcctcccgccatcggattatgcgcccagttgctgtacgacctttgatgacgcatttcgtaatgcggatctccacgccaggtattcttatccattcttattttcttctgaaaaacggggtcccaattataaggagtatttgccttatagggcatcagactcaataccactttcggtttaggcaatgcttcgggaagcgactcatcgggcagcatccacttcttttccaccgacatgcggggagtaccgacagcgctgccgaaatcaatctgcctgactgcatcctgattcaaattcagctcctgatcactgtccagcaactttctcagacgcaaggaatcctccttcgtccattcctgcgcatgtacaagcaaagctgtcaggcacagtgtcatagctgttatcaaacgttttatcaattcactcatctttctacctctgttttctatattcctcaagtacccccatcatgcatgagcgcattcgtttccttttgggcatagcacgcccctgtcggcagtacaaagactgctgatacaaataaacgttgcctcatgttttttagtttttatacaccgaaggatttttctttttttaccaccatcggtatcctgagccacaaagcggctcgtcgtagcacggatcaatcgtccaggtcgtcttcggatatttccgcccttcccaccatcgacgatagcaggctgccgcgtcgagcacttcgtcgtcggtcaggaaatagatggcttcgtaattttcggcattcgccagtaccatcctgcaacctaacgacggggctgttccctgacggatcgattctatcacccaaagcatacattcacctaaacggattttaccgttattcgtattgtagactgacgggaaagaaggaataatagtcagatcttccgcatatttcaatagttcgggaatgtcctcttcagtgaaatgaggaacttccacgacccctttttcattcttcatattataggtacccgctttcagctgtttcacaaaaacggttacatcgggattctcatagtccatttcttcgctgctgcatcccaccagggataccatcaggctaacagccatccacagcatcataagtgtttttttcatttttataaggattaatacgtcatgcgaagtccgcaaagtaaattaaaattagtcggccgtttcgtgcgtaccgtagccagtttcgaatccgtcttgaaatgatgggaaacacccggctcggcaaaaaccgccaatcggtcattaattttgtaagtgattccgataccggcagtaactgccagttggataggttcttctttaaaactgttgtccggcgcaccggctatacatttgtccgccactccgcctaccgtagcgtagaggtcgattttctttgtatccatcaaggtaatattcgctttcagcgggatgcccagataatgcaggtgctgtccttccgagcgcagattcgaataaagcagtccggtctctattccgagatagtcattcagtttccgctctacagtgactcctgcggagatcggcatcttgtaggcaccgtcctctgccggaagtgccgtccccatctgcgctttcaaagcccagcgatgtttttttacgttttccaccggagcaggtgtaccggtagtatatttttcttcttgtgcggcggatggttctgtgttaccattattcgcctgccaataaccgttgcgaccttggttgccgtatcggttgccatttcccgtggtggtagttgccgagaaagagaaagacatggagaaggaaatggaaaccgagtctccctcttccggatactgcgataataatccgaatgatttaggtgccggtttcggcaatacaggttccattgccgtcggcaactgattagcgcgtacaccatctccatccattcttccgctgttcgccaccacgattttggtaaacgcctcctccatctcttctttcggagagagataccagaaagtagctgaggatgcagccaataccagcaacacagatgctgccgctgccacacggaagaatatcaaccgacggcgatgctgacaagccacagggatatcctgcgaaagctcttcccaaaagccatcccgaacagtcatcccggcatcagcgagacgagtgcgaaacagatcggttatttcatcattttctttcttcatgatttctatattcttttattctttttgctaacaaatacttggctctgtgtaactgcgaagtagacgaatgttctttaatgtgaagcatcccggctatctccttgtgcgatttctcttcaaacacataaaggttgaaaacggttcggcaaccatccggcaattcggcgacaaacgccattaattgttcttcggagatccctgctcctcctcccgacgacgaaatatccggtatgtcgggaagctgctcttcatgcactaccaactgattgactcgtttctcccgtctcagatagtccagtgactgtgtcaccatcacccgtgtgatccacgtacaaagcgaggattcaccccggaacgagaagttggtaaaaatcttgatgaaaccgtcatgcagtacatcgtgcgccgcatccatatcgcccgtatagcggtagcataccgccaacatttgtttggcatagagggtgtaaagttcctttcgggctgaatcctgtcctgcccgacagccctttatcagttctatctcgttttccaatgccaattgtcttttttaaatcgaacgtatgtctgcgccgtttttatcctttagacgcaagtatttgaggaatgctgcaaagagttttgctaaaagaagttaaagaaatgtgattcgtaaataataaacggtgaacagctgcagcacgatagcaacagcactgttcaccgtttatttattatcagttcatcacttatagattcagcatgctttgaaactcatgtcaagtcctttcaccgaatgagtcagagctccaacagagataaagtctacgccacattcggcatagtcgcgaagggtatcgaaagtgataccgccggaagattctgtttcgtatttgccggctaccatatcgactgccttcttagtcatttcgggtgtaaagttgtcgaacatgatgcggtctacgccacccaagtcaagcacttgctgcaattcgtcgaagttgcgtacttcgatttcaatcttcaggtccttgcccttttccttgcagtaatccttggcacggttgatcgctttgtcgatgcctccggcaaaatccacgtgattgtctttcagcagaatcatgtcgaacagaccgatacgatggtttacacctccaccgattttgactgccatcttttcgaggatacgcatacccggagttgtcttgcgggtatccaacacgcgggtgtgagtgccttccagttgtctggcatacttgcgggtcatggttgcgataccgctcatacgctgcatgacgttcagcatcaggcgttcggtctggagcaaggattgtacttttccttctacgatcatggctacgtcgcccggtttcacttcggtgccgtcattgataaacacttccactttcatggacgggtcgaaacggttgaagatttctttggcaacttcgattccggccagtacaccggcttctttgatcagtagttttgattttcccattgcagtagcgggaatacacgaaagggtggtatggtcaccatcacctatatcttctgcaaaagcaagatcgatcagtttgtcgatcagttctttttccttattcattgatcttgtcaattcttatttggtgtattaaatattgagtctgcacttttttcaggaagcagttcacacggaatttcccttttgtagtcgtcagcgtacctatgacaaaactggattcatcccgttttccctgatgattcacgtcaaatgcgttgaccttgttttccgtgaaaaactcttgcatcattgctgtcgctttcttcttgtcaacgtttgccgagctgccttggagaacgaggtttaccttgtctcccatatacttactcagttcctgcgagcttccccgcttaaatgccgtaatcactcctgccggtatctcctgcgccatcagcaatgagacagaaagaagcaaagaggccattcctaaaagcactcgtttcttcataaatccaagcttttgggttgaagtttaaaggcttaaactttcaactaatgataggcaaaggtaagcattaattgcagaataacataaaaaatgcctatttttgtgctcgaatcagaatatcagacgcatgaaaacaactttgctcgtcgttggacgaaccgtagaacaacactatattacagctattaatgactatattcagcgtaccaaacgcttcatcacttttgatatggaagtgatccccgaactgaagaataccaagagcctttcgatggatcagcagaaggagaaagaaggggaactgatattgaaagcgttgcaaccgggggatgtgatcgtactgctcgatgagcacgggaaggaaatgcgttcactcgaatttgccgattacatgaagcggaagatgaatacggtgaataagcggttggtatttgtcatcggtggtccttacggattttcggagaaggtgtatcaggtagctaatgaaaagatttcaatgtcgaagatgacgttttcacatcagatgatacggctgatcttcgtggaacagatttatcgggcgatgacgatattgaatggagggccgtatcatcatgaataacatgcctccattcaacagcaaactctccttatcctgctgagttttccgctaaatataatttatcaaataccgttcgcagttcttcctcattctccatcaactgacgcaactccgccaaccgtccggcattatcagactggggtatccataacttcagataccctccttctgcatatttatcggcaagatgtttccggaagcgttcatactgctgctctttatccatctccggataatgagacaaaccatactgtacggtgcggcgcagtgttacttccggatcaataatccggtctgcctcagccactattttcccgtagatacttcgcggagcatctcggttggaggcacgatgatcctctatcgcttccttcatctgcagcatttgttcatcggtaaaccactgacgcaaagtttcatccgccaacaatattttgcccgaaacgatatgatgaaattcacgtccctcgcataaacccaagtcgtgataagcggcaaccgtataaaccattgcagaatcgacttcataatgaagagccagcttcagactttcttcgatcactttttctgcatggtctatctggtgcgccttatcaaagccggcatattgcgggataatcctttcctgcacgtatctctgcaattcagtaggtatattatgagtcatattctgctcgtattattatttttatatctggttattcccgattcatcaaccggtgctctgccatctgttcgaacttcgttcccggacggccataattggcatacggataaatcgaaataccgccacgtggagtaaagatacccgtaacctcgatatatttgggattcatcagttttatcaaatctttcatgatgatgttcacacagtcttcatgaaatgcaccatgattacggaagctgaacagataaagtttcaaactcttgctttccaccatcttaatgtcggggatgtagctgatacgtatttctgcaaagtcaggttgtccggttatggggcacaggcttgtaaattcgggacagttgaaacgtacccagtagtcattttccggatgcttattatcgaaagcctccaatacttcaggagcatagtcttgtttatactccgtttttcttcctaataaggaaagttggtcttttaattcagccattgtttaatatagttttaaactctcttcatatagaaaaaaacgcaaaacatctttcacctgtcaccatattctctgaaacggcttatccatcgatggttcagcggtgaaagattgattattgcaatctttcaccgatctttcatctttcaccatccggtattcctattatcatccggtactcctattatcaaaacgaccgttgcttttagtcgtttcctataaaggaatgaagtgtttcactatgatggaactctagtttcaaagccttgaaactaaaagtttcgagcgtatgaaactatggtttcaagtaatagaaactaaagtttcaagcctatggaactaaggtttcaaacctatggaaccaaagtttcaaccgcttgaaacttcttgaaacaaccggcaatgacttctttacccttgcacatcccgaaatgaaacgaacaccaataatagaatggcaagcagctgtcagcaacaataaaggtgacaataaaaaagcatttatcggttattatcaccctattatcaccatctattatcaccctttattcattcgtaatcaaggagttaatcttcaaaagtgacaagtgacaataaaaaacacgtttttagtctctatgtagagatattattgattcttcttttttaaatacttctccagcccctcacgacgcagcgtacaggcgggacaatgcccgcaaccatccccctgaatgccattatagcatgtcaaagtctcgttacggatcaaatccagtactcccaattcatctgccaaagcccaagtttctgctttatcaatccacatcagaggggtatgaatcacgaattgttcatccattgccaggtttaatgtcacattcaaagacttaataaacgcgtcccggcaatcgggatagccgctaaagtcagtctgagaaactcccgtcaccaaatggttgatgccacgttcgcgggcatataccgcagcaatactcaggaaaaacagattacgtcccggaacaaaagtattggggacgctgcctgcgggcttttcctgatccattaccatcgtggtgtcagtcaacgaattatgtcccaatgttcctatgaaagacacatccatcacatcaaattccacttctgcctttcgggctatttctctggcgagttccacttctttctggtgcttctgaccataaaggaaactcaaagcgtatacttttttaaagttgcgtttcgcccaaaagaggcaagtggtagaatcctgtccgccactgaacacaaccaatgcagtctctctgttcatcataaaattctctttatattctcagccctcgaagcaggccggaagaagtcgtttcattaaatatctttgactttcagtacgttataagaaatattagtatcgtacacgtcactgccgtctaccttcttaatcactttcactacgcggatagtcaccggaaggatgataacttcgtacatagatttcagtacgatctgaagtcccatcatgataagcagctctttccaggcaatgatgcctccgaaagctatcgggaagaaaatcaacgaatcggcagtctcgccgacaatcgttgagagaatagcccgggcagagaagttccgcccctgactggcaatcttcatcttactcatcacatacgcattcaggaatgaaccgacaaggaaagccatcaaactggctgctacgatgcggggagccataccgaatacaaaatcgaaatgctcttcgccttcccagaacggagcagcaggtatcgcaacagctatcaagccaagccctaccacaaagaagttcatagcaaaaccactccagataataagacgtgctttcttgaatccccaaacttcggcgatacaatcattaatgatataagaaataggaaaaaccaataatccggctgtgacagtcaggctgccgacctgaattactttcgtttcaagaagattggctgcaatgaggcatacattgaagagaatgcccagcaacataaaaggtactgatactttttctttcataactcctgttttttacgtggtgttctagaatacacgaccgctattcacggcatcatacatctttttacttgtttcggggtgcaaaggtagaagaaaaaagcgagaaggcaaagttatccgataactttattcggggcatgaactacaaccccgaaagatactccttcagcgtctccacatattcctccatcgctttcctgcctccggcagtgatccggcaggcagtacgcggccttttgcctacaaagcttttttccacctcgatatatccggcttcactcagcttatccaactgcacactgaggtttcccgctgtcgactgggtcttctctttcaagtagacgaactcagcctcctccaccgtcagcagaatcgacattatagccaagcgaagctgtgaatgcaagataggattcagttctttaaacattgcttcttcatctgtttattcataatatgtccggggacaatcatcatcactataaagatggcggcaaacaccagatataccccgcttccatgaataaaaagcatggaaaaagaaagggcgataccagtcatccctgctatactaagcggcttgtacttacataccaaccccgtaagagtagcccccatccccatcaataaggaaattacaaacagaatatcaatacggacaacaaatgccatgcaagacagacaaaaacctactactccaaacacagcccatatctgaccagtcacccggtctatgtaattttttgctcccttattcttgtctttcctattaaaaaagatagtcagcggtccggcaatgacaggcaaagcaaaccagagaaaattgatctgccacactcccgtctgcaaataaaagtaccataccacaagtgatatagccacagtagtatatccccatatcaataatgggtaggctgcataacgggctgtattgtcctgcgtctcccgaatcatgcaggcaatcagttccaaactctctttctctgaaattctcttgtcttccatattctatcaattttgtttcaaaaataatattgtttacgtaataaaccaaaaatccttgtctattttccttcgatacggcttctttcacttgccgatttcttttctacagtcaccgcacccgatttctttccatgattgaaattccaggtaaatgtgagtttcatcagtcttccgctcgaagccagttcaaaacgattttgagatgaataactcggtacattgctgaaataagaattatatcggttgaagatattgtctacccccaaagtagctacacaacgcccgtctttccattttttgcgcaggtgcaggttgaatgtatgacgaggatcgatcccgctattaccggaatacaaccggctaactccattatattgtgcttccaacgaatagtctgacggtaaaaggaccgtagcattagcattggcgaaataaaggaagtgcccaaagtaatcgtcctcccgatacatgcggatatcttgcctcactccgataaagctggcattcagattcagccaattgagcggctgccagggagcagtgatggctacgaaccaatggttctcacgattgtgattctcattgatgacatatgatatatccgaattctccgcatcttctttaccaaactgacggatcagatcatggtgcaaattgccgccaacagtcaatgtataccggaagttatagaccagcgtaatactgaatttattaatataagtaggacgcaacatcgggttgcctatcagataactatattcggaagtctgaatccggttcgggttgagagccgaaaaagtcggacgttctatatagcgtccatactgaccgataagcatccacttgtgaatttcatcaaaatagaaatttccgtcgatatgtggaaaccaatcccagtattttctcgtccgacgttctgtttcattggaggtttgcgtatattctccccgaagtccaatatgaacagatcctcttttcatatccagagaataagttccgtataaagcaccgatattctcgtgataatcgagttcatatccataagcaacattgggcttccaactttcgtcaggttccagcccttcgtaacaggcatcatctttcattcccgtataggtatatttcattcctatctggaaaaacgatttcttatgtaactgttgtttccacgacagatcggcagttgcgatctgataagtggcattagagcgggaacggtaaacggtatctttatttagagcacctatctcctgaaaaatttgatactgatttctgccatgcagatctttagagatatagtcggtgacaagcttcagcaccgaaccgtccttatccagtttatgtatatagttggcagtagctgtatacatattgtaagtctctttctgacgatacacaccctgactttccatatccagcggtcctaccgacagagtagagtaactctgagacggccagatgtatccgcgacgaacatactccagctctactcccagactattggaagagtccatcgtataaactgttcccatccgagtcgtcccgtaacgcgaaggctgcttcatacgggccagactggaaaaacctttatctcccgctacataatcacgggtaacgtacaaatctcctttattctgaggaaccaaagtaccggaagcaaatccataggtatcccacttcccactatgataattcaagctaccactaggctgataagattgcaaggaagaggcaaaagaagcattcatagaaagatttccctgaaatcctttgtccgtatgacgtctcattataatatgtatagcacctccctgagcatcggcatccttatcggctcccgccattggaagcacttcaacgcgggcaatatcgtccgatttcaaagaacggagatagcctatcagcatctctccggtaagttttatctccctattatctacaaacaccttcgtgccggaagaaccattgatggaaatccgctcgtcggacaaccatactccgggcgcttgttgaaggagttcgactccgtctttgttctgtgcaggagggacggacaggataaaacggtctgccttccgtttcacaggacttgtccgtaccaccacttcctgcaacgcataagtggaatcttctgtcagagtatcattcacagccatcggccgagcagtcgtcgaagtctgcccccaagcagtaactccggtaaagccggccaatatcagaaatatcaggtatcgcatactgttagtcatttaccggataatacatcttcattttaacggtagccgaagcatccgcctctttcttgcatttttcccgggcatacccttctaccggtattccctgttcattcatgtccaattcccagtttccgttctcatcatggaaaagagagattaaaaacttttcccatggaacatcttttagaacaacagtcactgtatctttaacagcagtagccatcgcatataccggcttcgattccgaatcctgttgtgccatgaccataatagcgccttttgcactacgaataccccgcacttctacttttacttcttgtgcaaaagtaacaacgtggtaacaaataatccctaaagcaatgaataacaagcgtttcatcttttactttcctccaatcaattagttgatacgatttaattagtttattttataaaccttatatggattaaaaaaagtaaggagctgcgcatctctcttactcgatgcaaatataaataggtttattttataaaccaagtatttcggaagaatatttcaaattaaataagccttcctgtcattcgtcgtattttgacaggaaggcttcactttgaccttaaaacacatcactcaattagaaagttgcatcaggagaagtctttcaattcttctttcagacgcttacggataaagaaaagtcggctctttaccgtccccatcggcaatcctaatttttcggcaatttccctgtatttaaatccagctacaaacatctggaaaggaactttcatatcttcggggatggaatggatcactctatacagctgcttcatgtcataagcaaactcgaaacggtcgccttcttcatcttctatcaaactttgctgattgatggaataggtatcatcgatcaaattcatttcgcggaccgtgcgccggtagttgttgacaaagatattacgcatgatggtaaacatccatcctttcagattcttggcatgcgtaaatttctcatgattatccaatgcctgcaatacacaatcctgaactaagtcgttggcagaatcacggtctgaagtcaacttatatgcgaaacgatgcaggtctgactccatcgccaatattccttgagtaaaatctactttttccattctcgtattttatttatctaattagtacgatacaaagatccgcttttttagaacgattataaatagcaattcttccgataagtttggcaatttttccttagcccctctcaaccatttctttttttagttgttcattgggcattcacctaaaacttaactgataatgaaaacaagctttaaaatggtagctatgctactggggatcggaattttccccgtctgtgctcatgcgcaaaagaaagtagtcatcgaggatgaggaaccgaattccatcatgttcgtctccagggacaaggccggagatgaaatcatccgaatcatgaacgaccgctctcagatgcgttttcacgacccgaatgctccccgcttccttctgacggatcagaaaggaaaattcgcccttggtatcggtggctacgtacgtgcgacggcagagtatgatttcaacggcatcgttgacgatgtggatttctatccggcattgatcggacagcccggaaagggaaattttgccaagaatcaatttcagatggacatcaccacttctaccctattcctgaaattggtaggacgaaccaagcatctgggcgacttcgtggtgtataccgccggaaacttccgtggagatgggaagacgtttgaacttcaaaatgcgtatgcgcagttcttaggatttaccatcggatacagctacggttcattcatggacctttcggctctgcctgcaacaattgacttcgccggtccgaacggttccgctttctatcgtaccactcaactgagttatatgtgcgataaactgaaaaactggagattcggcgttgccatggaaatgccttcggtagacggtacaacgaatagcgatgtatctatcaacacgcaacgaatgccggattttgcagcttctgcacagtataactggaatagtaacagtcatattaagttgggtgcaatcgtacgcagcatgacttattcaagtaatgtgcacgacaaggctttttcgactaccggatttggcctgcaagcatctaccacctttaatgtaaccaagaagtggcaagtgttcggacagtttaattatggaaaaggaattggttcttatctgaacgacttaagtaatctgaatgtggacatcgttcccgatccggataatgaaggcaagatgcaggttcttccgatgctgggctggtatgcggggttgcaatataatatttgcccgaatatctttgtatccggtacatacagcttatccagactttactctgaaaacaactatccgagtgataatccggaagcataccgaaaaggacagtatttcgtagcaaatgctttctggaatgtgactagcaatatgcaagtaggtgttgaatatctgagaggatggcgcactgatttcaactcttctacccgccatgccaatcggctgaatatgctggtacaatattctttctaatctattacatatataatattaggtatatataatatgagaagccgcctctgaacaatgttcgagacggcttctttaatataaaatcgtagcggattaatattagaacttatagtttacacttacaccaaacactttgtttgtacgactataaacatctttatccattgaagccatagccccatccaagccacgtggattttctttggtataatcgctgtaggtagtccagaaataagcaacatctaaacttaacgccttactaagattaatacgaccgcccaaaccgactgaataagaatcacaagagaaacttgtgtctgtctggaaagcatcgctcaatccataatcagttttctgataaccaccactgactgtgaatattttgtttatatcccattctacaccagccaggtattcgtgtgttccatgtttcaatgtcttctgcttgttatcagccatacctgcattcttgtcatcaaagaaatgatactctactgaagcacgaagagaaggcaagaattcataacttgctgctacagataacatagaagggaggtcacttggagtattcacaccatgctgataaggtgccatataggcagcagcagcatccggaaattccaatttatgtgtattgttctcaatattcatattagctttgaactcatacttcgcagccaaattcaacttaccgaacttagcgtctacaccgataatcggcgtcaatccccaacctgtctggtcacaatccagttcaagcttcgtatcattcagtttctgaagcataggtgcagattgttcttgtgcaatctgctgtgcctgttctaaactcaaattaggattagcccccataatttgttgtactatagcagcaccgatctgtcctgctactccttctttcaaggcaatattcagaaaacctttatatccacctgtaaagtaattcatacgggctccggcaaaaactgaaaagtgttcattaatcttatagcttgcccctaactgcaaaccataaatatattgacgaccttccatggctgaattgatattgtacatattaggtttcaacatatcacttgtagaatttaccaagccgatagcagctgcatcaaacataggcaaacctgtattgaaagaagcttttccaccaccaccaacgatagcgaaactaccggaaaatgcccagtcaccattcttatatacagcatgtacagaagggataacgggagccgaagcttttccttcataattgcgcacggaagtctgtccatccatagtccacaaaggacttgtagcagcaatatcacgagtctgatatgcactctgaatagtcagtgctacctgtaaaccgttttggggaaggaatgccagtccggcaggattactataaactccatcaatatcaatggaagcgccgcgggctatcatgcgcaagaaagcagcattctgattcgtattagttagataatctccggcaaaagttggaattgaaacgattaacattacaaatccaatcaagaaattttttctcatctaaatcttttttaaattaattcgggcgcaaagatacaatattcctgcacacgagacgtatgtttgtgcacttattttcgtttaccagctcattttgattgaaaataaaaactgtttctaatgaaacaattcacattcagagcggaggtaaagataaacaaaccaccctgtttttacgtttattaataagaataaaaacagaaaatattatggcctatacaattgcatttttcggaacaaagccttatgacgaagcttctttcaacgataaaaacaaagagttcagatttgaattccgttattataaaggacatctgaataagaataacgtgctattgacgcaaggagtagatgcggtctgtatctttgtcaacgatacggccgatgcagaagtcattcatgctatggcagccaacggagtaaaactgctggcactccgatgtgcaggattcaataatgtagacctgaacgctgccgccactgccggaatcaccgttgtacgggttcctgcatattcgccttatgccgttgccgaatataccgtagcactcatgctctctctcaaccgaaagattccacgcgcttcgtggcgtacaaaagacggaaacttttcccttcacggtctgatgggattcgacatgcacggtaagacggcaggtatcatcggtacaggaaaaatcgccaaaattctgattcatatcttaaagggattcggaatgaatatactggcttatgacctttatcccgactacaactttgccagggaagaacaaatcgtttatacttctctggacgaattgtaccatagttccgacattatttccctacattgcccacttaccgaagccaccaaatatctgatcaatgactactccatcagcaaaatgaaagacggagtcatgatcatcaataccggtcgtggacaattgattcacaccaatgccctgatcgaaggcttaaaaaacaagaaaatcggttctgccggattggatgtgtacgaggaagaaagcgaatatttctacgaagaccagtccgaccgcatcatcgacgacgacgtgcttgcccgtctgctctcatttaacaatgtgattgtcacttcgcatcaagcctttttcacacgtgaagcaatgggaaatatcgccatgaccacacttcagaatatcaaggatttcatcaaccacaagcctttgctaaatgaagtgaagagatagaacctttacctgacttcccttgttacagaagtatataaacaattagaaaaggagaaaattatgaagaaagtaatacataaagcagatacaagaggacattcccaatatgactggctggatagttaccataccttcagtttcgacgaatacttcgattctgaccgtataaacttcggtgccctccgcgtattgaatgacgacaaagtcgcccccggagaagggttccaaacccatccgcataaaaatatggagattatctccattccattgaaaggacatctgcaacatggtgacagcaagaaaaacagccgtatcatcactgtcggagagattcagacgatgagtgccggaacgggtattttccacagtgaagtgaatgccagccctgtagagccggtagaattcctgcaaatatggattatgccgagagagcggaatacacatcctgtctacaaggatttcagcatcaaagagctggaacgaccgaacgaactggcagtgattgtatcgcccgacggcagtactcccgcttcacttctacaagacacctggttttctatcggaaaggtggaagccggaaagaaactcggttatcacttgcaccaaagtcatggcggcgtatacattttcctgatcgaaggagaaatcgtagtagacggagaagtactgaaacgtcgcgacggaatgggcgtctatgatacgaaaagtttcgaactcgaaacattgaaggactcacatatcttattgatagaagtaccgatgtagaaatttggaattagaaatcatgaatcttgaatgaatgaagaatatagctgatatccggcaagaatataccaaaagcgggttaagggaaagcgaacttccctgcgacccgctttcacttttcagccgctggctacaggaagccatcgacgcaaacgtagaagaaccgaccgccatcattgtaggtaccgtatctcccgaaggcagaccctcgacccgtaccgtactgctgaaaggactgcatgacggaaagtttatcttctataccaactacgaaagccgcaaaggaaggcaactggcacaaaatccgtacatttcactttcctttgtctggcatgaacttgaaaggcaagtacacatcgaaggtactgccgcgaaagtttctccggaggaatcggacgaatatttccggaagcgcccttataaaagccgcatcggtgcacgtatttctccacaaagccagcctatcgcaagccggatgcaactgatacgcgctttcgtcaaagaagctgcccgatggctgggaaaagaagtggaacggcccgacaactggggcggatatgccgtcactcctacccgaatggagttttggcaaggacgccccaaccggttacacgatcgcttcctgtataccctaaagacggatggaaaatgggaaatcaatcgactttctccctgatttcactgatttttcttgccaactccaactagaatacgtaatattgcaactgtaaaaataatcagctcatgacactggattatatttatcatagcggttttgccatcgaagcagaaggtgtgaccgtcatcatcgattattacaaagattcttcggaaactgaacataaccggggaatcgtacatgactacctcctgcaaagaccgggtaaactctatgtattggccactcactttcaccccgaccacttcaaccgtgaaatactgacgtggaaagaagcacgtcccgacatccggtacattttctccaaagatattctgaaaagccatcgtgcaaagcccgaagacgctacctatattaaaaaaggagaaacctacgaagacgagacgatccgcatcgaagcattcggctcgaccgatgtcggcagttcgttcctgatccatctgcaagactggaacatcttccatgcaggcgatctgaacaactggcactggagtgaagaatctaccgaagcggagatacgaaaagccaacggagacttccttgcagaagttaaatatttaaaagaaaaagcaccgaagatcgatttagcgctgttcccagtggaccgcaggatgggaaaagattatatgaaaggtgcaaaacagttcatcgaacaaataaaaactactatatttgtacccatgcacttcagtgaagactacgaaggcggaaatgccctccgtgattttgccgaaaatgcaggatgccggtttgtcagcatcacccatcggggcgaaagttttgaaataaccaaataaacacaataataattatgaataagttaacaatcctgtttcttaccatgcttctcacatgcctgccaatggcaatgagagccgaatcgcacaaagaaaaaagagatgataccagataccttgcgggagctgttcctgtagtagatggtaaagtagtattttccaaggaattccagattcccggaatgagtcagaagcaaatctacgacactgtcatgaagtggatgaacgaacgtctgaaagaaaacaataatccggacagccgcgtcgttttcagcgatgaagcacaaggaaccatcgccggtgtaggtgaagaatggatcacattttactccagcgccctgtcattggaccgcacttgggtcaattatcagatcactgttacctgcaaactgggcagttgcttggtagaactggaaaaaatccgtttcacctaccgcgaaacagaaaaatacaaagcagaagaatggattacagatgaatatgcactgaacaaagctaaaaccaaactggtacgcggcttggctaaatggcgcagaaaaacggtagactttgccgatgacatctttatggatgtagctgtagccttcggtgctcccgatactcgtccgaagtctgagaaaaagaaaaaagaagaagaagcacagaaaccgtctatcgttgccgctgcaggtccgctggtgattggtcaaggcggtaaagttaccactgcagaagcagatcagtcaactactcctgctgctactttaacgcctgcaactcctgtcggcaaggcttcagcagatatgccgggatatacagaaatcgatctgaagcagattccgggtgatgtatatgcattgatgggcaatggaaaactggtgatctctatcggcaaagatgaattcaacatgaccaatatgacagccaacgcaggcggcgcactgggttatcaaaacggtaaagccgtagcttattgcacactttctgccgatcagccctacgaagcgatagaaaaagcagaaacttatacactgaaactatacgctccgaaccaaacgaccccttcggctgttatcgaatgtaagaaactaccttcacaaacgactccgcaagccggacaaccccgtacgtatgtcggagaaatcgtgaagctattgatgaaaaaataacaagatagcaatcatggaaattaaaagtagatttgatcactttaatatcaatgtaacgaatctggagcgaagcattgctttttatgaaaaagcgcttggcttaaaagaacatagtcggaaggaagcttccgacggttctttcatcctggtctacctgacggacaacgaaaccggcttcctactggaactgacctggctgaaagatcatacctccccctatgaactgggagaaaacgaaagtcatttatgctttcgtgtagccggcgactatgacgccatacggcaataccacaaagaaatgaattgtgtctgttttgagaatacagccatggggctttattttatcaacgacccggatgactactggatagagatacttccacaaaagaagtaaccttataaaaagaagcggggcaggatgatcatcctgccccgcttctttttataaggttgttagctattcatgacataacacatccccaaaatgcttgaaataatgaaaaaacatccgggaataaataaacgaacaaacaatcttgtcaattgcattttttgctcgacaaacattgcatcattatccaaattataccaaaccgtaactttatcacctatatgaaaatctttcgggtaatatgaaaattgtgtgatatcctccacaataatattgggattgatagaccgacagcatttttcaccctctccttctaatgtaaattcaacagacgggcgcataagaagctttccatccttcacataagtatcaacatccactactattccatctatcttcttaatgtatttcgtttcgactctcttgattaaaagacaaaacatcctcatcttaatgatcaaaccaagtccatggccagccagcaaaagtgctagtatacaaacaattgttcccatttattttttatgtcggttagctctctttttccgaatatccgctttcatcttcgcggctccggaaccatgttgtccacgaatataagtcgctttcttcgctttcgtcttcactttctcctcctcctggggcttatctttcttacctttaaagacgattccacccatgattgcatcttctatactcatatatattatattgttagcattcacatttctgatgcaaagataagccttttctacggaattgtttatctttggcggataaaacaatacataatcaccaaaatggcaacaataaccctttccgcagaaaaggacccgatgggagctgcaatctccgattatttcaatcatcacagagctgaccgcttgcgagtattctcttctcaattcgaagaagatgaaatccccgttaaggaattattccgaagtatacagtccatgccagttctcgaacgcactgctctgcaaatggctacgggaagaatattagatgtaggagccggaagcggctgccacgcattggcacttcaagaaatgggaaaagaagtttgcgccattgacatctctccgctttccaacgaagtaatgaaacaacgcggcgtaaaagattcccgcctcatcaatctctttgacgaaacattcaccgaaacattcgatacggttctgatgctgatgaatggttcgggcatcataggaacactaaataatatgcctgccttcttccaacggatgaaacgtatcctacgccctggcggatgtattctgatggattcaagtgatctgcgctatcttttcgaagaagaagacggtagcatgcttatcgatctggcaggcgattattatggagaagtagatttccagatgcaatacaaggatgtaaaaggagatacattcgactggctatatatcgattttcagactcttagcctatacgcctccgaatgtggattcaaagcggaattaatcaaagaaggaaaacattatgactatctggcaaagctgagccttgcctgacagcgtattattttaatcagaaaaagccctattcaggatagtgacactatcacatcagaatagtgtaaccatactaacgatatagtgtcaccatcccagtatgatagtgacactatatttattgtgcccgcatccggttcagagaccggcaataagcacttatttcagcatttcattgatctgctgaaccagtgaagcgaactcttcttcattatacagacgagtcagttttacaatctttccttcccggtctatcagcacattccgtgtgattccggcatcacgcaatgcatattttgcaaaaatatcagctcccggatccagtcccagcgggtaagtcactccggtagactttgcgaaggcaagcactttttcaagcggttcgtcacggtctattccaatcagtgcaaagtctgcattatccttatgcttcagccaaatgtctttttctataaaaggcatttccttacggcatactccgcaccaacttgctgtaaactgcaacatgacaaccttcccacgaagagatgacaaagtcacttgtttgccatccgtcaatgtaatcgtaaaatcaggggccatctcccctattctgacaatatatcctgtactatcagcctgtgccgacgtcgcttcagcagtcactttcactgcgtcggaagcactttcagtagcttctgctcctttcttctggcctgaacaagccagtaaactaacggctaataaagccacaccacatacattcataattttctttttcatcttcttgcaatcattagtgagactgcaaatataaaaaaagtacacgatgtatttgcatttttaaaataaattcgtacctttgcatccgcaaaacagaaaacgcctctttagctcagttggccagagcacgtgatttgtaatctcggggtcgttggttcgaatccgacaagaggctctcctcaaaattcaaatgccgctatatgcggcattttttatatccttttcattcgatgttcacgaaacacaaccatgcttaccccctcaacaggctcaaagcaaacacaactgccaaatcctttcttttcaaccgaaagtcacagccggaaaataatccgaatatgattaacactaccgaagctatcccccaacgataagaaagtatttcgaaagctgaaaaaccgatcagcaataaagtgatgaaaaaaacggagccagcccaaaagtggaagaggaaaccgacgcatatagtatgcctttgatacgattcatgaatatattcgactaaaatccgatatttatgactgcaaagatataaatataaatccaagaagatatcaaacaagaagaataatag

SEQ ID NO: 42 - DNA, 65856 bp, Bacteroides thetaiotaomicron
gctatatatttttaaatatataatttattagttatcccttattatggtaccgctttgcgtttcatagtcatttttccttacacaacatttccctatatatcaatcagttacaagagttttaaagtgttccgttcagcgttccacattttataagaaaaaaagaacgcttttaaaggccctatttaccctaatcagaggctctgtttgggtaaaacgaagcctctgtttgggtaaaacaaagcctctgtttggataaaacgaagcctccgtttctacaatccaactattcttcgtatattcgccaccaaaataataaacgggcatttctgatgaaacggacaattctatatccattactgactctttatctgcttatcttttcaaacggacaagccatagcttctggcaacgactccatccgcctcagcctgctgacttgcgcccccggtgaagaaatatactccctgttcggacatacagccatccgctacgaagatccggccaacggaatagatgccgtattcaactatggactattcagcttcaatactcccaacttcatcctccgtttttcactcggtgagacagactaccagctgggagctaccgactacgcccgtttcgcggcggaatatgccttcgacgggcgcagcgtctggcaacagacactcaacctgagcaaagaagaaaaagcggaactcatccgactactgcaagaaaactatcttcccgaaaacagagtttaccggtataatttcttttatgacaactgcgctacacgcccgcgcgataaaatagaagaaagcattgacggaaaggtaatatatcccgcagagccgcaagacggttcgctatctttccgcgatatcgtacatcaatactgcaaaggccatccgtgggcccgcttcggcatcgacctctgcatcggtagcgaagcagaccgccccatcacgcaacgccaaatgatgtttgcccccttttacctgatggatgctttcgcaggcgcccaaatcgtccatgattcggttcagcgtccgctcgtatccggcaaggagctgatcgtagacgcccttcccgaggaagaagaaggcggttggatgcccaccccgttccaatgttccctcctgctttttatacttaccgcagctgctactatctacagcatccgcaaaaggacaggactctggggtgtcgaccttattttattcggtgccgcaggcatcgtgggctgtgtgctggccttcctcgccctattctccgaacatccggctgtcagctccaatttcttattgctggtattccatccgggacagcttctgctccttccatacatcatttattgtgtccgaaaaggaaagaaatgctggtatttgacgctgaatttagtcgttttaacactttttatggtgctttttccgctaattccgcagagatttgacttagctgttgtacctttggcactctgtttgctgatacgttcagcgagcaatttgatattgacctctaaaaagaaataatgaaaggactactaacttccctgattaccgtactgaccttcaccgggctacaagctcagtcgttgcctactgcccctaaacttgtggtaggactcacgattgaccagttgcgtacggactatctggaagctttttcgtcgctctacggcgagagaggcttcaaacgcctttggaaagagggaagagtattccacaatgcagaatatacattcagcggtgtagaccgtgcctctgccatggcagccatctacagcggatcaacgccttccgtcaacgggatcatttccaaccgatggatggatgtagctaccctacgccctgtcaacagtacggacgatgcggccttcatgggttattacaccgatcagacctgtgcccctaccaaattattaacctctaccattgccgacgaactgaaaatagcgacacaaggcaaaggtatcgtatacgccatcgcccctttctgcgacgcagccattttcgctgccggacatgcaggaaacggagcgttctggatcaatcccacgaccggaaaatggagcggaacgacttattatggcgaattcccctggtgggcaagccaatataacgaccgtcaggccatcgactcccgcatctccagcgtcacatgggaaccggttttcccacgtggtatgtacactttcctgccagattggcgggacgtagtgttcaaatataaatttgacgacgaccgcaacaataagttccgccgtttcatcaccagcccgttcgtcaacgatgaagtaaatgccctcgcagaagaagcaatcggcaaaggttcggtcggcatggatgacattactgacttattggcacttacttattatgcaggcaactatgcgcacaagtccgtacaagagtgtgccatggaaatacaggacacttatgtacgcctcgaccgcagcatcgccaacctgcttgacctgctcgacaagaaagtaggcttgcagaatgtgcttatcttcgtcacttccaccggatatacggacagcgaatcgacggattcgggactgtacaaaataccgaccggagagtttcacctcaaccgctgcaccgccttgctgaacatgtttctgatggccacttacggcgaaggaaaatatgtagaagcctatcacgaccagcaaatctatctgaaccacaagttactggaacaaaagcaactgaacctgacagaagtgcaggaaaagtctgccgacttcctgatgcagttcagcggagtaaatgaggcatattccgcccaccgacttctcctgggttcatggactccggaaatatacagaatacgcaacggctatcaccgcaagcgttccggcgacctcgtgatcgacgtgttgccgggatggactatcgtcagcgaaaacggcaacgagaacaaggtggtacgtcattcctatatccccgcaccgctgatcttcatgggtcactccgtgaaaccggccatcattcagacacctgtaacaatcgaccatattgcgcctacactggctcatttcatgcgcatacgggctcccaatgcttcttcttcggctcctattaccgatcttcggtaaaagattcctcacaaaaaccatgcgaaaaacataaataaatcagcattttaatgtaactttgcgcggatttatatatggaaaaagcaccgtgcagacaatcaagaaataataataaactaaataatacaacatgggatttaatgaatttttaagctcgattttcggaaacaaatccacacgagacatgaaagaaatcaaaccctgggtagaaaagatcaaagctgcctacccggagattgaagcactggacaacgatgccctccgtgccaaaacggaagaactcaaaaaatacatccgcgaatcggctactgacgaacgcgctaaagtggaagaacttaaagcgagcatcgaaagcaccgaactggaagaccgcgaagaagtctttgcacaaatagataagatagagaaagaaattctcgaaaaatacgagaaagcactggaagaagtattgcccgtagctttctctatcgtcaaagcaactgccaaacgatttacggaaaacgaagaaatcgtagtaaccgcgactgaattcgaccgccatctggctgccaccaaagactttgtacgcattgaaggcgacaaagccatctaccagaaccactggaatgccggcggcaatgatacggtatggaacatgattcattacgacgttcagctgttcggtggtgtcgttctgcacaaaggtaagattgcggaaatggcaaccggtgaaggtaaaactctcgttgctacccttccggtattcctgaacgcgctgaccggaaacggtgtgcatgtagtaaccgtgaacgactaccttgccaaacgtgactccgaatggatgggcccgctttatatgttccacggtttgagcgtagattgcatcgaccgccatcagccgaactccgacgcccgtcgtcaggcataccttgccgacatcacgttcggtaccaacaatgaattcggtttcgactacctgcgtgacaacatggctatcagcccgaaagaccttgttcaacgccagcacaactacgccatcgtcgatgaggttgactcggtattgattgacgatgcccgtactccgctgattatttccggtccggtgccgaagggcgacgaccaactgttcgaacagctccgtccgctggtagaacgtctggtagaagctcaaaaagcattggcaaccaaatacctttccgaagccaaacgactgattgcctccaacgacaagaaggaagtggaagaaggattccttgccctttatcgtagccacaagtgtcttccgaagaataaggcattgatcaagttcctcagtgaacagggtatcaaagccggcatgctgaagaccgaagaaatctacatggagcagaacaacaagcgtatgcacgaagtgaccgaaccgttgtacttcgtcatcgaagaaaaactgaacagcgtagacctcacagataaaggtatcgacctgatcaccggtaactccgaagacccgacattgttcgtgctgccggatatcgccgcacaactctccgaactggaaaatcaaaacctgaccaacgaacaactgctggaaaagaaagatgagctgctgactaactacgccatcaaatcggagcgcgtacacaccatcaaccagttgctgaaggcttacaccatgttcgagaaagatgacgaatatgttgtgatcgacggacaggtgaagattgtagacgagcagaccggacgtatcatggaaggccgccgctactccgacggattacaccaagctatcgaagcgaaagaacgtgtgaaagtagaagccgccacacagaccttcgcaacgatcactttgcagaactacttccgtatgtatcacaagctgtccggtatgaccggtactgccgaaacggaagcaggcgaactttgggacatctacaaattggatgtagtcgttatcccgactaaccgcccgatcgcaaggaaggatatgaacgaccgcgtttacaaaaccaaacgcgaaaagtataaagccgttatcgaagaaatcgaaaaactagtgcaggcaggacgtccggtactggtaggtacgacttcggtagaaatctccgaaatgctgagcaaaatgcttaccatgcgtaagatcgaacacagcgtactgaatgcgaagttgcaccagaaagaagctgaaattgtagcaaaagccggtttcagttgtgcagtgaccatcgctaccaacatggcaggtcgtggtaccgacatcaagctgagtccggaagtaaaagccgcaggcggtttggccatcatcggtacggaacgtcacgaatcccgtcgtgtagaccgccagttgcgtggtcgtgcaggacgtcagggtgacccgggttcttctgtattcttcgtgtcactggaagatgacttgatgcgtctgttctcttccgaccgtattgccagtgtaatggacaaactcggtttccaggaaggcgaaatgatcgagcacaagatgatctccaactctatcgagcgtgcacagaagaaggtggaagaaaacaacttcggtatccgtaaacgtctgttggaatatgacgacgtgatgaacaagcaacgtaccgttgtttataccaaacgccgccacgccctgatgggtgaacgtatcggtatggatatcgttaatatgatctgggaccgttgcgcgaatgcgatcgagaacaatgactacgaaggctgtcagatggaactgctccagacattggctatggaaactccgttcaccgaagaagaattccgtaatgaaaagaaggacacattggcagaaaagacattcaacattgccatggaaaacttcaaacgcaaaacggaacgcctggcacaaatcgctaatccggtcatcaaacaagtatacgaaaaccagggacatatgtacgaaaacattctgattcctatcacagacggaaaacggatgtataacatctcctgcaatctgaaagcggcttacgagtccgaatcaaaggaggtggtgaaagctttcgaaaagtctatcctgctgcacgttatcgacgaagcatggaaagaaaacctgcgtgagctggatgagttgaaacactctgttcagaacgcaagctacgaacagaaagacccgctgttgatctacaaactggaatccgtaacactgtttgacgctatggtgaacaagatcaataaccaaactatctccatcctgatgcgcggacagatccctgtacaggaagctccggcagacgaacaacagccacgccgcgtagaagtacgccaggctgctcccgagcaacgtcaggatatgagcaagtatcgtgaacagaaacaagacctcagtgatccgaaccagcaggctgctgccagtcaggatactcgcgagcaacaaaaacgcgaaccgatccgtgcggaaaagacggtaggacgcaatgatccttgcccatgcggaagcggtaagaaatataaaaactgccacggacagaatgcttaacagcagtccgatgtaagattataatctaaaagaaagcctcaaacggttaaaaactgtttgaggctttcttttattcatccaaaatagtacttttgcttaaactactaaagatatcaagactatggcaaaattctattcactggcatttgtttctctgctactgttggcattcggcagctgtcaaagcctggagcagatttctattgactatatgcagcccggagatatgactttcccttctcaactccgtaaagtggctatcgtgaataacaccagcaccgaaccggataacaagctgatcacacagaccgaaaagccgaaagaaaacgtacccgaaataagccacgccacagcgtatgccaatggtaacgttaagattgcggctgaatcgctggcggaagaaatcgcgcatcagaactatttcgatgtagtggtgatctgtgattccgctttacgggccaatgacaagtttcctcgtgaaagtacactgagtcaggaggaagtccaacagctgacatcagacttgggagtggactgtatcatcgccatggaaaacctgcaattcaaagcgaccaaaacggttcgttatatccgtgattttaactgctacctggggacagtggatgtaaaagcctacccgacggtgaaagtatacctgccctcacgcagcaaaccgatgactacgctacaccccaccgacagtatcttttgggaagaatacggaggatcggtaacagaaacatttgcacacatgatacctgatgcacagatgctacgggaagcttctgaatttgcagggactatccctgtcaaacagctactccctttctggaagacaggcaaacgatacttgtacaccggcggctccgtacagatgcgtgacgcggcaatctttgtccgtgaaaattcatgggacagagctttcgaactttgggaacaagtgtacaacggaaccaagaaggaaaagaaaaagatgaaagctgccctcaatatcgctgtttattatgagatgaaagacagcttggcaaaagcagaagaatgggcagtcaaagcacagcaacttgcccaaaaagtagataagaaaaacattcccgaaaatgcggcgtacgccaccattgacgatgtaccgaattactaccttacaaccctttatgcaaatgaattgaaggaacgtaacagtcaattgcccaagctaaaaatgcaaatggagcgatttaatgatgatttttaaggaaatcatgcattgattattattttttttatacctttgaggtaacaaaaaggaagaacctatgaaactgagccaacaatctctgtctaccatcgaatcggctatccaaaaggcagccggcaaatatgtatgtggctgcgaccagacagccgtaaccgatattcatttacaaccggaccaaacatcgggacaactcactatttataacgacgatgacgaggaattggctaatgtaatgattgaagagtgggcgacttacgatggagatgatttcatggaaaatgtaaagcccaacctgaaaagtatcctttgcagaatgaaagatgcaggcgacttcgataaagtaacaatattaaagccttattcattcgtactggtagatgaagataaggaaacagttgcagagctgttgctgatagacgatgatacgttgctcgtggatgacgaactgctgaaagggctggataaagaactggacgagtttctgaaaaacttgttggagaaataactatgttcgattgcacggcatggccttgccgaagcaattatcatttataaaaagaataatcggaagtaaaaggtattcccctgtttacttccgattattcttttttcgttttatatgattcgtacaaactcaagtttccctattaggagtgactaaaagtcgatagtgccttaaatgggaatgactaaaagtcggtagtatctaaaactcccctccttcgggaaggaggggtggctgaaagccggggtggtaggtaaaacaaggttgtatctaatttactatgaatgaaagaattgcgtattcacctaccacctccccctgcgggtactcctccttcccgaaggaggagaattaaaatactatcgacttttagtcactcccatttaaggcagcactaccgactttttagtcagccctctagctgaaagccgaagcagtgtaggtagataaattactttgcttcaatcgctgtccgataaacagattttgccgtttcaattacagtttgtgacttatgatccgatgaatcagctgttttgtttttctccgcccatgctttctccataccatagaaattaatcggttcttccgctgattggtcaagtttaccgtccaactcccgttgtttctgctcaaagaaggttttccaacgttgataatacaagtctttcaaaatcccgctccactcccgatgggaataatcatgcagacctccccgattggcagctatactgtctccccagaccgtgatgagcgcagaagcattccattcgtaaagtttcttttcttcttccgtggttcccaaagaacgtgcggcattcagccatgaagacaccgagaactcctttcgggtggacagtaaactgtcctgagctaatattaactccagaaactgttgtgactgtttcccgaagctatccttatctttccgatcataactctgagaaatttcttcaagcagcacattccccttatctgccaggctctgacgcaccacgtctaccaaatcatattcaaagttattatttcccttgtactgatctgcaacagaaagtaacaagcgggctgcctttgccgttgaatcaggtgaatagaataacttagcatatccccatgtcgacgttctgtcctgatgaaatcccggacgggcacacaacaaggattcgactgtcccttctccctgataattcttcggagcattgtaaactgtatgttccagcgcacgccatgcttccgctacttccggtgacaaatcatttccataccgcgctttcagatacgcttgcagccatgcatccggtgcgaaccgttcttcccgccaaggaagttcatacagcaattcaaacatcaccggattattctcgattccttccggagtagctcctacccctcgcagggttttcccgttgacatgtgcacatgcgttataatatccattcaccagttgctccatccgtccgtgcagaccgacattaccgccaaagttaagcaacatacaatagagccagtcatgcttgccgaaacctttctcccgataccacatcgactccggatcaccccattggggaagtttttcactatacaaatccagtaccagcaaatcaccggaatcaagcgtactgaccatcgcttcccgcggattcgcctgccatgcctgcatcacccacacagcttccggattcgctttcttcatagcactcataatagaagttcccgcctttgccaagtctactccttccgtatttcctccttcatgaaaggggtccatactgtaatactttgcttttccgtacagtttctccaactcctcataatacatggcagcaaatgaatcgaaatgttcatcttccgtagaaagaaaggccggacgagggaaaccgcaccatttaccgggatcggcaatctgataccccaatttctctccgatattacggggaaccattcctgcatatccggggaataccggttcaatgcccagctccctcattcgggcaatgatcttcttttgcagtgcttcctgttgccgataccaactgtcgggattcggtccgccccatccttccagattattcatctgccaccatgccataaaggcaggaccggaaataaactcattgatctcctccgtcgtatatccgatacgtttcagcagattataccagacaacctccatccctgttatactcaaaggcatattgatgccgtgcatcgccatccagtctatctctttctcccagcgctcccagtcccagaaagccatggagtaggaataggtacagtaattcaggtaatatcgattcttcatagccgtcgcctgtcggattttcttttgaggcagaggcagtacttccggcaatttctgcgagggattattccacgaaagatgaatacctgccacgtatttcaggtaccaattcaagcccgtagccagtgaaagatcggagtttccggttatcagtactttgccatccttggagtctatctcaaagtagtcttttgccggatcggcttcatcagtaaccaaccggaaaaggatttgatccttcgacgtattctccgtcacacgtgctgccaatgaatcgattggagcagacgtagattggcaacttgtatacataacaacagaaccaaataataaaagtaatagaagacgcatgttcatagtcattatttttttaagggtcatcaaatgtgtttgagcgtttgagcctctaaatatatttcaaatttccgattactgaaaataaaatgtagttcttttatactgatacacattaaataacctccaatatatgaaaagtcggaaatattcggttgactcaccgactgtttccgacggatagcattggctctaataaagaaagaagatgtgtcaaacagttatttgcacatcttctttcaatttgtgtttcagttaattattactcccatcccggattattgggggccagttctgggtttaatgcgatttcattagtaggcacctgatacagataatacttatctaaccaacctttacctgctaccaaaggatcattatacatatagataaaaccttctttctttcctgtcgtatcggcgtatcctttttcaagatcaacaaactgtccggagtcgccaatctgctctttagtagcccattgaccgtactgtatcttattgataaaccaaggtgcctttttccaacgacgcacatcgtagaatccaaatccttcacccatcaattctaccatgcgctcgcgacgaatctcccacaatacagggtctacggtctggtcgcgcttcggatcaaatccggcatttatctcggccactttcatatgggcaactcccacccgatcgcgtaacttattgatagtaagatcagcaactgtctgattgaagccttcggcacctgtaccacctttttcaaatttagcctcggcataattcaacatcacttcatcaatcttgaacaaaggtacatctgaggtcccttcattctctttcgaattatcccaaacattatagtatctgtacacatagttaccgctacgggctacgaggaaaccttgtccgccattgttggtgaagaagtgaggcatccctttcaatatagcagcagaccagttcatcaatgggaacactttatgtttaccggcttccccatttccacccccgaaacctgtgtaacgggtaatgcccatgatatccataaactcacggtccttgggatcagaagtatactcccaactggtattatcggcacttgggatcaccttataagggggagctacagtctccagcagacgaaggtcacgattgcggaaggtagcattcatactattatccccatcctgcgaccattcatattccgagctgttatggatcgttttaccatctttacaaagatacatgtcgatgatgtgttgcggcatttccacattatgggtggatgtccgttcaacatgcgtcagtacataattagtcagttctttttctacatattccttatacagaatgatgcctttcattcctttcaggtcagatgtcagcatctctccccagtcactgttcagttcgggataagaatccatcagcttcttggaataagtgatacaagcatcaaagtacttatcttcgtcccccaaagcatgatatttacgccatgtaccttcaaaaaggcagaaacgggaaagaagagcacggacaacgtgcacattgatcgtattttcaccgtcaccttcttcttttatatgctcttcagcgtatatcaaatcgttcaatacatgatcggcaacttctttgcgaggtgtacggggaccatatgctatttccttatccgaatcacccagtacgcgatctacccaaggcacatcgccaaaacgagctatcagttccgaataataataggcacggaagaaatatcccaccgaacgccaatgctccttgtccgcatccgtcatccctgagttatcgatatttgccaacatgacattgacccgatagacgaaactgaatgcccatccattgcccgatgacgaactggatacattctgaaaagcatacggattaccgtcaccctgacgacgcatcagataacctgcataaatatcgcttgtataggatgtggcactggcataggctccgtttgtaccgggaatacgcaggatattagtatttgtaaatactccgtacaatccccaggcataggtcttgaaagtattataattactgaacactgtctgctccgtcaacgaagtatccggatagcgttccataaaactatcgttgcatgacgtaaatccgatagctgctgccgcaagcatagtatatattatttttttcataaccaattctaaattaaagagtaacattaaaaccaaaagaaatcgtacgatagaaaggatatccccatgacaggcgttccgggtcataacccttcatcagcttagtaaatgtgtgaaggttctcacaacttacgaacgctttcaaactcgttaatgtaataggtgccaaccagctcttcgggaaattataactcaaagtcacattcttaacacgcagataagagccattcatcagatacttcgtttgcgcacgtgtattgtaactggaattgtttccttgcccgtaaatacggaagtattccgcattcggattggctgccgtccagtcgccattggcagaatctaccggtttccaataatccagctggtctttaaagagtgaaccgaactgtccggaattaaacggccagcggcgtgcatcactgatccatacatcacgtttacctactccttgcagcaaaacactcagatcaaatcctttgtaattgactcccaggtttataccatactgcaaacgcaaagagttattaccgattatcttgcggtcacccggattgtcaaaggttccgtctcccgtatcaatgcgattcgtactcgatccatcatcacgcaaattctggtacttgatgtcaccgggacgcggacttactccatccactgtcaccactccttctttcagtttccaggtatttgtatcttcaaagtcatcggctgtatagtaaccatccgttacataaccccagatagaaccgatttcatatccttcataataattattcgtgccatcacttttcaggataatctttgattcattatggtatttggtaacgactgttttagagtcataaagattgaagcctacattatagccccatgcaccgattctatctctccacgtcaatgacaattcccagcctttcgtacgcaagtcggcggtattctgcaaaggtgcggaagcacctaccactgacggcaactcagctcccggagcaagcatatctttcgtatcacggcgataccagtcgaaagtactttgcagacgtccgttcaaggcagttatatcaaaaccaaagtccaatgtttctaccgtttcccaagtaaaactatcactgaccagtcccggagcattcaaagtcagcggcttcgctccattcaccagccatgccacatccttcttttccacttgcgacatggtcggaacaaatttataaggatcaatgccttgattacctatttgtccccaggttccgcgaagtttcagatcgcttagccagtcacctgcaactggtttcataaagttctcgcgggcaatgttccaacccacagatacagaagggaagaaaccgaaacgatttttcttcgggaatttagacgatccgtcataacgaccattggtctcaaacagatatttgcctttataatcataattaacacgatagaaagcaccacgaacggtatacacgcgatgatcatctgtaataaccttattctcaccggtagccgtactatgtgacggatacttctcgttaatcatatcataagaataagtatacaatttcttccagtcactggattcctggttgaagccgcccattaatgacaagttatgtgtgtcattccatgaatatctataattagcatacaggttgatggcattataatcagtactttggtgagtcgtctccagagaagaggtagtggcagtctgtatttttgccagctcaaccgttgtataatcaatggaagccttattcacattctgattactccatgtcttgtcaaaagtatattcgaatgccacttcaagccctttcaatggtttcaataccgtttttgacaggatacgggcattgtctctgattgtattgttatccgttgccattctcaaaacgttggaaggcgtattcgtcatcaggctggtgccgtcaggcaaagtcagggagccttcgggatatacaaccggcaaacgcatatcatacaatccggtcttatccgaagtcacaggcatattcttgtcactctgagcatagcgtatatctacagactgagtcagccacgaagtgatttcggcagaaatataggcactacccgacaaacgtttgtagcggtctttatcggtgatcaaaataccttgctcgctattatagccaagggacagacgataagccagcttatcagtaccaccgctcaatgacacattatgcgcttgcagaaaaccgtaatcatcaagcatattggcatacaggtctttctcattcaggtaataattcaatcctgtttccgggtctacatataccccgtctccggtagtctggaatttacccggattcttacgatattcggtcaggtagttcatccaggttttgatatcttgcccagtgtagtatttaccggcattgaactcgccgtccaggtaagcctgcatccactccagcccgtcagcctgttccggacgattgatagaactctggaaaccaaaattattattataattgacatgaaaaccgtctcctttcttcgccttctttgtagtcacaagtattacaccgaaagcggcacgcgcaccatagatagcggccgaggcagcatctttcaacacagaaacactttcaatatcttcgggattcaacatatcgatatcccccggaacattatctatcaacaccaacggaccaccgccattgatagaagtcgtaccacgaatattgaatgatttgctctgtcccggaccggcagcatcattattaggagtaatctgaagtcccggcatcgcaccctgcaaagcactcatggcatttacaacaggacgactccccagcacatcatccatctttacctgagataccgcaccggtcaggttcgctttcttctgtacgccaaaaccaactactaccacttcgtccagactctgtgtgtcctctttcagcactaccgacagcgtctttcctggagttactttcagggactgtccttgataaccaatataagagatttcaagaatggcttcttttgaaccgacattcaggataaaattaccgtccatatcagtgatcgtaccattggcggagcctttttctatcacactggcaccgattaccggttcacctgccgcatccaccactcgtccgctcacttttaccttttcctgatgcgcctgttcgacagatgccaactccgtggacagaatgatctttttatctattaccttatattctacattcgtatttttaaatacttcgtcaagaactttaaagatatcattacggtcagcggagattgtcaccaaccgtttcaaatttatatgagcattgttgtagaagaaactaaattctgtttgcttctctatcgctcttaatacatcctcaactgtctgattacgtacattcattgtaacctttgcagattgggcatagctatctgtcgcattagttaatccgacaaagcaaaataagaataaaataaccagtctcatagtacgtgggatttttttcgaggttagccaaaaagactttaccacccttaaaacttggatgctaaaattgttttgcataattttgtattgatttaagttgaaaatgagttaactatgcttgtctgccaaacaagcattttcaattgattcattttagtatggggagatctgccaaaatcttcccatacttttttctaagtgggttttgctttcatactactaaattgttaaaggttaatcaataaatctctattatctctttttttctgtcacttccatccttgtcatcattgatatgtttccagcgtattttggaggatactttaaaatattccagaatcttttccaaacgttgatttgtaaaggttcccgtgaacgaactattcttcagtttttcgttcttaataacgaatttcacgctatatcttctttccagcatccataatgcttcttccaaaggtgtattatcaagaaccacctctccatctttccaagccaattctgattttcccgaagttttataaaggtggactttatcagtctccgagtcgtacaccaacttctctcttggagacaagatgatatgtttcatcacagcatctttttcgaacataaaatctaccttcccttcaatcaaagttgtaataacctctgtattctgttcatatgcttccacattgaaacatgtacccaagacttctatctgtgattgatgtgtagtagaaaggataaatttcttttccggatctttggctacttcaaagtatgcctcaccacttaacttcactttacggaaatcaccattaaagcgagaaggataagacaaagaagattctgaattcaaataagcaattgtaccatcgggcaatgtcaacgaagttgtcattccaggactggtctttacttccatcatctccgctacctctccggtatcccctttccagttctgccatataaataaggtaagaagcgggataaacagaattgcagcagcacgttgtgcccactcccaccacactgtccttctcacttcacggtccgacatttttccctttactttcagtaaagctttctccgtatcaactttcttcattacctgaaccgtgtccacagccaaataaagagcaaaagtctgagtagcaactcgtttattctcctccgactcgtccatccacgcttccacttccagacgttccccctcgctcagcctcccctcacaataacgaggaagcaattcttctattctattattatttaaatctttcatcccttattccacctttttattatatgacaaggctaaaccaggacattcctaaacgaaaaccttatttttttcagaaaatctttattttattataaaaaagctatatttgcagcaaataactatttaataaatggaagaactacgcataaagaggaatgatcttcaattatctgaaatacagcgtggaggcctaaaagcctttgaaacgctattcaggcaatactatgcagtgctatgtgcctatggtcataaatacgttgacttccacgatgcagaagaaatagtgcaagactcccttctatggatatgggaaaaccgggaaaacttaatcattgaatcatcattaagttcttatctctttaaaatggtacatcacaaggctttaaataagcttgcacacattgatgccatcaaacgtgctgatacgcgtttctatgaagaaatgcaagagatgatacatgatatggacttttatcagattaaagagctaaccaaacgaattgaagacgcggttgctgcattgccggaaagttaccggcaagcatttgtcatgcatcgtttccgggatatgagctacaaagaaattgcagaaacattggaagtgtctccaaagactgtagattatcgtattcagcaagcactcaagcaattacgcatcgatttaaaagattatctgccattgctgcttcctttactgtttccttaatataagtgactccttccaataaattggattcgtacctattaaacctataccatccttcaactaaatagagaaaaacggtttctttttaggtaaagttcttttttgctctatcaattaaagctataaaacagaaagcagtaaatctgtatttatctatagtacaagctgatacagatcataaattctcaaccattctcatcatgatgagaattttttctcaccacagtgagaactttttctcatcgcagtgagaatcttttctcattgcattgagaattttttctcattgcggtgagaatattgtctcatcgtaataagctgatcaaagtcttggaagtctgcaatacataaaactaacaatcataaaggataagaagacaaatacgatgctattcctgctgatagggcagcgtaaaccagaaagtagagcctttgccttcttccgattcaactccaatcgtccctcctaatcggtcgataatcatctgacaaatggaaagccccaaaccggttccctgaacaaaaggattgtatttcacaaaccgttcgaatacatgcctgcattgctcttctgacatgccgcagcctgtatccgaaacataaaagcaaattgtatcggcatctttcagacgatatcccattctgatagaacctatctgagtaaatttaatagcattgatgacaaagttggaaatcagttgtatcaaacgattcttatctgtataaagggtacattccggcagacgttcggtaaaggtaagagtgacagtttcttttttcaagcgaagcctcatactctgttcgatttcttccatcgtctggttgacatctatcaatgacgggcagaagtcaaaagtgccggcttcaatcttggacatgtccagaatatcattgatcagttgaagaagtaagtcggtatttgtttcgatgatgtccgcatattcgcgcatctccttacgatcttctatatccggcaacatattcgagaagccgacaatcgcattcaacggagtgcggatttcatgactcatattagccagaaaggcggatttcaactgattcgcctgctccgccttttccattgcctcactcagacgagtgtatgccttgcgaagaatacgtatataataggcgatcgctgctatcaaaataagaaggaaaatggaacaggaaaggatttcaacacagtattgatgaaatatacttttaggttcgttgacataaacagctcgttcaggataaaggtgatagggaatattgtaggattccagcaccggataacagaggtaggcactcgccttccctcctatactttcggaaatgtcctccgcctgttctccatgcaacacacggtcaataatttcaagtaaggaatcgccgaatgattctgcagaaacgtaatagcctcctgcaaaagtattattggacaggtcttcggaagaaagcaggaacaagggagaggacgtaaaattggtgataatctcctgaatatgatcaaaaagataattattatcttctttattatgcgactcaaaccaggaataataaataattccggtgtttgctttatagctgcgcaaggtgtccagaagcatttctgttgacaagtgagtggtagaaagcaattctaaaggcaggtttggaaaatgcttttcaacagcttctttcacgtctccgcgggtttcttcactgatgtagcgatcgtccgagataaatgccaggcgatccatatcaggtatcaggctatagatcagttcaacggtttccttcacatagtaatgctgtttcagggtagtcaggttgtagccttttctccactcttgggcggggacgctgttggtctcattcaacgaggcatgagagagcagaatatccaaggtagcaggcaggcggtcacgggagttcgttatgatcactggaacatctttccataggtcatcaaataaaggacgacagacaatccagcccggatcaccaattatcacaacagcggcaggaggaagcggatatttctgacgcagatgctcgatgactgcatttacctccatcgtatcctgcaaggccgggacagacaatgattccgctctggcagttattccctgttcctgaagaacatcgtgcacataccaatagaagtttctggcccagggaaggttgaagttaatagaattcaaaactaatatttctttatctgatttcccattatctgccaacataggggaaaggagtccttcgaaaagaagaaagaacgcacctgttaagcatattcgcagtaattgtttcattttgctgtgtgattaaaagtggaagcaaagatagtattatttttatcttttaaaaagaaaggcatcccaaatctatcgggatgcctctccattacatatttttatgtatcagttcattatgccttttttaaagctgcgatgctttctttcaaagagctgatgatactttccgcatcggcctgcttcttacgttccatttcgagaacggctgcgggggcgttattgataaatttctcattactgagtttcttcaatacaccctgcaggaatccttccttatgtttcagttcagcttccatacgggcgatttcggcttctacatcaatcatgttgcccaatggcacagcgtattcggtagttcctaccatgaaggaagaagcaccttccgccttgctctctaccactgtaatggaagaaaggttacacatcttctgaatcaccgcattgaactctgcaaccggattttcgcccagcacctgcaagtcaagcggttctttctgagctatgttcttttgcagacggatgctgcggatattactgataactcccttgacaacttcaaactgtgcaacgaatgcggtgtctacataagtatccatgctcaatgcacttaccatcagactttctccttcttccgcattacgttcgtacatctgttgccacaattcttctgtgatgaacggcataaacggatgaagcagatgcaacaggttatcgaggaagcagagagtagcgctataagtggtacggtcaattccctgtccgtaagccggtttaatcatttccagataccaggaagagaattcatcccagaataatttataaacagccatcaatgcttcgctcagacggtatttgctgaacaagtccgctacttcggctgctacttcgttctgcttggattcaaaccagtggacagccagtttagcagcatccgaagcctgaatattatcgtcaaccgtccagcccttgatcagacggaaggcgttccatatcttgctgcagaagttacgtccctgttcgcagagcgcgtcgtcgaaaagaatatcgtttccggcgggagctgccagcatcattcccatacggacaccgtcggcaccatatttgtcgatcagttccaacgggtcgggtgagttgccgagtgacttggacatcttacgtcccagcttgtcgcgaacgatccctgtaaagtaaacgttcttgaacggcatctttccttcatattcgtaacccaccatgatcatacgtgccacccagaagaagatgatatccggtccggtcaccaggtcgctggtcggatagtaatagctgatttcctcgttacccggatgattgattccgtcaaacagggagataggccacaaccaggaagagaaccaagtatccagacagtcttcgtcctgacgaaggtcatccatcgtcaaagcagcgtttcctgttttctctttggcttttgccagcgcttcttcgggagtagcggctaccacatagccaccttccggcaggaagtaagcaggaatacgatgtccccaccacaactgacggctgatacaccagtctttgatgttctccatccagtggcggtatgtattcttatatttggcaggatagaatttcaactcatcgttcattaccggaggcaatgccatatcggcaaaatgctgcattttgaggaaccactgcatagacaatttcggttcgatcactacattggtacgttccgagtaacctactttatttgtgtaagcttctgtcttttcgagcaatccggcagcatcgaggtctttctcaatctgcttgcggacgtcgaaacggtccataccgatatataatccggcagcttcgctcaaagtcccgttatcattgaagatgtcgatgctgggcagattatacttttcacccaacatatagtcatttacgtcgtgggccggagttactttcagacaaccggtaccgaactcaatgtccacataatcgtcctcgatgacagggataacacggtttaccaacggaacgattactttctttcctttcagccatgcgttcttggggtcgttggggttgatacacattgccgtatcgcccatgattgtttcgggacgggtcgttgctactactgcatagcggccttccggatcaccttccaccttatagcggagatagaacagttttccgtgctcttccttgtagatcacttcttcgtcagaaagggcagtcaacgctttcgggtcccagtttaccatacggacaccacggtaaatcaatcctttgttgtacaagtctacaaatactttcaatacgcttttgctgcgttcctcatccatagtaaaggcggtgcggtcccagtcacaggatgcacccagtttgcggagctgcttcaggataatgcctccgtgctcttctgtccagtcccaggcatgtttcaggaactcatcacgtgtcaggtctgtcttcttgatgccctgggcagcgagtttgtttacaacttttgcttcggtagcgatggaagcgtggtcagttcccggcacccagcaggcattcttaccttccatacgggcacgacgaaccaaaatatcctgaatggtattattaagcatgtgtcccatgtgcaacacaccggtgacgttcgggggcggaatgacgatggtgtaaggttcacgaccatcgggtttcgaactgaataaacggtgttccagccaatactggtaccactttccctccacgtcagcgggattgtacttacttgctaattccatgtttctttatgtatatgataatgtatattcaaaaaataacggctgcaaaattaataattttaattcaaatcttaccacccacaggatgtttctgtgcccggaaagataatttatatccctcataaacagcaattccataaaataaggcggacatcgacaccacattcttcaccatgacagaaaagatttcgccataatcgactcccgccagcacttcgaaaaaggtcatatcataatccttggcagcaaagccgatgatggataggaaatcacccaacacacaactgatcaatgccagtgctgctccaagaagaccgaagacgggacgtatccccttcccctgccgcatggcgaaaccgaccaggaatccgactccgatagccatatatcccatctgaagacctgtagaaacggagatgagactccatgccaccgcccccaagatacatgcgacggatgcatacagcactcctttgggaagattttcttcggcgagaagttcttcttccgtcattgacaccggaaagtcgtcgggcttgggaggagccatcttcaacagttcttcatccttctcgaagttttcgcattcttcgtcaaagtcaggaagctctctggtacgtttgcaaacaagccctttcccattcacgaaatcacgtgacacgcaattccggcaatacttttcaatttcttctacggtagccatctttcgtttaacagtttttttgcaaatatagaggtattttttcgcgtgacgtttatttaatgcatatttttgttgactaaaatctgaacggatgatgaaacggaaactgataattagatatatactcctgggagtactgctgcttctggtatggatgacacagtcgattcccgcgttgggaaacctgtattcacaaaccgtttatcctgtcatctcccgcgtattgtcattcttctccaacttatttccttttgccataggggatctatttattttcgggagtatcacgggagtcatcgtttatcctttttatgcccgtatccgcaagaaactgccgtggaaaaggattctgctacgtgacggggaatatctgttatgggtttacgtatggttctacctcgcctggggattaaactattcgcaaccaaacttttaccagcgtacgcatattccttatacagcttacacaccggagatttttcaagagtttgtggatgactatatcgactcactgaacagttcgtttgttcccgtaaaaggaatccatgaggaacaggtacgtgacgaagctgtcaaactttacaatcaattaagcgacagcctgggagtgcaccgcccgccatttcccaatccacgggtaaagacgatggttttcaccccattcatatcaatggtcggagtaacgggaagcatggggcctttcttctgcgagttcaccttaaacggagacttgctccccatcaactatccggcaacgtacactcacgaactggctcatctgctgggaatttcgagcgaggcagaggccaatttctatgcctatcaggtttgtacccgttcacaaataaagggaatccgtttcagcggctacttctcgattctgaatcatgtactggggaatgcccgacgactgttgagtgaaaaagaatacgccgatataatcaaccgtatccgaccggagattatagaactggcgaaaaagaatcaggaatactggatggctaaatacagtccgttgatcggtgatgttcaaaactggatatacgacctctacctgaaaggaaacaaaatagaaagcggaagaaaaaactattcggaagtgatcgggctgttgatttcgtatcaagtatggaaagcgaaaaccgcatcagaccaataaaaagacttttattagcgtccttgcttttgttttcgtaccgattaaggctataaaagacaaggaagcattatctttgcaacattatttataaaaaaatcaaaggaatgatacatacaagagaagaacagatggaagccttcggccgctttctggacatcctcgacgagcttcgggtcaaatgtccgtgggaccgcaagcagacgaacgaaagtctgcgccccaacactatagaagagacttacgagctttgtgatgccttgatgagggatgacaaaaaagatatttgcaaggagttgggagatgtactgctgcacgtagcgttctatgcaaagatcggttcggagacaggtgacttcgacatcaaagatgtctgtgacaagttgtgcgacaaactgattttccgccatcctcacgtatttggagaagtaaaagctgagactgccggacaggtatccgaaaactgggaacagctgaaactgaaagagaaagacggaaacaaaagtgtactaagcggcgtcccttccgcacttccttcactcatcaaggcttaccgcattcaggacaaagcccgcaatgttggcttcgactgggaagaacgggaacaggtatgggataaggtgaaagaagaaatcagagaattccaggtagaggtagccaacatggacaaagagaaagcagaagccgaattcggtgacgtcatgttcagcctcatcaatgcggcacgcctctacaaaatcaatccggacaatgctttggaactaaccaatcaaaagttcatccgccgtttcaactacctggaggaacatacgataaaagaagggaaaaacctcaaagatatgtctcttgaggagatggacgctatttggaacgaagctaagagaaaaggactgtaacaccatcctccttccttatggaacggatatgatacctatccaaactctgttattcccacttccaatggtctactcttttagtttagtaaagcaacaaagataaatccggaaacaaaaatcagaggctctattccatgcggatagagcctctgatttactctgacagagcgtctgtttcatccaaacagaacctccgttttatttcttcctgttcggatcatttcctccgtccttgcggttcatgcctttcagcatttcccgatggaaacgcatctccgcgcgttgaacaaggaatatcttcttgttggaaagtatctttttaaaccggtccagataagacttatcaagacggtcggcagcgatacggttgtcacatacctttgctacaatttcttcgtactgggcttctgttgttttgtcgtctttaccttgacgcattaaactccacgattcatcgttcagcttcttcttcttctcctgcagttcaaaataaaccgggaagaatttggcagcctcttctttggttaatccggcctgctcaataataaacgctttctgtttattccggaaatcctcacgggacaaatgctggtcacatccatcggcagcccaaagaacaggcataaagccacataacaaaacgactaaagcgattagtttcttcatctttttattcaatctgtttaataaatcattctacactcgcgtcactcagatagacgtataacgaataatcatccaacatcgcacggtctaacgcaacatcaatcatctcatcggatacctgttccgtatccgcttccatagccgctactgtcaccgctatatcatctgccgccggtttatggtctgatgacgctacccggataatcagggcagctcctacaaacatagccgccatatagaataatggtttcaatctcgtccatgtcgaaatatgctcttccttgaaagcaactttctctttttcaggaagtttgttcatcacctctgaagtcagattttcaaagtaaccgtcgggcactttgaaggaatgctcctttccgattttcttcaatagggtatcttcttctttcatacgtttttctcctctcttttgattagacaatgtctgctttaaaaggtttaatctacttcttccaaaaacttctctattttcttcaccgcatggtgataggaggctttcagcgctccgactgaagttccaaagatttctgacatctcttcgtacttcatttcctgataatacttcaggttgaacaccattcgttgtttttcgggcaaggtgagcaatgctttttgcaatagcatctgcacctgatcgcccgaatagtagggatcactctccagtttctgcacgatcgccgcttcgggatcatcgatagctaccgtcgttgtagcacgctgtctgttcagaaaagtaagacattcattcagcgcaatacggtagagccacgtagacagcttcgcctcggcacggaaataatcaatatttgtccatgccttgatgaaggtgttttgcagaaggtcgttcgcatcttcatgcgacagtaccatccggcggatctgccagtataactgctcgctgtattgcgccacaatcaactcaaatcctttccgctgtgtactctcctcctgaaggagtttcagaacttcacgttcgttataaggggtcatagtctctcgtatctgtatagttatttatggttatgcacatattctctcttgccaaaaccgtttgggggaagatagccgccgcttcattcaacaatacagactcgtcctcatagcgggcggaaaaatgtccgatgactaattgtttcacttcagcattcaaagcaatctgtgcggcctgtgcagcagttgtatgatgagtttcttttgcccgcacctgttcggtctgagcaaaggtggcttcgtggaaaaggaggtctatcccctttatctgctccacgatctcaggtcggtaaatcgtatcggagcaataagcatattttcgtgcaggggcagaaggacgggtcagacgatgattcggaatgacttctccttcgggagttacaaaatccgctccgttcttgatccggttcagttcgtagacgggtactttatagaaatccaccatatctctgatgatatgattgggacgctgtttttcttcaaaaagaaaaccgcagcaaggaatacggtgtctcagaggaatggtggtcacagccaccgagcggtcgtcatagatcagcgtcggctctttcgtctcaaattcatggaagaagactttataggccagcgttttgcaaaagaaagaaagtaggggagcaaacaattcttccagtcctttgggtgaatggatatgcaagtctgccgttcgtcccaacagaccgaaggtagaaatcagccctaacagtccaaagcaatgatcgccatgaagatgggaaataaagatatgattcaagcgggaaaacttcaagcgggaacgacgcaactgcatctgcgctccttccccacagtcaatcataaaaagcttttcacgcaagttcacaacctgcgatgtcgcaaaatggcgagtggtgggcaaagcagaaccgcatccaagtatatgtagttcgaatttctccatagcggcacaaatgtacacaagttttttggtatttgtgctatcatggcaaaacaaaaaaagcgccccgacaaccggagcgcttttccattatatagaaataacgattatttctttccttccaactgttctttcaaagcagccaaagcgtcgatgtcgcccagcgtagttgaagcagcttggttctggatcatcggagcatcttctctcttgttgttagaagacttcttagcaccggaagcagctttcttttctgctctttcttcagccttagctacatcttcgaagatacggctgtgagacagaatgattctcttagcgtctttgttgaactcgatcactttgaattcaagtttctcatccaactgagcttgtgaaccgtcttcttttacaaggtgtttcggagttgcgaaaccttctacaccgtaaggaagagctacaacagcacccttatccaacatttcgatgatagtaccttcgtgtacagaacctacagtgaatacagtttcgaatacatcccaaggattttcttcgagttgtttgtgaccaaggctcaaacgacggttttctttgtcgatttccaatacctgaacttcgatgtcagcaccaatctgagtaaattctgacgggtgtttcactttcttagtccaagaaaggtcagagatgtggatcaagccgtcaacaccttcttcgatttctacgaatacaccgaagttagtgaagttacgtacttttgcagtatgcttggaacctacaggatacttctcttcgatagtttcccatggatcttgtttcagttgtttgatacccaaagacatcttacgttcttcgcggtccaaagtcagaactacagcttctacttcgtcgcccaccttcatgaagtcctgagcagaacgcaagtgctggctccaagacatttctgatacgtggatcagaccttctacgcctgtagcgatttcgatgaatgcaccgtagtcagccataacgacaactttacctttcaccttgtcacctaccttcaagtcagtgtcaagagcatcccatgggtgcggagtcagttgcttcaagccaagagcgatacgtttcttttcgtcatcgaagtcaaggataacaacgttgagcttctgatccagttcaaccacttctttcggatcgctaacgcggccccaagaaaggtctgtgatgtggatcaaaccgtctacgccacccaagtcgatgaacacaccgtaagaggtgatattcttaacagttccttcaagaacctgtcctttttcgagcttgccgataatttctttcttctgttgttccagttcagcttcgataagagccttgtgagatacaacaacgtttttgaattcctggttgatcttaaccactttgaattccattgttttgccaacgaatacatcatagtcacggatcggtttaacgtcgatctgagaacccggcaagaatgcttcgattccgaatacgtctacgatcataccaccctttgtgcggcacttgatgaatcccttgataatttcttcattttccagagcagcgttaacgcgatcccaagaacgagtagcgcgggcttttctgtgtgacagaacgagttgtccttttttgtcttcctggttttcgatgtatacttctacagtatcacctaccttcaggtccggattgtaacggaactcattcaaaggaatgataccgtctgatttgtaaccgatgttcacaactacttcacgcttgttcattgcgattacggttccgtcaacaacctcacggtcgttaactttgttaagcgtaccgtcgtaagctttttcaagatcttcgtggcttgcgcttgttacagcttcgccgttttcataagcatcccagttgaagtcttcaataggagctacgttctttaagttttccattaataaataaattgtttaatactttaattgaataagacattatattatctataaatcgggcgcaaaggtaggaatattttcttgaccgacaaaagaatacccaaagaaaagatggtgatatccgtattttttgtaatattgcaagtctaacattatacgactttcaacatggacggaacattggacaaaatcagggtgcagtttgattatctgccacttattaatttcgcgatgcagcaaaacaaagtatcggtcatccatcagctttcgattgaaaacatgacgtccgaacccttcagaaacattcaggtacaaatcactgccgaacccgacttcggcagtatcactcctgtgatggtggaagcgattcccgccaatgattccgtgtgtctgcaatcgttcagcctggtcttgtccgccaattatttcgcccagctgaccgagcgtatgtcgggaagtctgaaaatagaaatccgctccgaggcggaaacgatctttacccggacctaccccatcgacattctggcatacgaccaatggggcggaatcaatatattccccgagatgctggcagcgttcatcacccccaatcatgccgtgctcactcctattatcaagagagccgccgccattctggaacagtggaccggtactccgtcactggacgaataccaaagccgcaatccggaccgtgtgagaaagcagatggcagccatctacaccgctcttaccgaacagcaaattatttacagcaccattcccgccagcttcgaagagcacgggcagcgtgtccgtctgacagattccgtactggcacaaaagctcggaacttgtctggatatggcactgctttatgcttcctgcctcgaatccatcggactgaatgccctcatcgtcatcaccaaaggacatgctttcgcaggtggctggctggtgccggaaacctttccggaccctgccatcgacgatgtatccttactgaccaaacgaaccgccgaaggaatctacgacatcacgctggtagaaaccacctgcatgaatatgggacataatgccgacttcgacaacgccgtgaaaagcgcgaacggcaaactgagcgatccgggcagtttcatcctcgccatcgacgtcagaagggccaggcattcgggagtccgcccgatcccgcagcgcgtactgaacggacaagtatgggaaataaaggaagatgaggatatgaacagaaataccacgcacgccactccgcaaagcgtgaatccatatgatttgtcgggcagcgaaactcagacagtcctcaccaaacagttgctttgggagagaagactgctggatttgagtctgcgcaacaacttgctgaatatccggattacaaagaacactcttcagctgattccggcaaaccttgcctgtctggaagacgccttggcggaaggagatgagtttcgtatcctccaccgtcccgccgaatgggagaatccggcgatggagtttggcatttattcttccataccggaatcggatccgatagccgacttcgttaattcggagctttcacagaaaaggttacgtttttacttgccggagaatgatttgggcaaagcactgactcacctgtaccgttcgtcccgtacttctatcgaagagaacggagcgaacacgctttatctggctctcggacttctgaaatggtacgaaacaccttccagcgaacgtccccgttatgcaccgatattgctgctgccagtcgaaatcatccgcaagtcagccgccaaagggtatgtgattcgttcgcgggaagaagaaacgatgatgaatatcaccttattggaaatgcttcgtcagaacttcggcatttccgtaccgggacttgatccgcttccgacggacgaaagcggagtcaacgtaaaactgatttactccatcatccggcactgcatcaagaatcagcgtaaatgggatgtggaggaacaggctattttaggtatcttctccttcaacaagtttatcatgtggaacgacatccacaacaatgctcccaaactgactcaaaacaagattgtctccagcctcatcaacggaaagatcgaatggaacgcgattacggaagagatggatgcctcttacatggacagacagttatctccggcagatatcgtgctgcccatcattgccgattcatctcagctggaagcgatttatgaggcggtgcacgacaagacttttatcctgcacggccctccgggaaccggaaagtcccaaacgataacgaacatcatcgccaacgcgctttataagggtaaacgagtcttatttgttgccgagaagatggcagccctctccgtcgtccaaaacagactggcggcgataggacttgctccgttctgtctggaaattcactccaacaagacaaagaaatccactgtcatctcgcaactaaaggagacaaccgaaatcatcagacgaactcctcccgaagagttcaagaaggaagccgaacgcctgctgaagttacgaacggaactaaacaaatacatcgaagccttacacaaggaatatcctttcgggctttccctctatgatgcgatcatccactaccagtcaacagacgttgaaccctgcttcgatatcccgtcatcttatctggacgatctggacaaggatcgattctcacattgggaagatgccatcgaatctttggtcagtaccgccaatgcttgcggccacccgcatcttcacccattgacagggatttccattcgggaatattcgtccgccatcaaagaggaagcctctcaaacgctcgccactttcatcggcttattgactgccatacagtcaaaactgcctgtcttctccgctttactggaagatacggacattcatcccacccgcaaggatttcgatataatcaccgccattatccggaaaatactcgaaattccggaactgacgcccgaactgctgaccactcctttattaaatgaaacgctggaagagtaccggaaagtgacgaagcacggcaggaaacgcgatgaaatcaaagcagaaatagaaaacggattcaccaaagaagtactgaagataaacgccggccccatgctggccgaatggaatcgggtatccgcccaatggtttctcccacggtatttcggacaaagaaaaataaaaaaggcgattcgtccttacgctctgcagccagtagagccggagacagtccagcctctgctccatcaggtcatccggtatcaggaagagcttgattttacagacagatacaccgccaagctgccttctttattcggaagattcggaagagacgaagagtgggacatcatcgatcagatcatccatgaggtatcttcgcttcattccctgttactgagttattcaaaagatgtggcgaaaacatcccggatcaaacagaatttagcgttacaactgacggaaggtatccggacattcagagatatccattctcattctctgaatgaattgcatcagctggccgacacgcttacggcaaccgagcaacggctttccaccactctgggcataaccgtagagacgctttatacaaactccgccgactggatcggcatcgccctacagcaagccgcaacatggaaagaaaatctggacaaactcaaagactggtatcaatggcttcaatcctacaacaagctgaacgaactgggtatcggatttatcgcagaagaatataaggaaaagaatattcctacggacctgctcaccagcagcttctgcaagagtttctaccaagccgttattcactatatcatcgccaaagaaccgacactggaattattcaacggcaagatattcaatgatattatagccaaatacaagcaagtatccgccaacttcgaggacattaccaaaaaggaactgttcgccagactggcttccaacattccgtccttcacccacgaagccattcaaagttcagaagtcggaatattacaaaagaatatacgcaataatgcacgcggaatatccatccgcaagctattcgatcagatacctaccctgctgtcgcgtatgtgtccttgtatgctgatgagccctatatcggttgcccaatatatcgacaccgatgcggacaaattcgacttgatcgtcttcgacgaagcttcacagatgccgacttacgaagcggtaggcgccatcgcccgaggcaagaatgtagtcatcgtaggcgatcccaaacagatgccgcctaccagcttcttctccgtcaacaccattgacgaagacaacatcgagatggaagatctggaaagtatccttgacgactgccttgctctctctatcccttccaaatacctgctgtggcattatcgaagcaaacacgaaagtcttatcgctttcagcaactccgaatattacgataataagctgatgactttcccgtcaccggacaacatcgaatcgaaagtcagaatggtcgccgtagacggttattatgacaaaggaaaatcccgtcagaaccaagcggaagcgcaagccgtagtagacgaaatagcgagaaggctgagaagcgaagaattaaggaaaaagagtgtgggggtagtcactttcagcgtggttcagcaggcgttgatagaagatttgttatccgatctcttcatcttccaccccgaactggaaacctttgcgctggaatgtgaagaacccctgttcatcaagaaccttgaaaatgtgcagggagacgaacgggatgtgatactgttctccgtcggctatggtcccgatgccgaagggcgcgtcagcatgaacttcggtccgttgaaccgtgcgggaggtgaaagacggttgaacgtagccgtctcccgtgcccgatacgaaatgatcatcttctctacgctgagatcggacatgatcgatctgaaccggacttcttctatcggagtagccggactgaaacgcttccttgaatatgcggagaaaggaaccaagcgcatactgaatacctcgaccagcatccagccctcggaagaagaaacttccatcgagaagattattgccgacaagttgcgttctttgggatataccgtacataccgatataggctgttccggatacaagatcgatataggcattgtcgatactcaaaacccgtccaactaccaattaggcattatctgtgacggaaagaactacagacgtaccaagactgtccgcgaccgggaaattgttcaaaacaatgtactcaaagcactgggatggaatatctgccgtatatggacgatggactggtgggaaaagccggatgaagtgattgcatccatacagacagcgattgtacagggaatgaaagcccccaaaccggtcgtagtacaggaaaaacaagaaaaagaagaagaaagggtgcaggaaaagccgatgcagctaaagtccgcatacacaagcccctctcctatctttgtacaaaattataatagtactaaagtaagttcataccactacgcctccgacgatatcttcgctgccgagaacaagcccattcttatcgcccaaatccggaagatagtggagaatgaagctccgatcagtaaagccttgcttggaaagaagattctgtccgaatggggaatcagccgtctagggccacgaatagatgcttacctggagacaatcttcgacacattacatctctaccgcatagaacatgacggtcttgtcttctgctggaaagatgaagcgcaataccgttcttatacggagtaccgtcccgattccgaccgggatgcagcagacctgccacccgaagagacagccaatgccatccggcagatattaaccgactccatcagtctgcccctgccggatctgataaaagcttgcgcacagatattcggttttgcccgcatgggttcaaacatcgaagcatccatgctcagaggtattcaggaagcggtgaaaaagaattatgccagagtggaaaacggacgggcaacgatcatcggttaatacggaacggcaggcacaaacagccaccgccatccgtcaagaaccattctgcagacgtttcagagtagcgatagaatcggatacatacgtgttatccggttctatggaacgccaataacaaagcgatcctatcaaccgtttcagataggcaggatcatgggaaccgattctgcgttgatgttccgccagtcccttcgtcagaatgaaatagacattcttgcgaatctctctctttcgggctttaggaatggtcagcttcacaccggagctgacggatacgcccgtgattatcttcctgtcatactcattcagaaaacgggttttctgatgattcggttcaaacttctcttccctgatgatttccttgacccgggcaagcacctgatctttcggaaagacatcgcccgaaaaggtaaggtcgtcggcataacgactgtaagtcagcccgaattcttccgccatcgccgccagtttccggtccatctcataagcgatgatgttgctcagcaccggactggtagacgctccttgcggcaaatgccggcgcatacaacacaactcgcccagcactttcgatatattcttcggataaccgatcttttcgaaagtcttcttcaccctcggactgcgtatggaaataaagaaatcgtggatgtccgtcttcaagacatagcgttttcccaaatggggacggacgttatcgacgatggaatgctgacgccggaatcccgtagcggcaggatgcacatttacagacagtaatatacggtgataaatagtatcttgaatggctttcagttccttgtccggagcagagatcatgcggtatccccctctccgctttctgatccagaactcccgataatgagaagagacatcctgcagtatctctttcagcctcatcacctctattcccaacagattggcacaccacaccaccgcctcttcatcaaatacaggacatgttctcgttttaggagtgactactcctagagcatgcctgagccaggctccatgttcccatttgtttttggaagtctcttcgttagtagtattaccgctgcctgttgctttccatctcttgtatccttcctgtttccggctcgaagaaatcaatttataaatcagaaaaccggtaacaataagtatcgtaattaaaattccgtccatcttgttgttgcatatataaaaaggagaagaagaggacgagattttactaaaataaatttaggtatttatacctaggtatttattttctaggaaaacacctgtgcctgcgaggcgactacacctcttatctgctaaatttttcctcatcctcttccttacaaagatatgtattttatacacattatgcaattattacaaagaaaaactatcggttgaacaactcgaaagtaaatttacatccgatcccgctgaatttccagttctcactgctgacgaatactcccacatcaaagacgtgcgtaccgatgccgtagcccacttcaaggtaaggctgaaggtgcggcatagagagcgcactgatataaagacgttcgttctgcacatagcgggtatatttcatcaaatgccggagaatgaggaaaggggcctcataagtgaaatgtccgcgtacatagcggcgggaggagttataccaacgtccgtcgagcacttgaaacacaccgccgatttcatcattccaccctaccggcagattatgacgggcaaaattggcaaagtccacaaagtacagttcatcctgattggtaaatgccccgaagccgaaacgataataaatatttcgcatcagtcccagctgaatcttatgttgaagatcgaattctatccgttcatattctccggtacttttgaatactccttctatcccccgttcatagtccaccgaaaatgtcggatagtcagaacggagattgatcttacgctttccgttcatataataataaagcgccggagtccattccacccggatgcgcggggcaaagctgatataggtatttctgaagcgttccataaattccggcggaggcatcggatagtcacccgtaatcacaaaacgggatttctcgacggctgttctcttgtgtgccgagaaaccgaggctgatatccagtccgttggtaatttcaaaactatgccggaagttgaaatacaagtccttgaaataatccagatggatgaggtcgaaattaaagatactgtccggcatcgctttcagttcgtccagcatcttgctgctatagatgcggttaccattacccacactcagccggaaaaagccccgtttttgcggccagtactcaaagtcggcattcaacgaccagtagaactctttccgtgtaaagttataacccagtttgggcacgatgcggagccacttgtcacctctgaaaatccgattgtaacggaagtcctgccggtacgacaatccgttgcttccgctataactgaacaaaagcggattgataaacggcgagaagcggacacttccgatattggacaggttgaatttataatcttccaccatcaggtcgcccatcgttccccagaaagcctgactcttggttttctgttgcaccgacacggtatcccgcctgtatgtataatctttgtaaagttgcttttctccttcactcaaagggatggggcgtagcacgccgaacgtggacgcatctgttttataggcattcgtatcgcactgcaaggagaatgattccgacagattatactttttcttctctttcttccgaacctttctttctttcagttctatcgatttatagtccagcgaggcggtataattgccgtccaccttatttcccaggaacttaaaaagggcctccacgtcataacgtatcgggagaaattcatctttctttcctacttcccccatcttgatccagcaagtaaacgtaatcagttccgaccgccccgaaaaacggatttcacgcacgctccatacattgctgctgacaatcatatagccgcccaccagctggtcgctcttggtacggggaatgaaacgtatccggtagtcgagattattgggatcgcccatcacactgtctatccggtatttgtagtatttctgcccgttcttggcaagcggagacagcaagcgttcgtcattcagaagagaagatgagtagatattgacactaaaatattcaagtaatcccggcagtcccctgtttcctctcacagtgccttgtgatgccttaactttctggtcatagatattgggagctgtataatgcaggtcactatacgtttcgagcaagtattcacgtacccccttctgcaagcgaaacatcgaaggaacgtaccggaggataaaattcttcttctgaatattcatcttaccctttatatataggttcgcgcgatagtcgctcactatactttcataagagggagcaaaagtcatgacacgctcaatgatggaatcagcagatatctcctgacttgtataaggattaagaacaagattggctgcccccttcggaataaaagagaacaagcacaacatacatcctatcaatatcttatatttcaatcgtcgtatctccttgtttattgtaggcaaatataaaaaagaatatcgaaaagcaagggaattaagctgcaaaaaagcgttagcaaggaaaatcctttctcaatgccacgcatcatatcagttttcatggacatttttctacttattaaatccacttcccaatttcttcaatcattacagtagaatacaataaacattttctctataaaaaataatatcttcgagtgcatgaattaattcgtccggctataggcaacgtttcgtccgcctataggcaaacgcaacgtcgactataggcaaacttgcatccggctataggcggacgaattaatttatgcactccaaagtattatttattgcacaagccgggactaaatttagtataggataaaaaaacgcatatgcaaatgaacgcctcgatgggaaaacatttacagttcctcacccaaatggctatggacagtactacaatgaagctgctatacagaaacataaacaagcattatatgcaggtagaaatactagtcaaacagatggctgcagaaatcgaccgacagaaaaacaaggacggacagcaggaaatactggaatccatctcttaatcggttataatcaaaaagtgccgtgatggacaaaaggtgattcagagacgaatcaatcctataaggagggggtattcttcagaaaaatatatcattttccgaaaataccccctttaaaataggggtactttcagaaaaaacatatatttttgcgccatcaaccgataaaaagaagacgatttatgtcaaaaatgagattttacgcattacaagaactttccaaccggaagccgctggaagttactgccccttccaacaaactctctgattattatggtagccacgtattcgaccgcaagaagatgcaggagtatcttccgaaggaagcctataaggctgttaccgatgcaatcgaaaaaggtacaccgatcagccgtgaaatagccgacctgattgccaacggcatgaagagctgggccaagtcgctcaacgtcacccactacacacactggtttcagcctctgacagacggaaccgccgaaaagcatgacggctttatcgaattcggcgaagacggcggagtcattgaacgattctccggaaaactgctgattcagcaagaaccggacgcttcttctttccccaatggcggtatccgtaatacattcgaagctcgcggatataccgcatgggacgtttcttctccggcattcgtagtagataccacgctctgtatccctacgatctttatctcttacacaggcgaagcgctggattacaagactccgcttctgaaagcacttgctgctgtagacaaagctgctacggaggtttgccagctattcgacaagaacgtaacacgcgtctttaccaacttaggatgggaacaggaatatttcctcgtagactcctccttatataatgcacgtcccgacctttgtctgaccggacgtaccttgatgggacactcttccgccaaagaccaacagttggaagaccactatttcggctccattcctccacgtgtcaccgcatttatgaaggaactcgaaatcgaatgtcacaaactgggcatccctgccaagacccgtcacaacgaagtagctcccaaccagttcgagctggctcccatcttcgaaaactgcaacctggcaaacgaccacaaccagcttgtcatggacttgatgaagcgtatcgcacgcaagcatcacttcaatgtattgctgcacgaaaaaccatatagcagcgttaacggctccggcaaacataataactggtcgctctgcaccgacaccggcatcaacctgtttgcccccggaaagaacccgaaaggcaatatgctgttccttactttcctggtaaacgtactgatgatggtatacaagaaccaggacctgctgcgtgcctccatcatgagtgccagcaacagctaccgtctgggagcgaacgaagctcctcccgccatcctctcctgcttcctcggttcacaactctcggcaaccctcgacgaaatcgtacgccaggtaggaaatgagaaaatgacaccggaagaaaagactacgctgaaactgggaatcggacgtatcccggaaatcctgctcgatactaccgaccgcaaccgtacttctccttttgccttcaccggaaaccgctttgagttccgtgccgccggctcttcttccaactgtgccgccgccatgatcgccatcaacgccgccatggccaaccagttgaacgaattccgcgcatcagtggagaaactgatggaagaaggagtgggcaaagacgaagctatcttccgcctgctgaaagaaaccatcatcgcttccgaagccatccgctttgaaggcgacggttactccgaagaatggagacaggaagctgcccgccgcggactgaccaacatctgccacgtgccggaagcgctgatgcactacgtagacaaccagtcgaaatcggtactgatcggcgaacgcatcttcaacgaaaccgaactgaacagccgtctcgaagtagaactggaaaaatacaccatgaaggtacagatcgaggggcgtgtattgggcgacctcgccatcaaccacatcgtgccgacggctgtcacctaccagaaccggctgctagagaatctgtgcaaaatgaaagaaatcttctctccggaagaatacgaagtattgagcgctgaccgcaaagaactgattcgtgaaatctcgcaccgggtgacttccatcaaagtactggtacgcgaaatgaccgaagcccgaaaagtagccaatcacaaagataactacaaagagagggcattcgaatacgaagaaaaagtgcgtccttacctcgataaaatccgcgatcatatcgaccatctggagatggaggtagacgacgaaatatggccgctgcccaagtatagggaactcttgttcaccaaataaaaaactcctgaagattgcacgaaagaacctacttttgtgcaatctttttatagattcgttcattttctcattttttctttctacttttgtgctgtataacacagttttgtagcacccatggtaaaaatgaacatgtcagacatcgatatttcggaaccattatccgatttgttagctcctttgaataacgaacaaagggagtttctgatgaacaattatacgatacagacctacaaaaagaacgaaaccatctactgcgaaggggagactccctctcatttgatgtgcctcattaccggcaaagtcaaaatcttcaaagatggtgtaggaggtagaagtcagattatccgcatgattaaacagcgggaatactttgcgtaccgtgcatacttcgcaaaggaagacttcgtaactgccgccgccgctttcgaaccttctgttatctgtctcatccccatgactgccatcaccacgctggtcgctcaaaacaacgatttagccatgttttttatccgccagctttctatcgatctcggcatttccgacgaacgtaccgtcagcctgacacagaaacatatccgtggacgtctggcagaatcgctgattttcctcaaagagagctatggactggaagaagacggatcgacattgagtatttatctttcccgtgaagacctggcaaatctgtcgaacatgaccacctcgaacgccatccgtaccttatcacagttcgctacggaacgtctgatcaccattgacggaagaaagatcaagatcatcgaagaagaaaaactcaagaaaataagcaagataggataatacagaccttatacgatcataaaaagtgatctgaaactttaactggaagccgatgttcgtcacatcggcttttttatttctatactgttggaacttaccaattaaacaagtacatttgtcctgtcaatatattaataacttaacacaatttcagaccatgaagaaaagtatttcccttcttcttttatccttgctcatgattacccccagttgtcagaagccaaaagaagtgacgaacgagtacaacatcgttccgcaacccaaccagcttgttcccaaagaaggccgcttcgaactgagcaacaaggtccggctggtagttccgtctgatgctccggaagttaaaaaggtagccgacggctttgccgaacagctgaaacagactgccggaatctctctgacagaggccgaaagcgtggatggaaagcctgctatcagtttcgtactacaagaaggtatgcctaaagaaggttacaagctgtctgtcacccccacccttattacagtcacagcttcccagccaaatggatttttctatggtgtgcagactatttatcagcttcttcctcccgccgtatacggaaaagagctgaagaagaaagccgactggtctgttccggctgtagagatcgaagacgctccccgctttgtacatcgcggactgatgttggacgtttgccgtcattacgcaccgatagagtatatctacaaatttatcgacctgctggcaatgaacaagatgaacgtttttcactggcatctgacggacgatcagggatggagaatcgaaatcaagaaatatccgaaactgacagagataggttccaaacgcgaaaaaacgctggtagactattattatgtgaactatccgcaagtattcgacggaatagaacacggaggatattacacacaggaacagataaaagaggtggtagcttatgctgcaagcaaatatatcaatgtaatccccgaaatagaaatgccggggcatgcattggcggctctggctgcttaccccgaattgtcttgtgattctacacagacatataaagtatcacctacgtggggcgtattcgaacaggtattctgcccgagcgagaccactttcaagttctttgaaggagtcatggacgaggtagtcgaattatttcccagcgagtacattcatatcggaggagacgaatgccccaaaacagcctggaagaacagtactttctgccagcagttgattcgtcagttaggcttgaaagatgacgcgactcccagcaaagtggacggagtgaagcacagcaaggaagataaactgcaaagttacttcgttacccgcatggaaaaatacctgaacggtaaaggacgcaatatcatcggctgggacgagattttggaaggcggcctggctccaaacgccactgtcttgtcatggcgtggcgttgaaggcggattgaatgcggccaaagcaggacacaacgcaatcatggctcccatgccttatgcttatctggacttctatcaggaagatccggaaatcgccccgactaccatcggcggatacacaacgctgaagaagacttatagctacaatcctgttccggataatgccgacgaactggtgaagaaacatatcatcggtatgcaaggcaacctctggagagagtatatgaaaacttccgaccgggtagattatcaggccttcccacgtgcgatggctatcgcggaaacgggatggacactggatgccaacaaaaactggaagagtttctgcgaacgcatggttacggaatttgagcgcctggaagtcatggataccaaaccctgcctcaacttcttcgacgtaaacatcaatacgcatgcggatgaaaacggtccgttgatggtattgctggaaacattctacccgaatgcggaaatcagatacaccacagacggcagcgaaccgacttacggttctacactgtatgaacagcctttcgtgcttgaaggaaacatcgacttgaaagctgctgctttcaaagacggcaagatgctgggcaaagttaccaacaagccattgtatggcaatctgctggcaggaaaaccatttaccgtcaattatacaatgggatggacaggggatattttcggcgacaatgatgtattgggagctgacaaaacaactttcggtctgacaaatggaaagagaggtaacaatgcttcttacactccgtggtccagtttcgcaatcgtagaaggtaaagacctggaattcatcgtccatctggacaaaccgacggaagtaagaaaagtggtcttcggctccttgtttaatcctgccatgagaatgctccctgccggaggagttgccgtagaagtatctgccgacggtcagcaatatactcagatagccgaaaaggccttgaagcatgattgtccggaaacgggaagaatcgcattcaccgactctatcgaatttgaaccgacacaagccactttcctgaaagtaaaaatcaaaaatggcggtaccttgcgtaatggcgtcaatttcaaaaagaacaacggtccggaagtcattcctgccgaattgtggatagacgaaatcgaggcatattaatgcctgtgacataacaaaaaacggtggacatgcagcttgttgctcatgtccaccgttttttttattgattcagttcttatttattccatgcaaagcattccgccttgcttcatctttaaataattccctttgcagaaagataacgttccgcctcgatagcagccttacagccacttcccgctgctgtaatagcctgacggtaatgcggatcagccacatctcccgctgcgaatactccgggaactttcgtacgggggctgtcaccatctgtaataatgtaacccacttcgtcagtgtcgatatactctttgaaaatatccgaattcggtttgtgaccgatagccaggaagaaaccgtcgataggcaggctgtaacgttcttcgtccgattcgccccaacgcttcacaacattcataccttctacgccgttatcgccaaacaggccgactacattgtgttcgaaaagtacttcaatcttctcgtgcttctgcacacgttcctgcataatcttcgatgcacgcaggtaaggtttgcgaaccaccagatatactttggatgccagaccagccagatagatcgcttcctcacaggctgtatctccaccgcccaccactgcaacgaccttcttccggtagaagaaaccgtcacaagtagcacaagcgctgactcccattccggcgtatttcttttcgtcttccagccccaggtatttggccgtagctccggtagagatgatcaatgcttccgtttcaatcaccttatcgccgtcaatcgttatttgataaggagctttgctcaaatctgccgctgtcgcaataccgaaacggacgtccgttccgaaacggctggcttgcgcgcgtaaatcttccatcaactgcggaccactgattccttccggataaccggggaagttctccacatccgtggtagtcgtcaactgaccaccgggctgcaatccttcataaagcaccggacaaaggttagcacgtcctgcatagatcgctgccgtatatccggcaggccctgagcctataatcaggcattttactttttctatttctgccgttttatattccaactatctcgtctcttactcaaaagaatattctatcgtaagtctatcacttccgcagtggggtatgccttccggtcgaaagtgaaaacatgatccgcataatccagtccggtctgataagctgtcacggtaatctcattacgcgtttgctgaccacgttgctgaagctgaatgtaaaccggttcatacgtactcttcgtcacataaagcgtaatgctttccaactcttgctttttatcattggcagtcagaatcacttcccaaacagctttaccctgatatgtcttcacagttcccagcttataagagaatcctttctgatacatataaagaaaggtatacggattgatctgctgcaactcttcctgagtgggattgctgacattcacttcatcatttctcaccatgtagctccactgtgttttcccgtcaaaccaagtggtggtctcggaagtcttcagcataaacttctcgcccttcaactgaatgataccgttctcccgcccttccaaacgaccgtcattgacagccttcaaggtaaaatcggccctcacaccacctgccttcttaaacgcttcggccgtcttctccagaacagctttagcctgcgactgctgttgttgagcaatcacaggcagtgacagtaaagctattaaaacactaaaaatgtatttcttcatttgattaataaacgatctgttattgtaaattgttcaaacgcatttcaagatcattatcgtcgacacagagtacgtcacgagccttgcttccctgtgtaggtccgacgattcccgccttttcaagctggtccatgatacgtccggcacgattgtaaccgatagcaaatttacgttgaattaacgaagtggaaccttgctgatggatgaccaccaagcgtgccgcatcctcaaacaacggatcgagacgtcccatatcaatgtcgcccacttcactgccgctgtcttcgctcacatactcgggcaggaagaacggagtaggataactctgctgacgagcaataaatttcgtgatctcctccacttccggcgtatcgataaaggcacactgcacacgtaccggatcagcaccttgcaggaagagcatatctcccttaccaatcaggcggtttgcccccggacggtcaagaatcgtacgggaatccatcatggcggatacacggaacgcaatacgtgcggggaagttcgccttgatcgtacctgtaatgatattcgttgtcggacgctgcgtagcgatgatcatatgaataccgaccgcacgtgccaactgcgcaatacgggcaatcggaagttccacttccttaccggcagtcatgatcaaatctccgaactcgtcgatcaccaccacgatatacggcataaacttatgtcctttctccggattgaggcggcggttgataaacttctcattatactccttgacattacgtacatgagccatcttcaagaggtcatagcgtgtatccatttccacacaaacagaattcagcgtttgcactaccttggtcacgtccgtaataatcggttcgcctccatcaggaagtttggccagaaaatggttttcaatgacggagtaaatgctgaactccaccttcttcgggtcgaccagcacaaatttcagttcagccggatgtttcttatataataaggaggtaatgattgcattcaagccgacagacttaccctgaccggtagcacctgccaccaacacgtgcggcatcttgcaaaggtcgaacatgaacacttcgttcgtgatcgtcttacccagtacaatcggcaagtcaaatctggattcctggaacttcttgcttccaatcacgctctgaccggatacaatcttcggattcttgttcggaacttcgataccgatggttcccttacccggtatcggagcaatgatacgaataccatccgccgacaagctcagggcgatatcatcctccaagccacgaatcttcgagatacgcacaccctgttcaggagtgatttcataaagagtcaccgtaggacctaccgtagctttgatcgtactgatttcaatgccaaagctgcgcaatgtattaatgatacggtctttattcgcattctgctcgtccatgtcgatcgtcggatcgtcattctcaaaatgcttcatcaagtcgattgtcgggaaacggtaattttccagatccttcatcggattataaggttcttgctccggaccctgatattcttcttccgacgcagctgtctctacctgaaatccgggttcatcctcacccggcaattcatcctgagcaattggaggaaccacatcgcttacggtcggttcaaagaccatagtcaccccttccgcctcatcagcagaaggaagttcgtcgtccggttccggtgcgttgaccggagattcttctttcggctcttctgcctgtatatccatcacgggagcaggaggaggtgtttgcttataagtacgtttcagattgaactccacttcctgcggttgcgaggtcgtgaactcctgtgttccttctgccgcagtctccttttcttcttctttcttctgacgtttgaggaaactcagagcaaaaagtttgcgcaaccagattactgtccgtgcacttatatatataaagaagcagacagccgttatcagcaggatcatccatactccgggaactcccacctgcgaaaccagccagcggcttacattgtaaccgtgcatacctcccagataaatgaaagaatcctgataatgatccatcaaagcgaagccgaagaatacggagaaccacaccaataataatgtacaaccgataaaccatttccacagacggacaatgcgcacccgcatcagtttcaatcctgccaccgccagaaagacgaggataaagaaagaagatatcccgaagcagtcatttatcagatagctagctaactgtgctccgcgagatccggcatagttttttacattattattaaccgccgcaaggtctgccgagctgccgctgtcgataatactttggtcggccgcccccgtaaagaagaaggaagaaaaagccaacaaaagataaacggaaaagatcaccagcatcaatccgagcacaaaatgaacggtttcattcttaaaaattgatacaatctttccgggagaagacggagtgcgttcagcctccttatctattttcttttttgccatgagtctttattctttaaataaattggaatccgtattataagccgcaaaaataataaaaaaataacgagcagtactctcattcaatcctttttcttacctttgcgattcaaatcaatctgattatggaaaaagaaagccaaacgatatttgaaaagaatgtgatcgagttcgtaacggtagccgccgaattttgcgcattcctcgaacgtgccgaacacatgaagcgcaaagcttttgtcgacacgtccttaaaaatacttcccctgctctatctcaaagcatccttgcttccgaagtgtgaaacaatcggagacgaggcacccgaaacgtatgtgacggaggaaatttacgagattctgcgtatcaatctagcagggctgatgggtgaaaaggatgattatctggacgttttcgtacaggatatggtgtacagtgaccagcctatcaaaaagtccgtctcggaagatttggcggatatctatcaggatatcaaagattttattttcgtcttccagctgggactgaacgaaaccatgaacgactcgttggccatctgccaggaaaacttcggtctgctgtggggacagaagttggtaaacactctgcgtgcccttcacgatgtgaagtataaccagcagaatgagaatgacgaagaagacaacgaggaagagaataacgaactaagcgatgacgactattgttgtgaagaagacggttgtcactgccacgacgacgaatgtcattgtcatgaggacggttgccattgtcgtaatgacgaataaacaaaaatgatagtaagaagaagtataaataaagacgaactaaaggaactcccgaaaactgtatttccgggacgaatccatgtgatccagtcggaagcggaaacagaaaaagcagtagcttacctgcaatctcagccgatactgggtatcgatagcgaaacgcgcccatccttcaccaaaggacaaagtcataaagtagcacttctgcagatttcttcagacgaatgctgtttcctgttccgcctcaatatgaccggactcacccaacctttggtcgacctgctggaaaatccggctgttatcaaagtaggactgtcgctcaaagacgactttatgatgctgcacaaacgtgcaccttttacccaacagagctgcatcgaactgcaagactatgtacgccagttcggcatacaggacaaaagtctgcaaaagatttatgcaatcctgttcaaagaaaagatttccaaatcacaacggctgtccaactgggaagcggacgtactgagcgacggacagaaacaatatgccgctaccgatgcctgggcttgcctcaacatctacaacctgttgcaggaactgaaacgaaccggcaactacgaggtcgaaagcctccctgtagaagaagaggttgacgcaaatgctcccgccaatcgctgacaaatgaccgataaaagactaattaataactgataaaatagcattttaaacaacatgcataaagtatacctcaaacccggcaaagaagagtctttaaaaagatttcatccctggattttctccggagcaatcgctcgtttcgatggagaacccgaagaaggtgaagttgtagaagtatacacttcgaagaaggaatttatagccgaaggacatttccagatcggaagtatcgccgtacgtgtgctctctttccgtcaggaacccatcgaccacgatttctggaaacgtaaactgcaaattgcctatgatatgcgttgtggaatcggtatcgcagtcaatcccaccaatgacacctaccgtcttgtacacggtgagggagacaatctgcctgggctggtcattgacatttatgcccggactgccgtcatgcaggcgcactccgcaggaatgcatgtagaccgcatgactatcgccgaagccctgtcggaagtaatgggtgacaagatcgaaaatatctattataaatcggagactacactgccttttaaggcagatctttttcccgaaaacggtttccttaaaggaggaagcagcgataatatcgcacgggaatacggcctgaagttccatgtagactggctgaaaggccaaaagacaggattcttcgtagaccaacgcgaaaaccgttcactgctggagcattattctaaagaccgttcggtactgaatatgttctgctacaccggcggtttctccttctacgctatgcgtggaggtgcaaagctggtacattccgttgacagttctgccaaagcaatcgatctgactaacaaaaacgtagaactgaatttccccggcgatgcgcgtcacgaagctttcgccgaagatgctttcaaataccttgaccgcatgggcgaccaatacgatttgataatcctcgacccgcctgcatttgccaagcataaggatgctttgcggaatgccttgcaaggttaccggaaactgaatgccaaagcattcgaaaagatcaaaccgggcggcatcctgtttactttctcctgctctcaggtggtaaccaaggataatttccgcacagctgtgtttaccgctgctgctatgtcaggacgtagtgtacgtatcctgcaccaactaacccagcctgccgaccacccggtaaatatataccatcccgaaggagaatacctgaaagggctggtactctatgtagagtaatatatgtcataaacaccatgaacttgcataaacaaggggtgaataaaagaaaaataatagtttcaaagttaattagagttaacaaatagaagtttttcggcaaatcattatgttctataacataaaaccctttatatttgcactgtgtttttcatggtattagatttaaggttaataaagattggctgtctgggatagatagccttctttttttatatgcctatccaccctctttttaacagtaattcttcactattcttcgcatttatggcttttttatcccctttttatcgattaacttgtccacccaatcaacgaaaatattatatttgcatctattattaacgtaaaaagagaaacacaaattagaaaagtcatgagtataaaagttcgtttgatcattatgaacttcctgcaattctttgtatgggggtcatggttaatttcactagggggttacatgggcagagaactccacttcgaaggaggacagatcggtgccatcttcgccaccatgggtattgcctctttagtcatgcccggcatcattggtattatcgccgataaatggttcaatgccgaacgtttatacggactttgccacatcgcaggggcagcttgtcttttctatgcctctaccgttacgaattatgaccagatgtattgggctatgctactcaatttattggtatatatgcctaccctgtcactggccaataccgtttcatacaatgcactggaacaatataaatgcgacctgatcaaggacttccctcctatccgtgtatggggaacgattggttttatctgcgccatgtgggcagtagaccttaccggattcaagaattccagcgcacaactttatgtaggcggtgcatccgcactcttgctgggtttatactctttcaccctgccggcatgcaaaccggccaagacagaaaagaaaacattactttcttccttcggactggatgcattcgtattattcaaaagaaagaaaatggctattttcttcctgttctccatgcttttaggagcagcattgcagatcaccaacacgtatggtgaccttttcctcgggagcttcgccagtattccggagtttgcagattctttcggagtaaaacattcggtgatcctgctgtctatttctcaaatgtctgaaacattatttattctcgctataccattcttcctgagacatttcggcatcaagcaagtgatgctgatcagtatgttcgcctgggtattccggttcgggctgtttggcttcggagatccgggttccggtctgtggatgctgattctttccatgatcgtgtatggtatggcgttcgacttcttcaacatttcaggttcgttgtttgttgaacaagaaaccagttcctccatccgtgccagtgcccaggggttgttctttatgatgaccaacgggttgggtgccatcatcggaggatatgccagcggtgctgtcgtagacgcattctcagtatatgctgatggcaaactagtgagccgtgaatggccggacatctggtttatctttgcggcgtatgcactggtgatcggcatcctgtttgctctggtattcaagtacaaacaccaacgagagaataaagtaaattaagtaaaaaagaacaatggacaaaaaagtagaattacaagttttaaatatcacaaatagccaagcgcaagtaggcgcttttgccctactgttgggtgaagtgaacggtgaacggcaactgcctatcatcataggtcccgctgaagctcaggcaaccgccctgtatatgaagggggtcaaaactccccgccctctgacacacgacctgttcatgaccattatcggcgtattaggagctagtttgctccgcgtattgatctacaaggcgaaggacggtattttctattcctacatttaccttaaaaaagacgaagaaattatacgtatcgatacacgtacctcggatgctgtcggtatggcaatccgtgctgaatgtccgatcctcatttatgaatccattctggaacaggaatgccttcggatatcgaacgaggaaagaagacatcctgaagagtctgatgaagaagcggaagacgaaaagaagcgggatctgcctcgcaacgttacttcaatgtcactcgaagaagcattggatcaagcaatcaaagacgagaattacgaactggctgccaagatacgcgaccggatcaattcaagaaatcaaaaccactaaccaattatgcacgtattttatactcccgatatacagaaaaactacgaacttccggaagaggaagcacaacattgtacccgcgtcctgcggttgggtatcggagacgaaatcactcttacggacggtaagggacatttctataaagcagaaatcacggttgcaaccaacaagcgttgccttgtagccatcaaagaaacaatctttcaggaaccgctctggccgtgtcatctgcacattgccatggcgccgaccaaaaatatggaccgcaatgaatggcttgccgagaaagctacggaaatcggatttgacgaactgacttttctcaactgccgtttttccgaacgcaaggtgattaaaaccgaacggatcgaaaagattctgatatcagccatcaagcaatctcttaaggctcgcctgccgaaactcaacgaaatgacggacttcgacaagttcattgcacaagagtttcaaggtcagaaatttattgctcactgttacgaaggcgaaaagcctcagctgaaaaatgtactgaaagcaggagaagatgctctcgttctgatcggtcccgaaggagacttcagcgaagaggaagtgaagaaagccatcgaatgcggattcactcccatcagcttgggtaaatcacggcttcggacagagacagcggcactcgtggcttgccacacaatgaacttattgaaccaataataacttttaaatagtatgagtatggcaaagaaaatgatctcacggctctcggtactggcagtactgattgtgtttctggcagcatgttccaaacaaacggaatatacgaacgtaataccggcagacgctacggctgttgcctctattgatttgaaatcactggccaacaaagccggaatgaacgacaaagaaaatgaagctgctaaacagaaactgctggaagcaatgaaaagcgggatgaatgctgccactttccaacagttggagaaggtgatcaacaatccgggagcatccggtctggatccggaagcaccgatctatatctttagctctccccaaatttccggtggtgcattcgttgccaaagtcagcaatgaagacgatttgcacgcttccctcgatgtgatggcaaaagaacaaatctgccagccggtcagcgaagcggacggatatagcttcactaccctgaacggaaacttgcttgctttcaatgaaaccactgcaatcattatctctgccagcagaacttctcagacagaagcagccaaagaagccatcaccaaactaatgaaacagactgccgacaacagcattgcgaaatccggagccttccagaaaatagccaagcaaaagagtgatatcaacttcttcgcctccatgtcagcaatcccttctacttacagaagccagatcagcatgggacttccttctgaaatcaaaccggaagacattaccatcctaggcggactgaacttcgaaaaaggcaagatcgcccttaaaacagaaaactacacggagaacgacgccgtcaaagcgcttctgaaaaaacaaatggaatcatttggaaagacaaacggcacattcgtgaaatactttccggcatctacgctgatgttcatcaatatgggcgtaaaaggagacggactttacaatctgttgagtgagaataaagaattccgcagcactgtgtctatcgccaaagcggatgaagtaaaagaactgttcagttcattcaacggcgatatctctgccgggctgatcaatgtaaccatgaacagtgcccctacttttcttgcttatgctgatgtaaagaatgggaatgctcttgaagctctttacaagaacaagcagtcactgggcatgagaaaaggagaagacatcatggaactgggcaaagacgagtatgtctacaaaacaagaggcatgaatatatttttcggcatcaaggacaaacagatgtatgctaccaatgacgaactgctctacaagagcattggcaaaacggttgacaaatcgatcaaagacgctccttacgcagcagacatgaaaggcaagaccgtatttatggccatcaatgcagaagccatactggatttaccggtcgtaaagatgctggtaggcttcggaggcaaggagttcaagacttattctgatctcgcttccaaagtttcttatttatccgttagttcggaaggagaaacaagcgaaacagacctttgcctgaaagacaaagatgtcaatgccctcaaacaaatcgtagattttgccaagcaattcgccggcatgtaattcgtcaatgaacggcatgaatagtattcacttacagcaaacacttccccaagtgtttgctgaccgtaattcggtgacctctgatgtatggcatcaggaccttatcttccggaaaggagaaatgtatctgatagaagccgcctcaggcaccggaaaatcatcgttgtgcagctatctttacggctatcgcaacgattatcaaggaattatcaatttcgatgaaaccaatatcaaagcatattccgtgaagcaatgggtagacctgagaaagcattcactgagtatgctttttcaagacttgcgtatcttcaccgaacttacagcgatagaaaacgtacaactgaagaataaccttaccggacacaagaagaaaaaagagattctttcattattcgagaagctgggtatctcagataaactgaacgtgaaagccggaaaactttctttcggccaacaacaacgggtcgcttttatccgtgcattctgccagccgttcgacttcctgtttctggatgagcctatcagccatttggatgatgagaacagccgcatcatgggagaaatcatcattgacgaagccggaaaacaaggtgccggagtcatcgccacgtccattggcaaacatatcgaactgccatacaagaaggtgcttcaactataatagaatctgcgtcattcgcgcctaaaaatataaaaatacaaaataatgaatacccttgtctggaaacttctccgccaacatatcagtatcggtcagttagccggtttctttttagccaacttgttcggcatgatgattgtattgctcagcgtacagttttacaaagatgtcattcccgtattcaccgaaggagacagctttatgaaaaaagacttcatcatagcaaccaagaaaatcagtacgctcgggtcttttgccggaaaaagcaatacgttctctcccgatgacatcgccgatctgaaaaaacagtcgtttaccaaaacgataggagctttcaccccttctcaattcaaagtttcggcaggattgggaatgcaggaagcgggtattcatctctctacggatatgttcttcgagtcagttcccgatgaatttgtagatatcaaactcgataaatggcacttcgacgaagaaacacataccattcccatcatcatcccacgcaattatctgaatctgtataacttcggtttcgctcaaagccgcagtctgcctaagttgtcagaaggactgatgggacttattcagatggacatcatgatgcggggcaacggacgggtagaacaatacaagggaaacatcgtcggtttttccaaccgtctgaatacgattctcgttccgcagtctttcatgaactgggccaacaagaacttcgcccctgacgcggaggcacaacctgcccgactgatcatcgaggtcagcaatcccgccgactcttcgattgccagctactttcaaaagaaaggctacgagacggaagacgggaaactggatgccggaaagactacttatttccttcgccttatcgtaggtattgtgctgggagtaggtttattcatcagtatcctgtcattctatatcctgatgctcagcatattcttactgctccaaaagaatacaaccaagctcgaaagcctgcttctgataggctacagccccaacagagtggcgctgccttatcagatactgaccgtaggactgaacatcatcgtactgattttatctgtcggattggtatgctggctgcgcagctattacatagagagtatcagactcctcttcccgcaactggaaaccggttcgttatgggcagctgtcagtatgggtattcttttattcctcatcgtatcagtcattaatatactggctgtgaagcgaaaagttctttctatctggatgcataaaaattaaaaacacaatatatgaaaaacaccactactcttcaaagtaaaagaagtattacagtactcttgggagtccttctatatttctcatcgctatctgcacagaccatgcaagatacgattatagctaacttcagtctgatggaaagaattcctaaagaaaagttgtacctccatctggacaagcctttctacggagccggagaaaagatatggttcaaaggctatctggtgaacgccaccacccatcaggacaactcacaaagtaattttatcattacggaactgatcaaccgttccgactccattgtggaacgaaagaaaatccgcagagattctctcggattccacaacgccttcaccctccctgccacccttccggcaggcgattactacctgcgggggtacagcaactggatgctgaatgaagaccccgactttttcttttcgcgcaacatcaagataggaaactctatcgacaataccatcgtttcgagcattgagtatcagcaagaagacgatacacattacactgccaaaatcaaatttacaagcaacgtacaggctgttttcgaaaatacaacgatcaaatacctataccttgagaatggtaagataaaaaacaaaggcaaaaaaaagacggacgaaaacggctggatttccatttccctgcccgatttaaaatctccggcagcgcgcagaatagaagtagaatttgacgatccgcaatatatctacaaacggactttccatctgccggtgttcaccaatgatttcgatgtgaagtttttccccgaaggcggtgccctactcagcattccccatcagaatgtcgctttcaaagcacagggagcagacggtttttctaaagaagtcgaaggtttcttgttcaactccaaaggagacacgcttaccaatttccggtcggaacacaacggtatgggtatctttacaatgaatcccgtcaacaatgagacttattatgttacggtaagaaccaatgacagtattaccaagcgatttgaccttcctgccatagaaccgaaaggaatctccatcgccatgtcgcactataaacaggagattcgctacgaaatccaaaagacagaagcgaccgaatggcctcagaaactattcctgcttgcacatacccgtggcaaactggccattttacaacccatcaatccgaaaagaactttcggaaagatgaatgacagcctgtttacggaagggatcactcacttcatgctgattgatgaacaaggaaatgcacttagcgaacggttgattttcgttccggatcataagccgaatcaatggcaaatcactgcagaccaaccgacgtatggaaaaagagagaaggtatctttgcagatcgctgccaaagacaacgaaggtaacccggtagaaggaaccttctctgtcagcatcaccgaccggaaaagtattcaacccgactctcttgccgacaatatcctgtccaatctcctgctgacttcggatctgaaaggatatgtggaagaccccgcatactattttctaaatcaggacgcccggacgctccgttccatcgactatctgatgatgacacatggttggcgcaggcataaaatggaaaatgttctccgcactccttcgctgaatttcacaaattatatagaaaaaggacaaaccatcagcggacgaatcatgggattcttcggagcaaacgtaaagaaaggtcccatctgtgtactggctcccaaatacaatatcatagccaccaccgagacagacgagaaaggccagttcatcgtcaatacctcattcagagacagcacgacattccttgttcaggcacgcaccaagaaaggatttgccggtgtagatattctaatggatcctccccagtacccggtcgctacgcataaagccccttattttaacggagcaactacctttatggaagattatctgatgaatacccgtgaccagtattatatggaagggggaatgcgtgtgtacaatctgaaagaagtgacagttacagcgaagcgggaacgtccgagttcaaaaagtatctatacgggaggtatcaacacctatactgtagaagaagacagactgcaaggatacggtcagacagcttttgatgcagccagcagactacccagcgttacaatcacgaacggaagtgagatacatatccgtaacaattccgaaccggcaatcattgttatcgatgatattgtgtatgaagatgcttccgatattttgaaggatatccaagtcagtgacatgtccagtatcagtctgcttcgaggagcagatgccgtcatactgggtccccgtgcttccggaggtgccgttgtcatcactctgaaagaccctagaaatcttccggccagaccagcgcagggaattatcacttatacgccgctgggatacagtgagtccgtagaattctatcaccccacctatgatactcccgagaaaaagaacgctcagcgttcggacttccggagtaccgtttactggaatccggaattacggttagacgccgaaggcaaagcgaccatagaatactatacaccggacagcacagctcccgaagatatcattatcgagggcgtggacaagaatggaaaggtatgtcgtatcctacagaccattaataagtagcttttctcaacgcttcttcaaacttttatgtagttcaaatttgagttctgcttcctattaaataatcagataaaagcatccaaataacccactgggtcaaaattattttgtatttttgccgtcattaaagaataaagctatgccggactatgatttaatcaccatattagggccaacagcctcagggaaaactccttttgctgcagcattagcccatgaactgaatacagaaattatcagtgccgactctcgtcagatctatcggggaatggacctcggtacgggcaaggacttggcagattatacagtcgacggacatccaattccttatcacttgattgatatcgccgatcccggatataaatacaatgttttcgaatatcagcgggatttcctgatttcttacgaatccatcaaacaaaaaggctgtctgcccgttttatgtggagggacaggtatgtatctggaatcggtactgaaaggctataagctgatgccggtaccggaaaatccggagttacgtgcccgtctggctaatcactctctcgaagaactgaccgaaatcctgaagcaatataaaacattgcacaactctacggatgtagataccgtgaaacgtgcaatccgtgcgatagaaattgaggagtattatgccgtgcatccggttcccgaacgggagtttccgaagttgaacagcctcatcatcggggtagatatcgatcgggaactgcgtcgcgagaagatcacccgacggttgaaacaacggctggacgaaggaatggtggatgaagtaaggcgattaacagaacaaggcatttcaccggacgacttgatttattacggactggaatacaaattcctgacgttatacgtcataggcaaactgacttacgaagagatgttcactgagctggagacggccatccatcagttcgccaaacgtcagatgacttggttccgcggcatggaacgtcggggatttaccatccactgggtcagtgcagagctgcctatggaagaaaagatagcctttgtgatagaaaaactgcgagggaattagtatctttgccagtcatttacgaatggtctgtgaaagataaaaaatgcgattgttaatacagttaggatagaaatacggttatgagtgtagaacctggaaaatggggagtgatctacaaccccaaagcaggtacccgaaaggtacagaaacgatggaaagaaatcaaggagtacatggacagcaaaggtgtcaactatgactatgtacaatccgaaggtttcggttctgtagaacgtcttgccaaaattctggcgaacaacggctatcgtaccattgtcatcgtaggtggcgacggtgcgctgaacgatgccatcaacggtatcatgctctctgatgccgaagacaaggagaacatcgcccttggcatgattccgaacggtataggaaatgactttgccaaatactggggactcagtaccgaatacaaacctgccgtagactgtatcatcaaccaccgtctcaagaaaatagacgtaggcttctgcaacttctacgacggcaaggaacaccaacgccgttatttcctcaatgcagtcaacatcgggctaggcgcaaggattgtgaaaatcaccgaccagaccaaacgtttctggggggtgaaattcctgtcgtacgttgccgccctcttctcgctgatattcgaacgcaaactataccggatgcaccttcgtatcaatgacgagcacatccgcgggcgcatcatgaccgtatgtgtaggaagcgcctggggctggggacagactccgagtgccgtaccctacaacggctggctggatgtatccgtcatctaccgtccggaattcctgcaaatcatttcgggattgtggatgctgattcagggaagaatcctgaaccataagatggtgaaaagctatcggacaagaaaagtaaaagtgctccgcgcacaaaatgcttccgtcgatctggacggtcgcctgctggcaagacatttcccactggaaataggcgtattatcagaaaagacgaccctgattattccgaattagccaacagaaccgggcttctggcgaaaaacagcccttcactcatgaaactataaataagtaattagtaacttgtaattaataaaatgatcgaacttaagaacaatcctgccggtaacttctttctgctggccggtccatgtgtaatagaaggtgaagagatggcaatgcgcatcgctgagcgtgtggtcggagtcactgaaaaattacagattccttatgtattcaaaggttcttaccgcaaggcaaaccgttcgcgtcttgattcattcacaggtatcggtgacgagaaggcactcaaagtgctgaaaaaggtacatgatactttcggagtgcccacagtgacggatatccattcggccgacgaggctgagatggctgccgaatacgtagacattctccagattccggctttcctttgccgtcagacggatttactggttgctgctgctaaaacgggtaagacgattaacatcaagaaaggacagttcctctctccgctcgccatgcagtttgccgctgacaaagtggtggaagcaggcaacaagaacgtgatgctgaccgaacgcggaacaaccttcggttatcaggaccttgtagtagactaccgggggattccggaaatgcaaacgttcggttatccggtcatactggatgtcacccattcattgcagcaacccaaccagaccagcggagtgaccggtggtatgccccaactgatcgaaaccgtagccaaagccggcatcgccgtaggagccgacggtatctttatcgaaacacacgaaaaccccgccgtagccaagagcgacggagcaaacatgttgaagctggaccttctggaaggactattaacgaaattagtcagaatacgggaagctatcaaataactcttttttctgcccgtttgtgattatacacaaaagaatacgacagatatttcaaacaacttttttataaactaaatagaacat

SEQ ID NO: 43 - DNA, 63315 bp, Bacteroides thetaiotaomicron
actttgccataacgaaaaactttatgcctaaagatacaaaaactttgggtaataacaaagcccgggcttgtgaaagtctgggctttgtgcataaaaaaaggttgtgccagcgttttgacacaacctcttcttatttattcaaactccagcgtaccgaagaagtcgggacgatggaagtccggtttctcaatctttatcggattccatgacaggaagtgaggggtttgcagttcatccccgcatttatagaaattcgctttaacttcctttccatccagtgactgtatctgatgcttgaagaatgcagcataaggaataatcaaggctacttcccaagtcgtatcgtccacacgttcttcgaagggttcattgcccagactggaccaacgctgcacgagagccgtcacttctttcggagcgtgttcccgaccgttacgggctggtccggcaccgatcagaatcgttccgatgcagttacattctatattataatagattccgtcactggccggaacagagaaaaactccacacaggaatcagtccatacagatccattgtcttctccatacttggcacgtacactttcttctctgactttgaagtgcaacagaatagaatctttggtatgcgcaatccggaaacttacttttggcttgtaaggatattcagcccagttgacacactgaaccggctggaaatctatcttttcctcatcaaataatttaggaagcgaacaagcctctacattagcagaactaattttctttactttcatatatctttcgtttggaggatacaaatatagttactttctcctaataaggttcccgaaaatcaaataaaaacaatatatttgccattagtaataccctaaacaaccgaattagtgagaaaaacaatccttttatttctgctatttttaagcgtaactgctgtccgtacgttaggacaaaatattactttcagccatttgaccacagatgacggactttcccagttttccgtcaacagcctgtacattgacgaacggggcattatatggataggtacgcgcgaagggctgaaccgttataacggtaacgatatcaaaagtttcaagctcaagaagaatgatccgaacagtctgttcagcaataccgtactccgtatcacaggtaataagaacgggaaggtttacctgctttgcaccgacggtgtagccgaatttgacatgaccactcaacgattcaaaaccctactgcaaggcaatgtggacgctatctactacaacgaaaaactatatatcggaaaaagagaagaagtattcgttttcaacgagaacacgaacaacttcgacctttactaccaccttgccgggaaagacattaacctatcctgcctccatctggacgagaagaaaaacctgtggatgggaaccaccagcaatggtgtttactgcctgtcggacgacaagcaactctctcagcccatcacgaaaggaaacatagccagcatctacgaagactcatccaaagaactgtggattggcagctgggaggaagggctctaccgtatccgcacaaacggcactatcgacaacttccgccacgacccgaagaatccgaacagtatatgttccgattttgtcagaagctgctgtgaagataatctgggaaatctatggatcggaactttccacggcttgaaccgctacgacaaaagcacaggacagttccaactttataccgccaatgacaacaaacccgacggactcacccactcttccatctggtgtatcgtgaaagacgaacagggaaccctatggctgggaacttactttggcggcgtcaactacttcaatccggaatatgaaatctatacccgctataaagtgggagacacggagaaagaaggattaagcagtcccatcgtcggcagaatgacggaagacaaagacggtaacttatggatctgcaccgaaggcggtggcgtgaacgtctacaaccggaaaaacaatacttatcgctggtaccgccacgaagaaggcaagaacagtatctcgcacaacaacgtcaaggcaatctattacgaccggacagaggagattatgtggatcggcacacacttgggaggactgaacaaactcgacctgcgcaccaaccgctttaccgtttaccggatgaaagcgggcgacccgaccacactgccctcggacattgtacgcgacatcgtgccctacgaagacaaactgatcatcgccacacaaaatggagtctgccttttcaatccggcaacgggcacctgtgaacatcttttcaaggataccaaagaaggcagaaatatcggtatggtggccagcctctacatcgacaaggatgaaacgctatgggtttccgctaccggagagggcgtatattcttaccgcttcgacaccggcaagctcacccactatgcacacaatccctccattccgaacactctcagcaacaacaatgtcaacaacatcatgcaagacagcaacggcaacctgtggttctccacttccggaagcgggctcgaccgttaccgcaaggagagcaacgacttcgaaaacttcgacatgcagaaagacggactatccagcgactgtatctacgaagtattcgaatcgtccatacaaaagggagacttgctgctgattaccaatcagggattctcccagtttgactatccgcaaaagaagttttacaactacggtacagagaacggattcccgctgactgccgtcaacgaaaacgcattgttcgtaacgcatgacggagaagtatttctaggcggcatccaaggcatgatttctttctgggaaaagaaactgcactttacgcccaagtcctacagcatcatcctttcccgcctgctggtcaacggaaaggagatcactgccggagacgacaccggcatcttggaacagtccatcgcctatacaccggaaatcagcctgaaagccgaccaatccatgttcagcatagaatacgccacttccaacttcatccctgccaacaggaatgaaatcgtctaccgcctcgaaggtttctccgacgaatggaatcacaccgaccgcaaacagacgcttatcacttataccaacctgaatccgggcaaatatacgctcgtcatcaagtcggacggagacggtatcgaagaagcccgactactgatccgtgtattaccgccttggtatgagacatggtgggcttatctgatttacaccatttgtaccgtcagtctgttatggtatctcattcagaactacaattcccgcatcaaactgcgtgagtcactgaaatatgaaaagaagcacatcgaagacctcgaagcattaaaccaatccaagctgcgcttctttaccaacatctcccacgaattccgcactccgctgacgttgatcgtaggacaggtagaaacgctgttgcaagtacagacattcacacctaatatttatcacaagatattgggaatttacaaaaacagcctccaactgcgtgaactaattacggaactgctcgacttccgcaagcaggaacaagggcacatgaaaatcaaagtcagccgacataatctggtgaacttcctgtacgagaattatctgttattccttgaatacgccagcagcaagcaaatcaatttcaagttcaacaagcagtcggatgatattgaagtatggtacgaccagaagcagatgcagaaggtagtgaacaatctgctgtccaacgcattgaagcatacgaaagcggaagataccatctccatcaacgtatcgcaggaggataaatacgtcattatcgagatcaaagacacgggaacaggcattgccgccgccgagatcgacaagatattcgaccgtttctaccagaccgaacgcctcgactcgctgaataccggagccggcacaggcatcggactggcgttgacaaaaggtatcatcgaacttcatcacggaaccatccgtgtagagagcgaaccgggcaagggaagccgttttatcattacgttgaaatcgggcaaccagcactttactgaggaacaaatcatacgggacaatgccgacgccaacattcagcaaccaccggaaacaatcgttccaaccgtagaaatactgcccgactccgaatggaaggaggaagataataaacgcatcgaagatgcgaaaatgctgatagtggaagacaacgaatccatcaaacaaatgctggtaggtatcttcgaaacattctatcaggtcaccaccgcttccgatggtgtagaggcattggatatcatacagaaagatatgccaagcatcatactgagtgacgttgtcatgccacgtatgtcgggtacggaactctgtaaacaggtcaagacggacttcaacacctgtcacattccggtagtactactgacggcacgcacagccgtggaacacaacattgaaggattaaaaatcggtgcggacgattatatcaccaagccgttcaacaccaatctcctgatctcccgttgcaacaatctggtgaactcacggcggttgctacaggagaaattcagcaaacagccacaggcttttgcccagatgcttgccaccaacccgatggataaagaaatgctggatcgtgccatggccatcatcgaacagcacttggataatacggactttaacgtcaacatcttcgcccgtgaaatggggatggcacgtaccaatctgttcacgaagctgaaagccgtcaccggtcagacaccgaacgactttatattaagtatccgtctcaagaaaggagccgtcatgctgcggaacaatccggagctgaacattacggagatttccgaccgcatcggtttctcttcttcccgctatttcagtaaatgctttaaggagatttatcacgtcagtccgcttgcctaccgcaagggtgaagaaaaagaggaagaagggaacgaagaaacggatcaataacccacaaacaggtaagcaagtagcatttgtaacaggagaacctatgccaaagtagttccctcctgttggcacacttgtgccacgctgctggcacgaccgtgccatcgcggtggcacagctgtgccaacagcgtggcacaagatccgggctacgatgtcaggaaaaggcatccgtagccccgaaacatttaaccctttagaatggactattttgtatcacacctgtacattcctgctcactcatttccgccaatcctcttatctttgtgttcagtaatcactccataaaagaccaacattatgaagaatgtctcacgtttactaccgctattgcccggtatagccctgctgaccggatgcaatcagaaagtacaaaaagacaacggacaaaactcacaaaagcctaacattatttatatattcgcggacgaccttggcataggtgaccttagctgctacggagcgacaaaggtcagtactccccatatcgaccgccttgccggacagggcgtacagttcaccaacgcctatgcaacttccgccaccagtaccccttcccgcttcggactcctgacaggcatgtacccgtggcgacaggagaacacaggcatcgcccccggaaactcggaactaatcatcgacaccgcctgcgtcaccatggccgatatgctgaaagaagcaggttacgccaccggagttgtcggcaaatggcatcttggactcggtccgaagggaggcaccgacttcaacggccacatcacccccaacgcccaaagtatcggcttcgactacgagttcgtgattccggcaaccgtagaccgtgtcccctgtgtattcgtcgagaacggacacgtggtaggactcgacccgaacgacccgatcacagtgaactacgagcataaagtaggcgactggcctacaggcgaagagaacccggaactcgtaaaactaaaacccagtcagggacataacaatacgataatcaacggcatcccccgcatcggctggatgaccggaggtaagtccgctctctggaaagacgaggacatcgccgacatcatcaccaataaagcaaaaagcttcatcgtctcccataaggaagaacctttcttcttatatatgggtacgcaggacgtacacgtaccgcgcgtcccacatccccgcttcgccgggaaaagcggtctgggaacccgcggagacgtaatcctgcaactcgactggaccatcggagagatcatgaacaccctcgacagcctccagctgacggacaacaccatcctgatattcaccagcgacaatggccccgtcatcgacgacggctaccaggaccaagcctttgaacgtctcaacggacataccccgatgggtatttaccgtggtggaaagtacagcgcttacgaagccggaacccgcattccgttcatcgtccgctggcctgccaaagtgaagccgaacaagcaacaggctctcttctcacaaatcgatatctttgcctcacttgccgctttactgaaacaaccgcttccggaagacgcagctcctgacagtcaggaacatctgaacacgcttctgggaaaagactacaccagtcgtgaatacatcgtacagcaaaatctcaataatacgctcgccatcgtgaaaggacaatggaagtacatcgaaccgagtgacgcccccgccatcgaatactggacaaaaatggaactgggcaatgacaggcatccccagctgtacgatttatccgccgatccatcggagaaaaacaatgtagcgaaacagcatccggaagttgtcagggagctgtccgaactgcttgaatcggtaaagacaagataaccaatgagaatagcagatttgtattattttgtatcaatcttgaataattctatccatatgagaacaatcaatgcgtatatctttgccatcgtaaattcaacaaaatcacttaatttttaatatatgaaaaaacatctatccaaccagacaagaaaaaggatgctctccattttgggaatgctcctgctttctgttccatttgtgcttgcacaagtacttgtcaaaggtactgtgaaggataatctaggagaaggtgttcccggagccagtgttcaggtaaaaggcacttcgcagggaacgatcaccgaccttgacggtaaattcactcttaacatcccccaaaagaacgctaccttggttatttcctttatcggctacgtcaccgtagaacaaaaggcggactcgcaaaaaccaatggtcatcacattaaaagaagatactaaaacgctggacgaagtagtggttgtcggctatcaggaagtacgccgccgcgaccttacgggttccgtggcgaaagccaacatggcagatgtacttaccgcccccgtcgcttcattcgatcaggcactcggcggacgtatcgccggagtaaacgtaacttcgggcgaaggtatgccgggcggcaacatgagtatcgtgatccgtggtaacaactcactgacacaagaaaactcgccgctgttcgttatcgacggtttcccgatagaagattcatcggcagccagcacgctgaacccttccgatatcgagtcgctcgacttcctcaaagatgcgtcggctacggccatttacggtgcgcgcggtgccaacggtgttgtcatcatcaccaccaagaaaggtaaggtaggacgggcacagttgtcctatgacggtagtttcggtgtgcagcacgtcacccgcactattccgatgatggatgcttatgagtttgtcaagctacagaatgaaatgtatcctaccgtcgttgccggctcatacctaatgaactacgaaggcaagcaatggacactggacgattataaaaacataccgcaatataactggcaggacgagatattcaagactgcctggcagcagaatcatacggtcagacttgccggtggtacggaaggtgtacgctacaatgcttccttatcttacttcgatcaggacggtacgctgatagaaaccggttacaaacgtatgcaaggacgtatgaacacagtagtccgtcgcggcaaactgaacatgagcctgaccaccaactattcacgctctatccagacaggtagtactccatcatccacctcttacagtggtatgaacaaccttttctatagcgtatggggataccgtccggtgacttcccccgacactccgctcagcttcctgatggacagttcaacggacaatgccgtagattcaagcaacgactaccgtttcaacccgatcaaatcacagaagaacgaataccggaagagctacaccaacaatcttcaaatgaacggattcgcagaatacgaagtactgaaaggactgaaactgaaagtttccgccggatatacttatgattcacgcaagcaggatcagttcaacaactcgaatacccgctacggaggtcctacctctacagataaagtgaatgctcaggtaacccgccaggaacgcctgacatggctgaacgaaaacaccctgacttatcagactaacatcaaaaagaaacacttcctcaatgtattgggaggtatcacgttccagaactcggactatgagatttattcattccgcacaacgcacatccccaacgaatcactcggtatggcaggcatgagcgaaggacaggcaggtactaccacttcggcaaagtcttcatgggcgatgttatcatacctcggacgtgtgacttacaactatatgtctaaatattacgctaccgtttctttccgtgccgacggttcttccaagttcaacaaggacaaccgttacggatacttcccttccggttctctcgcatggagcttctcggaagaagaatttatgaagccgttgaaaagtgtactgtccagcggtaaggttcgtttgagctggggactcacgggtaacaaccgtatcggcgaatatgattattatgcgctgctggcggtattgaaatcaagagtcggctcgtatacatcgacaaactccctcccaagcggtgtttatccgttcgacaatgatgcgacgaatgcaggtgttgttcctacttctctgcccaacaaggatttgaaatgggaaacaaccgaacaatggaacgcaggtctcgacctcggattcttcgacgaacgcatcggtataacgatggatatttaccggaagaccacccgcgacctgttgctggacgcttccctgcctttttcttcgggttattacagcgctaccaagaatatcggtaaagtacgtaacgatggtctggaacttagtctgaacaccgtcaacttccagacacgcgccttcaagtggacgactaacttcaacatttcattcaataagaataaagtactggcattgtcggagaatcagacagccttgctgactgccgcgcaattcgaccagaactacaacggtcagtccagctacatcgccaaagtcggtctgccgatgggactgatgtatggttatgtctatgaaggtacatacaagtacgacgacttcaacaaatcgggtaactcatacagcctgaaaccgggagtgccccactactctactgagaccaacactcagccgggtatgcccaaatatgccgaccttaacggagacggagtagttgactccaacgaccgtacgattatcggacgcggacttccgatacatacaggtggtttcaccaacaactttgaatataaaggcatcgatctgagcatcttcttccagtggtcatacggcaacgatatcatgaatgccaaccgcctgttctttgaaagctccaacaaccgttcacgcgaattgaaccagttcgccagctatgccaaccgctggacaccggaaaatccgaccagtgacatccctgcggctaccaactcctcttccaaccgtgtgatctcttcacgcatcatcgaagacggttcgtacctgcgtctgaagaacgtaacagtaggctataccttccccgccaagctggtgaagaaatggaagatagacaaagcacgtgtttacgttgccgcacaaaacctgtggacatgtaccggttattccggttatgatccggaagtatctgtacgcaacagtgcgctcactcccggtctggactactcttcctatccgagagcatactctatcagcttcggtgtaagcctgggattctaaacggataatgatagtaacagttagaaaaaagaattcgattatgaaagcattaaaaataacaatcatagctctattggcaggtttcagcatggtatcctgtgactttctggacaaagaacctaccaaactgacgccggagaactacttcaacacccccgctgaagccaactccttcctgacaggcatctacgccatactgtcgcaacctactttctacggcggtgactatatgtacctcgtagccggtgacgacttatcccactacggaggcagcggacgcggtcccgcatctaccggactgatctgcaacaacgccaccaccagtgacaacgccgtgactgccttctggtatgccctctattcaggcatcaaccgtgccaatatgttcctcgaaaacatcgacaaagtaaacggtttcgatgcaggcgtcaaagaacagtacatcgccgaagcccgcttcctgcgtgcattctattatttcaatctggtagagtgctggggagatgttcctttcaaaacagtttcaacccaaagcgttaccaacctgaatatcccgcgtacggacaagcaggaaatctatgacttcatcatctccgaaatggcagatgccgccgagactggtctgaaatcggcctccgatcttgcttacaagccgggacgtatctcccagtctaccgcatggggcatactggcacgtgtatatctgttccgtgcaggcgagcattaccgtgaaggtcgcaatgccacacaggccgaaaagaaagactatttcgaaagagccagcttctatgcccagaaagtaatgactgccggtcacaaactggctgccaactactgggaccctttcatcgatatgtgttccgacaagtataacaccactgccaacgaaagcatctgggaagccgaatttgccggcaacaacacttcggatacacaagccgaaggccgtatcggtaacatcatcggactcgccggtccggatctgtcctccaaaagcgatgtgacgggagccaaagaccccggatatggctatgcctttatctacagcactccgaaactgtacaacctttatgtgaacaacggtgataccaaacgtttcaactggagtatcgctccgtttgaatacaaagaagccggaggcaagaatacaggcgttacccaccgtgaatttgagcagggcaaacttgctgaagtaatgtctcaatacggtcagcaacgcggaacttaccagtacgcagatgacacagaaaagaccacagccaccaagaacttcagccgtatgtgcggcaaataccgccgtgaatacgaagcggataagaaagacaagaactatacgtctatcaacttcccgatcctgcgctatgctgacgtactgctgatgatcgcagaagcggaaaacgaagcgaataacggtcctaccactctggcttaccaatgtatgaaggaagtaagagaacgtgccggattgaacgagcttcccgacatgacgcaggaagaattccgccagaccgtgaaagacgaacgtgctatggaactttgtttcgaatacacccgtcgtttcgacctgatccgctggggtgagtatgtgaagaatatgagagcattggtaaccgaagcacaatccggcaacaactggacgcagggacctaccaacgtatatacctacttcaacatctccagcacatacaactacttcccgattccggatgcggaaatgagtgtaaacaaagatatcacacagaacaacccgggttggtaatcacaatattcatcgataaaagcatcatagattatgaaaacatataaactcatagccatctgtatagcaagcctcttcttcggggcttgcagcgacgggctggacgaagcggtaggtctgcacgtaaaagtagcgaccaacgagaatgtaagcttcgacggacagatcattactgccaaaaaaggtactccgatagagttcatcctttcgggcgatccggacttcctgacattcttcagtggagaagcgggcagcaaatacgaatatcgcgaacgcgaaacgattgatccttcacagatcaagtcgtctatgctgaacttctctatctggttccagtacggtaacccgagcacgacattggagaaacacgtatatatctccgacgaattcaccggattatacaaggataatttcgaagctgactctttgcttgtagagcaatttgagaaagacggtaaatggaaagaactggttccgcagtccgcattcccgacagcggcggtaggcaatgccgatcttgccactccatacagttttgatatgaaagaatacatgggcaaacggattgcaatcgctatctgctaccgtggcattgacaatacagtggcacaatccaagatgtactttgagcggatgcgcatcaataatgtgatgacgagcggacaggaagcagaatattctgccggttctttcggctttactccgatcaatatgaagaacaaatggaatctgaaggatcagaccagcatgaccaaagaccgtgaatacgggacagttaccaataacgtatccggtatctggaacctgacaggtgtaggcggcggctccttcttcatccatagtaccaatgccaacgatccgctgaaatacagctggctggtttccgatctgattaccgttaactcttgcagccccgatcagggaacgaaagtaaaggatattacccagcgtctggataagtacacatatacctacaatcaaattggtatctacaacgtgacattcctcgctcgtaatgccaatatcgatcattcctccacgactacttaccacatggtggtaaacgtagtggaataacaataaacgaataaaataataactaatacattatatctatgaattactttaaatcaatcatgttaaccgcatttgcgctgtttgcattggcagcgtgcgatacagacgacttgagagacgatgttgacaatctgaaagaccgcgtagagtctttggaagcacaagtcagtctattgaacgataacatgacagctatcaagcgactgcttgaaggtggtcagactatcacagaagtgacgaatacagacggtacatataaactgaaactgagtaacggagaaaccatctcactgacacaaggctcgaagggagaagttgcttatcctgagattactgtcaatgacgagggtcaatgggtagtgaacggtgaggtattgatgcagaatggcatacctgttcaggctgtgggcactcccggtaaggatggtatagctcccaagttccggattacggacgagggaagtttctggcaggtaagttatgataacggaaccagctgggaagacgtactcgacacagacggtcaaaaggtatccgcagtcagcgatggttccggaggaagcagtgcagactctttctttgaggaagtatacgtagattcaaccggggaattcttcgttgtcaaactgaaaggacagacggaagccatctctatccctatcgtaaaagacttgctttgcgaaatcaccgaaccggaaaccggaatgaagaacggatactgggaaataggctatggcaagactgccactacgactgtaaaagtaaaaggtgaaaacattatcgttactgctcctgccggatgggtggctactgtgagcgaagcggatgaaatgaccaatgtagctacattgagcattacagctccggcaaacgcaatgagtacacgtgcaacggcggataacggttccgacgtaacagtgcaggttaataagggtgccagttgggcggttgccaagattcaggtgaaggcaattcaagtagttgacagctactatgctttatataatagcggagccacatttacggtaaatggaattgaagtaaataacactaaattcgagaatgcaacatacattgattctgatcagacaatcactactccaggcatctattttatcaaaggaggggtcactgtcaactataacagtaccgttaatgctgctaatttgcttttcatcggagatgattcacaaaacatcagtacagtggcaattacaggaaattatatcagactcagacaaaataccgagactggacatttcttgtgtaaaaacattgtatttaaagcagccgagggattcactaattatctgtttactgtttatgcagacgagtcatttgctaatgtagcttttgatcaatgtcagattgtacttaatggcaaacctgtaagtgccattactaacgacaaaaggagcattgccaatttcagcatggaaaatagtaccatcaagataacagctgttacacaacagtttattatcaataccagcagtaataagaatcaggattatggcaatgtcatctttagaaacaacacattctattgtccgtcaggtaaagtaaatcaattggttttattcaatggttcagcttcaggtatagccagtctgaccatagaaaacaatacatttataaacttggaaacaaataccggtggctacgtaaacataggcaatctggcgaaaacctctattaaaaataatatcttctggacaaatacagacggaacaggtaatgtagtcatcattcgtcctcagataacatccccaacaggagatatttgcgcagataacctcctttacaaaactatgacttataattggcaaatgttctatggaggtaaactaccgtttgaaggagcagaagaactgaaagcattaacatccaatccgttcgacggcggcaccttcgacctcgccaacggtatcttcgttccgaatgcagaatatgccgaatacggtgcaaccaactaataccgactaacgtatgaaaaaagtaatatcaatcatatgtatcaccctcctcgtcgcactttactcgtgcgacgaacgggatgatctgcgctccgacattgacaacctgaaagaacgggtagccaatctggaagcgagcatagaacagatgaactcggacatcagcaactatcagcagatggttgaaggtaagattctggtggtgggatatagcaaggatgaacaggataactataccatcgaactgagtaacggcgaaactgtaaccatatacagcggcaaagtagacatgaacgatatgcctttgttcagcgtcaacgcgtcaggtcactgggcatataccatcaacgacatgaccaccgaactgctcgttaacgacaaaccggtaagcgccatccccgaagcgggaacagcaggcgtcaccccgaaactgaaggtagatgcaaacggtttctggctgatctctatcgacaacggaagcacctggaacaaattgggcaacaaccagattgccgacggaacgcaagccgttgccaacgcaagttccctgttcagcaacgtaaccatcgacgaagcgaccggacagatcacctttaccatccgtgccgacaacagccaagtaaaagtccccatctacggaaaagacttctacctgacaatcaagtatgaaggcacagccactttcggtctgggacaaaagcaggaattccttgtagaacaagccaacgtggaaacagccaccatcgaaaaccagacatggggcgtgaaactgacggaaaacaaactgatcgtcaccgcccccaaaacaaacgtgcaagggaaagaatacgaagaacagatttacatcaagatattctcgaaagaaggttactgccgggtagtgaaacttccggtaaaactgctgaccacggagatagatgccaactcggctttagcttggcaacgcttcaggcagggagaggacaatgtgctacccgactattcgtatgccggatataatcatggagaaagtgcgccgcaaggcgcattttctttaggataccaagtgatcaacgtaaaagagcgcatgaccgccaagaacatgaccgcccgtgaagcgctgatcagcatcctgcaagagaaaggcatgacaagagtaaacggaaccaacaagctgaacgccaacgcgaagattgtaatctatttccccgcaggcgactacattcttcacaacgacgacgataacacccgcgacgaaagcaagcagaaggatgccgttgattcgaaaaacaacaatgtcagcagtggcattgaaatctatggcggtaactttgtgatcaaaggcgacggtcccgacaagacccgtctgatcatggaaacgcctaatctgccgacaagtatcagcaacctcagttcatcacctatactgttggcaatcaagcacaccaacggtccgaacaatgccggtaactcccccaagcttgcttccgttaccgagaatgccaagcgcggagactttaccgtgaaagtcagcggaaccaccggaatctcctccggacagtgggtacagttgcgcttgcgcagcggagacagggaactggtaaagaaagagatcggtccgattgccctcaacgagaactgggcgatagcgaaagcccctatctccatcaaccaaagctccgacgacctgtatggcgtcaaaatcaccgagtttcatcaggtgaaatccgcctcaaacggcaagatcactttctacgaaccgatcatgcacgacatcgacatcaaatataacgatacggaagggtgggaaatccgtacgtacaaatatctggagaatgtcggtgtggaagacctgagcttcgtaggaaacgcattggacggctacgcccatcacggagaaggacacgccgaacaggctaaagtaggctggcaatacgacggagcctataaaccgctgctgctgcaacgtgtagtcaattcatgggtacgcaacgtccacttcgagagtgtcagcgaagcgcttacttttgccgaatctgccaacagctcggcatacgatatccgtatcagtggaaaacgcggacattcagccgtacgttcgcaaggttcttcacgcgtctttatcggcaaagtccgcgatgaaagtgcaggaaatgacgtatacggcaagagttgccaagggcagttccacggttgcggcgtatcgaagccaagtgtaggaaccgtattatggaacgtaacctggggcaatgacgcctgtttcgaatcccacgccacacagccccgtgccacgctgatagacaattgcagcggcggacttgtatactaccgcgcaggaggcgacgaaaatgaagtccccaatcacctgggcgacctcaccctgtggaatctgaatgtgaccggaacggattctcacgcttctaacttcgcatggtggagcgacagcgatacatggtggaagattttcccgcctatcgtagtcggtacacatggtatgaacgtgaaattctccggtaaagagcagcaacaagtcacatatgaagaaagtaccggtatgaaggtatcccccgaatctttgtacgaggcacaattgcgggaacgtctgggctatgtacccggatggctcaacgcacttaaataacaaccaatcacccgcacgatttttctaaccttcagttaaaaacgtatatgaaaatcagactttaatcaatttaacacccaaaagagaggggccgggaggttcctctcttttacttttccgtatatctacaggaaataagaagttttttaagtacttttgtaaatcaataatatacgcagtatgaaagcagaccaccctgaagatatagaagatataaaggaactcatagcccaaactgaaaatgaacaagtggaatttaaagaaaccaccggacaattggaacgtggcatggaaacgctttgtgcttttcttaacggagaaggcggaacggtcttattcggcattacagacaaaggcaagataatcgggcaagaggttgccgatgtaaccaaaaggagcattgcggaggctatcaacagattagagccaacagcaaacgtacacgtcttttatattccccttccagacagtagtaagaaaataatagcactccatgttgaaaattcaagagacaaccgcccattttgctataaaagtcgtccttattatcgtgtagaaagtgtaacatccgccatgccacaagcagtgtataatcaattgctgataattcgcgacgaggcaaaatatcgttgggaactgtttgaaaaccctaaactctctttgcaggatatggatgaaaatgaaattctgaaaacggtcagactcggaatagaatgtggtcgtttgccagagaatacaggaaacaacctctccattattttagaaaaatttgggttactggtgaatggcgtattaaacaatgctgccgctgtactgtttgccaacagggaactgatagaatatccgcaatgtcttttaaggctggcgcgtttcaaaggaacagataaaatggtctttatggataatcagcgcgtacaaggtaatctgttccaattgcttgattcagcaatgacctttatattcaagcacctttctttgtcaggcacaaccgaagctttggagcgggaagaacatttgacgattccttataaagctatacgagaagggattatcaattcactttgccatagacaattccggactccaggcggctctgtaggaatagctatttatgatgaccgtgtggaaattgaaaatcctggaacattccctcatggctgggatatggaaaggatgaaatccgaacattgttcagaacctcggaatcctttaattgccaatgtcctctataagcgcaagttattggaaaactggggacgtggtatcagcttaatgacagaagaatgtcgaaaagccaatttaccggaaccggaatttaagttggccaatggttttgtaatacttgttttccgatacgggacaaataaccacacaagcaccatgcaagtaccacataagcaccacataagtaccatacaagttcagtccctattgaatataatggaatataacacctattccgttaaggaaatgatggagcttttagaattgaaaaaccgtagctatttttcaaaagaatacttaaagcctgctgttgaaacaggagttatagagccaattttccctgaccagcctaaaagcccgaaacagaagtatcggctgacagaaaaaggaaaagctttattagagaaaagataacgaataacgaatagcaaattaaaagatatgcaagatacactacccatccattttgctccgctgcaaggttacaccgaagcaatttaccgcaatgcacatgacgccttcttcggcggtgtagacacctattatactccgttcgtacgattggaaaaagggaacttccggcgcagagatgtccggggaatcgaacctgagaacaatggggtgccccacctgattcctcagttgatagcctcatcggcagagaaagcagaagtgattttatcccttttcatcgaaaaaggatatcaggaagtggatataaacctaggctgtccgttcccgcttctggcgaaacgtcataacggctccggcatacttccttatcccgaagaggtgaaagcattgctcagcattgtcacccgatatccgcagatcagcttctccgtcaaaatgagactgggatgggaacagccggatgaatgcctggcactcgctcccatactgaatgacctgcctctgcgccagatcaccatgcacccccgtctgggcaaacaaggttacaaaggagaagttgacttgcaaggattctcagctttccgggaggtctgtcagcttccgcttgtttacaatggagacattcataatttggaagatattcaacgcatcagcacacaattcccctcactggcgggaatcatgataggacgcggactactggcaaatccggctttagcactggaatacaaagaaaaccgtacgctcgcgcccgatgaaatgagggatagactgaaatccatgcacaaaagcgtgtacaacaattacgacgtactattggaaggaggagagggacagctactgactaaaatgaagaccttttgggaatacctggcgccccaaaccgacagaaaagtactgaaagcgattcataaaagtacgaatatcagcaaatattatcaggctgtcagtgccttttttaatcaacggtagattgagaatcagttattttatgtaattttgcgcccgtttattaacaagcacattatgaaaaaatacattctattatctctctgcttgatgacactatcaagtagtttcgcacaattaaaggattttaaattcaaattctacggacagattcgcacggacttctactataacagccgtgccaacgaggaaactgtagacggattgttctacatgtatcccaaagatgaagtgctcgacggcaatggtgaagacctgaacgctacatcgaacagtaatttctatacattatactcccgtttgggactggatgtggcaggcccgaagttgggaacagccaagacatccgccaaagtggaagtggacttccgcgggtcgggaacttcttactccaccattcgtctgcgccatgcatactttaacctggactggggaaagtcggctgtactggtaggtcagacatggcatccgttgttcggtgatgtttctcctcagattcttaatctttccgtaggagcaccgttccagccgttcagccgtgcaccgcagattcgttatcgcttcaacaataaacaccttcagttgaccggagcgttggtatggcagtctcagtatctgtcacaaggacctgccggtaaaagtcaggaatacataaagaagagcaatatccctgagatttatgtcggagcagattacaaaaacggaggatttctggcgggtgccggcatcgaaatgatttcattaaagccacgtactcaatcttcatgggaagaaaagacgtttgatccgaccaccaatagtactatatcaatcccacatacgtacaaagtagacgaacgtatcactaccctctcttatgaggctcatgtaaaatataccaataaaaattggttcatcggcgccaagagcgtattaggttccaacctgacacaagcatccggtttgggaggatttggaattaagcacatagacaacaagacaaaagagcaggaatacactccgatacgcttctccagttcctggctgaatgtggtctacggacagaaatggaaaccgggaatctttgtaggatacgccaaaaacttaggaacaagcgacgaattagtctctgaaaaactctatggaacaggaaccaacctcgataaactggtaactgccggagctgaacttacctacaacgttcctcactggaagttcggagttgaatatacattgagttcggcatggtacggcaagctggacaaatcggatggtaaaatcatagacacccactccgtcagcaacaaccgtattgtagcagtcgctatgttcatgttctaatttgcagaaggtcattcaacagaatttaagttcctacatcattttaaggccgactaaaaagtcggtggtatcttaaatctcctccttcgggaaggaggagtacccgcagggggaggtggtaggtgaatacacgattctttcattcataatcaattagagacaaccttattttacctaccaccccggctttcagccacccctccttcccgaagggaggggaattaatgatactattgacttatttgtcagtcgcaatttgtttcaaaaagtttcagacgcttgaaacaatcaggagaaatactcgattaggatgatttgaccgcccgatccgatgaactcaaccgtatcagttgtttcaattaatctgttcttttaggaagcattaaatcatttattagtcaataatggatgatctctcagtcattaatagctgatttctcaattattaatggctgagagatcaaacgttaacagttgagaaatcagctattaacatcctgtaagtcaaaagataacattgtagaaatgagacagatcaggatgagacagagtgagagcaaccgtttgccctcatacctgccaccacagttgctaccaaaccgaaaaccacgatgaataaagggatacagacttttgttagagcatgagagcaaaacggctatcaaatcactgtggagaacctaagcgatatgtaggctcctcagctttcattgctgctattacagcagattcctttggccgtaaatgctctggggggatctgattattcagatagcataccacagaacaaaagattatttctccagttctacctcatagctggctccatccttacagaggaagcggagtaccgtttgttttttatcctcggataccactttgcagaaaggagtctccgctaccttccacctgcctttcagagtcaccgtcacaggaatctcaccgctttcattgtcaatccacgggcgggaatagatgctgcgttccatacgttttccgtctttatcgaaagcttcatcactcggaccacgatacaatgccagatccggttgagctacagtcaataatactttatcagcagattccttacggaccatcactaagcaggacgtatccgtacgctgcaacaatccaccgggaagcagtgactggggagtttcaaaaagcacataagaagttatcctgtccgaaggcgattcaaggatatgtgcattccggtcttgctgtaatacgctgtaggcaggtttctttgcaaaggcagtcatcgtcttccggtcggttcccggcagaatggcatattcgtagcttcccgctttcggtgctttcccatggtcgataatcaatgatacccagtctcctttcgtttctttgcctgtatcctgcatacgggagtattgcggaaagtttttctcgaatcttgcaggaaccggcacataatatccggtgcccagatgatccatccatacttttccttcacccgcattattcttccaatagtcatgtgccgctttatctgtcaccgccagttggaagatggtcgtctccgttggataatccgtgtttgtattctcgatatccgagcctagacaaacgatcattccatcgatgaaatggtaggattttcgcgcacgatgcgttccgttatacttatcgtgttcgtgcagtttcattccgaagttgccattcatctttccttgtgacaggccgccggcaaaggcttcatccgaataaagcatctcttccattccggagaatgtatctacattcagcacgttggctttgagcaggtccagcgggagatggatggaagtcactcccggaatgcggttccagtcgaaaccttcctgctgccatccgctggtggcgggagtcactgtctgtcccggaggtgctgtcagtatctggagacttccatgtgccagataacgtccatagaggttgtgtcccagataatgttcggctgcccaaaggtagcgtgaatgtccgcgtgccacagccgaccagttttcacgccgttgcacagatacacagccatagcctagtgagagattaccctgcggatcggattcggcacgaaaaccgttttccaccagtcgtttggcaatcttacgctcctgagcgttcgaaactttcggcatatattccggtgcctgttccgcagaagaggaatcggaagatacgagacgcaggtaggcggatgccatctctttatcaaaatcgccctttccatcgggagttccggcaattgccatcatcgcatagtgcatgggaactaatttcccctgtccatcgggatggcgcccggacatagacaagggaaagttcagtttattgcagtagaaacgcatggcaagcaggacatctttgaccgtccggtgtgccaattcggaaacggcaaggcttgtccgactgaaaagataaatcatattcgttgccccgtccagtcctccaacggcataggcagggtagttattacggtgatggaaagctcctccgtccactttgaaagaaccggccagtcccggtgcaggacggcagccgtagtcaatccatcgggagaaggatttcaagtattgcagcttctccggcgtgtcttccatcatcagaatgcttgcgatacgcccggtggtttgtgtattgaaagaatccatatcgatgccgttgccttccggtttgggatatacctcgttggtgatagcataccaacgcaacgtacgctccgcttcaagcagttttccttcttcccgcaatacatctttcatcaggaaataagccggataaagtccgcgcacgctatatccgtaatgatgaatattgccccagcaactaccataagccactccctgatcggtgatatggtcgtacatcgcaaggaatttccgtttcatttcctcgcggaccggtgatcctgcctcactgttattgtaagctacggcaatccgtttcatcaagtcaaaataggcacgcatctctatccccatcttggtcagcatatccttgtcccagtccggaatcatccgttcgtaggcttcggaagcgcgcaccatgaaaatgggcactccggacacttgcccgtccttataggttatctgatagaggtcgtatttcttacggatggtttcggcttctttctccgtcaccttccctttggtatagatcatgtcacgaaaacgcttttccagcagtttcatttcctgccgctgcctgtcgcttacgggagtcagttcgatgtccggtttcaggagggagtgtttgtagagtaccagccagtgattggtagtgccggcattgacaaaggggacttgcagatcggctgtctgctgacgggcgtctaccttcgtcgcagtgatcagatgatcgatgaaaaggcgtccttttgcattgggagccacgatgcggagctcgttcattccctcttccggcgtgccttgcatatcgcgttcatagcagacccatgccgcacgccagcctttgaaattgatgccgaaagggaaagaagcgcacttacggccgtctttcagaaattcaaactcgatagcagcgtcctgaggctgctcattgtatatccatacgatgaaagcggaaagatacaggtctttccctgtcgggtccttcttttcaaacttcaggtctttccggagttccagtttcccgttcggttcgaaggtccattccaacgaatgtttcccgtctttataatgtgcaccggatatgcccaactgagactgaacaccggttatacaggcaggtaactgcggttcttcaaaagagaacatccgctcgtccgtaactatctgcgcattgaggaatgccggacagagaaaagacaatatcagcattgtcactgacagagtaaaagattgctttatcatagaatatatcgttttaggtccgatggtaaatcggtttatcattagccggtatttacagagagagatcacttgttcttctcccgaatgcaaagaaacccctcttttgttggaaagaggggttcaaatcgtacaaaatagttcaaattatgtgctatctcttataaataatgaccgatatgctctctgccggtcctgcccttaagggtgaagttctttaaaagccgcattctcttcctgcacgtgctgaatggtttgtttcagctctgcaatcggcaaatcatatccataccagccggtataacagtctactacataccattttccatcgggcagcaattcgaactccacacgtaagtcgatctccgattcttcgtatcccgcctcaaataccttatgcgccggttcgttcagcgtaaacttagatacataaacaccgccctcttcctgagtgatacgttcttctttcagcgtttcactgtccagcaacggccacttttccttcgtaaaagggaacgttttctcagtttccccgtcatccgccaataaagtaaccggcgttttcaacggaaacttgacacgagtatactgaaacgccgcactggaagtaaacttatccagaaacgacttgaaatcttctcctgtctgtgctgcttcactttctactttcgccctggagctattgccacaggaaataaatgaaatacctgccagcaatgacatgaccatcaaacagcatgcaaacttcttagctctcataacacgatataaattaagagtttaaaataacgctgcaaagataatgacaagttcaatatcttgatacgaatcgggaagaaaatagttaaactactacaaataataaacttaccacacctcattattccggtattaaaatacctttgtcataaatcgaaatactaacttaaataaaaacacaccatgagacccccctactgttttctcctgataggtcttttgcttttatgcagtacacagactatcgctttcgcccaatccggcacttatcagacaattcccgaatctttgcgaggctactggcaatttaaagcagacaatgtgtctgactggaacggtccgctcatcggagagaatttcgtagagaactattatgtcgttttttatgccgaacagataaaacaggaagctgacggcagctacttcttccatttacgcaatcagaaaggagatacgacggaattccgtatcacacctaccggcaatgacgccgccaccatctggtacaaaggctggaaagagccgaagaactgtatccgcaagcaagtccccgaccacacggaaccgctcactccccttacattgcccgaccgtgtttatcagaaatgggtgaaaggattatccggaaaagtaatctacgaattcacccgtgacggaaaactgctctatgacggaaaaacatgggatatcttatcggccggatattttctcaataaagaatatcggctgctcgtcaaaagcggagaatcatacaaactgctttacctcagcttccccctgccgaaaacaatgaacgtagccgctgaactgcaaaatgaaaaagtctctcccatcgcctcacaccctgaaatatatgctttcgccggatgttggatcaatcaagcaaccggggactggcgcatcggattcttcgaagactttgctgtctaccaatgtcaattttgggattatgagtcgataaacacccaaaagaatcagaccaccatcatcctgaaaaatggaacagaacaactgaaagtacgtttaactcgtaaagatgaaacatcctgcaccctgtctgtcggaaaagaaaaggcacagacatatgttctttgtaacgacaaatatctacccgattatccggtagctgataccactcctttcgtagacaatggttatcaaacggatagcgtgactctcatcggatacctgcgtaacctgccttcgacacgtcctttcgaagtagacgtaccggatatgatcaccaataatgaagaagaatatacaaccgaaatcgactcacttggaaggttcaccctccgtttccctgtattgaacagccacaacgtgttcatcgattggggacgtaccactatctgtacatccgtagagccgggagagacctatttcctctatgtggacttcgctgacaaaaagaaattagtgatgggagaaaaggcacgtatcctcaacgaactgctggcccacgaaggactcagtgaatatatcggctacgacgaaggagaaaaaatggaaaatatggaatatttgcaaaagacgcaggatatcatccgtcataaatcagaatatcgtgcaaagatgctcaatgatcatccgcttctctcgcacaagttccgctattacacagaacaggaaatccgctacaacgccgcacgtgacctgatgcagcgccgcttttcggtagaccgtaacaagcaggagcatctgcaaccgaaatttatgagttatgtagactcggcactatatccccgtccggtagagccttatacgcttctcagagattatggttctttcctgcgggattacgtcggatacataacggacattgctcccgcttcttcaaacagattgaccgtgactcctcaaaagatggaaatgctctatctcaaatttgaaagggacggaaagattcagctatcacaagaagaaaaagacgcattacacgccttcagtaacttcgaacaagaaattgaaaaaatgaaagctgcgaatacggctgactcgctgacaatggctgcctacaacaaaaagatggaaccgagcatcaaaacaatacagagcctcgtaggcagagacgaaattttcaatgactatatgatgggaaacttgctcgctaattccatcaatcgtacccttactatcattgactccctgcaaatggacgaaaaattaaaggagatactaaaggcaaattgctattatgagatgttgcagcagactcacaaagaattgccggacagcctcatcaataaattcaaagcagaagtttctaatccttccctacaggcttatgtattaaaccaacaagggatatacgaagaaatatcccataaggccatcgaatatcccgaaagcctgatgcctaacgaacctctggcagagatcacagacggagaacaattattccgcaaaatcattgagccttataaagggaaagtggtttatctggatgtatggggcacctggtgcggtccgtgcaaggacatgatgcaatatgcaggaagcgccaagaaactgtttgagggaaaagacgtgatattcttatatctctgcaaccattcctcagacaaatcgtggaaaaacattatcaaggaatatggactgaccggcaaaattgccgtccactataacttgcccgatgagcagcaaagggctattgagaagttcctgcaggttcgctccttccccacctatatgttgatagacaaggaaggaaacatcgtaaaccgtgacgcccccagacccaacagggaaaatgatcttctcaatgcagtctataagttattagagaaataaacgactcatttcttccgcaaatactcgtatccgaaacggcaaaagagacatttccgtttatcacaatactctttgcggagctgtatcaatgcctggctatctgccgccgaaccgaccggtagcccggcatctccccacgaccggataatatgattattctccgctttcaactcttccagaaaacgtccggcacgatcacacatccgctcatcggttctatgcagaccataagcatataagaaaggaacaacggtattaatcacgatcaagtcctgtgacttctctcccatcgatttctctctttgcggagaaggccggccgaatatataatgattatcccaatatgcagaagcatgagtagacagtaattgacgcacttccggcaaggtttctgcctccatcatctgcgaaaagagcttatcaactttctgatacaagtaggccaactgtgctaaccggatatggggaaagttttccggacgaagcctcaaaaaacgccataaaccagcatccatcacctgattaagttcaaacttccgttgcagatagcgaaattccttacgaagccggagactatactcgtcttcctgctccttctttaaaaacgcctcctccagcaaaccggcctgcccgaagaaaaaagcctctatctgaaacagatcattccgatgcttgtctatcgcccgaaatggaagcagtcctgcccacgtctcaaaagcatcgccattcaagccgaaaccgaaattacgggcaagagtgataaagaaggcatcttcccaatgacggtcacatcgttccagccggtcggcaatttgccttgctttttgctccagtcgttcggtctgaagagccgtcagccaggagtgaatcgttaatttggataaggaccctatgatggagtagcaggcaggatattggtcggcaatgcagagttcatgataatgggtttgtacattctcgggacaggtcaatagcagttgggggatttgctcaccattggaacgggttacttcggcatctgcctcggccaccacatgcagaatcacagaatcgtatgttttatcatggtcgtgaccgtgacggtaccagtctgaagaatgagtatgtatctctatatttcccacccacaatgtaccgtctatcttcagcttcgcattaaaaaagtcgggaccggcatcagggttctgcagtcctgaatcgataatttctaccagtaagcctttggtggtttgcagtattttgagagggaataatttatgtttccacacatagtggagaaggtgttccatgttaacagaaagttaatgtgcactgcaaatgtaataaaaatcttatctttgcgactattattttgaatataagtcagaaaacaatgaaaatagcgttgatcggttatggaaaaatgggcaaggaacttgaaaaggcagcccttagtcgcggacacgaaattgtctgcattattgatgttgataatcaggaagactttgagtcggaagcattcaagtccgccgacgtagccattgagttcaccaatccgatggtagcctacagcaattatatgaaagctttcaaagccggagtcaaattagtatcaggcagtacaggatggatggcggaacatggcgaagaaatcaaaaagctatgtaccgaaggaggaaaaacccttttctggtcgtccaacttcagtcttggagtagccatcttctcgtctgtcaacaagtatctggcaaaaataatgaatcaattccccggttatgacgtcaccatgagcgagactcatcatatccataaactggatgcacccagcggcactgccatcacactggctgaaggcatactggaaaacatggaccgcaaagacaaatgggtaaaaggaacgctccttgcaccggacggtaccgtcagcggcaccgacgcctgcgcttccaacgagtttcctatcgactcgatccgtgaaggagaggttttcggcatccataccatccgctacgagtcagaagtagacagcatttccatcacgcacgatgccaagaatcgcggcggctttgtattgggagccatccttgctgccgaatacacggcccaacatgagggatatctgggcatgagtgatttattcccattcttaaacgaataaggcttcaaagccactatcaaacgaatatagattatgagacaagccacacgcacacaatggatcaaatgcaccattgctattctcctttatctcgccttcctcatctgggtacgcagttggtgggggctgattgtcgttcctttcatcttcgatatttatatcaccaagaaaataccctggtcattctggaaaaaatcgaagaatcctaccgttcgtaatgttatgagctgggtagatgccattgtctttgcattggttgctgtctactttgtcaatatctacattttccaaaactatcagattccttcctcgtctttggaaaagtcattgctggtaggcgacttcctgtacgtcagtaagatgagctacgggccacgtgtgccgaatacgccgctttccatgccgttggcgcaacatacgttgcctattttaaataccaaatcatatatcgaatggcctcagtggaaatataaaagagtgcccgggttcggaaaagtgaaactcaatgacattgttgtcttcaactttcctgccggtgatacggtagcgctcaacaatcagcaaacagatttctactctatagcttacggtgaaggtcagcgcctgtatcccaagcagatagagatggacagtctgacacgccagcagcaacgtgctgtttacgatttgtattataatgccggtcgccagcagattctatcgaatccgcgtgtttacggagaggtcgtttatcgtccggtagaccgccgtgaaaactatgtaaaacgctgtgtcggtctgcccggagatacgctgcagatcgtagacggtcaggtcatgattgacggcaaggctatcgagaatcccgaaaatctgcagttcaactacttcgtacagaccacaggcccgtatatcacagaagatatgttccgtgaattaggcatcagcaaggcagaccagacattgtatgatgattcttcatgggaagaaaccttcagacagatcggactggacaatcggaatgcacaaggaaagatggctcctatttatcatcttccgctgacgaagaaaatgtacgaaacattgtccggcaacaaaaagttcatcagcaagatcgtcatggaaccggaagagtatgccggacagatgtacccgctcaacttacataccaaatggaaccgtaacaactacggtccgatctggattcccgccaaaggtgctactatcactctgactgaagataacctgcctatctacgaacgttgtattgtcgcttacgaaggaaataaactggagatcaagccggacggtatttatatcaacggcgagaaaaccgatcaatatacctttaaaatggactattactggatgatgggcgacaaccgccacaattctgcggactcccgctattggggattcgttcctgaagaccatgtagtaggtaaacctatcgttgtatggctgtcacttgacaaagaccgcggatggtttgatggtaaaatccgttggaaccgcctcttcaagtgggtagactaataagtatacagacgtgatagagtgataaggtgatagaaattgatgaacattcgtaaattcaaatggatattcgcattcgccggagcaatagccgtcgtgcttctgctccggggattcgcttttacatcctgccttatcccttccaccggtatggagaattcactttttcagggtgaacgtattctggtcaacaaatggagctacggcctgcgggttccgctgatgtcactgttctcatatcaccgctggtgcgagcgatctgtccggcaacaagatgttgtagtctttaataatcccgccgccatcgggcaaccgactattgaccgaagagaaatctatatcagccgttgtatcggtactcccggtgataccctgcttgtcgattcccttttctccgtatcctctcccgaagcgcaactcaatccggacaagaaaaggctctacacctatcccgctgccaaagagcagttgatcacttcgcttatgcaaaccctttccatcaccaacgacggactgatgggaagtaatgacagtactcatgtccgcagtttcagccgctatgaatattacttactggaacaagcgatcagcgatcagaactggattcagcctttgacggaaaagagcgaaaaagagcttaaaccgctcatcgttcccggcaaagggaaagcactacgagtatatccgtggaatatcacattgctgcgaaataccctcgtgatgcacgaaggcaaacaggcggaaataaagaatgatacgctttatatcgacggaaaacccacacagcattgtttttttaccaaagattactactggatggcttccaacaatagtgtcaatctgtccgattcacgtctgttcggattcgttccgcaagaccatatcatcgggaaagcatcgttgatctggttctctaaagaaaaaggaacgggaatctttgacggataccgatggaatcgcttctttcagtctgtaaaataattcacatgcatagttttcaacataacatctgtacataaaataatgagaatagcttatttatcttctgcctaccttgctccagtagaatattataccaaactattggaatatgataaaatatatgtcgaacaacacgatcattatataaagcaaacctatcgcaaccgttgtacgattgccggacctgacggcgaactggcactctccattccaaccgtcaaaccggatacgctgaaatgtccaatgaaggatatacgtatttccgatcacggtaactggcgccatctgcattggaatgccatcgaatcagcctacaacagtactccttactttgaatattacaaagacgacttccgccctttctacgaaaagaaatacgagtttttagccgatttcaacgaggaactctgccagctggtctgtaagttgatagacattcaaccctgcattgaacgaacttcagaatataaaacggaattcacaacagaagaaacagatttccgcgagattattcatcctaagaaagatttccagatagctgatccagaatttgttccgcatccctattaccaagtctttgattccaaactcggttttctccctaatctgagtattattgacctgcttttcaatatgggaccagagagtttgttggtattaacaagtaaataacattataatagccagacaaagacatcaaacgtcctgacactacgtatcttatcatatatcccggtaaggttaacaggcggacaagccttgattaatatcttttgtccgcttcctgttttcgttccacgtacgtaaaccgttgggactgcgtacgtgatcccatcggttcacgtacatgaactcatgggattacagacgtgaaacgaagaaatgtaacgaccgtaatacattaatctaacgttgaaaacagcttaataaacgtagcacaaactattaaatgaaccggcttacctgaactaggaaggcagaatctcttatgaaggtgacaatagaaaagcgatttttctctattatcaccctattgtcaccacctattatcacccttatcacgctaaattccagcacattaagcctggaaagtgacaagtgacaataagaataacgtttttaactctgtagaaagagacaaattataatcaccaggtcactattatttccttcaacagattactcttcattcagtcgattcagtaaatatctgacattctcaagatgtaaatgattgacccggtacatctgtttatattgccaactatttttagtagtatcgataatacaatctataaaagagcccattatattggcactttgcatacgattggtatttgaaacctgcatattcatcatatgcataccaaatcctttaatcacatcttttacactaattttcttaaaatgatgaactgcctcgaaggctgctacattaccaaaaagaacattctctaaatcttccagtctttgccgatccgagcgttccaccaaataactggctggatttataaaacgattgagcgtaagataaaaggtcatcatttcatgatctgaagaaaaaatggcatgcatgaattgtgttgcgtcccccggacaaacaatctgctggttgtttaaaacctccttcataagaatttaaattaaatggtgaataaattaagttcaacggggctaaacagaaaggtggttttagataataaaagaagcggttccgcctgtcccattgctcttttctcgttcacacaaggcagcaggtgcattaacactctacatgggggtgcgaaaccgcccatatagaatgaaccggacaggcataaaaatgcctgccacaattacaaggcaggtttccagccttgtgtgattttgaaaaaagagcactacaaagataggacataaatcagaataggaaaaagaaattcattctaaattgcatataccacagtaaaatgcaaggtataagccttatttctaatcacaagccaaactcgtttcaaagaaaaaggagaatgttgtgactctctcttttataagataacaacattctcccagcaatctgttttaccgggggaggaccccagttttaccaaccggatacctatctcaactcaaatggtacaattcctttaatgtctctggatgatgttccgatgactgcttcaaacttacccggttctgtcatccattcgtgtttgacatcatcgaagaagctcagggcttttttatcaatcgtcagcgttacagccttctcctcacccggagccagttttactttcttgaagcctttcagttccttgaccggacgaggcagagaggatttcttatcgctgacataaagctggataacttcctgaccttcacgagtacctgtattctttacgttgatcgtgaaagagatggtatcatcggcagtcatcacctttttgtcagccgaaggtttcccgtaagcgaaagtagtatagctcaatccgtgtccgaacgggaaaagcggtttgatcttttctttgtctgcccagcgatagccaacaaaaatatcttcacgatagatttcgtttatggtatcaccattgttcttggagtgtgccagctcttctttattccccggatattcacccagtttatgtgcgcctacgtcttccagtcttgcaggaaaagtaaaaggaagtttccccgacggattagcatctcctagcagtaccgaagcaagagctgttccggcttccgaacctaagaaccaaccctgaacaatagcgggcacttcatttacccaaggcatggcaaccgcattaccggagatgtttacgacaatcaagttcttatttacttttgccaactcgccaatcaccctgtcctgcgcatacggcaatccaagggatgcacggtccgaatcttcgcaatcctgatgattgctcttgttcagtccaccgaagaaaattacgtaatccgcatctttagacacttctacagcctcagcaagaagttcatcctccgaacggtcgtctttcaaatcttgtccggtctgtactccattatattcccctgtcgggtcaccaacgtatccacggacatacaaaacttccgcctgtgaacctacgcggttcttcaaaccgtccaaaggagatatctcatatttcactttcagagaagaactgccaccgcctacagtcatcatcttaatggcgttttcaccgataacagcaatcttcctggctttcttcaagtcaataggcaatacattatccttattctgtaacagtacaattccttcttcaccgattttgcgtccggcttgtccatgctcgggcgaagccagagaaccgaaaggtttatgcgggttcatcgaagtgcggaagatcagacggaggatattactcactttttcgtccagttctttggttccgactgtgccgtcctggatcagtttcaggtaaggatgcgccaaatagtaattgtcataagcattccttgtcccggcagaaagtccgtttgtccatgaaccgaactccatgtccagaccattcgaaatggcctggaaagtatcatgtactccgccccaatctgaaacgacgacaccatcaaagccccattccttacgcagaatatcttgcagcaatcgcttattatggcacgcatgctgagtcttatagagcttaccggagtcggtatcttcactaaacgaataaaggttgtaagcccccattattgcccaagcaccaccttcctgaacggccgctttgaaagccggaagataaatctcataaagagcacggtcgctcaaatgaacattggtggtgtgacggttgaactcctgattgtttaatgcgtaatgcttcacacaagcagcaacaccgttttcctgtactcccttaatataaggaactaccatcatggaagacaggtacggatcttcgcccatatattcaaaattacgcccattcaacggggtacggtagatgttgacaccgggccccaggagaatatcttttttccggtaacgggcttcttcgccaatgctcttcccataaagataagacatttcgggattccatgttgcagaaaggcaagtcaatgcaggataggctatacaggaatcgtttgtccatcctgcctgatcccactcatcccataatacttcgggacggatgccgtgagggccatcggttgcccatacttcgggaatccccagacgagggactcccggtgaactaaatttagactgcgcatgagtcatcttcaccttctcttcaagtgtcatacggctcagcgcatctttcacccgttcttcgataggcttgctcgtgtctagatatactggtgtctgcgccatattcatagtcggtaaaacggcggctatagacaagccaagtaacgttgctttaaatttcatgttcataaatgatttctgtatttttacttcttcacaacagaaagaattcctttatctatcccctgagtgaaatctaacgtaaacacataagtaactccctgttccaacggagaggccaatacaagattttcctcatcaacattgaataagttccgggtagcctgatccatttgcaggttcttttgatgaaattgctgatcccaagactttccacccagatatttaacactgatataatcgtatcgtatgcgttcaccaatagccgtactgccttcagcaccagtcttcccagtaaactgataaactttcggactgatttccgccacacaataagcagtcgaaaagtcccagttaaattcgtccttaatagacggagagcccataccatagcccaacaaccatacggcaccatgcccgtcagcatccagtccggcttcactattgccattcatacgtactactgcaaagtatttgcgtgtagcatttaccatcaccctatagctaccggcaaccggcaagaacttcaagtgattatctccggtcttcaccagataatccggatcaacataccaatcatttagatcttcgatgccacctatttcgagtgtctggttctgcgtcaaagacatctgcaattgatacatatcggaactgccttcttccagcttcattccattgattgtaatgtccggtcgcggcaagtctacctgtcctactttctctacagtcagtactgctttggtattacctttcgttacatctaccgtaaacttataaacaccgcctctctcaaatttctgaccttcctgcaacttcaagttacccgactctgttatttcaacaagatcgcttgtagtagagatggcatctcccttaaattcaccattatcccacttgtttatgtggaagaatttaaagtcaatatcacttgttttcatagtcacaccggcagtaaacgtaagctgatacttctttgccgcaagttgcggcatacacaaaccattctccggcgtccatcccacttcgtacaaagataccgacggcttgccaattccatttccgatagcccagatagctcctgttccgtcatcctgcaatttagctgcttcaccgtcttttaaagctatgacagagaagtactgtctcttaccgtttgctgtaatctgatagcttccgtcaatcggcaggaacttcagtgttccatcctcctgcttttcaaagaagtccggatcaatccaccattcatcataagcaggcactccttcgaacgtcagaatgtcattctgctttaacgacagtttaacagcatatacatcgttttctaccaattccatttcttttccattcagcaataatttggcaaacggactcgcttcatagttgaaagtattaaactgaatcgtataattgcccggctctgtattggagaacgggatagacgtagtagagcctactgcaatcgtattgtcttcccagccaaaagttagctcgttgccgtgctcccctactttcggagttttgatatacgctttcatcttctgcgaaaagtctcccgatacgctataatgatacatcgattgcctgtccatccggtactcctgtccttcttcatctaccaaggtcagataaggaaagtccgggcgtgccaacgtaagttccgtttcctgttccgtcgtagtaaagtgaatattctgaaggatatacttcaatgtcgcctttccgttaggaatattagcataataaggaatataaatctttccagtatagtcgcttccacttgtctttgttcggatcaccgtttcagatacctgttcttctccatagaaaagctgcgctttcaaagtagaaagaggaacgtctacatccgaagccttgatcgtaaacggaaggctgtcgccgaaaagggcatccgcattctccgccttgatctccatactcggattaccgggaaggaactcgtcatcattacaggaattcatggataagattcccgccaatgccaatgttatatagatactttttttcattgtctttatacttttaaggttcttactttgactttgcccaacggtatgaagttactgatttaccgggaacgtcataagcaaaatgacgttggccgtcgctgacagttatcttcttcgacttctcattgttgtttatcagaacaaaggcatacgttccgtccgtattttcgaaagcagaacaggtaataccgttgtccgtataaccggtagtggcgatacgcacagctcccggcttcacaacacttgaaagatgagcaatgatatagtagtgagagttacgtatgattgtcttataatcactgttattgatatctaccgcaccatagcaagtctgacaaccaccttcacgattcggaccacggtcgttatcgagcatcagattccagacaattacgcccttacaccaattattgattgttcccaatgctacctcttccatatcttccatcagacgcttcgacaagtcacgtccgctgttccatgtgccgatagaagtttctgtaaacagaagttctttctcaggatatgcctgatgtatattcagcaattcttcacggttgccgccatagttatggtaagcagcacctgccagatactgagaagcagcagcatcttcgtaaatcttgcccggatagttcttctgcgattcgatattgtcataattgtagttatggtcgaaagcataaatcttggtagacagtccggcagctttcatctgaggaccgagcgctgttttcacgaagtctctttgttcttcccattccatatagagcgaagcggagttgccacggttcaaaggttcattttgcggagttactgcataaatgtcaatgccttcggctttaaatgcctgtatccatttcacaaaataagtagcataatcctgataataatccgggttcaattgtccgttcgtccacgaatccaatggtgtacggtctgtcaggcttttcactttcatccatttcggacaggtccaaggagcggcaattaccttgatagaagggttaatggccagaatctctttcaggatcggaaggatatagtccttttcttcgctctgcaaagcaaagttttcgatccctttcgtatcacagcaggtatattcgcttaacgagaagtccgaacaaccgatggaaatacggatgtaactgaatccgaaaccatctttatcggagaatgtttccgtcaggaaagcatgacggtcagccggtttcatcagtaacaggttgtaacaggtagaacctgtgatagctgctccgaaaccatccatcgtctggtactgttccgcaggattcaaagttattgtggttggagccaaattgtctttcgggctgaagttaaccgcatcacgggtcaaatcacgggtcagactgctggttgtcgtataaatggctacatctccggtggggacaggtactaccggtttttccgcatcatcactattgctacaagccgctaatatggtgaagcatcctaaaaaggtcagtgctatatttctcatgtttatcataatcgttagtttctttttctatttaaatacattataagtgatgttatctccggctctatcaatatccggggttctgttcaatcttgtcattggcatcgattaccgattgtgggataggcaggcgataagagttcttatcaaaggcgtaaacctgtgacttgcgacctgaatctttcgcatatacggcgttcatcacctcttctaccttatccagacgaaccagatcaaaccagcgttgtccttcgaatgccagttccagccgacgttcgttgagcaatgcggtaatcatcgcatcccggtctttacgtacggatgaagacaattcgcccaatccggcacgttcacgcacttcgtcgatgatcttagctgccgcttccagatccggcgtatcctgcatgatcaatgcttctgccttcaataacagcacatcagcatagcggtatttaataatgctgctattagccgaacggcatttgtacatgaaaggataattgtccgacggataatagttgctccaattacaatcatagtaaactacggattcctgaaagcgaatctgatctccttctttcttgaaagcattgatcaaatcacgtgacggagttacccattttgcccaagtgaagttattattccagtttacaaggtcacgtccgaacatccatgtacaccagttacccgaaccgggagtaaactgagcttccagtatagattctttagtattacgggcttttgcatccgttccggcagcattcatgccgaacaaatcgctaaagtccttcacaagctcaaaaccatcagccttcacctcgtcacagtaacggattacttttgaatagtcacgcaacggtttctctgcatagatctttgcaagaagagtacgggctacggattttgtaaacagagttttgttgcctgccgtattatccggcgcatgctggatggcagccagcaaatctttctctatctgctgataagcttccagttctgtgttttgtgccgggaaatattgttcatacacatcttcgatattttctgaagtaatatcatcagctactgttgtaataaccgggaaatccccccacagacgtaccatatcgaacatgaccatggcacggaatatcattgcttccgccttatactgcgcacgttcggcagtagtcaaagagttatcggtcaccaagtcaatattacatatcaatttattggcacgggcaacgtcttccagataacggttccagtcacgttcgagcacagagttggaaccttcgatggaattgttctcaaacggaagtacctcagctcccgtagttcctgcgtacgcattatccgcatgcgaatctgatatgagcaacaagtccacataccagtgttcctgacgatcgcgcatctgattatagatagtcgtcaggtgactttctacagccgctttatctttaaataccacctttgtaccggtatccgtcacaccttcggtcacatccgaataagtatcgatcggatcgtaattcagtgagcaggaagaaagtccgaacagcaaaccggaagtgagtccataaaatatatatcttagtttcatagtctttcctttcattagaattcaacattaataccaaacacgtatgatctagaatgcgggtatgtaccccagtcgatgccttgcaccgtaccgctgttgccccattggtttacttccgggtccatgccggagtagcttgtccatgtcagcagattggtagcggtaaagtaaggttgcagacgggtgattccccatttctgcagtaatttgcccttaaagttgtacgacaaggaaacgtctttcaatctcaggtaactgccatcttcaataaagtaagtagagttcagcaacttgaaattagctttcggcacattggttatctgtccgggtatcttccagcggttcagtactttggtagactgattctttccatcgtacatcccttctgtttctatacgggaagcattgaagatatcatttccgtaagagccttggataaacacactcaaattaaatcctttccatgagaaagtgttggtcagaccataagtaaagtccggattcgggtcgccgatataagtacggtcggaagtcgagattttaccatcaccactcaggtcacgatacattaattcacctgtctcaggatctacaccgtcactgatatatccgtaaaagcctcctaaagcacgtcccggctcattacgcactacataatcgttgactacatccgcagttttggcatcatagtacactttctgcaattcaagtttcgtcaatttgttccggttgaaggaaatattgaagtccgtatcccaggtaaatgctcccccccggaagttcttcgaactaatggtaagctcaaaacctttattagtcatttcaccttcattacgggcgatagaagtagctgcagcagcaccggcaggcagtgatacgttcatcagcatgttcttggtcttcttgtaatagtagtccatgttaaaagtcaaacgtccattcaatactgtcaggtccagaccaatattggtctgagtagtcgtttcccaagtaaggtcagacgtacgtaaattggcctggctgatagtcggtaccgcattcgcataatctgttgtatcaccttcagccgctaccttaaaccattcaatacgaccgatattataacgttgcaaataagcatagtcaccaataccagactgattacctgtctgtccccagcctccacgtattttaaagtcatcaatccacgtcagatcagccataaacttctcggaagatacacgccaggcagctgagaacgatgggaataccccccaacgatgatcaggatgcaacttagaagaaccgtcggcacgcaggttagccgtcaacaggtacttactatcaaaattgtaagctacacgtccgaaaaatgacataattccccattgagaagcacctgtaccggtattatcccaggcaattttgttcgcggcattcaaggtctgtatcagatcattgcggtagtgtgaaccgtttatccaactgttagagtagtctgaatccgtccacgatgaccctgccattacctccagaccatgtctcttgaagttcttattgtaagtaaatacattgtcgaatgtcaataccgtattcatattccggttgtcggaggcttcaccatactggttacgtccccaagcagtagaaatcggatcaagaaaagtagtatttacagcattgcgacggtcaagtgttagagttgatttaaacttcaactccggcagcaaggtaagcaacacgttgcccgatgccagcaaacggttttccttatctttattattcttcgcacgtgccatgttctccaacgggttggtgatatttccaactccatagaagttattgtaatactggttcggatttaaagcatcccagatcggagcatatgtcggcgtattgataacagccaatacaacgccaccgcgattcgctcctgttcccatcgctccccctccgttactggtatagtccgagtaggagatattagcacttactgtcaaccagctacgaatctgattttcaagattcacccggaaattataacgcttgtaataagagatatccagtattcccttttcatcgagatatccggcagaaagatagtatttcatcttttcattaccgttagatactgctacctgatagttttgcatctttccggtcttatatgtttcgtcaaaccaatcagtacggtcgggcagtccatcaggcaaggataccagtccgatttcatcctgtaactctttatactgcgcagcattcagagattctaccttatccgccaccttgttcaagccaaactgtgctgtcagagatacttttgcctttccggtcgctccggcctttgttgtaatcagaattacaccattggcagcacgcgaaccataaatagaagccgaagaggcatctttcagaatctgcatgctttcaatatcattcggagataaaaacttaatgttatccacaggaacaccatccactacatatagcggatcgttacttccgttcatagaagtagtaccacgcacacggatagacatctctcctcccggcgtaccgctaggctgaattacggagataccggctgccttaccctgaatagcctgtccggcagaaacgatgggacgtacatcaagatctttagtagacacagtggaaatggctgtcgtaacatctttacgttttaccgaaccatagccgatcacaactacttcttcaagtacttcattgtcttcctgaagtgtaactttcatctgtcgggatgctttctgttcctgcgatttatatcctacataagagaatattaaagtagcattggactggaccgtcaatgtaaagttaccgtctaaatcagttatcgctccgttagttgtccccttttcctgtacacttacaccgataagcggttctttctgtgcatccagcacctgaccggatgcagtaaattgttgtgcggatgcactcagagaaaaaaatactgctaagatagcaaagagaatcttgcgactccccgaaaggatttttcgcctgttctttttcatgcgtattaattttaaagtttataattaaggtatgtgcttgacaggactttcgccactatttcagaagcacaggtcaaaagtataaagaaactgaagtgatttgacaatgagggtataataagtggattatacaaacatacaaaccactaataaacagcaagttaatatcaaccaaagaggcctaaaaagtggataggttacaacatcgatcaacgtattttccgaactaaatcttcgaaatcttctctggaaccacgagctttgttttttactttcgcccgataattataaattgtattcaccgaataacggagaaactctgctatttgtgaactatcttcaataccaagacgtattaatgcaaaaattctcagttcggtattcaataattcatctttcttcagaatgatttgttcattgtcttgcaacaatgcattgaacttcttcacaaaatcgggaaataaatgcaggaaagcagtatcaaagttggcatatagttcttccaattcctcatcaagggcatcctgtgagcgggtgattttaagtaattctgctatctgaccagcagatactttcttatttaccatacgacgatatgcatcgagccgattgatataagtagagcagagtttaataaaacgggcaatatattcttccttaatctggttagattcagacagttctgcattggtagatgtcaaacaggcattcatttgctgtaattcttcattcaattgattcaattgatgattggctgtctgcagatgattccttgcaacagccaatttcttcatctgccggtatatatagcccaacgcaccaatcagcagcaccagcaatgccgtaatcagcactaaatactgctgaaggcggtcgttctgtttctcaatcatcgcctgataagttttatcaatcaaagaaagcacatcggcactctgccaacttcgaagacgagcattatagaatttggtagcattccacgagaaacgcatatattggtaagctctctccatatcgccattctcatagagcaactgagccaacatccacaaagaagcatgatctttaatagcagaacgaatatcagagatagcagaaaggcaaagattctgtttctctcttattttatctccaagatatttataaataagtgagcgatggtaagttacaagtgcatattgaggcgtatcgggctctgctgccatcagacgacggtcgtttatctccaaggcctcatcatacttgtgccggtcacgaaacaacgtttcgcgcatgaccataaattcttccgattgaggagataatatcgcatataatgaatctttatatgctgacgatatttcccgataataagcagataacgtctgatcttgtgtataaaatcccatctcaccatacacatgatcgaaacatgtataataatcaagtatcagatgtgaagttaccttctgtcggtctactgacttcaggacatcaattgattcggtatacatacccgtagaagaaagcaaaagagaaagttgcagcttactttctatttcccggtcagtatctcccagattacccgcgatacgaacattctcatttaaatagtaaatagcggaatcgcaaataaaggctttatattccttatagatctgattattcagattatagcgttctatggaattaggagccacgtctccggcaagctctttcagatgccgtatccgcgattcgcgctgtaccacataagtgtcatgtgccaagattgcctgatcaaggacatgcaatagtgaatcaagagtttcatcagcccatgagaaaatcggaaaagaagcaaacagcaacaacagcaaacatttatttttcattagagtattaaagttttgtaggaaatatgacattcttcactcaaggtatcacttataaatcagcgtcgacaaatattcctccgcaaacatctcattggcaacctccagcagttgttctgccgtcaacgcctcaatacgatggaacactgattctgacgattcatacttatgatagtgcagatatgttttcgccatacctagcgcattattctcgaaattatcagatgccacgccgatctggcctatcagttgcttcttcgctgccgccagctgagaagatgtcatcttcacatcccgcattcgcttcagttctttataggtcagtttcagacagatatccatatcttcgatatctgtaccgaaatagatacagaaagctcctgtatcggtataagaagtcagattggactctacattatacaccaatcccctccgctcgcgaagcgatacattcagcttactgttcatgcccggaccgccaagcacattattcagcagataaagtgccgtacgcttatcatcatacgcattgtatccccggctaccaatcattacatgcgcctgatgagtatctttaggcactaccaaccgttcgggcacataaagaggaggaggcatacgctgattatccaccgtcactgccgggatatcggacaaatgcttttccgccagacggataatcttcttgaaatcatattgtccctgaacaaagaataccatattccccggttgataaaagcgacgggtaaacgagagaacatcctccgtacggaaactccgcagcagttccggcttaccgagaatgttccttcccaacggatggttacggaaaatcatatcttcaaaatcatcgaagatcaactccgaaggattatcctcataagactggatttcgtcaatgatcacttccgtctccttttctatttcatgctgcgggaaagtagaatggaatacaatatctccgagcaattcgagggcacgttccagatgcccggtcaggaaggcggcatagacaaccgtctcctctttattcgtataggcattcagatcgccgcccacattctccatgcggttaaggatatgccacgctttccgcttctccgtccctttaaaaataagatgttccacgaaatgagccatcccctgctcatcctcagcctcatcgcgcgttccggcatcgatggcaaaaccacaataagctactttcgagagagtcggttcatgaattatgcgcaggccattcggcaatgtatattcgttgtaatgcattgttttctacttccttattgaattaatgccgcaaaaatacaataaaacttattgtcgtttatagaaaattgcagatatttgtagactatattagcaacaacgtgtatgaaaaagataggaatattctgttctgcctcggaaaacattgacaaaatgtactttgacagtgcccgtcaaatcggagaatggatgggaaaagcaggcaaaacgttgatttatggaggagccaatctcggactgatggaatgcgtagcccgcgccgtgaaagagaatggcggtacggtcatcggagtagttcctgccaaactggaagaaaaaggtagtgtgagcacattactggacgaggtgattcatacccgtaacctgagcgaccggaaagatgtgataacagagaagtcggagatattggtcgcattgcctggtggtgtaggtacactcgacgagattttccacgtcatagccgccgcctctatcggatatcatcagaaaaaggtgatcttctataacgaatacggtttttataatgaacttctggctgcacttaagacgttagaggataagggcttcgcccgacaatctttctctacctattatgaaacagcaaacaatctggatgaattaaaagaaaaaataaactgattatatgatagactccatcaaacaactcttgcaacaagaggcacaagcagtgctcaatatccctgtaacagacgcttacgagaaagcagtacaactgattgtagaacagatacatcagaaaaaagggaaattagtaacttccggcatgggaaaagccggacagattgccatgaacatcgccacaaccttctgctccaccggcattccatcggtcttcctgcaccccagtgaagcgcagcacggcgacctcggcatcttacaaaaaaacgatttgctcctgcttatctccaactccggcaaaacacgcgaaatcgtggaactgacccgactggcacataatctggacccggaactgaagtttatcgttatcaccggaaatcccgacagcccgctggccaacgaatcaaacgtctgtctgagcaccggtaaacctgccgaagtttgtacgttaggcatgactcctactacatcgactaccgccatgaccgtcatcggtgacatactggtagtacagacaatgaagaagacaggattcactatcgaagaatactcaaaacgccatcacggtggttatttgggcgaaaaatcaagatcgctatgcgaaaagtaatcggtatcggagaaacaatcctcgatatcatctttcggggaaaccagccttccgcagccgtaccgggaggctctgtattcaacggcatcgtatccctcggacgaatggggatcaaggtaggttttatcagtgaaacaggtaatgaccgggtaggaaatatcattctgcaattcatgcgtgaaaataatattccgacggatcacgtaaatgtcttcccggatggtaaatcacctgtatcactggcattcctcaatgaacagagcgatgctgaatatatcttctataaggattatcccaagcaacgtctggatgtgctttatcctaagttagaggaagacgatatcgtcatggtaggctcttactatgcgctgaacccggtactcagggagaagattctggaactgctggaccaggcacgcgagaagaaagcaatcatctactacgacccgaacttccgctcttcacataagaacgaagcaatgaaactggctcctacgattatcgagaatctggagtacgccgatattgtacggggatcgctggaagatttcttctatatgtatggcttgcaagacgtggacaagatatataaagacaagattaaattctactgcccgcggtttatatgcacggccggtggggacaaagtatcacttcgcaccaatctggtcagcaaagaatatccgatagaaccgctggaagcagtcagcaccatcggtgccggagataatttcaatgcgggattgatctacggattgcttaaatatgatgtacgataccgtgaccttaataatctgaatgaagaagtctgggacaaagtagttcagtgcgggaaagactttgccgccgaagtatgccgtagtttcagtaattcagtatcggtggagtttgccggacagtacgcatcgaagtaattacggatacaaccatcccctaaattactattaactttggctaataatcgcaaaggaattaccacatctaacggtaattcctatctttgcagtacatgattcatcagacaaagaaactatgtacagaaacctgttaaactggctgaccatcctactggtatttccgtcatgttccggcacttcgcccactatatccgtagtgtgtgaagagaacaatgtaggaaacgccattatcaaatgggaaacagcacctatactgaaaggacaggtaaaagtatatgcttccacttctcccgacttcattcccgaagaaaatcccgtagtcaccatcaacattgcgaaagggaaaaagaccatcgtgaccaatgatccgtctcagcgctattactacctgatggtattcaacaacagataccgggtgagggtagctgcccgtaacgtcaatattcccggcattcagaacttccgtgacctgggaggatacaagtctgcagaaacaggcaaagatacccgctggggaatgctgtaccgttccgcacagattgacagcattccattctgctcccgccgggaattgaaaaacatgggcataaggactatcatcgatttgcgttcggaagaagaacgccataactatccacagcttcatgatgaagactttaacgtcctgcacctccccattgcaacaggaaacatggaacacatcctgcaagacatacgtgataagaaaatagaaacggatacgatctatcgtttagtagagcggatgaaccgtcaactggtcaccaactaccgcaaggaatacaaagaactgttcacactcctgctcgaccgcaacaattaccccgtcgtcatccactgtacttcaggcaaaggacgtacgggcattgtttcagcactggtacttgccgctttgggagtcaatgaagaagccatcatgaaagactatcgcctgagtaatgactatttcaacatccccaaagcctccagatacgcgtataaactccctatcaactcgcaggaagccatcactacaatctactctgccaaggaagacttcctgaatgcagccaaagaacagattgatgcggaatacggcagcgtacaggcatatctgaaaaaaggaataggactctcggcagaagaaatcgaacggttgcgcagcattttattaatagataatggttaatggaaaatggagaatgctatgcaggcagcaataattatccattatccattattcattattcattatttttctctatctttgcgcccgaaataaaagatatacagagatttaatgaagacatttgaagagcttggcgtttctccggagatacgtaaagcaattgaagagatgggatatgagaatcccatgccggtacaagaggaagtgattccgtaccttttaggagaaaataatgatgtagtagctcttgcacaaactggaacaggtaaaacagccgcattcggcctgcctctgctccaacagattgacgtaaagaacagggttccccagtcactaatactttgccccacccgtgagctatgcctccagatagcgggcgatctgaacgattactcaaaatacattgacggactgaaagtactgccagtttacggcggttcttccatcgacagccagatacgcagcctgaaacgcggcgtacatatcatcgtggccacaccgggacgactgctcgacctgatggagcgcaaaaccgtatctttatcgaccgttcacaacatagtgatggacgaagcggacgaaatgctgaatatgggattcaccgacagcatcaacgctatccttgccgatgtccccaaagaacggaacaccttgctcttctcggcaaccatgagccccgaaatcgcccgcatctccaagaactacttgcagaatgccaaggagattaccatcggacgcaagaacgaaagtacaagcaatgtgaaacacgtagcttataccgtacaagccaaagacaaatatgcagccctgaaacgcattgttgactattacccgcaaatatatggtatcattttctgccgtacccgtaaagaaacgcaggaaatagccgataaattgatgcaggaaggctataacgcagattcactgcacggagaactgtcacaggctcagcgcgatgccgtgatgcagaaattccgcatccgcaacctgcaattactggttgctacggacgttgccgcacgcggactggacgtagacgacctgacacacgtgatcaactacggcctgcccgatgatacggaaagctacacacatcgtagcggacgtaccggacgtgccggaaagacaggtacttccatcgctatcatcaacctgcgcgaaaaaggaaagctgcgtgagatagagcgcatcatcggcaagaagtttattgccggagaaatgccgacaggcaagcagatctgcgaaaaacagcttatcaaagtgattgatgaactggaaaaggtgaaggtaaacgaagaagaaatcacggacttcatgccggagatttatcgtaagctggaatggctgagcaaagaggatctgatcaaacgcatggtatcgcatgagttcaatcgttttctggactactaccgcgaccgtgaagagatcgagactccgaccgacagccgcgaacgtaacacacgtgacagccgtgaaagaggcagccgcaaggcagcgccgggtttcacccgcttattcatcaatctgggaaaaatggacagtttcttcccaagcgaactgatcagcttgctgaacagcaatacacgtggacgaatcgagttgggacgcattgacttgatgaaaaatttctccttcttcgaagtagaagagaaagaagcacaaaacgtagtgaaggcgttgaaccgcgctaactggaacggccgcaaagtatctgtagaagttgccggtgaggaagcaggagaaggtcggagaggcagtggttctgccgaacgcagaggaggaaaacgtcctttcggaagttcctccgaaaagcgtagtgacagtagccgcaactcacgttccgaaagatcggacagagcaccgcgagctgacagagcgactaaaggcagtgacaagaccgacaagaaaaaaagaagcgacaagcccagccgcgaagaacggggttacggagcacgtggtcctaaaaagacagacgactggcaacagttctttaaagataaagagcctgacttcagcgaggaaggatgggcacgcagaaagccgaaaaagaagtaacaggcaaaacagccattataaggtgatgttggaaaagaagaagatttaaggcgttgatatagtttacctattcataaccgatattgacgtaacatatttattctctatccgactctgctgaaaaatactgacctgttatgcctaatctatatttcagtttttaataaacttcttgatcgtttattagaaacggtatccaagtttattagaaacgattacatggcttttcgatagcatttatccgaatttatataacaaaacaggctgcaaacctctcaaaagtttgcagcctgtttcttatatacaagctaccgaaaagccttccgaagcaaggcattatcggataaaatgttgtcatattatactatatcagcacaacaaatgcagtataaggtaagatattctcattggtctaagttttaattcatttattgtaaggatacaaatatacaacattaaaagccgtttgtcaagccttcaggagttttatacgttcatagttcctcctccttcctcagaagcctcatgaacatccttcgtcttgatattcctgtactgcttgggcgtcatctcgaacttctgggcaaatgctttatagaaagtccccctgttcgagaatccggttttatccataatctcttcaatggaaagttgcgttgtcagcaacaagcgttctacaatcgtcaggcgatactctctgatgatgtcggcaggagtcttctccgtgacatttttcagcttccgatagaactgccgggtactgtatcctaatgaactactcaacaattccactgataaatccgtattctgtatatgactatcaataatctgcatcatcttctcgaagaaggatttatcctctttatgcagaaaatgaccatcatccagttcaaaagcacttagaacagagctataatactctttcaggtcctcttcgcgctgtaacagccttctaacgactttctcgagatattccacattgaaaggtttcgtgatatatgcttccgcgccggattcaattcccctcgtctgctcgtcaatattattcagtgccgaaagcagtattaacgggatacggctcaacagtttatccgactttatctttttggcaaacgacattccatccataccgggcatcattacatccgaaataatcaaatccggtaactggatgcccaactgcttcaaggcttcctctgcgctgcctaaagagacaacattgtatgccccgacaaatatctccgtaacaaaccataacatagaagggtcatcgtcaataatcataatcgtctgcttgttcttatcaaattcaaccgacgaattcttgagttcgactgcttgctcatctgatgacaaaaccaattcttcagctactttttcatcttcattatccaccgtaacctccataacaggcagccatacatcaaaagtagtcacctcattaggaatactggatacctgaatctgtccattcaacagatttaccatactgtgacaaatggccagtcccaatccatttcgcggagaaatcccattcttgttctgcacttcgaaattatccagaatcttataacggtcgaatattttcgtgagatcagcctccttgattccttttcccgtattagatacccgaatgcaaagttgttctccttcaatacgcagctctaccgtaatggaaccattctccggagtatatttgaaagcgttagaaatcaggttatttacaattttactcagacagctgacatccgtattccaaaaaactccatcttctatctgcaatcgatagttcagtttccggctttccgccagctctccgaatgattcggcaatagtccgtatctgttctgtgacaggaacatgttttatcttcaaaatcttgttccccgtctccagtcggcggaactcaatcagttccaatatcagcgcattcagtttcaacgcattctgctgaatcatggaagcatacttccggacataactgtctacccggctataagaaaggattttttcacacggaccgttgatcaatgtcaacggagtacaaaattcatgggtaatgttagtaaagaaacgcaatttcgattcatacagttcttcgcgctgctggcggttcatttcctcgatcataacattccgctttctgcgataacgttttatcaccatccggatagctcctgcaattaccccggctaataataagaaatagacaatataagcacaagtagtcatataccagggaggagtgatacggatcaataatgaataaggttcactctctttccctgttatattacttcggtacttcactagcaaggtgtattctccaggagatagattagagaaaaccgccaccgtagacaatccgttctcaatccaactatcgctcaaaccgtctatcttataagagtaagtataattgttcccgttaatgtaatcgacagcaataaatgaaaggttaaagaagttctgactatagtccagcaccaaagtttcttgcttcgtagcgccttgcagaaaatcataaatattgcactctttaccaaaaatagagaggcggttgaaatgcaaaggaggcatgtattcttccgaaagttgatcattctcgctaatcgtaatgaatccgttcgtaccaccaaaaaataatgtccccgtctgctgatccttgaagaaagcaccgtcactaaactcaatcacttccaggtcgccctgctgccgatacgtctgaactgtgttttcgcggacattaaacctcaccaacccttgattggtgctaagccacaagttattgtcccttccttccaatatgccgtgaatcgtattgttgggaaagccgtcagtctcgttatataccctatattcgccctgataaagccgggtcaatccgaaactcgtaccaaaccagtatccttcgtcattcttatgaatagcaaaaatatcatttacagtctgattcttcactacatcgtcaatgcggcagggagttagttgattggtatgcgtattcattttatacgcaccatatccacggttaccaaaccaaataaccgaatcattctcctgaaaagagacaaagaaataattggagtttctctttccgccatccagtgtaaagcgacgggcagacttcactttaggtaaaagtgaagtagcatccagaatgattttcacaataccttcaccggcagaaaccacccacaacgtactatcatttgtctcacggacagaatgtacatacttcaccatcttgccatctgccatgaccggaaattcctgtatccgcttttgtgaataggagtagtaattaagtccgctctccgttccaatccataagagtttcctccggctgggagcaaaactatacaccgagttgtccatcaacggactattacttgccaggatcctttctgcccgaggcaaagtttccatatcaggatggaaatcaaacatctttaatattccccctcccttcgtacctatccacaatgtctgatcctgatcctgatatagagcacgaaccggattatctacccgatactccggtacatccaacatgatgttgtcaatagaaaattcatctgtaaaatacatataaagcccttgaccgtcagcgcccacccagattatatcctgaaaccggtctttcataagacaaaagataccggactgaacatttatggactggaggctatattttacctttgaatccggcatatactttaattggattaatccactactcttaaagccgataaaataatcagttttctgttttataatggaagaaacctcaccccgacgaagtatctctgcctccatatctgctataaaatacgctttatgattattcagatcgtattcataaagtgcataagtactgtctatgaaatagagaaaatcgccatctacaaacgtccacaacaacttttccgaatgattcaggcaattactgggaaccagcttcacttgatttccgtttttctctattatataactccggttatcattatccgaagagaatatccaaagtactccaaagttatcaatagccatttgttgtacttcctcaaaatgtatctttttcacatcaagtttacagaagtccttctgctccggctgataataataaatgtagccatcatccttaataataaagaaatcatcttcgggacttatcgccatacggtttatgtatttaaagtctttgaagctttgtatggtctgtctgcgtgtatcaaagcggtcgagcccataattagtctgtatccaaagcacatcgttgtccgcctcgataatccgttcgatgagattaccggagaaactatggtgcacattggttggtttgtacaatcccagataagtgccgtcgtagatattcagcccatcgcatgaaccgatccatatcacgccatgcctatcctgacacatcgaaagaatagcactattggataatccgttcttactggaaaattgccggagactatacgaagcatttatgtctactcctatcaaaagaaaagaaaccagtatcagcagaactcttcttaaaagagtagttctcttcgtccattcattgtgttttttcatatagcattctcttgttttaaatcaagacacaaaaatcgacggaaagatatggaaaatcgggaaaacgtccaagaactgcacaaaaaacattctgatcatctgaaaattaacataacaggagtacgcttttacgacacatatatatatttttgcgacatttcatcgagaagagacatttatgtcatgggtccgtacatcatcttatactaaccataataactttgcagcatcagacaacggaataaggtaaaaagcaaaataaaaaggattgtagtttgaaataggtaatccacaaacaggtagcatattcagctacctgtattttggaaggaaaatctttagttaataatgaatataatattatatagaatgaaatcaccgtgtattttactaatcatagtttgcaccctctctttgactggttgtgcctcaacaaagcaggcagactcagattcaagtttgggaaaagcccagcagacattggattccctttatcaacattactcagcaaaggactcttatctgcttcgtgaaaactatcctttcaacgaacaatataaagtcacttatctggcatcggaaaaccaaacaaacatgcctaatcagttctcctatttatggccatattcaggtacattttccgcagtaaactcattattagaagccacccacgacaagaaataccagcaattattagaaaaacaggtattacccggcttggaagaatacttcgatacagaaagaactcctattgcttactcatcgtatatccgaactgctccgacctccgaccgcttttatgacgataatatctgggtaggcattgacttcatcgatatctatcagattaccaaagaaaaaaaatatttggataaagctcaactcatatggaatttcatagaaagcggtactgatagtctgctaggagatggcatctattggtgtgaacaaaagaaagagtccaaaaacacttgttcaaatgctcccggttctgtattcgccctcaaactatttaaagcaaccaatgacagcctctatttcaaacggggaaaagaattatataaatggacacaaaagaatctgcaagattctacagactacctctattttgacaatatccgtcttgacggtaagataggaaaagccaaatttgcctacaacagcggacaaatgatgcaatcggctgccctactctatcaactgaccaaaaatccggattacttgaaagatgcgcagagcattgccaaagaatgctataattacttcttcacagactttacaactgacacaggagaaagccttaaaatgttgaaacaaggaaatatctggtttactgctgtcatgttaagaggattcattgaactttaccaattggaccaaaacaaaacttttatcgacgctttcaatcaatgcctatcatatgcttgggataatgcccgtgatgaaaacggcttattcagcacagacctaactggcaataacaataatgagaagaagtggctgctaacgcaagctgccatggtcgaaatgtatagccgactagcaactatacaataagtacaaatttaaaacaataaataattaaggctatataatataaaggtcttccgtcacaacacagcacaaaataatagctacacaaaaaccaatactcaaaagaaaattaatatgaaacaaaaaagacttacgtttttactcctgttaatctccaaccttttttgtgcatctgctcaaaaatggtataaaccagagattgatctaaaagttgaagagctactgagccaaatgacagtagaagaaaaacttggatatatcggtggcattgactggatgtacactaaaagcattgatcgcctgggtattcatcgcatgagaatgtccgatggaccgcaagggataggcacaaaaggcaagtctaccgcatacccggctacagtgacactagcagctacttggaacgagaatcttgcctatcaatacggaaaagctttgggacgtgattgcagagcaagaaacatcaatgtcatattaggtccagcggtcaatatctaccgtgccccaatgtgtggacgtaactttgaatatatgggtgaagatccgtatttaacatcccgtatctgtgtaggatacatcaaaggtgtacaagatcaaggtgtcatggctacagtcaaacacttcgttgccaacaactccgactatgaccgtaataatatcagtaatgatattgatgaaagaaccttgaatgagatttacttccctgcttataaagctgccattcaggaagcagaagtaggagccatcatgacaagctataacttgatgaatggcatctacaccactgaaaacccgtggctattgaaagaagtactcagaaatcaatggggcttcaaaggattagtgatgtctgactggggatcgactcattactgtgttccagctgcaagaagcggattagatctggaaatggcaggaggagaaaagatgaatcctaaagatatggcttactatcttaaaacaggagatgtgactatggatatggttgacgaaaaagtacgccacatcttacgcatactcattgctttcggattcaaggatggtacggaagctgacaaaagtatcgctctggatgaccctcaatctgtagaaacagcattaaatgttgccagagagggacttgttcttttgaagaatgaaaacaacattcttcctatcaatccccaaaaatacaaacatattatcgttaccggcaaaaatgcacatggatatgtacatggtggtggtagtggcgctgtagttcctttccattataccaatttattcgacggaatccaaaaagaaggtaaactgaataatgtaaaagtagaatatattgatgaactcgactttatgccgtccatcatgtatacagacgacaatctcaacgaaaagggatttcatgccgaatacttcaagaatattcacttcgaaggagcccctgtggtaaaacagactgagaaaaaaatcaattattcttgggctgcaggcacagaattggaaggtatgcccaaagattatttctctgtgaaatggtacagtacaatgtgcgtagacgaaaccgctgactatgagttcacattaggaggcgacgatggttataaattgtttatcaacgaccaaccgattattgatgactggacgcccggaggtttcagaacgaccaatgttaccaagacactaaaagccggtgaaaaatatcatgtacgtgtagaatactatcagcagggtggtggagcaggtatctgctttttatggaaacgtaagaacgagactcagaataagtttgccgattacctgaacaaagcagatttagtgattgcctgcttcggtcatagttccgatacagaaggagaagcaagcgaccgcacattcgaactgcccgaagtagataaaaaaatgctggccagcttatccggatgtaaaaagcctgttatcggtattgtaaatgccggaggtaatattgaaatgcaaaaatgggaaccgtctttgaaggggcttatttggggattttatggaggtcaggaagcgggaacagctatcggcgaagctttattcggtaaagttaacccatcaggaaaattacctatgacttttgaaaagaaatgggaagacagccccgcttacaacagctatcatgacccggataaagacaaacatgtagcatatacggaaggaatattcatcggctatcgcggctatgacaaattgaaacgtgaagtacaatatccttttggctacggattgtcttataccacctttaagctatctaatatagtagtctcaaagccaaatgctgatggaacagtagaagtaacctgccgtcttgccaacacaggaaaaagagatggtgcacaagtcatacaagcctatgtgggcaaagcagaaaacagcccagtagaacgtccccaaaaagaactgagaaaatttgaaaagatattcctgaaagccggagaatccacaactgtcaagatgacattacctaaagaatcatttatgtattttgatgtcaacagaactcagttcgtcactgatccgggtatttacaatataatgcttggcttctcctctagagatattaaagcacaaaaaaatattcaatatacactatagatt

SEQ ID NO: 44 - DNA, 62958 bp, Bacteroides thetaiotaomicron
gataggaacttttctatgatttacaatattataaataaataaactggggcttaggtctgttttgagcagcaaaggctgatttatagtctttgttgctctttttattgaatatttaaataataatcgtagattctgccattcttggttaaatatttttaggtttaagttgcaaatatatcataattcttttacttttgctttcggtttcggacaaaacttatccgaaatctctgaaaagcatgaaggaagttacgtttatccgtcggaacattgaaaaatggaaagggaccgaaaaggtggtggaacaggctgcaaacctgtcccctgaccaacttgccgacgcctatacggaactgactgccgaccttgcttttgcacagacccatttcccgacttcccgcattaccatttatttgaataatctcgcttcagccctgcataatgaaatctatcggagcaagcgtgagaaatggacacgcattatcactttctggacacgggaagtgccgcagaccatgcatgatgcgcagcgtgagttactgatctcttttatcatctttgccgtcagtgcgttgatcggggcagtatctgccgccaatgatcaggagtttgtgcgtttgataatgggcaaccaatacgtagatatgacattggacaatattgccagaggtgagccgatggcagtatacaatggctctcccgaagctccgatgtttctgggcattacaatcaataatataaaagtatccttcctgtgttttgccgcggggatactgaccagttttggtacggggcttatacttcttcagaatggaattatgctcggttcatttcagatgttcttttatcagcacgacctgctttgggagtcggcacttgccgtctggctgcacggaactcttgaaatatgggcgatcatcgtagccggtgctgccggacttgctttgggcaacagctggttgtttcccggcacctattcgagactcgaatcttttcgcagaggagcgaaaagagggctgaagattgtaatcggtacggtgcccgtgtttatcatggcgggatttatcgaaggctttatcacccgtcacaccgaacttccggatatgctgaggctcggcatcatccttacatcccttgcatttatcatcttttactatatttatttaccaaatagaaaaaaacatggaatcacagaaacctaaggttgcaatgtacgtgaaacgttctttcggtgataagttgaacgcttcttttgacttcataaaagagaattggaaaatactgttgaagtttacgacttatctgcttttgcctgtaagccttattcaggcattaagtctgaacggactgatgggaggagcgtttgccatgactgctatgtccaagactgcgacggtgccggatactgcatctttattgggatttatgtcctattacggtctgtatatgattgtatttatgataggcagtattttgctgacctccatgatctatgcattgatccgtacctataatgaacgtgaagaacgcttggagggaatcacgttgggtattttgaagcctttattgttccgcaatatcaagagactgcttgtaatgacccttttctccatcttagtcatgcttttcgtggggcttgtggtaggtctgctggcgtttctgtcactgttcaccttgtttctgaccattccgcttcttatcgcttttgtagtgccgcttgcattatgggcacctatctacctgtttgaagatattacagtgatggagtctttcaaaaagacattccggctgggctttgccacttggggaggcgtcttcttgatatctctgatcatgggatttatagctaatgtattgcagggagtgactatgatgccgtggtatatcgctacgctggtgaaatatttcttctcattaagtgatgtcggaagcgagacgacagtatcggcaggatatagctttatcctttatctgcttggtattgtacaggcattcggcgcttatctttccatgattttcacttttgtcggaatggcctaccagtacggtcacgcttccgaagtggtagatagtgtaactgtagagagcgatattgataatttcgataaactctaaacatatataattcagaatagatgctgacatccccggctgatacattggtttgcgacaccgtgcagattgccaaatggcaatccgaatcggcgtatgactacaatcgtgaactgataactcctgaaatcaatatctttgaatggtttcgcaggcagtttggggaattgttgcggaagatattcggcagccgttttgccgaagagtattctgaacttatattaatatgtctggccattattattctgctcctgattatatggtttgtttataagaagcgtccggagttattcatgcgttcgcccaagaataaactgccttatgaagtgggagaagatacgatttacggtgtggatttttcgggagggattgccgatgcgctttcccgttccgattatcgggaggcggtgcgtctgctttatttgcagacattgaaacggcttagcgacgagaaacgcattgactggcagccttataaaacaccgacacagtatatcaatgaagtacggatacccgttttccgtcagttgaccaatcatttcctgagggttcgttacggtaactttgaggcaacggaagaactgttcaattccatgaaatccttgcaggaagaaatagggaaaggagggggctcatgaggggaagccgctggtttatcttctttgtccttgcttttctgctgctgatgtttgctatagaatatcatctgccgaagaaatttgtatgggtgcctacctttagccattacgatgagcagcctttcggatgcgctgtgttcgacagtctgctgactgtttcactgccttcgggatatacactgtcccgaaagactttttatcagatggaacaggaagatactgttcacaataaaggaatactgctgattgccactaatttacctttcggacgggtggatatagaagccttgctcaaaatggcggatcggggaaataagatcatgctggtaagcagttcttttaccaagattttggaggatacgctgaagtttgattgcacttattcttatttcagatcggtcgatttgaaaaaatatgccgcttcgttattgaagcgggacagtatttattggatcggtgatccggaagtttattcacggcaggtgttccgtttttatccgcagttctgcaagtcctatttccgccgttatgattcgctgccggtacgtaaactggcggagatcaatctggcaagcgatatggggcacgcattggatgaactggattctacgaccgtttcccgcaattatcatccgttggtggctatggtgcgtccgtggggaaagggtgaaatcattctggtttctactcctttgctttttaccaattatggagtgctggatgagaaaaatgcgacttacatattccgcatcctgtcgcagatgggagagttgcctattgtccgcaccgaaggatatatgaaggagactgcacagacgcagcgatctcctttgcgttattttctgtcgcaaaggccgcttcgctgggcgatctatctgtcgatgttcgctatcttgctctttatggtgtttacagcacggaggcggcaacgggcaatacctgtcatacaggaaccggaaaacaaatcccttgaatttaccaagttgataggcacgctttattatcagaagaatgaccatgccaatctggttcataagaagttcacctactttgcggaagtgctgagaagagaaattcaggtagatgtggaggaagtggcggacgatgaacgttctttccaccggatcgctcagaagacgggaatggaggtggaagaaatcagcaggttgatccgcgaaatcagaccggtgatttatggaggacgtgtcctttccggcgaagaaatgaagggatttattgataaaatgaatgaaataatcaatcatatttaaagaagatatttatggaagagaatacagaacaacgagtggatttaactctcttttccgagaagatacaggaattgaaggatcagattgcttccgttattgtcggtcaggaacagacggtggacttggtgctggcagccatccttgccaatggtcacgtactaatagaaggcgtgccgggagttgcaaagacattgcttgcccgattgacggctcgtctgatcgatgcggacttcagccgtatccagtttacgccggacctgatgccgagcgatgtcttgggtaccactgtgttcaatatgaaaaccaatgattttgactttcatcagggaccgatctttgccgatatcgtattggtggacgagatcaaccgtgctcctgccaaaacgcaggctgccttgttcgaggtgatggaagagcgtcagataagcattgacggcattactcataagatgggtgaactctacactatccttgccacacaaaaccccgtggaacaggaaggaacttataaacttcccgaagcacagctcgaccgctttctgatgaaaataacgatggactatccttcgctggaagaagaagtggatattttggaacgtcaccatacgaacgcttcattaatcaagctggacgatatcaagcccgctatcaccaaagaagaactcctgtcactgcgtgccttcatgaatcaggtgtttgtagaccgtacgctgctccaatacattgcattgattgtgcagcagacgcgtaccagcaaagctgtatatcttggcgcttctccgcgtgcatcagttgcaatgttgcaagcctccaaggcgtatgcccttttgcagggacgtgacttcgtgacaccggaagatattaagttcgttgctccgtatgtgcttcagcatcgtctgatcctgacggcggaagcggaaatggaaggatactctccggtaaaggttacgcaacgcctgattgataaagtggaggtccccaaataagaaccgaatctctataattcgtaactcaaaacttaaaactcaaaactcagaacccgaaattgtacttaacccgtcgtttctatattgcccttattctggttatcctcttattgggtagcggatatctgtttgctccgttttttgtcatcgggcagtgggcgctttttgccttattcgtgttggtatcggcagatggatatattctctaccgtacccaggggattcaggcattccgtcgatgttccgaccgtttctccaatggcgatgacaatgaagtgagcattcgtgtcgaaagtacttattcgcgtcctctctctctggagatcatagatgaaataccttttatcttccagaatcgggatgtctgtttccggactacccttcagccgaacgaggggaaaacaatcagttaccatcttcgtccgacccgtcgcggagtatactctttcgggcaaatccgtgtatttgtgaccgataaaatcgggctgctttcccgtcggtacacttgtgggcaggcgcaggatatcaaggtatatccttcctatctgatgcttcaccgatacgaattgctggcaatgagtgataatcttaccgaactgggtatcaagcgtatccgccgggtaggccatcaaacggaatttgagcagatcaaggaatatgtaaaaggagacgactaccggactatcaactggaaagcgagtgcccgccggcatgagttgatggtaaatgtctatcaggacgaacgctctcagcagatttacagtgtgatagataaaggcagggtgatgcagcaggcttttcggggaatgactttgctcgattatgcgattaatgcttcgctggtgctttcgtatgtggcgatgcggaaggaggataaagcggggctggtgacttttgatgagcattttgataccttcgttccggcttccaagcagcccgggcatatgcagacgctgcttgaaaagctgtatagccagcagactacttttggtgaaacggacttctcggctctttgtgtgcatctgaacaagcacgtcaataagcgtagctttttggttctgtataccaactttgccagtatcagcagcatgaatcgccagttggcttacttgcagcagctcaaccggcaacatcgtttgctggtggttttctttgaggatgctgacttgaaagcgtacatcgaaagtccggcgagggatacggaagattattaccggcacgtgattgccgaaaagtttgcttttgagaagcgactgatcgtttctacattaaagcagcatggcatttactctctgctgacgacacccgaaaatctgtctattgacgtgatcaataaatatctggagatgaaatcacggcaactgctatgataagtctttaataatattttctactgtttcttttaaaggaggaaggtgctttgttatgactacccatataatctcatagtcaatgttggcatattcatgggaaataatatttctgagtccaataacttttgcccatggaacttgtggataatctttgaaaaatgatctttgggttttatcatcaatagccttaattgtttctccgattacctgtattcgcataatgcaggcatccaaaacagtcattccccaaggggataacaagaaatcgtctacattctgtatattcttgcatctgtcttcaatgatagagattgattctgataattgaagaaacttatctagaatttcctctttaagcgtagattccatctttttctattctttgggatatgagtgaacgaaggtttttgcgtaaacggaggagatctattttgcaattgcagatatgctccagttcttctttaatatcgaacatcacgaaaggatcgggttctttcaattctacgaaaacatctaaatcacttccttcgtgttgttcaccacgggccacagaaccaaagataccgatagaaataatcccatatttctcggcacactgttgcttgaattggcggatttttgtaaggtattcattcgttgttttcataattacatactcctttctctacaaaaatagtaaaaaacgggaagataacaagcgcatttctttgaaaatagcttattatagaattgccttccgtgtttctataaagaagaatacagccattcctattataatgactcccagtatgccgtaaaagagccgtgctctgccgcggcctacattccggacgattgtctgggcattgcgtgtggtgaagaaccagttccagttcagtaaggaagctagcagggaagtgattcccgctagcgcaaaaattccttgtacgatgtattgtccggtcatagtctgatcactctgcttccgtcttccagttcttcaatcgtcacttttacggcatctcccggtagtaattcttctaccagttccggccattcgataaagcaaagggcgccgctgtagaaataatcttcgtatcccatgtcatatacttcacttagctttttgatgcggtaaaagtcgaagtgataaatcaattctccggtttcgtccgaacgatattcgttgacgatagcgaaagtaggagaactgataacgtctgatacacctaattcttcgcaaagagctttgacgaaggtcgttttgccggctcccattttaccatataaagcgaaaacggtgttatcacccatagcagcgataaattcccgggctgcctcatggatactttccagtgattgaatcttgatttccatatactattctattattatgactgtttcttgcaacaactctttccgatcttgcaaacggcataaatcaggatagagaagaatataatcgaagcgcccgaagggactttccagtggtaagaaataaacagaccgcccagacatcccagaaaaccgataccgatggacagccagatgattttcttgaaactgtaggtaaagaggttggctgtcatttgcggaatggtgagtagcgatattgcgagaacgatgcctaccatacgcagacaagcgacgatggtcaacgcaataaacatcatcagcacatattcgaatatctctaccggaatcttttgcgaacgggcaaactcgcggtcgaatgcaatatatacgataggacggataaacagataaaagaatccggttaatatcagagccaatatgcccagcatccacaagtccgcctgattgatggtcaggatattaccgaaaagataagctgacaagtccggagcaaatcccggtgacaggaaactgaacatgattcccaaagccattcccagcgtccagaatacggcaatcgcagaatcttcacgcatatctttccgccggctcagccactcgacaccgaatgcggacaatacagagaagacggcggctgagagtatgggagaaattcccgcaaacagtcccagtcctatccctccgaaagaggcgtgcgtgattcctccactgataaataccagacggcgggtaacaatgtaagtaccgataatcccgcaggcaatgcttgccagtaagctgcccagcaaagcgtgttggaagaatgtatatcgaagtagatccactttttaattaaagattaaagattgaaaattaaaaatcaaagcaagaataatgccgtccatcaataaaaacaacttcaacgccctcctaatacttattacttaatacctattacctctccccattccttctctctccgataatcagaaagacttcatctttgaggtcatccggcaactcgataccccgtagttgcaaactacgtacccagcctgcgacatcaatgtcctgcatggtatataacacatccctgaattggtttgtttcttcgtcagtatacgcatttgcttcctttccgatgaactgatccagttcttcgtcatcgtaatattcaatttttttgcttacggcggcaagcaaactatctttctcgcacacttcgtgttgtccgcagcattctatatctgcttctttcacttccggcatacggtccagttcacctttttctattttctgttgcagtcttttgttgcggatataaccggctatcaatgcgatgatacctagcaacaccaaacttataataagtatccacatagtctgtactgattcaattttctgcaaagttacttattaatttgcattctatcatggatggtatctatttcttttcttacttttgcacgttgctaacttaaatatatattagacgatgaagcataagaagtggttgactgtcttatttatacacggtaacaggagaagatatcaggtaagtatatgggcggaaggaaatggctgggtgatagaaaaaggtgcggattaaagaaagaaacagccggaactgtagggtaccgacaaaggtgattttcatctgcttaggcggttatttaaaataatcctgtatatttgtgataataaatcgaaagactatgatacgacgtaggctttgcctcttattcctactgactggaatgactctgtttgcttattcgcaaggattgttgtttcaggctaatgataaagaaattaaagaaaggacttctcttcagatatttcaggaaggggagataccttgttttacgaaaaactttcagttgagctttgaactttctattcgcgattttgatacttttggatatgtttttctgctgaaggaagatcaggggaaaactaaatatagctttacgtatacttatctggatggtgagaacagtacattcaagtttaataccgacggaaaagagaatcattattctttaaatctgcgcaatgatgcactggcttatcaatggattcctgtgtcttttgcattcgatttgcaacaggacgtacttacgattcgtatcggagataacgaaaagaagattacttctttaggattgaaagatactttttgtccgcacctcttcttcggacgttatgattatattttggatatgcccacttttgccatccgcaatctgaagctggaaggtgatagaagtcattcatatactttccctctgaatgaaaatgaaggggaagaagtgcatacttctacagggaaggttttgggtacggttgtcaatccggtgtggctcatcaacggttcttatcattgggagaaactttttgagtattcttttcagactccttcgggaatcacttttgagccggacagtcagcgactgattattttcagccaggattcacttcttacttataatctgttgaaacgtcagccacaaaagtattcttatagcaacaaactacccgtaaaattgcagttggctactcatttcatgaatacaacggatggtaaactttatgtttatgaattgaataacctgccgttgggggatgctacggtagcggcgctcgatctgaataatcaggagtggaaacagaccggagtagcagccttgccggtacagttgcaccatcatgacggcttttgggatgaaacaaccggaaagtatctcgtttttggcggttttggtaataagcgttttaacaatacattcctcgaatatgatatcgaggccgaccgttgggacaccctctcttattccggcgaccggattatcccccgttatttctcgggtatggcagtcaataagaaccgggagcatatctatgtctttggcgggatgggaaacgaatcgggtgagcagagtgtaggccgaaattatcttcacgatctttatctgcttgacagaaagcagcagtctgtgcgacgtttgtggcagaacgcttcggatcatcgtttggtcgtcgcccgtgatatgatactgacacctgatgagaagtatatctatgccctgtgttatccggaatatctttcggatacctatctgcaactttatcgcttgacggttgatgatggaacgatgaaagctttgggagattccattccgatgcgttcggaagagattatgacgaatgctaacctttactataattcattgacgcatgagtattactgtacgaccacagaatttgacaagaaggggcatacggtgattcggacttatgtgttgtccgcccctccggtttctctggatgaaatccgttcttacggctccaggtcttctctggagattcgttggttatggataatggcaggaataggagtattattgcttgtcggaggtgtgctgtttgtcaggagaaagaggggaaaacaaagaaatgcggttccggaatcatcttctgtgctcatgtcaccacctgtcggaagagaaccggataaaagtgtactgggaaaagaaatgcctgcaaaagaagattttgaatcatccatcgttcgtccgaatgcagtttatttattcggtccttttacggtaattgaccggaatgggcgggatattactcatttgttcagttcccgtttacggcaggttttcatctatatcttgcttcatagtacccataatggagtattatctgcctccttgaatgaggttttctgggccgataaacccgacgacaaggtgaaaaacctgaaaggggtaacgatcaatcagattcgcaaaaatctggctgagctggatggagtggaacttgtacacgacaagggatatttcagactggtgtttactgactgttattgtgattatttccgtttccgcaccttgaagaatgctgaagaggtggagaatgaactcggcattttattaatgcgtggcaaattccttgatggtatggatgcggggatgatggaccacttcaaacaaaaagtagaagagttcttgtcttcctttctgccactggaaatcgaacgtctgtatcagcagcataagtatgatgccgtcattcgtttctgtaatgtgcttttccgggttgatccggttaatgagctggcactggcctatggtatgcatgcccttaaccatacaggttcgtcacaagaagcaattctgcaatattccctgtttgtgcgtgagtacaagcaaatgatgaatgaagaatattctacttcttatgcagagctgatgagcaaaaatcctccttttcatcgataaaaacatatcggttaatgatatttattcgcttattaatccgttattaacccatcactaataagttgtttaaccttgctacattatgtttgcagcgatgttatttacttattgttttatttaaaaacctaatacgtatgaaaacaagattctttatgaaactttgtttattcagtttgttggtttggtgtgtcagctcgtgcaagagcgataacggcgattcagtgcggcctattgcacttgaatgcatgtacacgcatctgaccgacatgacaaacatgcttgataccgcaaagatcggtacaagtgacggtactttcccattggcaaatgcccagaacctgcaaaaagctgtcgaagaactgcaaacaggtatttctaaaggtatggctggctactttgttctacagtatgaaatagataactactgtatagccgccgaaaaagcgattgccgaatttcaggattcctatcaacagacattgcaaccgggtacgcctgccgaattaaaggtattcggcattgacggtaaagggcgtattgaatttggttccgatcctgcttatggtggcggtaatactttcaccgtagaaagttgggtgaagtatgatgccggtttctttgagtcgggaattggcagtttcctctctacttttgacggtaagcagccgaatgagggatggatgatcaacttcttaggctctaatcttcgtacaacgatcggtatgggaccgcaggaaggccgcgtactggaagaaggccgtgcttatcctgataattttggtaaatggaatcatgtcgtgacggtgtgggataacaccttgcctgaaggacagctgaaaatgtatgtcaatggtgaattattcttcagtaagacaaatgatgtgaagaatgatgccggagtattacagaattatatgcctaacacccgtaaccagaatatgtgggcattccaggaaccgactgacaattcacgctgtatgaccggatttattaagaaattccgcatgtggagtactgcgaaatcggcgaatgaggtaaaaacgctgatgaactcggatgtgacgggaacagaaagcggactggtatgtgcgtgggacttcacgacagtggtcgaagacgttaccaacattccggataagacaggaaaacacgttgcgaaaattgtaggtaactacaaatggtttaaagttgagaactaaccttaataaacagacgaagagtatgaaaaataatacgataaaaataaaggctttcctctgcctgctgcttctgatgtgcggatgggtaagtgtgcaggcacagcaggtgcttacagtgaaaggtgtggtagtagacgctttaaaagaaccgttgcccggagccagcgttcaggtggtaggaatgtctaccggtacggtgactgacttggatggtaattttagtcttcaggttccgaaaggaaaaacgattgctgtttcttttataggatacgtgacacaggaactgactgtaaatcagaatcagtcgaaccttaccattcagttgaaagatgattccaagcagttgaatgaagtagtcgttatcggttatggtacggtagaaaagaaagatttgacaggttctatccaatccgttaccagcaaggaattaagtaaactggtgactaccgatgtcactgaaacactgaacggacgtgtcggtggtgtactcgtgaataagacttccaaccgtcccggttcggatacgaaaatagagattcggggtatcaactcgttcaatttctcgaatgaacctttatacgtgatcgacggagtaccttctcaaacgggaatgcgtcatttgaactctgccgatattgaatctatcgacattttgaaagatgcgtcttccagtgcaatctacggttcgcggggtgcaaacggggtggtgattatcactaccaaaggagctaacaagcgtcagggctttaatatcgactattcgggttacgttggtttcaagactcctacccgtattcctgaaatgattggtaacatgggcaatggactggaatatgtagactatcgcaccgctttgtggaaaaagaagtatggtgatgcttcactgagccgtccggacttcctgactgatgatgaaaaacgccgtatcaaacatggtgaatactatgactggttgcgtgaactgtcgcagaatgcattgactaccagtcattctgtttccgctaccgggggtacagacaaactctctttctcattcggcttgggatacttgaaagacgacggtatggtaggcgatgaaagctttgaacgtattacggctaatgttgggttggaatatcgcttctctgataagttcaaaacaggaatcaacagttatgtttctttgaataacacgaatgaaggagccaatgatgctttgattaatgcatacttcctgcctcctacggtcagcccgtatgataaggacggaagctacttgtttaattgtcagccgacttccagcaagatcaatccatttgttcagattgaaaataataaaagagagaaagaagcaaactataccaacttctccggttatctggaatatcagccgatcaaaggactgagctttaaatcgcagattgcggttcagtatgattcggacgtttacggagaatgggtaggtacgatgacacaagccaaaggaggtctcaatgcaccggaagcttaccggaaagaaggacggaatatgaattgggtatgggacaatatcattacttatgataaaacctggaagaatattcaccgtctgaatgctatcggtttgtatagcgtacagaaagaaactcataagggttcggaaatgcgtggcgatggtctgccttacaactcggactggcatgcgatcgaaacagccgaagaaattcgtgacgtgaagagttactattgggagtcatccatgctttctttcatgggacgtgtcaactatacgttgatggatcggtacttgtttactgtaacagggcgatatgacggaacttcccgtctggctaccggcaatcagtggggatttatgccgtcggcagctgtcggctggcagatgaagaatgagaatttcctgaaaaacgtagactggctgaatagtctgaaactccgcgtcagctggggtaaatcgggaaacaacagtattgaccatgatattacctggacaaagctggacctgactcattatatctatggaggtaaaggtgaaaatgctttcggattaggtgaccgcaaaggtaacaaagatcttcgttgggagatgacctcggagtggaactacggtattgatttcggctttctgaataaccgtatcaacggtacgattgatgtgtataaccgtactacgaaagatttgattttcgcccgttcggtaggtaacctcaacggttatggctctatccttgagaatataggaacgtcctccaataaaggggtggaaataggtctgaacacggtgaacgtctcaaagaaagattttacgtggaagacaaatctgactttctctctgaaccgtaataagattgtagacctctacggtgataaaaaggatgacttggctaaccgctggttcatcggtcagccgatgaaggtgatctatgatctggaaaaggtaggaatctggcagacggaagataaggaactggctgctaaatacggacaagtgccgggacatatccgtgtagctgatctggacgagaactatgtgattgatgaacgtgactataaagtactcggctctccgtcacccgactggacagcgggtatgaccaatacctttacttacaagaactgggatttgtctttctatatgtatgcacgtatcggtggcacctacaatgatgatttcacttatatgtttaccgcatgggataatgaacactggaacaaactgaatgtgaagtactggactccggaaaaccacagcaatgagtaccagcagatcggtgcgcaatcctaccatactcaggtattaggtaagatttccggttcgtttctgaaaatacagaatatcacgttgggatatactcttccggaaaactggatgaagaagatgaaaatgaaaaatgcacgtgcttacatcaatgtgcagaatccgtttactttcaccgactatctcggtccggatcccgaaacgattggtgaagacgtatacaagtctttgtcactttatccgatgacatttacttttggagtgaatttaaccttctaaatacttgaaaccttatgaaacgagtaaaagaacaaattaaatatttggcactgttagcaatctgtttgctaagcggatgctccgattttctggatagttataacccttcggcagtaacggacgatttctataatactaaagaaggacaacagaaattgttgacagatatcaatgcccgttaccgcaatgttttcaatacaggcgaattgcagtattacggaactgatatctacatggctatctccgaagaacctgccgaacgtatgttcaacggctatgacaagactttcaactccaccgctccgattgttggcgattattggaaagtactctataagattgtgcaggaaagtaacatcctgctgaatcgctgcacaccggatattgcaggaagcgattatacttcgctgaccgcacaagcccgctttttccgggcgatggcttactattatctggtagaaacattcggtcccgtacctttgctcaccgaagagaatacaagcgttatccagcaggcggaacgtaccggtgaacaggctatttacactttcatcattaccgaactgaatgatataaaggataaactggacatgaccacgatttcagccggaaaggtaacgaatgccgcagtcattcactttttagggaaaatgtatctgacacgtgcttacaaatcctttgctgaaacagacgacttctccaatgcagcaacgacatttgatttgctggtagagaatccggcctccggttatgctttgcaggaaaactatgctgctttgttcgatgaaaacaatcaggctaattcggaagtgatctgggcgattcaatatggactggataagaactatcggggggatggaaatccgcaacaggcacagttcggatttaatattgtagcattggagccggatctgttcattaagaatcagaatgattactctagtgtttcccgtaaatactgggtgaatccgaaagcgcacgagctttataccgacccggaagcggatacccgttatgatgcgacgttcaaacgtgaatattacataaacaatccggataatgctgattacggtaagctgggaatctatttcccccgttggaacgataaatcgggtatgagtaataacgcgaaaaggttttatccgttcaagcaggacgatgaatatgtgtggtatccgcaatctacggcacttcctgtattagaaactgcttcagatcgtatgccgatggtacgtaagttcagcgataccaagatacaatggggcgaaggcggttctcgtgaagatgtcattttccgcttgggtgatacctatctgttgtgtgctgaggcttatctgggtgccggaaacaagaaattggcattggaacgcatcaacagtatacgtaagcgtgccgctaaagatgcgaccgcttatgaagcaatgaagctgacagatctggatataaacgttatcatggatgaacgtgcccgtgagttgatgggagagcatgaccgctggtttgacttgaaacgtactcagacattgctgacacgtgtacctgcatacaatccgtttgtggtgaagtatgataatttgaacaagaaccatctggtacgccccattccgcaagatgaacggaacaaggtagatggattatcgcagaatgaaggttattgattaatggttaactaacaaatgaaagaaataattatgaaaatgactatatgtggtgctgcactgttgctcagcttgacaatggctagttgtgaagtgtacgaatcgccggaaatcaatcaaggattgaacgaagaaaacaacacgtccctttatacagatgcttatgatccgatcagtaatgtgggtcaatactatatgccggaaatgaaggtgaaaccgaagaaatactggaattgtgtggaagtcgtaacggtaggcagccgtaatgaactgggacaaacagaaaaagtacgcggattacagtaccacctgatgtgtcagtcattagccggtctggctaatcgtgccgtagaacagggaacaagtgaaatagctgtttggctgcacgatcacggtggcagtgattcctataaactgtctaagcaggcactcgaagatatgggtatccacgaacaggggatgcagagcggactggaactggcacgtaatgattatggtccgtccgacggagtgactattcagctgaaaggtatgtttgacggatatgtcttgacggatattgagcataatccggagagtggtgttgtagcttccgttgcttctcatgtttataattctattattgtggatgtccgtgacaaggaatattatgaagaagcaggatataccatgaaatatgatgcaagaagcaaaactactgcacaggcatgggcggagttcaaagacaaatgcagcaacaaagcattggtgatcatgcctgtacaaaccggtgaattgcgtgagtttgctattaagaatgaacttttcgtattgaacttgaataagcgtcagggcagttcggctggcggacagaatacggctttgctgaaagaaatccttgcctggctggaaccgaatgcacctgtctacggatgggaacagggagtaagtgaagatgcttttgtcgatttggtttccaaaagcggtcatccgatgatcccttgtgactggagttacaatcattccttgacttcattgctttattctcaacgtcagaaatcgacattggctcgcgtgaagaatccgcagtttctggattatacaaagaaaaagaatttcgtttctttcttcctttccgatggtgacaatattcagtggatgatgaatgactttaaagatttctataatgcggcggagtcggaagaagtacggatgacgtatggtattgctgcttcagtgcttccgatgatggcaccggcacaattcgataatctgctgagtcagcaaaagccgaattgctctattttggaaatgctgggaggcggttactattacgtagacaattatagcgagaatggcgaccgggcgaagaatttgaaagtcgtggcagaacgcctttcggcgcatatgcgtcaacatcgtgtgaaactgctgggtgtaatggctatgaacgtaaaatcagaggctgccaaagaagcatttcaggcttatgtagatgccaatgaccagttggaaggtatcgtagcgcttcagtatagtccttatgcaggaggtgaaggagacattatttgggtaacgaataaagcagggtatgatatcccggccattacggtgaaatactctttgtggaattttggaaaccggaatgcggaacgtgaaggtacccctgcctatattgccggaagattgaaacaggaagcacagcaggaaagtttttctgtcgtatgtgtgcatgcatggagtaatttctccgatcacggacagacggaagacccgctgattgagaaccagtccggggatattcgtggagccggagcggcaaagctttgtgcaggacatctgaacgatagttttgaagtcgtaaatatgcaggaactggtgtggcgtttgcgtatgagccagcgtccggaacagacgaagaagtatctgagtgaggtattttaattaacctgagtttcacaggctttctgcatggttttctctgttttaacgtggaaggagaagtgatacagaaggcttgtgaaacttaagcaaataataatagatatggttacaagattgtttttcttatcaatctgttttccttttctgctcacttcgtgtcagcagtcaaagaagacggtagagtttgtagactacgtgaatcctttgatgggtaccgagtctacttttgcgttttcgcatggtaatacttatcctgctgtggcggtaccttgggggatgaacttctggagtccgcagacgggggagaatggcagcggatggatgtatacgtatactgacagtctgatgcgcggtttccggcagacacatcagcctagtccctggataaatgactatggtacattttccattatgccgcttgccggagaactgaaaatgagtcacaaagaacgtctggttccgttctcacatcaacaggagaaagcgactccttataactacagtgttacattcaataacggattgcagacgtctctttctgctacttcccgcggagctgtattcgaggtctctttccccgaaaaggaagatcagtatgtagtggtagatgcatacaacggaggaagttcaataacgattgaaccggaaaaacggttggtaaaaggtgcgacacgttataataacggaggtgtgccggataacttcgctaattactttatgatggaattcagtcatcccgtcatagaatacggtacttacaatggagatactttgttgcaccatcaaaccgatgtagcggccgattatacctgtgcctatctgaaatttgatgttccggcaggtgaaaagctgaccatacgtacagcctcttcttttatcagtcccgaacaggctgccatcaactttaatcgtgaagtagctgatgcggatgtacaactgatcagcgggaaagcccgtgaacagtggaataactatctcggacgtgtagaagcggaaggaggaacagacgaacaacttcgtaccttctattcctgcctgtatcgtacattactttttccacgtgagttctatgagtttgattcacaaggaaatcctgtttattacagtccttatgacggtaacgtgcatgatggttatatgtatactgacaatggtttctgggatacgttccgtgcggttcatccgttattcacattgctatatccggaagtttcggaacgtgtgacgcaatctatcattaatgcttataatgaaagtggctttatgcccgaatgggcgagtcccggtcatcgtggttgtatgattggcaataactctgtttccttattagtcgatgcatggatgaaggggatacaaacggtagatgccgaaaaagctctggaagcgatgattcatcagacacaagcccgtcatgcggaaatagcttctgtagggcgtgacggcttcgagtattatgataagctcggttatgtaccttatccggaagttcccgaagctacagccaaaacactcgaatatgcttatgctgactggtgtattgcccgctttgcggaatcgctgggcaaacaggatatcgcagaccagtattaccagaaagccccaaattaccgcaatctctattatccggaacatggttttatgtggacaaaagatgccaaaggcaactggcgtgatcgttttgatgctacggaatggggcggtcctttcacagaaggaagttcctggcactggacttggagtgtgtttcatgatccggaaggcttatccgaattgatgggcggacatgaaccgatgatagcccgactcgactctatgtttgtggctccgaacacctataactatggaacctatggtttcgttatccacgaaatagctgagatggttgccttgaatatgggacaatacgcgcatggtaaccaaccggtgcagcatgccatttacttgtatgattatatcggtcagccctggaaaacacagtaccatctccgtaatgttatggacaaactttacaattccggaagtaaaggatactgtggcgacgaggacaacgggcagacatctgcctggtatgtattttctgctatgggtttctatccggtttgtccgggaatgcctgaatatgcgataggttctccattatttaaaaaggtaactctgcatcttcccgaagggaaaaacttcgtcgtttcagcagcagataatgcggcagaccgtccatacataaggaaagctctgttgaatggacaagaattcacacgcaactatctgacgcatgatgaactgaaacagggcggagaactgaatctgtcgatggacagcgtaccgaatcagcaaagaggtacccaaccggcagacttcccatattcttattccaagtagtttcaataggttttagtatacttttcattgaccgatacggagagaatcttaattgatttgatctgtatcggtcatacaataggaatttaaagtcaggctttgtctttgctgtttcttttgttacctttgtgcatctaatatgaggtttatgatacattctcttccatcttccgaacccttgacggcacaaaagcttttctcaaagctttatgtttcctactatgcccgtttggttcgtttcgcttccctttatgtaggagctatgggagacgcagagaatatagtacaagattttttcctctatttatgggaacgtaaagagatacttccggaactgcaacagcccgatgcatatcttttctccgctgtcaagcatcgctgtctgaacttccttcgttcacaactttctatagtagaccgcaggcagccgctttctgatattatggagcaggagtttaaactgaaactttatagtctgcaactacttgatgactctcaaatgtcgatagatgaagtagaaaaacagatctgccgtgcaattgatagcttaccggaacgttgccgggaaatatttgtcatgagtaagctgaagggtatgaaatatcgtgaaatagccgaatcccttggcatttcgcagaatacggtagaaggtcaaatggctatcgctttgaggaaacttcgggaagaattgcgtcattgtatgcctttgctgcttctattgagcgtataaggataaatcgcctatgtattgtctttgcttcagtccattccatatactttagtcaagctgagtactaatttgcagcttataatgaatgaatttagttccggttgcttataaatctattcgtctgacagttgttgaactttcgtctgacaattgttatcttttcgtctaacaactgtcagacgaaagttcaacaactgtcagacgattaaatttaagtataatgaatactaaatctgtgtacatcaagaattaaatcttagagtaaatccgaacagattagttcgtttcaaaacagttcttagcttaaacttattggattttacttcccttccttgattttttttcattttcctttggtggtaaatgtaagttgctgtgtcttcttattaaaagcgcgcaatatgatgaatgagaaatggaatcaatactttttcggagaaccgaccgaagaggaaaaacgggagctttttcaggaactggaaaagaacgaagatatgaaacgggaatttgcagaaatgcaaaatatcgtaggtctgtccggattattacccagagaagatgattctttgaaaggcgaacggaatctggaagcaatgatgaaccgtcaggagaaaaagctgaggcggaaacgggtgttgcaaatcgtgcggtatactacttcggcagccgctatgattgctctgacgtggatgctcgcctggtatatgtttgttggctcggagactccttcttatacggagattacagttccgaaagggcaacgggtacatttaacccttccggatggtagtgaggcatggttgagttcgctttctacgttgaagtggccttctgttttttcgtccgatgcccgtacggtagaactggatggagaggggtttttcactgtgacaaaggatgcttcccgtccttttacagtgcagacgcagaagtatgatgtaagagtgcttggtacggaatttaatgtgtatgcttatagtaacagtgagaagtttgagacagacttgctctcgggtaaagtgagggttagctctaccggatttccagaagaatcggtgaatttattgcctgacgagaaagtatctttggtagatggaaaactggtaaagtcttcttctcattttggaggaaaggaatatcgtgaacaaggaatttatgactttgaagaattaccgttgggcgaagtgctggaaagattggagcaatggtatgatattcattttactgtagatgatccatctctgttgagtaagattatttcgggtaagttccggcaaagcgatcagattgaaacgattctgaaagcaattagccgtgcggacttatttgagtacaaaatactgtcacagcgagagataacgatatattaataatctgattaaaatttaatgcctatgtaacacaacggagtagaataaaacgaaagtaaatagacatcaaaatgaggaataaaaagggggaaagtggtgcaacactctccccaattcctcagctattaatactttctctgtttcacgtttttgtgaacctaaaataaagtactaacaaaaccacttagcaaagttatgaaaaaaatcttttcactgctcgctttggtcctgtttattaacctttttacataccaggcccaggcacagacagcagttgtgaatattaataaaacttcggtttcgctaaaagaactgattcaagaagtcgaaaaacaggccggatatttgtttgtctacggaaaagacatcaatatcgaacagaaagtaaaaatcaatgcccggaataaacaggtaaaagcattgcttgaaaatgtattgccgcaaatagggctgacgtatgaatacgccgacaactacatctcattgaagaaaacgcaggtagagaaaaaatcaataggtaaaaaaataatagtcaaaggaaccgtagtagacaaaagtggcgagcctattatcggagctaacatcatggagcagggaagtgcttctaatggtacgatcacagatatcgatggtaaattcacgttatccttgccttccaattcggtattagcggttacgtatgtgggtttttccacaaagaatattccggtgaacaatcagaatgccattcagattgtgatggaagaagattctgaaattctggaagaagtagtggttgtggcttacggtacgcagaagaagatttcttctacagctgctgtatcaagcatgaagactaaagatgtagcgcaaaagccggttatcaatatttctaatagtttggcaggtcgtatggcgggagtcattgcaaaacaaggatcgggagaaccgggagctgatggttctgatttgagaatccgtggtgtggctacattagggaaccaatctccattggtcgtagtggatggagttccccgtgacttttcacgtatcgatccgaatatgatcgaggatattactatcctgaaagatgcagctgccgtagctccttatggtatggccggtgccaatggggtagtattggtaacaacaaaaaagggaaaaagcggtgctccggtactttcatacaatggatatatcggttttcagaacccgacccgcatcactgaccaggttaattcgtatgaatatgctttgatgaaaaacgaagcggctatgaatgcaggttatcccaattattatgcctactcacagcatgatctggaaatgtaccggaaaacctgtgccggagaccccgatgccgatcctgaccgttatcctaatagcaacggtctgcgtgacttggtacaaaacaattctgtgattacgaatcacaacttgcaattatccggtggtagcgataaattccagtactacgtatctttaggatattcttatcaggaaggaatgtggagtactaccgattaccagcgttttaatctgctggctaatttaagcgtggatgccaccaaatatacgaaaatcagtttaagtctgggtggatggcacgaaaagaagaattatccgggtgccgatacaggcgacatcatgtatcaggcatatcgtacacctcctatctctgctatacagtactcgaatggtctgtggggacaatatgtaggtaagtcacttttcgggctgacctatcgtagcggatatcgtcaggagccggccgaccaactgaatacttctctctccatagagcaacagcttcccttcattcaagggttaagcatcaaaggagtaatcaactacgatccgtatcgtgtgaagaaaaagaaatatctgacaccgatacctgtatacacactggatgcatcacaaactccgtatcaattcgtggaaggattccagggaccggagaaaccgaatctggaacaatcgtttgaagaaagcgtgagcatgacttatcagggaatgattaattactcacggactttcggcaagcatacggttactggactcggagttattgaagcacgcgaaagaaacgtatggaatatgagtgccaaacgtctgaattataatattaacatagatgaaatcaatgcgggaagcagtgaccctgccgatatcagcaacggtggtacgtcttggaaagaacgtcaggtaggttatgcattccgtttgggatataattatgataaccgttatatggcggaagtttccggtcgttatgacggacactactattttgctccaggcaaacgttttggtttcttccctgctttctcactgggatggaacttgcgggaagaatcctttatgaaagatgtcgaatggatggataaactgaaattgcgtctttcttatggtgagtccggaaatttggctggtagttcctatcaatatatgagtgattacggattcggaaacgctgtaaactttggcggtgtacctatgatgggtatgtgggagaacttgcaggggaacccgaacattacttgggagaaagctaagaagtttgacttcggtgtggagttttccgtattgaacggtatgttttctctggaagctgactatttctatgagaagcgttcgaatatgctgatggctccgaatgcattggttccggcagaatatggtattcctttgtcacaggtcaatgcgggaagtatgcacaatcaaggtattgatttatctctgaatttcaacaaacgtatcggcaaagactggatgatcagtgcaaaaggtactttcactttcgcacgtaatattctggatgaagtatttgagacggaagccacctttaataatccgaatcgtcgcagaacaggacgtcccgacggaacaatgttcggatacaatgctttggggtactttacttatgacgacttcaatcctgacggttccttaaaggccggcatcgctactcaaccttggggacaggtatatccgggtgatttgcgctacgaagatttaagcggtcctaacggcgtgcctgatggaaagattgacgaacacgaccagacagtgatcggcttctctaactgggcgcccgaaattattttcggtctggctcctactgtccaatggaagaacttcgacctgaacgcattgattcaaggggctacccgtaccagtatctcattgggtgagactttggtaatgcctttctttgattccggttcggctactaagttacaattcagtgatcactggacgccggataacacgaacgcaccttatccccgtctgaccagtgaagtaacggtgaataaccatcgtcaaccttcttcgtggtgggtacgtgatgctacttatatccgtttgaagagtattgaaatcggttataccttgcctcgttcggcactgaactttattggtatcagctctgcccgtgtatatgcttccggacaaaacctctggacatggactccgtttatgaaagagctgatcgacccggaagccaaatccgctaatggtaaatactatatgcagcaggctgtatatgcttttggtttgaatattactttttaattagttaaccatcataacaagatagaatatgagaatacataatataataaaaacagtttgcctggcaggctcattagccttgctgtctgcctgtgaagactggcttgaaatagagccgaaagaccgttttggagatacaacggtctggggatcggaagaaaatgccgatatgtttctgaatgatatctataatcagttgccgcatctgaacaatgaaacacagaatctggaccaatattcggataattcatacgtaggtgcggaatggatgaatgcccgtacaacgatttataccggagcattatctcctaccagctggatacccggcccctgggatatgtggaaatggggacgtcagaataatgacgacgccaaaggacagtatgagcgtatccgttcctgcaatcttttcattacgaaagtaacagaatccgatttctcggcagaatataagaaagaacgccttgcagaagtgcgtttcctgcgtgcctggttctatcactatctttggatggcgtacggtggtgtgcctatcatcacggaagtgctggataataacgtgagtacggatatcttttatccgcgtgagactgcacagaaaacatttgagtttatcgacaaagagttggacgagattaaagatgatcttcctccgcgccgtagcggttccgatctggggcgtgcttccaaaggagcaattctgacactgaaaggatgggtggaactgtttcatgccagtgaattgcgtaatccgggcaaagacaagaaacgctgggaagcagctgcggctaccttgaaagatgtaattgacttacaggtctatcatctgcaaccgactattttggacctttggacagaagctaccaacaataacgatgaagtgatcttcgacttccagatgtctaagcagaatggagggcgtcgtgaaggtctgttcggtccggtgtttgtaaaaggagtacagtccagttggggaaatatgcagcctacacaggaactggttgacgactattgcatggccaacggattgcctatcactgatcctgcatccggttacaataagaataatccttataaaaatcgtgagaaacgcttctaccagagcatcctgtatgatggatctatgtggcagggggaagagattattactcgtgtaggagtaggtagtcccaatgagattgatacttcttcggatagtgacgttacgaatacgggatactacactcgtaaaacgattgatgaatccgtgaatggagcggacaatctgcaaatgagcaacggaatggcaaattatattttcttccgttatgcagatgtgttgctgatgtatgcagaagcttctttggaagcgggagataaaccgactgccatcgaatatctggatatggtgagaacacgtggagataatatgccttctatcggcgatacttatccgcagggaatcacagaaaatcagttgcgggaaatcattcggagagatcgccgtatagaattggcatttgaagataagcgttggtgggacattcttcgctggaagatttgtgatggtgaaaacggagtgatgaataaaccgattggtggtatgaagatagaagataccaatggagatggtgtgtgggaatacaattatcatgaagttggtaaacgtaccttcctgccacgtatgtattatcagcccattccgcagtatgtgatagacaagaatccggtgatccgcgagcaaaatggtggtgaagacggatgggtaaacgggcagaatcccggatattaataaagaatgtaaaccttgaaagattattcgtatgaaactaaatagatttgtcatggcggcaagtgcggtactttgttcgtttgccttgctgagtggatgtagtgatgatgatgtttgtaaagtatatattccggaagccaaaactttgcagattaaaaacttcgatttgggtgaagaactgagagaagtatttcatgtggctgtgactgccagtgactatgtgacccgttccggtaaggaagtgggaggagatgtaaaggtacagttgactgtggatgaggcgaaggtgcaggagtataattctttgtgtgggacagactatcctttgcttccttccgattgctatacgctgacaacagaaactgtgattccggccggggagagttcttctgccgatctggtgcttacggtaaatgcacagggaaaaatccagccgtttgattcttatttgttgccggtcactatcacttcggtagaaggtgcgcaggcggatcatattcagcagacagtatattaccttttgagtggtgcggaggatgtatgggcgatgccattggccgaccgcagtgcatggcaggtagtagaagtttcttcggaagagacgagcggcgaagggtcggataacggtcacgctatccacgcttttgacggactgaaaggaactttctggcatacacaatggaaaggcaacgagcctcagccaccacatcatatcgtagtagatatggggcaggaagtgaaaatgctgggctttcagtatgtatccagagatcatggtgaagcatggccgcaggagatgacgatggaaaccagtctggatggctcgaagtgggagtcggcaggaacttacagcgaccttcctgcgggggcaaaagaggaattccgttcctattttccgggatttaagcaggcacgttatttccgtctgacaataactgccgtgtatagtggcaaatgggcaacagtggtagcagagattaatgcgatttctattattaaataacagaaaaaacgattaccatgaaaaaatacatttatatacttttgacgttctgtctgttaatctcctgtatggaagatccgacggcaggtgtggtcgttcctaaatatactccgtctaccgagaatccgggaggtccgggtgaagaaccgggtgatgggctgatagatccggcagaaccgctggacaggggatttatgcatctgaaaggtcgtgaactgaaatccctgaattctatttccatcacaggactgaatgatggcgagaaagtaattctttccactttggcagggcttgcggcaagagtgacgggcgatcaggtttatatcaatgaaggaggtccttcttccgtatggttgaagcagatgcagaataagtacggaattccggtaaatacttataatgctttggctccgttggtacagcattatgtagaaaccggagtgatcaaggggtatattgtctatacgccttattcggaaggacaatctcattcgatcaatgtagctacttctttatgtgggttgcttcgggggattgcggtaccggaatctcttgtcgataaggtaaaggcaatgggagtgacaaccgaacttatggacgtaaggtcttatgatgagaagtggttgtacgagaattataaagaccagttggacaagagtcttgcagccgatatgaaaccggaaatcttccatcacctgcgcgattatatcacaatgaccaatgcttttgctttttatgactacaatgcgcgcagggattggtcatggcgtacttctatactgaaagatctggataaaggagcttattgtttcggttattatgatctggatgaatggggcatggtgaataatgcttctcaattgggtgtttctatgttgccgaccgatcaggcggctaatctggccacgttgagtagtatatatgatacaacaggactgaaacagcgtccggcaactaaagaagtggttaccgaagagaatgtgcactatgtgacattcctcgtcagtgacggtgataatattgcgtttaacctttgggggcaacaaggatacatggatcatgacctgcacggtcaattcccactcggatataccatttcaccttctctgtacgatttggctccggctgctttacgctggtactatgagaatagcaaagaaggcgattactttgtagcgggtccgagtggcagcagctatatattcccgagtaagatgtcggatgccgacctggacgattatctggctaagttgaatgagtatgtcgataagtcaggcttgaatatctgtaatattctggatcagaagattatggataatccgaaagtttacaataagtatctggctcagcctaatatcgatgcgattttctacacaggatatggagaaaaaggggatggaagaatcaaattttcggataatggcaagccggtgattgagcagagaagcgtattatgggaaggcatcgacggtggctcgaacagaggtgaagaatcgactgtcatttctcagatcaatagccgctctgccaatccgcatagtgccgacggatatacttttgtatttgtacattgctggacaaagaaccagcaaagtatcaaaaccgtcattgatggattgaatgacaatgtgcgtgttgttccggtcgatcaattcgtgcagctggtgaaacaaaatctgggtcctaaataaacgaatatactcgtaagttatttattatgaacataaaagtattagttgcatcggcagttgctgcattcagttctctgccggtcatagctcaacaagcaccagctccttgcgggttggttccgagtgcccgtcaacttgaatggtacaatcgggagatgattgctttctttcattttggaatcaatacatttgaagaatatgtgaatgaaggtgacgggaaggcaagtacggcaattttcaatcccacagccctggattgcaggcagtggatgcagacattaaaagcagcggggattcccgctgctattctgactgccaagcatgccgacggattttgcttgtggcctagcaagtacacagattatagtgtgaagaatgcagcgtggaagaacggtaaaggagatgtagtccgcgagtttgtcgatgcttgtgaagagtatggattgaaggcaggaatctatctgggacctcatgaccgtcacgaacacctttcacctttatatacgaccgaacgctacaaggaatattatgcccaccagcttggcgaactgatgagtgattacggtaagatatgggaaacatggtgggacggcgcgggagccgacgaattgacaacgcctgtttatcgtcattggtataagattgtccgtgaaaaacagccggattgcgttatcttcggtacaaagaattcttatccgtttgctgatgtccgctggatggggaatgaagcgggagaagcgggtgatccttgttgggcgacgactgactcagtagctattcgtgatgaagctcagtattacaaaggtttgaatgagggtatgctggatggtgatgcgtatattccggcagaaacagatgtttcaatacgtcccagctggttctatcatgccgaagaggatagccgtgtgaagagtgtccgtgaactttgggatatctactgtacctccgtggggcgtaatagtgtattgcttctgaatttcccgcccgacagacgtggtttgattcattcgaccgattcgctgcacgccgccttgttaaaacaggggattgatgagactttcagtacgaatctgttgagaggagccaaagtgaaagcgaccaatgtacggggtgcaaagtatagtccggaaaaaatgctggacaatgagaaaaacacttattttgccggaaaagacggagaggtaaaagcggatataatttttaccttgcccaaaactattgagtttgattgtctgatgatcgaagaagttatcgaattgggacatcggacgacgaagtggagtgtggagtacactgttgatggcaaaaactggatcaccattccggaggcgacggacaagcaggccattggtcataaatggattgtacgtctggcaccggtgaaagcaaagcaggtacgtttgcgtattcaggacggtaaggcttgtccggctatccatacttttggcgtatataaacagtcaccggttttcaaattataatataaattagactactaaatgatgcaacgattaaaaatcttgggaagtgcattgattgcactgtcgttttccgcctctgcggttgtggcgcagcagtttgatccgaagcaaggatatgaaatccatacggtcaacggattagtgctagacaatcaggagagtctggatacgaatacgaaaatatttatcagtaagcgggaggcagacaaagaatcgcaggtctggaacctgattccatgcgaacaagagggatgctatacgataaccagtcccttgactcaaatgaatgtagataatagtggtaaaggaaaagtagaatgttccgtgattcaatggtcggcagaccctaaaaatccgaaccagcaatggaaaataacggctttgccgaatgggaattacgtattaaccaatgtcgggactggctataacttaggatttcctgatgccggactggtcggagagcctgtctttcagttagaaccggaagcttcgaaaagtaaccagcagtggcagatacggaaatcgaacctgaaagtagtggcggaagccttgaaaacaacgagtcataatgactgggaaaatgaacgtatctatgcaatcaataaagaagaaggcagggctacatttattcctttcgccaattcggaagagatgaaggcggatcccgcttatacccgtccttgggagcgtacccgctcttcccgttatctgctgttgaatggaaactggaagtttaactgggtgaaacaaccttcggaacgtccggtggatttctataaaacgagttatgatgtctctggctggaaagagattcctgttccctccaactgggagatgcacggatatggtacacctatttataccaatattacttatcccatccgtaacaatcctccttttatacaggggcagcgtggatatgctgtagagaaagagccgaatgcggtaggatcttatcgccgtgaatttgctcttcctgccgactggaaagacaaagaagtctttatccatttcgatggaatttatagtgcagcttatgtatggatcaacggtaagaaagtcggttattcgcaagggtccagtaatgatgcagaatttcgtatcactccttacgtcaaagcgggtaataatacggttgccgtagaagtttaccgctggtgtgacggcagtttccttgaagatcaggatatgttccgtttaagtggtattcatcgggatgtttatttggtagccagtccgaaagttcgtctacgtgacattcacctgacttctcagatcagcgaccgtctggataaagcggaactgaaagtgaaaacggatgtgcataattacggaaagaaagtacaggaagctaccgtacgtgtctctttgctgaatacggaaggaaagcctgtgagttcgtttatcatacctaccggtaagataactggtggacaggaaaacgtctgtgaaggtacgactacgattcgcgaccctcggttatggagtgctgagactccttctctgtataccgtccaactggaactgcttgatgccgcaggcaatgtgcttgaagcgacgagccagcaatatggtttccgtaagatagagatccggaataataaggtgtatatcaacaatgcattgatcctttttaaaggagccaaccggcatgacatacatccgcagtttggaaaagctgttccggtggaaagcatgatagaggacattcttctctttaagcgtttcaatctcaacacgattcgtaccagtcattatccgaacgatccgaagatgtattcgctgtatgattattatggcttgtacgtcatggatgaggccgatattgagtgtcacggcaatatgtcgctgtcaaaccgtgaaagttgggaaggagcttacgtcgaccggatggtgcgtatggtggaacgggataagaatcatccttcggtcattttctggtcaatgggcaatgagtccggtggtggtcgtaactttgaggctacctatcaggcagccaaagcgatagacgaccgttatatccattatgaaggaatgaacgatgtggccgatatggattcccgtatgtatccttcgattgaaagtatgatcgaacaggacgagcaaccccgtaacaagccttatttcctttgtgaatatgctcatgcgatgggcaacgccatcggtaatctggaagaatactgggattatatcgagcatcattcgaaacgtatgatcggaggatgcatctgggattgggtggatcagggcattaatatgcccggacagcctgccgatcattattattttggaggcagcttcggtgatcgccctaacgacaatgatttctgttgtaacgggattgtgacggctgatcgtcaagttactcctaagttgtgggaagtgaagaaagtctaccaatatatcacattggaaccgaatgctgaaaacagtatcggcgttcgtaaccgctatgttttcctgaatctgcatgattttaatctgcgctatgtgattttgaaagatggtgtgccgatagcggaagaagagttcagcctacccgatggtaagcctggagagcatcgtgcggtgcagataccttattcccgctatttaacttcagaaggtgaatattatttgaaccttgaaataaaactaaagaaggattgcgtatgggcaaaagccggacatatcgtagctacggaacaacttttgcttcaaaaatccccgaataccgggctatagccggtagcagtttccgcctcatctaaagaatctctgtttaaggtggtggaagaggagaagcgttatttgttcttccgccgtcccggtgtagaaatcacctttgataagaaagaaggcaagttgaccggtatccgttataatggcgataatatgcttcatctgcgtgaaggatggtcgctgaatacgttccgttttatcaataacgatgtgcgtaaatggcaggatacccaaacggaggtaatcagtttcgactggaaatggtcggaagataatcagtcggcaattgtaacgattcagttgcaggaaaccgtcggagatgtgaaagtgccttatacattgatttaccgtttgtatggtaatggtgaaatagatgtggatgcttcttttacaacgaatgatgactttaatcttccccgtctgtcgttacaggccttctttaatccttcgttggagcagttggaatggtatggtcgcggtccgatagaaaattatcgggatcggaagaatgcggcttatgtcggcaaataccagtctgctgtcaatgatatgaaagagagttatgcccgttctcagacgatgggtgggcgttgtgatacccgctggctgactttgaccaataaagcaggtaaaggaatcaagattactgctgccgatacatttgatttcagtgctttgcactatacggataaggacttgtttgaaatcaagtacggtcatgccttgcctgatatttatcgtgcggaggtggtgctgaatctggattgcatacagcgtggtctgggtaatgccagttgcggaccgggtccccgtcccgcttatgaaattcagaagaatacagtttataaatatgctttccgcatgtctcctttttcaaaataaggaaagattgacaggataacaaggtcttaatagtttgtagaaagagtgagcagccaaatcttataaaagatggcaactgcttactctttttttgtatttaaggatagattctgtgttcttttcgtacttttgtaacatggactctaaattatataccacgatgaaacaaagaattatattattcggattaatacttgtaggaacagtaacttttgcacagtctcccgaagaaaagggcttgaacacgatcaaccgttcttctgccgaagcaacaatcggtttccttgcaagtgatgaattacagggacgtgaagccggattccacggttcgtatgtctcctctgagtatatagcatctatcttacaatggatgggaatccaacctctgaacgaaagctacttccagccttttgatgcttaccgcaaagagcgtcagaagaaaggacgtctggaagttcatccggactctgtagcgaagctgaaacaggaagttcatcaaaaactatctatgaggaacgtactggctatgattcccggtaagaatacgaaggaatatgtcatcgtaggcgctcactttgaccatttggggatagacccggcacttgacggagatcagatttataacggcgcggatgacaatgcttccggtgtctcggctgtattgcagattgcccgggcatttcttgcaagcggacaacaaccggagcgaaatgtaatctttgccttttgggacggagaagaaaagggattgctcggttctaaatattttgtacagacttgcccttttgtttcgcagatcaagggatatctcaactttgatatgataggtcgcaacaataaaccggaacaaccgaaacatgtcgtctatttctatacagctgctcatccctcttttggagactggctgaaaaaggatattaagaagtatggtttacagttggaaccggactatcgtgcctgggacaatccggtagggggcagtgacaatggaacgtttgccaaagcaggtattcctattatctggtatcatacggacggacatcccgattatcaccagccatccgatcatgctgaccggttaaactgggataagatagtggaaatcaccaaggcttcttttcttaatatgtggaagatggccaatgaagcttcatggtaactcagcctcactgaaaggctgttttacatcttgcaataaagggcggaaggaatcagtttgaataaccatgccacatatttccatcttttggagataaaggcgacttttttcctgtctgatatagcctttttgatttgttttacggctttatcgacaggagtaacccaaaacaatccttctcctttcgccatcgctgtatctataaatcccggacggatgtcagtggtgtagacagcaaagggtagctttgccgccttttgccgaagtccctccatgtaattgatttgataggcttttgaagcattataagctggtgctacaccgctgccgcgtgttccgcctactgaggaaatgttaatcagatgcccgcctttctgctgttcaaagtaccggaacccccagccggcgatattggtaaatcccactacgttggtcaataaggtcggttcttcgagctgataggagagctgcggattcagttcccccgttccggcacagataatcagcatatccatgcctcccatttcttgtacaagcgtttccagtgataaaaggggcgtttctgtgtgagtgatgtcacatacctgatagaatagtttatctttatcttgtgcgcaaatctcttttaatagattctcacggcgaccggtgataccgataaggcagtcttcacgggcatactgttctgccaatccacgaccgatgccggaggttgcgcctacaattattattttcttcatgaattaaaatagactatgtttgcctgcaaaggtaggggaggagtctgaataaaatcttgattgaaatcaagaatttacttccgaactacttttctccggatgcggctcaatgtttccggacgaatcaggagataggaggcaagttcttttaaagtaatcagtttcagcaggtcaggacagcggttgataatatccagataacgttcttccggtgtcagactgtacatggagatcatccgatcatatatttcccacagaagagtttccgcaatccggcgtcccagtttttggtggtcgttgttaatgtcgtagaaatctgccagttgggaatggttgatcacatacaccgtacagtcgcataacgcttgaatatctacatttgattggtcctgcaactggaaagccggataattcccgacaaaagaatggtcgaatgtatatccgacaatgctgctttcgcccagactgttgacgcaacaatagcggaaagagccggaaacaacaaatcccatgatcttacaggcttctccttgccgtacaaagtactctccttttttataagaagtctcttttccctgctgtaatgtaaaatctacaataggggaatagttgatatgggaagtatatttattgaaatcttccacagtacgacaatgattaaccttcgtttatcacttggaatccggcaagtttcaaatcctcccaataaccgggatacgatttggaaacaacttgcgggtcagcaatcagcagcttagggaaggtgattactgccggtgcgaatgccatcgccatccggtggtcttcgtaggtcgcaatcacaggaaccgcttccggttcgcaacgttcgccgttccacatcaatacgctgtcattttcttcttcgatgaggtatcccagctttttaagttcggttctcaatgcggcgatgcggtctgtttcctttattttcagactctgcaagcctgtgaaacggaaagggatatttaataaagcgcaagttacaacgaacgtttgtgccaggtccggaatgtcaacgaagtcttcttccagtcgttccggtgtcttgcctgtttttttgatctttacgcctttgggagtgaactccgtcgtgatccccagacgggagaaaacttccgctccccgactgtctccctgataactgttgcggaataatcccaacagttcaatctctgcttccggagacaaagcggcaatctgataccagtaagaagcagcgctccagtcgctttctacggtgaaggggacactctgatacggttgcggagctacggagatgctgctgggtgaagtccatgccgcttttgctccgaagtcctgcattaattgcagtgtcagattgatataaggacgggaaatgatttctcctgtcaagtgcagtgtcagtccgtctttgagcacaggacctatcatcagcagggcggatatatactgtgaactgacgtttcccttcagcgtgatttcatttcctttcagctctgcgcccttgatgcgaagaggcggatatccttcgttatgggtgtactctatttcagctcccaactcgcgaagggcgttgaccagaatctgtatcgggcgttgctgcatacgggcggtgcctgtgataatccgttctcccgaagtggcactcagataagcggtcaggaaacgcatggcggttccggctgccatgatgtctatagtctctttaccttcggtcagggcttttatcatgacttgggtatcatcgcaatcggacaggttttccggcggataaatgcctttacccagcgcattgatgatgagtgcacggttgctgatacttttggaagctggcaactggattgttgcctttaccatggaaggggaaataagtttatagagcatcattctaagtatattctttgttatggagtacaaaagtagagatttattcggagacttccaacagcttctgactcttatcgagagagttgaaataatatctgtaccgatgtttctgctgatacctcatgagccatggaatggcaagaaggatgcccgtaaagagcatcagaatgaatgtaagcccttttaatccttcgtaatcattgaaatattgaatcacgaacctgacggctgttccgtaaaagaatatcagatatatgatgaaatcaatattgattcttcgttccagctgttttttgagcattgctccggattctttcagtgaatatgtgtctgctgaccttgtgaggagctgataatgtccaatggccgaaaccagcagaaacagcagaaaggcacttccggcccatagggagatcgaggcgcttcccatgatgatcgtatcccagatactggcagctacggagaatgccagcaggatggcaaataaagagatcaacgttttctgacgacgtaaggtttgggaaatggtacgacaatgcttcttgcgtatcacttcttttatattcattggctttatttctgtgccggtatgtatttctttccagcattctttcaaattattgtcttccattgtttaattgtttaatgagttgtttcttgattctattaatttttactccgacattactctcggaaatgccgataacggcggcaatctctttgtattcatagctttcaagataaagaatgataatcgctttttctatttcggacaaccggttgatggcttgatatagctgctcttttttatccgttgcggtgttctcttctggatggctgtcatgtatggcatattcctgtgtcgataactctttgtaaacgggctgcacagattctttccgcacaagatcgatggcagtgttcagcgtgactctgtagagccatgtcgaaacggtgctctcctgcttgaatttggggtatgctttccacagccggattaatatctcttgataataatcctcacggaacggatgctggtagaaatagatattgcatattttctgcaatatcccttgatactgattgattagttcgataaattcttcttccacttcatttaaattttaatgtattttggagagttagtcgtatgacgggggattattcttacaaaagaagaaatagaaaatgatatttaattcctgtccggcggataaaaaaagttctttctgcttatcaattaatcatttataatgatttgttagcgaaaagattttatatttgtggcaaataaaataactaatttatgaatataccgaatatccgtttactgaatcagcagttattaaatccacttttccgtgaacctaaagagttggtgtcttggatgggagccatgcaggcacagaactattccatggtgaagtgggcagtagggatgcgtctgaaatcggctacaattcaaacagtagagaaggcgttgcgtgagggagaaattctgaggactcatgtgatgcgtcctacgtggcatctggtggcggcagaggatatccgctggatgctgaaactttccgcgcaacgtattatttcggcaaatgattcttttgcgaaaggatatgatctggacatcccgaatgaactctatacgaaagcgcatgacctgttggagaagattctttgtggaaagaaaagtctgacaaaacaagagattgccgaacactttaaccgttcggggattgtggcggacaatcgccgtatgactcgctttatggcacgtgcggagcaggaaggcatcatttgtagtggcgaggacagaggaagcaaatgcacgtacgcacttttggaagaacgggttccgccgatgcccgaactgacgaaagacgagtctttggcgcgcttggcacggagttatttccgtagccattctccggcagttttgcaggatttcatttggtggtcagggctgtcggtttcggatgcaaaacaggctgtttatctgattgcttcggaactgataaccgaacaatggaaggaacagacatggtatattcatgacatctgccggactcgtggcaaactgtcggggcatatacatcttttgccttcttatgatgaatatctgctgggatataaagaccggacggatgttctgccccttgaacattattccaaagcgtttactaataacggattgttctttccgattgtccttcataacgggcaggtcataggaaactgggataaatcggtgaagaagaaaagtgtggacctgaagtattcatggttcaggcaggtggccgatatgaatgaagaaacgttggaacgggagcggcagaaatttacccgttttttggaaaaatagctctatgggacatcggtaaagtgggagtgtttagtggaaagttccgttaggatacggaactgggttctgttactatccattagccgacgatagttactcattaatcacataaatagcgatttttttttcgttgcacctaggtgagacgaaagagtcacctaggtgcttcagttgtttaaccaaggtgagacaattgttgtacctaggtgcaacggaagaaaatagccaagaatgacgatcattttggctgatggaatacttgtttagccatacatctccctaaagggtaattgttctgagtgaatcgctattgattggctcaacaagactgtccgtgaagtgtgattgtgtaccatcattttgctccgccatctaagggagcttgttggaagaactgtctttctttatttgtcggcttgttttttagcccattccagtctccgctgatctgccaaaggagttaccttaaattcttcgaatgtggccgtgaatccctttccgtccgggcaggctcccattaatccgaccataaccggacaattatcctgcaaccagcaagtacgtatcatcgtatattccttatcatcgcgggagaagaaaatctccactgcatccagtcggcggaccgctttaatccataaagaacgaggagcatccggcagttgcactacactccagtcgctggtgcggtgggtgactacggcacttacattctgtttgccgtctacgtactctacccctgcctttatccagttctcatgatcgatgcgcaacatcaatcccatttggtcgaaagtagtcacatagtttccggtaatctttactttcacttcgaactctccgccataagtagcatagtagaaaggtccgtcgtctaccgtaaatccgtagtgggaaatccgccagaaatcggttttcgccggaacgtccatcactaaagccttgccttcttttatttcccattgctgaggctcattcagccagttcattttgtccaaactttgtgccatagaagaagttgctgccgccaataacgcgattgacatgattttgatttttaaatgtttcatgttcttttcttatttatttatctttgtggtgcaaagataggtcatgcctgtccttgcgacaatactgaataataaccattttatacgatggacgtactacaaaaggaaatagatgaagtctatgctacgcatccgacagcgcacgaagcactggataatggaatagtggaacaacaccagcagtttgtccgctcattgacggaagttaatggagggtgtgctgtcatttccgatctttcgaaccggaaaagttacgttactgtccatccgtgggcgaatttcctgggacttactcccgaagaggcggctttaagcgtaattgattcgatggacgaagattgtatctaccggcgcattcatccggaagatttggtagaaaagcgtttgatggaatacaagtttttccagaagactttttccatgtctcccggcgaacggctgaaatatcggggcagatgcagactgcgtatgatgaatgaaaaaggcgtttatcaatacattgacaaccttgtgcaaatcatgcagaacacccctgccggcaatgtttggctgatcttctgcctttattccttatctgccgaccaacggccggaacaaggcatttatgctacgataacccagatggaacgtggggaagtagaaacattatccctttcggaagagcaccgcaatatcctttcagaacgcgaaaaggaaatactgcgctgcatacggaaagggctgtcgagtaaagaaatagcagcgactctttatatcagtgtgaatacggtcaaccgccaccgacagaatattttggaaaaactttctgtcggcaactcgatagaagcctgtcgggcagcggagctgatgaaattgctgtaatattccttgaatttatccgggatttatccagatagagtatttatccaagtaaagatagcagatcatcgagtcttttcacctgtttcaagcgttcgtgtgcgaacgtttccgttacttcatgcttccacatgacttcaaaaggaatatgtactccgtatccacctaaagataagaccggctgaatatccgatttaaaagaattgccgaccatcaaaagttcggaaggagctatttgcagaatactcaatagccggagatattctttttccgtcttgtcggacatcacctcgatatggtcaaagtaaggagataatcccgaacgttccagcttattctcctggtccagcaaatctccctttgtagctactaccaacttgtattttcccgtttctttcagcgttttcagcgtttccttgactcccggaagtaattcgataggcattttcaacaaggatttccctaaatcgacaatttgccgaataatgtcggctgcaatctttccgttgctgatctgtaatgctgtttcgaccattgaaatggtaaacgccttggcgccatatcccaaaatttgcagattattcatttctgtttggaataaggcggctgagatttctttggaggtgccatacggtttcagcaaatccgtatactgtttttccacttcctgaaaaaaaggttcgttactccacagcgtgtcgtctgcatcaaaagctatgactttaataagttctttcatcggtcttgtcgttaatgggggacgagaatcgttccgttatattttgcggcaaagttactgtattttcatataaatccctatctttgttacccgttttaagtttgaattttaataggagatacaataatgaaaataggagataaggtgcgtttcctcagtgaggtaggcggtggaatcgtaacaggattcaaaggaaaagactttgtactggtggaagatgcggatggttttgatatcccgatgccgatacgtgaatgtgtcgtgattgaggcggatgattacaatataaaacgcaagcctgccgcgacagctccgaagcaggaggaacccgcgaagccggccaaaccggaaatgccggttatacagcgccagccggaagtgcgtggcggtgatacgttgaatgtgtttttggcttatgtgcccgaagatgccaaagcgatgatgactactcctttcgaggcatatttggtgaatgacagcaattactatctgtattatacttatctgagtgcggaaggaaaggcttggaacaaccgttcacatggactggtagagccgaataccaaactgttactggaagaattcaccaaggatgtattgaatgaaatggaacgggtagctgtccagctgatcgctttcaaggatggaaagcctgctgccatcaaacctgctgtcagcgtagagctgaggattgatacggtgaaattctataaactgcatacattcagtgcttccgatttcttcgaagaacctgctctgatttatgatattgtgaaagatgacgtgcctgccaagcaggtatatgtgtcggcggaagagattcagtcagctttgttgcagaaaaagtttgtggataaacccaagtcgcagcctattatgaagcccaaccacggtcagagcggaaaaaatgggattattgaagtagaccttcatattgattctctgcttgatgatacgcacggaatgagtaacagcgaaattctgaactaccaactggacaaattccgtgaagtaatagaggcgaataaagagaagcgtgagcagaaagttgtgtttattcacggaaaaggagacggagtgcttcggaaagccattattgatgaattgaaacggaaacacagcaattaccgttatcaggatgcctcttttcaggaatatggtttcggggctaccatggtgactatcaaatgattccggtgtacttgtaaatgatgctgaaaatgtatttgccggaataaagtccggcaggtgggatgagataaaaagaagggtggagaacttgaccggtctccaccctttctcttgctatatgattcaattttacttacttaggtcgatgcctttattcagtaaagtaaggttcatcaaagcggcatatttagcatattgttcagcgctgagcgtctttctcataagtttcaagttgccgtatacagcgttgcgcaattttgcttctttatctttcttggctgtagtggctcttgacatctgttctgagaaataatcgcagatgtttgctacttcttcgctctgaacagagtttaactgcaaatatttacctaatttatttacgttgatgttaccttcccattttgcagttgtaggttggtttcctgctgcaaaagtcgaagcagcgaggcagagtgctgccactaatgttaatcctaaacgtttcataatacctactttttaattgttatacctaaaaactattcctaaaaaacaaatctaatacctattgaaaactgatctaatcgcttagttttttctttttacctatgcaaatatagcgatatgttttatagcataaaaataaagaaaaggaaaagattttgtttcggttgatttcttgatgtaaatcaagaaatcaactgctttttgatacaaaaagaccttattctgaaacatttttgcaatacgtgtgcggaaacgaaaatgtaatataactgaattttaaggaatattgctgttaaaatgatattgagcaaaggaaggtgacgagaaatggaacactgaaatcaactacaaaaccatgaaagatagaaatgattacgaattcttttccggaacatcgggtgatgatgggaagagtagtgtccattgtggtagctcctcctacagaaataggggccagcttgccgaaatacttcacgagtaacggggctcccagcaatgctatgatttcacgcatgatgttggataacaatgcgattgttcccaattccggacctttatattcggtgatgaatatactcgaaagggaatagtagccgaatccggctcccactgccatacagtctgaagaggttctttggctcatgaaaatgcctgctacggcgcatcctgccaatgtccccagtatcgtcatgacggggagaaacatcaggcggggattcagagaacggaaacttttcagtgtgttgggatcattaccgatactgatacctacgcagaacatcagtccgcaaagggcgtaatagcttagtttgctatccgtaaaatcgtaaggaatcagatgataaaacccgcaaagggtaccgagaatgaaaaatgagacgatgatcagacttcctttcatacttccgtctcctttcctttattccttatatataataggtaccagagtccccatgcgcaaagtatactgccggtcactgccgccagtgtgataatgagtgcttcgagtcccaatgtatgcagtcctttgatgatagcctcgtttcctcctacatcaatcccgaggaggaagagcaggacccatatcagcagggtgattattttatgtatccaagatagtcttttattacgtaacaggaagccaaaaagcattcctgtcagcataattccgatgatgataaacatagtaagtgcctgtttttggctgcaaagataattgaaatagatcgttgttcctaattaaagtcggtggagacgttcgtaaaatgaaaggaaactttcagcgaatttggaataaaaacagaaattgaagcctggtttttagtaagatgtctaatttaaattcatatatttatagccgtcaaattaatgtaagatatatgcggagactaaaactatattatttgtttttccacagtacgttgaaaataaacgttccgctgtctatattaggtgcacttattgtatcaaaagctgactggagcttgttttgggaagcttttccttatctattgggtggctggggaattgttgccagtttgctttataaggagtttcttgaaaaggaagcctactttttctattataattccggaattctgaaacggaacttgattgtctttgtgtttgctgtatattggtctgtactttggattgtaaaattatgcatcacttgcttgaaatagatagtattattaagaatttcggtaccaggcaactgctgactgatgtttacctgaaaataaatacaggtgatgttattggattgttcggcaggaacggtacaggaaaatccgtgttgatgcaaataatcttcggaacaatgaaagcagaccggaaatttatccggttggatgaatgtaaggtcctttcggctccttaccaacatgcaaggacaatagccttcctgccgcaacaaggctacttgcccaagcatgaaaagataaataaattggtagactgttacctggatgctaatgtcgttccctatttttatgaggatgatgaagttgcccagtcgtgtatggaacggcgtgtctcccaactttccggaggtgaacggagatatttggaagctaagttgcttttgctgggcaatgctaaatttgtcctgttggatgagcctttcgattatttatcctttcatttggtagataaactgatcgggttaataaaaaaacattcggaagagaaagggatagtgattgctgatcataattacgaaaaagtcttagaggttgtcaatcgacttgtcttgattcgggagggagtattgatggaactaactgataagcggggattggtggagcaggggtatcttttagatgaaagttacttatgaatcctgctcctatatttatttttgcaagtcatttcgggttattttccctgattcgaaccgtttgagatacttccgtgctgatacctatcattcccgtacctccatgtacattactgggatatctgagaggttcgttaattgtttcgtcataaacgtcggaatcgactagattgagtgctttcagatagtaatattctgtttccgtgatactcaacaaacggatgatgacatccattccttcataatatccgttgtaattgttgttgtatgggatggcgggatcgttgtagaccgtcattgtataggaggtatctctaaatcgcgaatcatcaaagacaccataaatgtttttagctgtgtcgaacagtccgttgtcttcgtcatctcctgtggaaggttgaccgtctgtcagtactatgtcttcgcgtccgataaatgaataagtgatatgctttgtccagtgaaggtaatcttctcctccttcttcgtggttgtatccccatagtcgcatttgtttatctactacaatgcggtagaagtttgcctcgttcgggcggtctttaaaagttattttgtagcgcatgtagtcttgagtatgtccgttttgtattagcgggacggtgagcgtgtcgatgttttctattttatcaaggcgttgcggaacggtgacttctgcccaggcatgatatttgccgtcatcggtcatggcatcaatacgcactacttctcccgaagcaaatttgcctgtgatgttgaaccggcattgcttgtcatactcagtttccatcgggagtgggcgcaaggtctctcttaactctccgttgacgtgaacctctacagtggcattttcaatgtggttggcatagtcttttcccgtcaggttaaggaataagacatttgtcagactgtcagcgttaatgaatgcattcattaccaatttaggaggattatcctttatattaaaagggagttcattttcacaagatactgtcaccagtattataactagcaggataagcggatgatatatataagttttcatgttaacttagaatttgtaagtgtaagtaaaagatggaatgcaggggagcagggtatattttttgatcacactttttccatcgtcattatgagagcgaaatacccatgccggattcatggagttgtatgcattataaagactgatgttccagatacgcattccgtgcttggtctttttattgaaattaatccctatgttcaaccggtggctcgcaggcagccggtaattattgcgatgttctatgtaattggcctctccaacattaggggaattgttataaataggattgtagtagttatcgaatcccagaataaagccattgtttgctccattaccaggacggatgatggttgttttttcttcgggaatagtactggttcctcctgtgtaaaacacccacgaggcaccgatgtcaatacgttcgctgaatttatggttgagagtcagattaataatatggcgccgatcatatttgtatggaaatcgctctccattgttgatagcacctttagcaaatttgcggtcgcttttggataaggtataagacaaccagcctgttgtcttcccgagcgttttttgagccataaattcaattcccatcgaacgtcctttccccatttcaactttgctttcccatccggtggaagaaccgaaaaaactgactccgtctttatattccagcacattgtacatgtctttgtaatagccttctactgagaactcccaacctttgatacctgtataatatccccccaatgaatactggtgggatcgcatcggtttgattttttttgtgacaggcacccataaatcagtaggcatagcgatgggcatggacgaaagcagatgtacatattgactcatctttgtataagatgccttgagaattacgtctttacttagttgataacgtgttgagacacgcggctgcaaggagaaataactttgtttttgtacttgaaacagagaaaagtgtaatccaagattaagccgtagacgagtaccgatttttaggttatcttctgcataagccgatacttcatgtgcataaatccggctgttgttcatgctgtggtaagtagtgtcgcgaaatgcctcagagtctaccttgtctgatattttggaggtcatcacttccggacgaaaacggtgatagatatatcctgctccaaatttaatatggtgcataggagatgggttgtaatcaaaatctatctgataattccagtcattgatacctgaacgatagtctgaagagtatcggttgatgaaggttgtgttattggtgagtgaatattgattattcgaatatgcacttacattgaataggtagttgttgtaggaaactgtcgtgttgctaaacaggcgattattgaaaatgtagttccatctggcggaaatgattgtgtttccccagttcattttacttccgtccttgaaatcgctattatcatcatattgggtagcgaagtgatctttcccgttataagcactcagatataaacggctccggtcggaaaacttgtgattgatctttgcattgatatcataaaagtaatagttgtatttctcatcatcgggcatgaatggtttggctattaaatcaatatacgaacgtctggcggatatgttgaatgatgttttgtctttcacaatcggtccttccaaatttattttgctggttagcaagccgatactgagtgtcccatgatattttttcatatccccgtcattggtgcgtacgtcaatgacggaagaaaggcgtccgccgaagcgtgcaggaaaggaacttttaaataaagtgacctttttgatagcttcaggagtaaagacggaaaagaagccgaacatatggtctacgttatataccggagttccgtcaagtaagatcagattttggtcgggactgccaccacgtatatataatccagccgatccgtctactcctgcctgtactccgggcattaactgaatggctttcattacatctgattctcctaatatacttggagtattcttgatttgcaccattggaatctcgacagctcccatctgtgtggcaactgtccctgcttctgctttatctgaaacgaccactacttcttctaattgtgcgtttcctttcatacgaatattcagcagagtatcttgagcaagggtgaaatgatgtgtttctgtggtatatcccaaataagagaaacgtaattccgtttctccttcgggcagagtgatactataaaagccgtaaggattggtagtagtgccttgatattgatgactctcaatgatattagtaccaatcaacgtctcggacgacgtcccgtcggtaacatatccgctgatagtaaacttgcggcttaccggcttttgcacccttttcttttgcaggagaatgtatctctcagagaacttgtaactgatcggttcatccttgaatacgagatccagtatctcatgcaaaggcatatctttcactttcagattgattttatggctgatgctgatttcttcactgtagataaaagaatatcctgtagagttttcgattaacttgacgaactccttcaatgtagcatttcgcaatgtgattgtgagtcgggcatttgcattctgtgcgtatgcctgtgcggtgataaggatcaccatacctatcagaacgagcgttctgataggtaggtgtccttggtgaatagttctcatttagtctagtttttagtaatagtaatctgttgagtgtttcgtgaatagttgaaataaccggcattatgcagtacagataaaatcgcatccaagtcttctccattacggaatcgcgctgtgatccgataatttcgcaaggttgagtcggcaatgtgaatggttgttccgaacgagttggaaagttcgcgggcaatctcctgcaacggcagatcatcgaatatgaactccccgtggcgccatgaaatttcatctccggcattctccagtaccttgcgagtaagcttttgttccaccttattatatatagccgcctcattcggtttcagcaccatgcgtactgagttgtttttattgctgactgcaaccgaccctgttaataaagtcgtctttacatccggattatcgggataggcgtccacattgaagtgagtgcccaatacttgaacgtcaatcgtttctgtctgcactataaacggatgctttgggtctttacttacttcaaaataggcttctccgctcaactccacttcccggttatccgatttgaaccgttccggataggaaagggaagaataatggtttagcgtgacggaagtgccgtcgggcagatggacggtacgtgtttctgccaaagtgctaacagtctgtatggttgccggctgcatgtacagataagctgtccataccgatagacagagtaaaactactgctgccgctgccgcaaatgtgcgtgtcagatacaaccggcggttgcggaaattcagctttttctccagttgcggataactggatgctgctgaaaaacgtcctctcggtgagcgggtggaagcgatgagcttgttcagtatgtcttctaattctctatcggtatatttcatatctttttctatttagctttctttctaattccgtttcagcagaatcgtcagcttgcttacactgccttctttccactggggagtacaggataaggtaatgttctgctgtttcagtaccatctttttgggatataacttaatggtggtcgttgccgatttctgtcccgccttgatggtgactttggtttctgttagtttcataatcggtgcctgtcccgccggcaaagcaggagtggcaagtaacactgtcctgtcttctttggatttgtcggtggcaataattttaatctgcaactcactctcggattgattcttgtcacattctactgttcgggtagatttttcaaatcctacataatccttaggataattgtcattgtcgttgttgcaggaaaataggctcaggcatgctgttaaaaggacaaagagtccaacgtttgcgtcattaaactttttcatcattcaatcttttttagtgattaatcggtttatttgctgataaagaccggagattgacagaaactccctacgccttttgtgcaaataaaagttaatataaaaaagaagtgctgaacggttcgggtgatctccggttatccgctggacgaaatcatctctttcagtcgggagacagctttctgtagctgggcatcaactgtctttatgctgatatccaattcttctgctacttgggcataactttgtttttcttcacggatacggatgaatatttcccggcaacgttccggaagccggtcgagtgctttcacatagattgcaaacagttcttcactgattaatgactcttccggagaataactttgttcctgtggctccggcagggaatcggaatgaatggtggtgtacttcgactctttttccagataattgagagaagcgttcttgaccagaataaagcaatagtcctcgatgtttttcacatcaagaagagtgtcgcgctgcttccagagtttgaggaagatgtcgagtacgatttcctgcgaccattcttcctgtttcacataatagtaggctatgcggaagagtcggtcgtaagtcatgttatagaagtcgcggaaggctgtttgcgagtccagttccttcatttgccgtaataacttccttacttctgattcggtcatcggctgatcgtttagttttttaattaacccaaagcaagtcgctcataatgctgtcggagatgaaaattccttcccgtgtcaggcgtaaagccccctcgtggatttccagtttcccattttccagatagggggcagacattttccggcaatattcccacagttcattaccgaactcttgttttagtttttctataggtgttccccatacggtgcgtatggtggtaatgataaattcgttgtaacgggtcgtttggtccaggttttctgtctcaaagtcgcgctggtttccttctataccttttatatataggtcgatggaagatacgttccattcgcgtgtcgttccattgaatgaatgtgcggacggtccgcagcccaaatatggtattcccctccagtacgaagtattgtgacgggagtatttgtcggggcggcagaaattggatatttcataatgctcgtatcctgcattctgcaaatgttcgatcagcaatgtaaagaactgcagactggaatcttcgtctacttcctctatctgatgttgcttcaacatattatatataggtgtatcttcttcgtaagtcaaatggtaagcagaaatatgctctacatccaggcggatagcttgccggaggtcgtttacccaccgttcctttgtttcgccgggcagtccgtaaatcagatcaatgctgatattctgaaatcccgcttccctgcatctgcggacagcttcgacggctgtttgggagctatggcggcgtttcagtaattggagtgtcgtatcatcaaaagtctgtatccccatgctgatacggttgaaagggagcgaggataacatcttcagatattcctgggacagatcgtccggattggcttccagagtgatctcccggcagtgttccattccgtaattttcccgtatcgtttcaaagatgtgtttaaaatcagcttcctccagttgagagggagttcctcctccgaaataaatggtttctacaggttcgcctttcagatattctttccgcatttccagttcacggcagagggtatgcacataatgcgtctttaattcgctgcgggtagtcgaataaaagtcgcaatagatgcaacgtgtcttacagaagggaatatgaaggtaaatacctgccatagtagatgtttagcttgttaccaattgattatagcctgcaaatttaaaccttttttctgagcaattgatacaattaacgggaattaggtataagtctggcctgtctgctacccataaaacggaccttatgttacataacattgtttagtaacactgtcataaatattgcttttcccccaataaatccctaatttgcgcatcactaaattaatggtatgcgagaaacatactgagtaattactaaaatcttatatattatgaaagtatatcagactaatgaaattaagaacattgccttgttgggaagttctggctctgggaaaaccactctcgtggaagcgatgcttttcgagagtggtgttataaaacgtcgcggatctgttgccgcaaaaaacacagttagcgattatttccctgttgaacaagagtatggttactccgttttctctaccgttctccacgtagaatggaacaataaaaagcttaatattatagactgtccgggttcggacgacttcgttggcagtacggtaactgcacttaatgtgaccgacacagcaattattcttctcaatggccaatacggcgtcgaagtcggtacacaaaatcacttccgatacactgaaaaattgaataagccagttatttttctagtcaaccagcttgataatgaaaaatgcgactatgataatatcctcgaacaactgaaagaagcgtatggatctaaggtggttcccatccagtatcctattgctaccggtccgggctttaatgccttgattgacgtattgttgatgaaaaaatattcgtggaaacccgaaggcggtgctcctgtgattgaagatattccggcagaagaaatggataaggctatggaaatgcataaagcattggtagaagctgctgccgaaaatgacgaaggactgatggagaaattttttgaacaagattctctgacagaagatgaaatgcgtgaaggtatccgtaagggattgatcgccagaggtatgttcccagtattctgtgtttgcggtggtaaggacatgggcgttcgccgtctgatggaattccttggcaacgtagttcctttcgtgtctgaaatgccgaaagtggaaaacacagatggtaaggaagtagctccggacgtaaacggtcccgaatctttgtatttcttcaaaacgagtgtcgagccgcatatcggtgaagtatcttactttaaagtaatgagcggcaaggttcgtgaaggtgatgacttgctgaatgccgaccgtggttcgaaagaacgtatcgctcagatttatgtcgtagctggtggtaaccgtgtgaaagtggaagaacttcaggcgggtgatatcggtgctgccgtaaaactgaaagatgtgaagacaggcaatacactcaacggtaaagactgcgattataaattcaactttatcaaatatccgaattctaaatattcccgtgctattaaaccggtgaacgaagcggacgtggaaaagatgatgaccatcctgaaccgtatgcgtgaagaagatccgacatgggtgatcgagcaatcgaaagaattgaagcaaacgctggtacacggacagggagaattccatctgcgtacgttgaagtggcgtctggaaaataatgaaaaacttcaggttaaatttgaggaaccgaagattccgtatcgtgaaacgattacgaaggctgcccgtgccgattatcgtcataagaaacaatccggtggtgctggtcagttcggtgaagttcacctgatcgttgaaccttataaagaaggtatgcctgtgcccgatacttacaaattcaatggacaggaatttaagattaccgtgagaggtactgaagaaattccattggaatggggcggtaaactggtatttattaacagtatcgtaggtggttctatcgatgcccgtttcttgcctgctattatgaaaggtatcatgtcacgcctggaacaaggcccgttgacaggttcgtatgcccgtgacgtacgtgtaatcgtatatgatggtaagatgcacccggtagactcaaatgaaatctcctttatgcttgccggacgtaacgcattcagtgaagccttcaagaatgccggtccgaagattttggaaccgatttatgatgtggaagtatttgttccgtccgacagaatgggtgatgtgatgggagatcttcaaggacgccgtgccatgattatgggtatgagcagcgaaaaaggtttcgagaaacttgttgctaaagtacctttgaaggaaatgtcttcatattcgacagcacttagctcacttaccggcggacgtgcttcatttatcatgaagtttgctagttatgaacttgttccgacagatgttcaggataagttgattaaggattttgaagctaaacaaacagaggaataaacaataattctctcaaaactgttaaaaccgttgtcttttttaagtaaaagacagcggtttttgtttaactatgattaataaagatggaaaatcgcaaggaaaagatttaattttttattaaatttgcaaaccaaaggaggagttatattgttgtagtaatcagaatacaacctaaatagctctttacggttaatttccgggaacttccggttaaatcaagttaatgtgttaggagtgttaattagggagtgttaattttgttgctatgaagaagtcaacaatttggatattaagtattgtaatggggctttctttccttagtctgttgtatttgcaggtcagttatatagaggaaatgatgaaaacccggaaggagcaatttgattcggctgtgcgcaacagtctggatcaggtttccaaggatgtagaatatgcagaaactatgcgctggttggttgaggatatttcggatgctgaaagaaaagcgctgactgaaaacaatacttcattagggcagaataatgtagttcgggggacacagcgatttcaagtgaagtcacgggatggcaagattatttctgactttgaattgagggtgatgaagatcaaaccgtctgaacttcctaaagcgatggtacgtggacgaaacacgattcctcagacttctaattcgatgttggaagctatcaagaatcgctatatgtatcagcgggcactgttggatgaagtagtgttggacatgattagacgtgcgagtgacaagtcgattggtgatagagtacggttcagggaccttgacgattatctgaaatcgaacttatataataatggtatagacttgccttatcattttgcagtgattgacaaggatggacgtgaagtataccgttgtgcagattatgaagcaaaaggaagtgaagaatcctatcagcaggcattgtttaaaaacgacccccctgcaaagatgagtattctgaaagtgcatttcccgggaaagaaggactatatttttgattcgatcagtttcatgattccgtcactgatatttacgttggtgttgttggtgacattcatctttacgatttatatcgtattccgtcagaagaagttgacggaaatgaagaatgactttgtcaataacatgacgcatgagttcaagacgccgatatcaactatctcgctggcagcacagatgttgaaggaccccgcggtagcaaaatcaccgcaaatgttccagcatatatcgggagtcataaatgatgagaccaagcgcttgcgctttcaagtggaaaaggtgctgcagatgtcaatgttcgaccggcagaaggcaacactgaagatgaaggagattgatgcgaatgaactgatttcgggagtgatcaatacctttgcactgaaagtggaacgatataatggtaagataacatcgaaccttgaggcagccgatcctgttatatttgcagatgaaatgcatcttaccaatgtgatcttcaatctgatggataatgcggtgaaatataagaaagcggaagaggatctggaactgaaagtgaaaacgtggaatgaatcgggtaaactgatgatttcgatacaggataacggtatcggtatcaaaaaggaaaacctgaaaaagatatttgaaaagttctatcgtgtgcatacgggtaatctgcacgatgtgaagggctttggactgggactggcttatgtgaagaaaattattaccgatcataagggaaccattagagcagaaagcgacctgaacgtaggaactaaatttattattgcattacctttattaaaaaataattgatatggacgagaaactgcgtattttattatgcgaggatgacgaaaatcttggcatgcttttaagagaatatttacaggcaaaaggttattctgctgagttatatcctgatggagaagccggttataaggctttcttgaagaataaatatgacttgtgcgtgtttgacgttatgatgcctaaaaaggatggctttacgttggcacaggatgtccgtgctgcgaatgctgagatacctatcatcttcctgactgcaaaaacgctgaaagaagatatcctggaaggatttaagattggtgcagatgattatatcacgaaaccattcagtatggaagagttgactttcagaattgaagctatcttgagacgtgttcgtggaaagaagaacaaagaaagcaatatctacaagatcggtaagtttactttcgatactcagaaacaaattctggctacagaaggcaagcagacgaagctgactaccaaagaatctgaacttctcggactgctttgtgcgcacgctaatgaaattctgcaacgtgactttgctctgaagactatctggattgatgataactacttcaatgcccgtagtatggatgtgtatattacgaagttgcgtaagcacctgaaagaagatgattctatcgagattatcaatattcacggaaaaggctataagctgatcacaccggaagttgaatcttaatgagcactccgataaccacaaataaaaaatcccggaaacattcgttcccgggattttttattgatttctaataaattaatcagcgatcttcttattaatgacaatataagaaatgagtcccagtactacgaggaatactgaactgcccaaaaccgcgttgttgtttacattgccggtaaaggaacaagccaacaggatgaccactccgatcaagattaatatcaatcccaaattctttaataagcctttcatgcgtgtgtattttaatagattataatattccagtcacaaattaaagcataattctttaacgggcgaaataatttaggtgaaaaatccattataaagacagatttagtggattttatgaattaaacgattgtttttctgtttagtctttggtattgtagaataccttttttaagacctcttgcccgatgctcagttcttcgagagtgatgccatgcagagcttccttcagtgtctgccccgcaatgatgcgtgccttctcttccagttcttttccgtcttttgtcaggtggatcagattggtgcgacgatcttttttgtcggaaatacgtactacaagatgctgccgttccatgttgtctatgagacgggtcatgctgggtttgtctttaaaagttgcattgcacaactcttgttgtgtaacgccgtctttttcccatagaaaaataagaaccgtccattgctccgggctgatttccagaccgttctgacggaaattgcgatatagcttccggttgattgctgcggaaaccttaccatttaggatggcgaatataagccggatatcgaaattaaattgctctatcatgaaattattgtttaaacaactttgcaaaggtaagccacttcccggataattcctacatt

SEQ ID NO: 45 - DNA, 60906 bp, Bacteroides thetaiotaomicron
ttaggaagtagctatacacttctgaagagtaggtatgtctatatacaaacttacccaaggatacgttaatgttcgtaaacttgggtaagattttatagatattgtttggagaggacttagaattcaccttctttatttttggtattacagatttcactttcctatatcaatcagctttttatcagacagcttcaattttataaatctccactttccactacctcttgtatcgactactcccgctatggtaagtccaatataaaacactgcgttttacaagacataaggctatgctttagggagtgaaaagcatagctttataccttgtaaagcgtagctttagcttccatatcctctctcctttcaccaacaactacactgaaggattaccctaaactcatattaatatcattatctacttgtaacgattacaattttataaagattttatgtgaatattcatttttatttctttactttgcaaaagataacaaaacagaagcacgaatatgtactatgtatatgtagcaggttacattttattagcagcagccatgcagctgttcacaggaaactttcctgtttcttttctcgcctttccgctgaatatcatctttgcggcgatctggcttttcctgttatggatactatataaagaatataataatctaagaatcacccgttttctcggttcatccaaagccagcgttttatctatcagcctgtttatcggtggttgcctgatcataggacttttcccccagctatctgaaccggaagccgaaatgcgcaaaggaatatcagcctcattgggatgttacaatttcatgacttcatggatattcatttctatactcttattattattaagcaatctggcgatgatcaccatccacgcctgtcggcatcgcaaacaagcacgctggcgctttattctgaaccatacaggtttatggctggctctgtttgccggatttctgggtagcagtgacacgcagacattacgcatacctttatataaaggtgaaccaaagcatgaggcattcgacatgaatggcgcatcttattatttagattatgatatggaactcaattcgttcgctgtagaatattacccgaacggacgtccttcccgcttttccgccaatgtacgtttggggaatgagaacgttctgctggaagtaaaccacccctattcctaccgactgggggaagacgtctacctcaccggatacgacgtaacgaaaggcaacgaaagcaattactgcattctacaggtcgtaaaacaaccctggaaatatgtgatggtagcgggtattctgatgatgcttgcaggagcagttcttttatttataaacggagctaaagcgtatgataaactgggataatttttatgtatttgcagcagtatccatctgcctatggctggcaggagctgtatttgcccttcgttcgtcatcgaagagtaaggtggcaatcggatttacttccggcggcattattatattgggagtatttattgccggattatggatattcctccagcgccctccattacgcactatgggagaaacccgcttgtggtattcattcttcatgggaatagcaggattactaacctatatcagatggaagtatcgctggattctctctttctcgacgttactttccacagtttttgtgatcattaatttgatgaagcccgagatacacgatcagtcattgatgcctgcgctgcaaagtgtatggtttatcccgcatgtgaccgtatatatgttctcttactccgttctgggatgtgctttcatcatcgccctgaccggactgttccgtcataaagaagaatacctgcatacagcagacaatctggtctacgcaggtgtcgcctttctttccatcggtatgctactcggttctctctgggcaaaggaggcttggggaaactactggagctgggaccctaaagaaacttgggcagccatcacctggatgggatatttgctctacattcacctccgcctgttcagaagaaccggacggaaaacactctacgtcctgctcatagtctccttccttgctttacaaatgtgctggtatggagtcaactacctgccggcggcccaacaaagcgtacatttatataatcgtaataactaacctcaaaaaacaaatgtgaaatgaagagaagtacaaaactaatcgtagcatttttggtagtcgtggcggcattggcagtcacttaccgactgatgcaccgggtgccttctgccgatttggaagcaaacgtacagatgcaacagattattacggatgcaggatgcctgagatgccatacctcaacaccggaactaccgttctatgcaaatatgcctgtcgccggaaaaattgtaatggaagacgtgagcaaagcctatcgcgctttcgacatgactcagatggagaaagacatgaaggaagggcgccctctcaatccggttgacctggctaaagtagaaaaagtaatcctcgacggaaagatgccgcaggcaaagtattaccttgtacattggggagcttctttcaacgatgcaaagaaagaggtagcactgagctgggtaaaaaatcaccgcatgggactgtataccgatgtagcggtagcacctgatttcattaacgaaccgattcgtcctattgccgactcgatctcagtcgatgtacgcaaagtggtcttaggaaatctgttgtatcacgacacccgcttatcggcagacaacaccgtttcatgtgccagctgtcatggcctggataccggtggcgttgacaacaagcagtattctgaaggagtaggcggtcagttgggcggtgtcaatgccccgaccgtatacaatgctgcctataactttgttcaattctgggacggacgtgccggaactctggcagaacaagctgccggccctccattgaatccggtagaaatggcttgcgagtcattcgatcagatcatcagcaaactggcagaagacaagaatttcgtagtagcattcaacgaagtatatcccgacggattgagcgaaaagaatatcacaaatgctattcaggagttcgaaaagacattgctgactcctaattcacgcttcgaccgttatctgaaaggacagaaagatgccatcaccgcagatgaaatcgccggatacgaccttttcaagaaatatgattgtgcgacttgtcatgtgggagaaatcctcggcggacaatcttatgaactgatcggtgtacagcatgattatttcgcagaccgtcaggcagaaatgactgaagaagacaacggacgattcaagcagacaaaagcagagcgtgaccgccaccgcttcaaagtgccgggattgagaaatatcgaactgaccgctccttatttccacgacggcagcatggctactatggatgatgcggttcgcgccatggccaaatatcagttaggcatcgacctgccacaaccggaagtagataagattgtcgccttcctccgtacactgaccggagagtataaaggcaaattactgacgaataagaacatgatctgacaagaccaaacagaggctccatttcacccgaacagagcctctgattgatgtaaacagagcctccgtttcacctaaacagaggctctgtttttcttgcctgaaaatcagagctttcccttgtactttttaccttctttcctactcgtattccaatatgttccgctgtcccctctccacaaaaagtccattccttttggagagttcagttatttattttacttttgtccatcaccaataaatactctgaaaatatgactttgatagacggaaaagccatttccgaacaagtgaaacaagagattgcagccgaagtagccgaaattgttgctcgtggcggtaaacgcccgcatctggcagcaatccttgtaggacatgatggtggcagcgaaacgtatgtagccgccaaagtaaaagcctgcgaagtatgtggattcaaatcttccctcatccgttacgaaagtgacgtgaccgaagaagaactactcgccaaagtacgcgaactgaataatgacgacgacgtagacggatttatcgtacagctcccgttacccaaacatatctccgaacagaaagttatcgaaacgatcgactatcgtaaagatgtagacggattccaccctatcaacgtgggacgcatgtctatcggacttccctgctatgtatccgccaccccgaacggtattcttgaactgctgaaacgctatgagatagagacgtcgggaaagaaatgtgttgtactcggccgcagcaatattgtaggcaaaccgatggcttcactgatgatgcagaaagcgtacccgggagatgcaactgttactgtatgccacagccgcagcaaagacctggtaaaagaatgtcaggaagcagatattattatcgctgctttgggccaacccaacttcgtgaaagaagaaatggtaaaagaaggtgcagtagtaatcgacgtaggtaccacccgtgttccggatgccagcaaaaaatccggtttcaaactgacaggcgatgtgaagtttgatgaggtagcgccgaagtgctcattcatcactcccgtaccgggcggcgtgggtccaatgacgattgtatcactgatgaaaaatacacttttagccggtaaaaaagctatttataagtagaatattgaaggacagtgaaatgtatttcactgtccttttccttcccttaatctgacagttatgaaaacaattacgattcttcctctcttattatgtccgtttcctgcctaagtaacaatcattctcgaaaagacattataatcctcttgaacgtatgaaagaactattagtatcccttctcctggttacacaattctcttgtatcagcaaagcgcaagaaaatgatactaccacacagatactgacaactgacagtctgcaaacagacaccctttcgcttctttttgcaggtgacctcatgcagcatcaaggacaaattaacgctgcacgtactgcgacaggaggctacgattattccagctattttgaatatgtcaaagacgaaatccaaagtgctgactttgccatagctaatctggaagttactctcggaggaaaaccgtacaaaggctatcccgctttcagcgctcccgatgaatatctgaccgctattcataatgccggattcaatgtactgataaccgccaataaccatagtctcgaccgtggcagaaaaggcttggaacgcaccatacaattaatagactccttaaaaattccacacgccggaacgtacctcaacgctgaagagcgtgaaaataaataccctcttttattagaaaaaaaaggcttccgcattgccatactcaactatacatacggaacaaacggaatccctgtcactccgcccaatatcgtcaattatattgatacgaccattatatccaaagatatcgaagcaagtaaaacactgaatcccgatgcgattattgcttgtatgcattgggggatcgaataccagtcactccccgacaaagaacagaagtttctgacctattggctgcttcaaaaaggagtaaatcacataatcggttgtcatccgcatgttgtgcaacctatcgaagttcgcgaagacagtctgacaaacgagaagcatctggtagtatattcattgggaaattatatttccaatatgtccgcccgtcgcacggatggcggcttgatggtcaaaatggaattagtaaaagatagtaccacccgactcaaccattgcgaatatagcttggtatggacagcccgtcccgttcaatcgaaaaaaaagaatcatcaattactaccgattaatttccctactgactccatttccgtaaatgcacgtaactctctgagaatcttcgcaaatgatgcgcgagccctcttcaacaagcataatcggggaataaaagaatatcttttttataaaaaaaagtagcagaatcttttggagatttaaagataatatctatctttgcaccgcgttagagaaacgcagacatggtggatgtagttcagttggttagagcgtcagattgtggttctgaatgtcgccggttcgagtccggtcttccacccccaaaagaaagactaaaagacaagtcctgtaaagcgaaagatttacaggacttattttttattaatacaatagctttatggaaaacaacaaaaaactgactcgttccagaaaagaacgaatgatagccggagtatgcggaggtttagccgaatacttgggatgggaccctactctagtaagaatagtctatgcgctggctaccatcttcactgcttttgcaggaatcattatttaccttattctatggatcattatgccggaagaaaggtatagcgacggatacagtggcagaatgaatcaacgtttacattagtattgctttcatatccatccggagcatttactttaaagatccggatggaaatcttatagaggtccgtacattaatataattcaagtccgaactcatctttcagttgcatgagcgcctgattcttctgagccatcatctggaacttctcaacacgaccaaccgcccgaacagtttccgtaggttcactgacccgtactgtcatcgccactttgctgttcttcaatcttccacgaaggtaagtctgtaattccggaatcaaagctgtaaaatctttagcagcaatctcattatcgaccactacttcaaaagtagtcgaattattcaataataccggacgtatcacttgcatacgctttgctatagctacctgttctttgggtaactgtcccgcatattcctgccagtaataattcaaatctctgtcgttgaagataaagtcttcttccggctgtatttgaacctgagcaacattgtttttggctgtattctgagcagcctgatcacgttgcggatttttgatagatactcccagactagacatcttcatcacaggaatcttccgttcctctttggaaatcgaagaaattccagcactctgtgacggagcggaagcagtatttaccggagcagcagcccccgaagcaacagatacctgcggttgacgcacagcagtattagcggcagacggagcagtagccggagacggagcagtatgaacagtagtctgttgagcagacgttgcagaagcgacctgcggctgctgagctgcggcaggttgggtgaatacgggttttatggtctgcttagggccacgcccaccacttacgtcatccccctcggtggtaagctgggcaacctgtatcaaggtcagttccaccagtaagcgcttgttcttgctggcacggtaattcaaatcacaatcattgcaaagtttcatcgcacggtaaagaaactgcaacgggcatttctgcgcctgttcctgataacgctgacgtatgctcgcccctacttccagtaatggcaaggtagcggcatccttactgaccagcaaatcccggcaatgcgaagataatccggtgatgaagtgactaccgtcaaatcctttattcagtacatcattgaaaagcaacaacgcatcactcaccctgttttcaagaaaacaatccgtcagacggaaataatattcgtaatcgagaacgttcaagttctcaataacactcttataagtaatattccctcccgtaaaactcactacctgatcgaagatagacaatgcgtcacgcatacctccatccgctttcatcgcaatgacattcagcgcttcgggttctgccgtaatattttcttttgcagcaacgtacgacaaatgattcaccgtatcttcgacactgatccggttaaaatcataaatctggcaacgggaaaggatagtcggaagaatcttatgcttctccgtcgtagccagaataaagatagcgtgacggggaggttcctccaatgttttcaagaatgcgttgaaagcggaagccgagagcatatgcacctcatcgataatatataccttatatttaccgatctgtggcgggatgcgcacctgttccaccaattgacggatatcatccaccgaattgttggaagcggcatcaagttcatggatattatacgaccgctgttcgttgaaagccacacacgattcgcattcgttgcaggcttcaccatcggtagtaggcgtcatacagttgatggttttggcgaagatacgcgcacaagtagtctttcccaccccgcgcggtccgcaaaacaaataagcatgagccaatttctgggtagcgattgcattctttaatgtagtagtcaacgctcgttgtcccaccaccgattcgaatgtggacggacggtacttacgagctgatacaatatagttctccatatccgggattctctctgttttttttgatttttcgctttcagtgcaaatgtacacaaaaaagtgataagtaataaaggatagagaaagaagttttgaacctaaagcggtaagtttttaagttattagttttatctttgcggatataaaaaagagaaattatggataaactgatcactatctggagtttcatatgccggcgcaagtatcttatcaccgtcgttgcatttgctgttatcattggttttctggacgagaacagcctgttccgccgtctgggatacgaacgcgaaatcagccagctgaaagaagagatagaaaaataccgggcggactacgaagagaacaccaaacgtctcaacgagctgaacagcaatccggatgctatcgaacaggtggcacgtgaaaagtatctgatgaagaagcccaacgaagatatttacgtttttgaagataataaatgaaacaattagtacccgcacttttcgccgtaggcgcaatcatggctctcacaggggctgccgtatacatcaccggatggaactatgctccttatatctataccatcggagccggattcattgctctggcacaagtaaacacaccggttaaaggaaaaagcaaaatattaaaacgtctgcgtatccagcagatattcggagcacttgcgctgatacttacgggggctttcatgtttaccactcgcggaaatgaatggattgcctgcctgactatcgctgccgtacttgaactttacaccgctttccgcattccacaggaagaagcaaaagaagagaaataaaaaaaacctgttcaaagcttctcagtcttgaacaggcatcaatttattaaaatcatgaatgcccttaggaaacccaagggcctaaaaaaacatttttatttcttagcagatgaatatctggcattcaatccatctacaatttcttttgtgatattatatgcactatcagcataaagcagattatcgaaacctgtgttgctgaagatcaggctatatccacgagttttattatattctttcaggaaagcgttgatagaatcacggaaaagcagactgttagcattattgtcttccatcaggccattttgaagtttattgctcaattcctgcaaatcctgttccattttagccaaacgattgtattcctgctgagctctttcgggtgaaaggaaagcattgctttcatatttcttttggaattcctgtttttctttgttcaaagctgtcatcttctggttcagcgtcatgcgaacattttcgctcttctttaccatagcctcattcaagtcaatacagaaattgtatttagccaacaaggtatctatttcaacataagctattttcattccagacaattctgcattagccgaagccggagtagttgcaacttgattatcagctttgccggcgcattgtgagaataaaacgataaacgcaagtgcagctaaaccgttcatgaggtagtttattctattcataactctaaaatattgtttttaattaattagttcatactatcgttcaaggctttttccaactcatcaatagaaaaacgtgatttcttttgtgcttcacgatcctgcgactgcgcacaaccgattcctttcttacgcaactctttattaccgctcacatgaccattagggaacttcccccccttcgtaaagaatactttcacccccaataatagcagggaaatagcaactattaacaaagttatcagtatagtctcaaccatttctattaattttgtgagtgcaaagataggctttaatgagaaatgagttcagataagtcaagcaaattaaccatatttagcaataagaggaagcaaaatgaacctcctattcctattataaaagaaaaaagcatggaaaaaaaagaccttaagccggctggcgtattcaagtattttgaggaaatctgccaagtgccgcgtccttccaagaaggaagagaaaataattgcctacctaaaggcattcggagcaaaacataacctggagaccaatgtagatgaagcaggaaacgtactgatcaaaaagcctgccactccgggcaaagaaaactttcagactgtcatattgcaatcgcacatcgacatggtgtgtgaaaagaacaatgatgtacagcacgacttcctcaccgatcccatcgaaacagaaatagacggagaatggctgaaagccaaaggaactaccctcggagctgataacggtatcggtgtagctaccgaactggctatcctggcggatgacagcatcgagcacggcccgctggaatgcctgttcaccgtagatgaagaaaccggtctgaccggagctttcgagctgaaagaaggtttcatgagcggtgatattctgctgaacctcgactccgaagatgaaggagaaatctttatcggatgcgccggaggtatcgactccgttgcagagtttagttataaagaagtagaagtccccgcaggatatttcttcttcaaagtagaagtaaaaggactgaaaggcggacactccggtggtgatattcacttgggacggggcaatgcaaacaagatactgaaccgattcctgtcccgaatggctaaccgtcaggatctgtatctctgcgaaataaacggaggtaacctgcgcaatgccatcccccgcgaagcatacgctatctgtgcagttcccgaagatgccaaacatgacgtccgcacggaactgaatatcttcaccagtgaagtagaaaacgaactggccgttaccgaaccggacctgaaactggttcttgaatcggaaactccccgtaagatggctatcgatcaggatactactacccgcttgctgaaagcattgtatgctgctcctcacggtgtatatgccatgagtcaggatatccccggactggtagagacttcaaccaaccttgcttctgtcaaaatgaaaccgaaccatattatccgcatcgaaaccagccaacgcagctctatcttatctgcacgcaatgacatggcgaatacggttcgtgccgtcttccagctggcaggcgccgatgtgaccttcggtgaaggttatccgggatggaagccgaatcctcattcggctatcctcgaagtggcagcagaatcttacaaacgacttttcggtgtagaggcgaaagtgaaagcaattcacgcaggactggaatgcggtctgttcctcgacaagtatccgacattagacatgatttctttcggacctaccctcaccggagtacactctccagacgaacggatgcacatcccttccgttgagaagttctggaagcacctgttggatattctggcacatgttcctgccaagaaataacagtcaggtaagacatcatagaaaagatgatggtgatagcagaaaaatatttgttatgaccgtcatcttttttataatgctcttttttgtgccctcttatatcatagggcaaacatcctttacaaggcaaacttcccttatcgaaaaagaatcgttcagcaataaacaatctgtttcccaaaagaagtcttccgctgaagaacgaatcccctttcgtgtcatgagctggaatgttgaaaacctctttgatactcaccacgacacactaaagaacgataacgaatttctccccgacgctatccgtcactggaactacaccaagtacaagaagaaactggctgatatggcccgtgtcatcactgccgtcggtgaatggaatccacccgcccttgtaggtctttgtgaagtagaaaacgacagcgtactacgtgacctcacacaacgttctcctttaaaggaactggggtatcggtatgttatgacaagttctcccgatctgagagggattgatgtcgctttattatatcaacgtgacctattcaaattattatctttccggtctatccccattccctcattcaagcatcatcgccccacaagagatttactgcacgtcagcggactattattaaccggagatacacttgatgtaatcgtctgccatctgccttcccggtccggtggagccaaggaatcagaaccttaccggctacacgccgcccgaatactacgcacagaagccgacagtctgctgaacatccgccttcatccgcaactggtcatcatgggagatttcaatgactacccaaccaataaatccatcaaagagatattagaagctactgcccccaaacactcagtcaccttccccaatccccgaaaactctaccatctgcttgcccgaaaagcaacatcccgccattttggctcctataaatatcacggagaatggggattgctcgaccatttgattgtatccggcaatttactcgatgcttcctctaaattcttcaccggtgaagacaaggcaaatgttgcccgtctcccctttctattaactgaagacaagaaatacggtgacgacgaacctttccgtacctataaaggaatgaaatatcagggaggaatcagtgatcatcttcctatttacgcagattttgaactaattatatactagccgaaagagttttttatgttaataaacggggttcgatacaaaatttacttatttttgcagggtttacagcatttacaaaaaaatacccccaatggaaacctttgacgaaaaacaacttctgaaggctattagcgaaggagatgagaaagcctttaaaactttcttcctatactactatccccgcatcaaagggtttatcaacggactactgcaatcgcaggaagaggccgaagatttatcgcaggacatctttcttacgttatggaacaaccgctcatctctccataccatcaataaccttaaaccttatcttttccgcatttccaaaaatgcggtataccggcacatcgaacgcgcactactgttcaggaactatcagcagaaagaaactgaaaagtatagcccgccacaggaaagcaacgaaacagatgacaccatccatctcaaagaactcgaactattggtgacaatggttgtagaaaaaatgcctccgcaacgacagaaaatatataagatgagccgggaatcaggaatgaacaacgaagaaatagcccgcgaactaggcatcaacaaacgaacagtagagaaccacctttcacaagcacttaccgacatccgaaaaatattattcataacctttattctatttttctaaaaaaaagtagcatagagactgtgcgtaattaatcagttacgtatcttatatatgtaaccacacctaaaatgcgctaatatgtcgaacgctcataaaataattaaaaactttacttccgataagttcagtcctgaacttaaagagaagttatggaaatggcttgtcgactccagtgaacaggcagagaaagaagaagcattgatggaattatgggaagaccagaatttcaaggccgatgcaggtaccgaacgttcttatcagaatttccgcaggaagattgccccccgacagcggaaggcaaccgcaaggtataccttacgcagatgggcgcaagtggcggctgtattattgattcccctactctctatagtggcatcctacctatatatacaatcgaatgaagagcatacagaacttgtcgagtactatgtgcccagaggcgaacaaaagcagattaccttgcccgacggcaccacagcatacctcaactcaggaaccttactggtctatccgcaaaagttcacaggagatatccgttcggtatatctgataggagaagccaattttgacgtaaagaaagacaagcaacatccattcatcgtcaagaccaaccatctgaaagtgaaagtattgggaactaaattcaacgtacacgcttatgcggaagatgagaagacaaccactactctggaatcgggctctgtagtcgttcagaaagcaaacaatgaggatatcatcaccctcacacccaacgaacaactggaatatgacaacccgtccggagaatttaataaaaagattatcgacgcctctgtctactccggctggaccagaggcgagctgaactttgcggcaatgactctcagcgatattttcattacgatagagagaatatacgacatacacatcatcgtccctccgcatctggctaccaccgatgtatataccatcaagttcaaacaaaaagcccctatcaaggagatcatgaatatcgtgaccaaaaccataggaaacatagactataaagtcgaagacgagaacattctcttaatttattcacccctaaataagaaaggaggccgatagacagaaaaaagggagtcgatatttcgcggataccaactcccccaaatcaaaattacttcatttaaattagttgtgtacacttaaattagtattaatgattaactcacaaaagtatgaaattttataaattgtcgggcataggttatcccgtaaaaattcataaattttatatattgttattcgctttatgtttttataacatagcctatgggcaaaatcagccaataacggtatctatgaaaaaccaacctctattaaaagtattcgaaatcattgaagatcagaccgaatttagtatcgcttataatcagacgaaactggacgtgaaacaaaaggtcagcgccaattttgttagggaagcagtctcttccgttctgaactccgtactcaaaggaacaggattcacttacaggcaagaaggtaagcatattattatcattcctgtcccggcaaaggcagaagcagcccccaacaatactacttctacccagcagtccataaaaatacggggaaccgtaacagatgcgcaaggtgaacctctaattggagcaaacgttctggtcgacggcagcaaacaggcgaccattaccgacatgaacggggaattctcactggaagtgcctgccaacagcaagttacgggttacttatatcggttacgtcacacaagaagtaacagtcaaaaacaagacacttttcaacatacagctacaggaagatacccagactatggatgaagtggtagtcatcggattcggtacacagaaaaaagtgaatatgaccggcgctgtagcctctgtaaatatcaaagagtcgttgggcgaccgcccgattaccaacgtttcggctgccctacaaggagtcgtgccgggactaaaaattgaatcgacaacgggaactccgggagacgacatgacgtacaatatccgtggaacaacctccatcaatggtggtgagcctctcgtattggtcaacaacgtaccgatggatatcaacatgattgatccgcaggatattgaatctgtctctattttgaaggatgccgcttccgcagctatctacggtgcccgcgcagctttcggtgtgattctgattactacgaagcagggtaaaaaggacatggctcccagattcaattacaacaacaacttctctttctcgaaagcatcggagcttccgcagaaagcaagtccgttggaatcggtactggcgtacaaggaaatgggatgggcaaacgatacctatgtagacggaaaaaacatcacccaatgggaaggctacatacgagactatcaggcgaatccttccaattatccgaacggatatattttcgacgatcagggcaacctgttcctgatgcgggagaatgatatgtttgccgatatgatggataacttcggattcatgcagaaccacagcttctccgtatcgggaggcagccagcgtaccagctaccgactaagcctgggatataccggtgaggacggcattctggtaacggacaaagacaaattcgaccgtatcaatatgtccagcttcctgagtgtcgacgtaaacaagtggctgaccacccaactggatatcagatacgcgaactccacccagaacaaagtggagcaaggcggacgaaacggtgtctggggaagtgccatgtacttgccgtcctaccacaacatcctgccatacgaacaagacggcatcgaatatcctgccgaaacgtccgctactttcgtacgctacggagaaccgagggtgatcaagaagaccaacctgcgtactttgggacgtgtcatcatctctccgctgaaaggactgaaaataacaggtgaatatacctacaaccggatcaccgagtacaaccggatgtacgtcaacaaatacaagtatataggattcaactttacagggctgctgaacaatgtagagaactcacgttatgccctgacgcaaggtttcaccaattacaacgctattaacgcattcgccaattacgacttttcaataggtaaacatgatatctctattatgggtggttacaatcaggaagagagtcataaggaatcgcaatggtcgcagcgcacggacgtattactggaaaatctgccgtcgctctccggttctaccggaacggcatccgtcaccgacagtttcgatgaatatgctatcagaggtttgttctaccgtgtcaattacacttacgacggtaaatacatgttcgaagccaacggacgctacgacggtacatcccgtttcccgaaagacagccgtttcggtttcttcccttccttctccgccggatggcgcatttcggaagaagcattcatgaagaataccaaaagcttcctgtctaacttgaaactacgtgcctcatggggctctatcggcaaccagatcatactgaagccggacaacactccggaaaactatccctacatcccttccatgtcaccttacttgacagaatggctggtggacggacaaaagacgactacactgaatgcaccggcaatggtcagcagcagtttctcgtgggaaaaggtatatacactggacttcggagtcgatttcggattcttcgacaaccgctttaacggtactttcgactggtatcgccgcgacaccaaagggatgctggcacccggtatggacctaccgtgggtagtgggagccaccgccgccaaacagaacgccgctgacctgaagacgtacggctgggaactggaactgaactggagagaccgcatcaacaaggactggagctaccggatcggattcaacctgtacgactcacaaagtgaaatcacgaaatacaataatgagaccaacctgctaggcgacaagatttaccgcaaaggcatgaaaatgggagaaatctggggatatgtcaccgaccgcttctacacggaagacgacttcaacgcagacggtacactaaaaccgggaatccccattccgaaaggagcaggaaaagtttttccgggagacgtgctgtataagaacttcgatgacgataccgaaaccatctggagcggcgaaggaaccgccgacaatcccggcgaccagcgtatcatcggtaactcgactccgcgtttccactacggcatcaccgcaggaatcagctggaaaggactcgacctctctatcttcctccgaggcgtaggcaaacgggattattggcgcaccgaccagatcgcatggcctaccggaggctggggaagcctgttcaaagaaactctcaacttctggactccgactaacaccaatgcctattatccgcgtgtgtattccaacgacggggtaaacacaagctacaaccactggaaacagtcgaagtatctcgccaacgcctcttacctgaaactgcaaaacatcacgctttcctataccttgcccaaagtatggtcccagcgtctctacttcgacgatgtgaaagtattcttcagcggagagaacctctacacgtgggatcacctgccggaaggactggaaaccgatatgctgtcaaaaggtgcctgggaatatccgttcatgagaaaattctctttcggtatcaatgttacattctaataaccaatgtattatgagaaaatatttaatctttatatgtacagttttgttagcaagctgtctcaataacgatttcctggaaaggtatcctttgggagacccgactgccgaaacggcttttgaaacatacgacaatttcaaggcatacgcctggggattgtatgaaaccctgccttcattgggctatggctcggaaaattctacggacgacatctcgtacaaccagacaagaggaaccagcgaaagcaactggatcagaaaactggtgaccatccccgacaagaaagacaatacttcctggaactattacagctatatccggagggtcaacctgatgctcgaccgcattgacggttcgaaaatgacggatgtagaaaaggcgaactggcgttccgtcggttactttttccgtagttaccgctacctgtctctcctgtcggcttacggtggcgtaccctggattgatcatgtgctgagcgacgacgaaacagaactgatcaaaggccctcgtgcctccagagatgaaatagccggtcacattctggaagacctgcaatttgccgaaaagaatatcaacgtgaacggagaaggcagaaacaccatcaacaaggcttgtgtacaggctttactctcccgtttctgccttttcgaaggtacctggcgtaaatatcacggactcaacaacgccgaaacttatctgcgggaatgcaaacgggtatccgccgaactgatgcagacttatccgaacgtggcggactgctacgacgatctgttctgttcactggaactgaaagatgttaccggcgtcattctgtacagagaatattcggatgctgtcggtgtagtgcacgctgtcagcatcgggggaacgaccgctacctccttttacaatccgacccgcgacttagtggacagttacctgtgcacggacggaaagccacgctggacgagtgacgcctatctgggtgacaaggatatatacgacgagttcagcaaccgtgaccatcgtttgtggctgcacgtcactcctccttaccgggtagaccgttcggcttccagcacagcctgggacaataaatggaaatttacggataactccaaagaccgcagttttatcgacagcctcaccgtccgcatgggaatcgggtacggcaccagcaaggaacgacagaagttattgccattccgtcaaggatatgacggtggtattctgggtgcatcgcctcactttgacttctatctggagaaccagccgtggtacaagtctgccttcggatataacaactggaaatactattgctgctacctgagcatgggcagccaacgaaatgaagagacggatatgcctattttccgcatcgaagaagtcatgctgaactacgcggaagccatgtgcgaactcggcgagtttgaccagacagttgccgacgtcacaatcaacaaactgcgcccgcgtgccaatgtaaaactcatgaaagtctcggaaataaactcagccttcgacccgaaacgtgatctcggaaatccggattatcccaacgactacgaagtgagtccgctattatgggaaatacgacgggaacgacgcatcgaactattctccgaaggattccgtttcgacgacctgagaagatggaagaaatgccattatgcactgaagaagaaactcggacaatacgtacgtgcatccgacttcacggcaggaaccaatgtgactatcgacggtggcggctccgaaggatatctcgaattccatccgaaacagaatcatctatggccggattactattacctcaatcctattccacgcaacgaacgggtactgaatccccaactcgaacagaatccgggatgggaggaaggaaattaaccggtaatccatcaccaaccggataatccggaactaaccggaagaggctgtggcaaatattggctcttcttgacagtcatcccaatgacaggacaagcatttcgtcattagcgtggctgaaagaccttgatatttgacactgcctcttccctttttaactgtattgatttcgtaagtttactcaaaagaataattgagtacttgaaatttattcgtatttttgagacatcagactaatacgggtaatccttttgccgactcttacaaaatctaaataaacacactgtaccccatgaagcacctaatttttacagctctctttcttctatcgtacacagtcgccgtccgcgcccaaatcgtatttcctacccccaatcaagtagaaatgcagacaggcaacctgattttagggaaaaaggtttctatgtacgccgaagacactaccgctttttatctaaacctttttcgagaagaagtactctcccacactcccatcaaatggcaaaaaaaagaatccaaagccgatatctgctggataaccgactcatccctgccccccgaaggttaccggatcaagattcatccgcaacagatggtaatcagcgcctccgacaaaggaggattcacctatgccgtacaaacgctacgccaatgggtagccggttcagcaggatctatcacctttgcctgcgcaagcgtgacggactatccccgcacacagtggcgctgcttcttactggactccggacgtcagttccagaagattaccaccatcagaaagtatatcgacatggcttcactgctcaaaatgaactacttccactggcatctgaccgaaggactgggatggcgcatcgaaatcaagcaatatccgcacctcacccggactggcggttcggtaggcaaaggagaagaacagcagggattctatacacaggaagaaatacgggatatcatcgaatatgcccgtcaacggaatatcaccatcgtccccgaaatagatatgccgggccatgccgaagctgctctctctgcctatccggagctcggttgtttcggattgccggtagagataccgcaaagcggatttacccagaacatattttgtgcaggaaaagacggaactctccgtttcctgaaaaacgtactggatgaagtatgcgccctctttccttctccctacatacatctgggcggagacgaagccccgaaaggcaactgggatcaatgcccggattgccggaaaaggattaccacagaaggactgaaagacagtcacgacctccagctatggttctctgcgcaaatggcaaactatctgaagtcgaaaggacggaaagccatcttctggggcgacgtagtctatcatgacggctacccgttgccggacaatactgttatccagtggtggaactatcggggacacaaagacctcgcactcagaaacgccgtcaaacaccattatccggtcatttgcagttccaactactatacgtatctgaacttccccgtcaccccgtggaaaggatatacggaagcacgtacgttcgacttgaaagatgtctatctgaacaacccttccgacaaagccatcagcgagaaaaatccgctgatacttggcatgagctgcgcattatggaccgacgacggagtcacggaacgaatgatagaccgacgacttttcccccgcatcctcgctctgtccgaacagatgtggcacgagggggaagcgcttgacttcgaccggttctaccggaacatccttcaccgcaaagcatggttcgaagaagctggattcgaattcggaccggctctgaaagaagatgtaacgaaagattataaatgggattaaaaaaaagaacatcatgaacaaaagaaatttattgatcgcaatacccgccctgtgcagcggttacctgcacggacaaacccaacccgcatctcccaacgttatctatattttaatggacgatctgggatatggagatatcggttgcttcggacaagacaaaatagaaacaccccatatcgaccgtttatgcagcgaaggcatcaaactgacacaacattattccggttcccccgtatcagctccggcacgctgcgtactgatgacaggtatgcactccggtcatgcgcaaatccgcttcaacaatgagttagccgaacgcggagcagtaaacaactacgactcggtgtacgttcataaagagctggaagggcaattccccctacaggcgaacacgatgactatcgggcgaatgatgcaacaagcgggatataccaccggatgtttcggcaagtggggactggggtatccgggttccgaaggaactcccaacaaacaggggttcgaccgattctacggatacaattgccagcgccagtcgcacacatactatcctccttttctgtataatgacgaagaacgtgtctacctgtccaacaaagtgacagaccctcaccgaagccctctggataaaggtgccgatccgaacgatccagccagctacgctaaatatacgcaaaaggaatatgccaacgatctgatctttgatgaactgatgggatttgtcgatgccaataaacgcaaaccgtttttcctgatgtggaccactcccctgccgcacgtctcgcttcaggcacccgaacgctgggtacagcattatgtaaagaaattcggggacgaaaagccttacaccggacaagcgggatatctgccctgccggtatccgcatgctacctatgcggctatgatcagttatttcgacgagcagatcggccaactgatcgaaaaactgaaagcggaacatctgtacgaaaataccttgattgtgtttacttcagataatggtcctacgttcaacggaggcagcgattctccctggttcaacagcgggggacttttcaattcagcatacggatggggcaaatgtttcttgcatgaaggaggtatccgtgtccccgccattatcacatggcccggcaaaataaaacccggtacgcaaagtgaccacatctgcgcttttcaggacgttatgcctacgctggcagaactggcaggcatcacttgtccgccaacggacggaatcagctttctgcccacattgctcggcaaaaaagggaaacaaaaagaacacacttatttatattgggaatatcctgacccaaggattggcaacaaagcaatccgcatgggaaaatggaaaggaatcatcacggacatccggaaaggcaatacgcaaatgcagctttataatctggaaacggacatcagagaagaacacgatgtggctgcgcaacatcccgatatcgtaaaacgcttcgaacgactgatgaaagaagctagaaacggtccggacttttaacgaccttccttgctaactaacgggacataccggagcatcatccgtaacatccctgcgaaagacttgtgccaacgctttggcacaactatgccaacagcttggcacggccgtgccacaggcgtggcacagttgtgctaagcctgtggcaaagatgtcccctatagagttagtcagaatactggtataccttcaagtcgaacttcggcaccatcgccagcaaatggtcgaagatatccgactgaatccgctcgtactctttccacaccttattgcgggaaaagaaataaacctgaataggaactccgtacatggtagcctctttctgactgataatcaaatccaaatcctgattcaccaccggcagactgcaaagataccgctcgatatacacccggtaaacctgtgaattggtgggcaccactccttcctccggctgataatccgccatgagtggaatctctttccgataacggtcgagcatctccggcgtacaaaactggagtgtcgtcaggtccagtgtaatattcttcatcacccgccgcccaccggaatccttcatgccacgccagttctgaaaaggactgctaaccagcgtataaggcggaaccgtagaaatcgtattatcaaagttctgaatcttgaccgtgttaagcgtaatctcctgcaccgtaccattcgcggcaccggaaggaagcgtgatccagtctcccggacgcaccatatcattggcagaaagctgaatacctgccacaaatcccaaaatggaatccttgaataccagcatcaggatggctgccgaagcacccagtcccgcaaacagactggcaggcgatttatttacaaggatagagataatcacaatccccccgataaaaaacaaaagtacctgaagtacttgaatgaatcctttcatcggccggttcttcattgtctcctttccatcgtaaatatccatgatcatcagcagaatcccattgatagccagcagcaaagaaaagatgatataaatggcacaagccttctgcgaaataaccagcagttccttgccacgcatgaaagccatcggcaacagggcatagacaaggatggcgggaatcgtatgaatcagattatgaaacactttacgtttcatcagcaatgtattccaaagatgcggtttcctgcgggtatactgcctcattcctcccactagaattgcctgacaaagatagtccacccctacagcaatggctatcatcagtatagcaataattgtttcatcaaaacgatcggcaaccttcgcatctatcccccaatctatcaggattttgttcatccattttcctaaatcgactactaacataagttctttctttatatatcatttatatagaatgataacagtgaaaacctacgtttggtttaaaaaaaagactggcgtccgatttactagaaatcaagaccgccagtcccactgctactctctaagcatttcttttatagtggcagaccgtagcgtccatctacaattttctccaactgtgctgccatcttctttaccagttccggattctgacccgccacattattcttttctttcggatctttcttcagatcgtaaagctgcggttccttactgtttcccaactcgatattcactgctttcagatatgccggtccatttcccggacgaagatatttccatcttccgtctgtcaccgacaggttattctgtgcattctgaagtaccagccattcgcgtcccttcttttgcttgcctgtccacgctttcagcatcggttcactatccggtgccgcaccttccggcaagcggacattcagcatttcggcaaaagtagcaaaccagtctatctgacagagcaatgcatccgaaactgttcccggacggatcacaccctgccagctccagatacaaggaatacgtgtacccgcttcgaacgaactgtactttcctccgcgataaatgccgcccggagtatgatcgcctagcaattccactgcctgatccttatatccgtcgtccactaccggaccgttatcactggaaagaatcaccagtgtattcttatccaatcccagtcgttcgagtgcattcagaatctcgcctaccgaccagtcaaattcgagcagacaatcgccgcgaggtcccatgccgctctttcctgcgaactgtggagacggaacacggggaacatgcgcatcctgcgtggcaaaatacaggaagaaaggagcagacttgtgtccttcaataaaggaaacagcttttcctgtcagcgtctccgcaatcttctcatcctgccagagagccgactttccgcccttcatatatccgatacgggaaataccgttcacgatactctggtcgtgtccgtgagaaggatgcattttcagcaactccggattgtccttcccggtaggttctcccggaaagttcgctttgtaacttacctgaatcggatcattcggatcaaggttgatcacctgatcattctctacaaatacacaaggaacacggtcgcccgtagctgccatgataaaggaatattcgaagccgatatcattcgttcccggctgcaaaggcttgttccagtcttgttctccgcccttgtcgcccagtcccagatgccatttgcctacgactccggtgttgtatccggcatccttgaacaggttcgccattgtatagcgttccggacggataatagccgcagcgtctccggcagcaatacctgttccggctttgcgccatgcatattcaccggtcagcatcgcatagcgggaaggcgtactggtagcagctgcactgtgcgcattggtaaaacgtactcccattttggcaagacgttccacattaggagtatgaatagtcttggctccgttacaactcaaatcgccgtaaccgatatcatccgcatagataaaaacaacattcggacgctgggtttgtttctcctgagcagtggtctgagaagccagacaggaagttaacgctaaaggtaatataccataaaattcttttctcattttgtcttttgataattattaggttagaatgaataagtatctattctcaaagtgatgtacttattaagttaaaattcaaagcttcgtcaaggagctacggtcactccgatttcattcatttctacttgcgccgttgtagccgtaggggtggtagcttccagcttgataaagcgtgccttttccttctgaccgaaagtgacagtctgcggcaacggattatgcatgatattgctgaactcaccgttggcaggcacttccttccagttcttgccatctgcgctcacgtagaatttgtaacggaaagccatcgtcggtttcgcttccgctttcagaggtgcataagtaaatgcggagagttcgacttctttgcccaaatcaatggtcaacggagaagcagccacctgtttccatgaagcacgaggcagattgttccagttttccgtccggttctcttcttccaaagggtctgcatagtaggctgccacctgactgatgtgagccgtcagacgacattcgttgatcttcacccgaagctgggtagcctttactgccggaaaacgaaccatacgcttatagcctacagtcgttcctttcgccacttcctgccagccttgttccgtcaatgcctctacggtaaaagactccacccgttgccctttcgtgatatcttcctgcaacatcacaacgttgatttccgactccggtttcaaggaataaacagtttcactgccggaaacagcctcccagtcttttcttcctttctctacccggttgttcgtaaatatcttctcccgataagcagcaaattcgttcaaccgctgcacatccgcttcattaatcaatcctctgcggtcgggaggaatattcagcaagagcaccgagttatagcctaccgattggaaatagatatcagccagatgttttaaggatttcactttgctgtcttcttccgcatgataaaaccatcccggacggatagacacgtctacttccgaaggataccagaataactccgttgccttttccagcatcgcacggcttcctaaatcttcggctttgctaaagacgcccagtcgtttgttgttttcttcggaacgagcataaatgcccggagtcagcaccgttgcactccattccgtttcgcgtcccaatcctttttcattacctacccaacggacatcatcgcccataattgccatcaccgctttcggctgcaactgttggatagtcttgtagaacgcatcccagtcatagatttgtttctttccgttcggtccttctccgtttgcgccgtcaaaccacacttcgtgcacttcgccgtaattagtaagtaattccgttaattgccgaataaagaattcgttgtatttaggagaatctccgtagcattccgcattccggtcccacggagagaggtagactccgaatttcatatcatatttatcgcaagcgttacgcagttctttcactacgtcgccctgaccgtttttccaaggggaagaggctaccgaatgtttcgtggtagctgtaggccacagacaaaagccgtcatgatgctttgccgtgagaagtaccattttaaatccggcgtctttcaaggtgcgcacccattgttctgcatccagctctgtagggttaaagatagcagggtcttcctgaccatcgccccattcgcgtccggtgaatgtgttgataccgaaatgcaggaaagcagtcagctccatttgttgccacgcagcctgctggggggtaggaaccagccttgctgccatatcgattttttgttcgagggttgcatcctgtggaaattcaacatgcttcacatagtagttttctttcgtcagtccacatccgcccaacgttatcacagaagataaaaagagagaagtaagtagtttgttcatcataataaatattgatttaatgctaatgagacaaagataaatataaaggagcaaatttcatggctttcccgaagcgcttttcattaaacttcgctaaatccatgccattcgctcccctatattctatctcaatgcaatatttctatccaaatgcaatcagtttcaggctattttaccggataaagcgtaaattcaaaactctgctttttcaccggtaccagatattgcggcaatacacccggtccgcaggtagccgtacctactcctgcctgttcggcatccagatgtatagttatcattccgtcacgctccagttcattaatgtggtgcgccttctctaataatacatccgagaaaggaatgatactaaactggaaaggacgattcgattccataaagacaccttcgcctgcctgatccgtcagtttcgcccagcgtacatctgtccggttagctgtagattgtggggtagcgtaatagtggaacatccgttctaccgtcgtatcatacagtcctatcctaccggactggttgcggtcgatatacgtttcatgatcgccacgtcccagataagatacttgattataagcatctgccatgcggaaggtcagccccagacgagccatcgacttcacaatcgccgtatccggctggaaggtggtgcgaaccttcaatgccccgttcttgtcgagtgcataaacaaaatccgccattcctactttctgtcctttcccattaagaatctcagcacggaccgttgccgatgtcttttcttctttcagtgacaccactttctgtgtcagattgttcaaacctgccttgcgccacagacgggctccgttcctatcccggttatcattatccgtagccggacggaacaggctcaaagtgattggtgcagccagcaattcctttccatccaaagtcagggaagaaagtgccccggtattcttgtccacaacaaaagctgtttctcccgccttctgcggacgataagccgtcgtattcttattaccggcaagtacaaactggtcgtatgccacttcccagtcggtatccactagcggagtggcctctttacggctccagcttaggttcagataggcttcccgaacggtattcggaagtttgacggcacccaaagtgacatctaccgtagcgtgcggctcgcagtctacttccttcgtgccttcggcaagtacggttccatcctcccctttcacattccaacgcaggatatattcattcagattagaaaagtcataccagttctttatgcagactttcagattcttccggtctgacaaagtcgctttgatgttctgatatattttcttcacttcgagtagatgcggatgcggttcacgaacagcattcaccagaccgttgccacagaaattaccgaagctggggattccttccggtccgtaatcgcctccataagtccagtaccattttccgtctttgtctatttcacggaagttctgatccacccagtcccaaatgcagcccccttgtgccatcggctcattttcaaagacttcccagtattctttcattccaccgcaactgttacccatagcgtgcagatattcgcaaagaatgaaaggacggtaaatatccttcttacccacgtatgccttaatttcgtccacactgcggtacatacggcaatagatgtccgtgttgtaattcagttcagcacgttcatattgcacgggacggcctttctctaccgatttcagccagtcgtaagtacgttcgaagttgatgccgttgccggcttcattgccctgtgaccagatcacgatagccggatgattcttggaacgttcgtacatacggtgtgtacggtccatgtgagcggtcagccaagtactgtctttggcaagggaggcaggcccgtatcccatgccatgcgattcgatattcgcctcatcaatcatatacagcccgtagcggtcgcaaagctgataccagtacggatgagtcggataatgtgagttacgcaccatgttgatattatgctgtttcatcaggcggatatcctgttccatcagttctttgcttacggtacgtcccagttgcgaatgttcgtgacggttcgtccctttcaccagcaccggaacaccgttaatacagaaacgtccgtccttgatttccgaagtacggaaaccgacttcacaaccggtcagttcggttacttttccttgcgcatcttttaattcgagtaccaaggtataaaggttaggatgctccgcattccatgcttttacttctgcaatcttcttctcatcgaaagcgataaagttactcagtccacgggacttgatgttaatggcatcctgcaatactgcctttccggaagcatccttcagtgtataagcgatagagctggcagtagcagaagggccttccaccgtcacttccagattgaagataccttctttgtatttctctttatcaagggaagcacttactttatagtcagcaatatactgtttgggagtgctatacagataaacatcccgttcgatgccactcagacgccacatatcctgacattccagataagcacccgaactccagcgatatacttccagagctaccacattctctccttcactcagtacatcggtaatgtcccattcggcagccgtcttcgatccctgattatagccaagcaactttccgttcacccatacataatagaaagagatcactccttcgcagcagagcactacccgacgtcctttccagtcggcaggcaccttaaacgtgcgacgataagaacctacttcattctcagcaaatggaaccaatggcggattcttcttgaagttgaacatcttgtcgtcaaactcataagtttcgttgacatagatagctgttccgtagccttgccgttcccagttgccgggaacattaatatccgcccaccctccggtataataagagggctggtaaaagtccttcggacggttgtccgggttcttcacccagttaaatttccacttcccgttcagactcatataataaggagactgttcatatcctcccggctttccaatatcggaagcgtcggcgtaaggccatacataggtatgaggagcgagtttattcagtcctaccgcatactggctctgccactccggcaaaggctgtttctgagccgaagcgaaggtagcagtcagtgctgccatcaagattaaaaacgttcgtttctttaatttcatcattattatattgttttttggtgactggttattcaatgatcagttcatcgaaacatactcttgattcttgtccgggacgtacatgatttgccggacattctcccgctccttccgttgtaacccgcacataacgggcaacggttcctctcatatctatcgacaggtcttcgatgaaagttccttcacggaatatctcctcgggagtatattccaattcgttgatatcccgataagtcgcattatcgtccgacacggctacccggattgatttcggtttgtgcactcccattccatagttagtgatacaaccgattgtcagcgtattcattttctccttttgcaacagatcgacggtgaaggaaatacggtcgctacttccccaactgcaccattcaaagtccgtttgcttcagacttcctctgactccgttgttcaggacggcttcattcactttattacccagcaacggttttgccgtagccttgttccagtgtaccggaagcgtcagtgttttccccatctgctgtccatcggcaaacgttgcggcattgactgtttgagcttcttttaccaacaatggttgttcatagagcggtgaagcggcggtcggctcgcttccatccattgtataacggatttccacatccggacggacacattccagttttactttcagtgctccgtcttccggtctcacggtatgctgtatattgtacatcgaacgggcatacactatccctttggctgcgagatgttcattaaacgaatccatgccttccaggaacgaagtccagtctttcttttccggttgtgtccatgccacttccgccaatgccgccaggcgtgggaataccaaataatccacatcctccggcttattacagaactctgtccacatacaagcctgtacgcccatcagcaaatccgcatattccggtttccagtctttctgaaccggctcatagtcatacacatctttcagcgtattattgccgaaatacgtcagcggctcaaaccactgcggtccttgataacgaatcaggtacatgatgcgtgcgggagtcatgatgaagcgatgtcccttctcggcagccttcagtgcagcctgtccgtatccctgccaacccagaataatggcatcgtccggcaaaaagctactgttcgtcagctcatcccagcctatcacctcgcgccctttgctacgtacatattcgctcatccgattcatgaaataaccttgcaaatcctcttcattggcaatcttctcctttttcatccgtgcctgacacagcgggcatttctcccaataagttttacgggcttcatcgccaccgatatggatatatcgggaagggaacaattccagaatctcatccatcacatcctgaagaaaggcatagacactgtcatttccggcacaatagatgatctcggaatttcgtcctcccaaaccggggagcactccgatatattccttcactaccggacaagctaaatgaggataagctgccaatgccgaattactgtgtgccggcatatcgatttccggtaccacttcaatctgacgttcagccgcataagccaccatttcctttatttcttcctgtgtgtagaaacctcctaccggagtgggttctccgggttccggattccgccgggcaggaaaaggcaggtccgtacgatccactctccatgcacctacttccgttaaacggggatatttcttgatttccacacgccagccgttatcatctgtcagatgaaagtgaagcgtgtttattttgagcattgccatacaatcgataatgcgcaatacattctctttgggaataaagaagcgtgacgcatccagcaataacgcacggtaaccaaaacgcggttcgtcctgaatactcactgccggaatactccattttacttttttatccgacacttcctctttttcgatggatgccggaagcaactggcgaatggtctgcaaagcataaaagaatccttttgcatccgatgcttcgataataatttctttcggagacacttgcagcgtatatgcctcacttttcaaggttgcatccgtctggaaacgaacatttcccttttccgcatcgcctaccgtcaacttcggagtaaagcctgccgcacgggtaaacaaagctataaagctgcgtgccacttccgcctgctcctcattctctacggcaaataccgttttaccggagaaaaggtagttcccgctgcccggcactatttgcgccgggcgtggaaccaagggtatgtcatgtgtcaagttagtatcgctacatccggctactatcgaagatagaaagcctatcagtaatattaaaatcgttcttgtcattgtattattcgggggttattccttgtccctttccggagaaaagcggacgggatcattatattgttcctgtagtttcagcaattcgtctttcagttcctttactaccggttcatactcagcctcaccgtagaggttgtgcatttccgacgggtctgcctgcatatcatacagttcccaccagttgatatcattatagaaatgaatcagtttatagcgttccgtacgtacgccatagtgacgtttcaccatgtgttcggcaggatattcatagaagtggtaatacagagactttctccagtccttcggatgctcacctttcaacagaggcagcagtgatactccgtggatatctgcgggaatttccgctcctgccagttcaaggaaagtaggtgcatagtcgatgttctgtaccatttcggtgatatctcccctgcggtcgaaacctttcggcagacgcatgataagtggtgtgcgcatagattcttcatacatgaaacgcttgtcgaaccaaccgtgttcgcccatgtagaaaccctgatcggaagtataaactaccagtgtattgtccagcaaccctttttccttcagatagtcgagcacacgtcctacgttatcatcaagagacttcacggttttcatgtagtcgcgcatataacgctggaacttccagttggccagttcttttcctgtcagattctgtttgtagaaatcatcgataatcggagcatagaacttgtcccatgcggcacgctgtccttcgtccatgcgtccgaggaatctttcataaagtgatctcaggcgtgatttctcattcggacgaagcatcttcaggtcgtaaatcatatccatgtccttcacgatactcatttcctgagcagccgcagcagggcgaccttcatagtcgtcaaagaaattatccggcaacgggaatgtcttgtcctcgtagagagcaaggttacatgtatccgccatccagttacggtgaatcgccttgtgatgaatcagcaggcagaacggtttctccggatctcgcttgttttccatccagtcgatagcatcatcggtaattagattcgtgatatatccgtgtttctggatggtatcattatcttgtgtaataaaggcaggattatagtaatccccctgtccgggtactatctgccagtaattaaatccggatggcaaactttccagatgccatttgccgaccagcgcagtctgataacctaccttttgcagcagcttcgggaatgtctgttgagaactgtcgaatacgcaagtcgtattatcgtagaatttattggcacagctatgcttacccgtaatcatacaggcacggctgggaccgcttaatgaattggcaacaaagctttgagtaaaacgtacaccatccgccgcaatgcggtcaagattcggagtttccatgtagcgggtgtcatagcagctcatcatctgggctgtatggtcgtctgtcataatatagacgatgttcagcggcttttgttctgtcgttttctgcttgtttgtacaagatgcaagggaggcaacggcggctactcctgccaaagaatagaacaagtttgattgcaggttttccataatgattaatttatttagattacatggcaaagatagggaagatatgtaaaaagtatgtctacaaatagctaatgtatttacaatattctctatttccacccgaattagcagtaaatgccggaagtaaatcgctgttgcacgatggccttccggcattgaacttatttcatactattgaaaacggttcgtcaatatgacagattaatagaactggtagaacttaccaggaattgagactttatagtctctattcacaagttcattcgcttcccgtttatagttatcatttacatagaaacgaatccagtctattatcattcttggtccttctgttgcataatttgcaggattaattgacttcagttcagtatcccaacctgccggaagttcagaagaaacactattaccttctccgaacaagtccattcgcattactaaataaagacctttcgctccaactgatgttcctgtagaagctttggtaaaaggccatgaatccaacatatcccttgtgacttccaaggttgtagaaccattaatacctaactttattgtattttcatcgactagttcgacccaataaatattataatcttctactttaggaatagcagatactacgctcttcgcatcactgacaacctctcccctcaccgattgggtgattgcagagccggaaacattcttaagtatacagattgattgcttagcttctttacatgtagtagcagttgctggattcttcacctctatcatcggtacaaatcctgttctattacctcctaaacgaactttcatttcaatacgcatacccggatatatacgtgtaacattttgtgcccacatctgccctaaagacttacagcaatgtattcctgctgttccataattagtaccttctacacctacacaaatattcaattcaccttcatcagtaacttttgcgtatttgatccaatcaatctttaaaacatttcctctattggcatccgttgcattacctaatttttgataatctcccgatgttgaatttttatggaactcaatagcataatcaaacttccactgactgcccaattcggcattcggatgtgctgttccttcgtccatcttagctgtttctttacccgtaaaccagtcatcatcataagaaacaaacatgatgttcggattctcatatacagtagtcatatcatacaaatcaggatcagccattgattccaggtctgtcatggtaatagtcaatgcaggagcagtcatcggattggaagaagaattacttttcagattcaataccaactgcaagtcgcctgtcatttcatagtcctgtttgatagtcacagcagcacttttgaccgaagttcttcctgcaggaatagttaaagtagaaggtagattgtcatacctgccctcttccccttccttcggagtaatagtgacttcgagtggcacagaactcggtttgtctactttggcaaccaatacaaacttaccgccttctgtcaccacattttctgtattattttccagagacatggatatccgataataatcagataccttgattccctgactggaattagccatcttataaccacgtgcgaaagcaacaaactccatcgtagtagtaccaactaatccggaagtcttaaccggaaaatccacctgaatctgcttctctcctttcgggaaagtaacaatactactaaatggttcgaacacattcgctacatcttccgttccggcttttgccgtaaagtaaatatcgaaatcttcgttagctaccacctcattaccatcagcatctggttccactttaatatctactttcaagtgttctcccatcacaaacgccttttcattgatgctcattgtcaaaggtacagcttccggcagaggacgatacttggtctcatcctcacatcctgtcaaaccgatggtcaacaaacataccggaagtattttatataatatgttcttcatatctttatctatctaattatcataaatgaatcttgttccattctcctatttccgttgccagcccggattctgtttcaactcatgattcaacgatatctcactcggaggtaccggcaacaggtaatcgcggttagcatcaaactgatagcctctcggaagaagttccttctgtgggtcgagccagccgtctgtagtcagaatcgttttcaagtccgctgcgtttttaggatcgaatgctttgtacaatacaccgtctgtaccaaaataagcaccggttccacgttttccctgaatcagtttatgagctctccaacgcatcaaatcatcaagacgaaaaccttgcaaagctagttctgcacgtctttccctacggatttcctgcaaattggcagaaatggtataaccaaaatcggtgaaattaggatcgatttcagacgggtctttgtacgtcaccccagcgcgctctcgcaatggttttaaagttttttccaaaacagcaggagtacattttcccaattcttccgcagcttccgcataagccagcagagcttccgcataacggatcaccggaagagacgtctcgccctgaccgcttacatatgtagtatcgatactcatacggatgtgataaccggtagcattacgcgcaggaccgccttcagtcagataagggggacgaactatctgtttgttctcttccgaatattcctctaccagcatcgctttcgattttgattccggtgaggttgacttaaacttacaatttgaatgcataaccgtcgccagcaaacgtccgtcacggcctttaaaagtcaaattgaaatctttaaaaatgccgtcagcaggattgataggtgttccgtcagcattcaagtaattatcaaccaacgactgagataaacctgccggtccgctgttatctacataacccgctcccagattactgctcagattatgaatcacaccatctgctatcgaatatttcttccaaaatacaacctctgtcatatccgacaggtctttcgagttgaatatatgcgcataagcatcttctatattcactgcattcttatcggtagcttttgtgttcaaagcaagtcccataccaaacagttcatcgcccagtgtcagcacctgtcccagtaagtctgccgatttatcttcagcagcggcaaagtctgttcctttgtgatatttctcccaggtaccttcataaagggccactctcatagccataataatagcggcctccttacacactctcaaacctttatactggctacgcgagtgaagtaatcccttagctgtattcagatcgtcaagaataaactgcgccactgcggaacggtcacgcggaggaatctgcaaaccgccgacagttgcattgccgtcccagaatctatccatcacaggaatacttccaaatctggtcagcaaataaaaatgccagtatgcacggaaaaaataagcctcacctttcattgaaagtacatctttcgtctcttctgtttccggcactttatagtattcaaagaaataattcacattacgcaggttctgatatcctttctgccattccgtagtacctcctccgttttcctgcaattctccgttcagacgtttgtcataaacctccgcaacgatattatcactgttcttctcttctccacgaactcccatatcgtaagtcccgaaagaaggaagtgctatatacaaaccgttgatatagttgttcacggcacttgcattggaaaggaatgtctcactattgggtgttgtcaaaggctctctgtccaggaagtccgaacatgccgacatcatgaaacttgccccaaccactaataatacatatatttttttcatcgtcattctctaattaaaaggtgaaatcaagtccgaatacgaagttacggttcatcgggtataccataccgttaccattctgcttcataggagaagtcagacccggagccgtattttgagcatcaccgccagccgacatattcacctgattcagtgtttccggatcaaattgtttcggcagtttcgttacggtgaataagttatcgcaagtcacatatactttcagattgctgataccaatatgtttcagttgttttttgttgaaggtataagcaaccgtcagattcttcatacgcatgtaagcagcgttcaacagataacgtgtggtgttatatccggtattcaccaaaaagtctttgtcatccttccagccggtcagacgcggcaagtatccattcggattctctgtgctgaaataatcgagatgttctttgaaattgtagttgtttccaccaaacatatagttacttccggaaatcggaaaatctctcttagccacaccttgcaacaatgtagatacttcaaaacctttatatcccagattcaagttgataccgaacgaatatttgggagtcgtattaccaataatctgcaaatctccgtgatcagccaaagtacctttaccaccgtctactctaccatccccattggaatcgatatattttaagtcaccgcgacgccaaaggtcattcgacttgaacgctgtcagatttacatttctcaggtaatcatcaatttcacggttcgacaggaaaagatcgtctgcgcgatatccccatatttcaccaatatccataccttcataataacctttattggcagccagacctgtatgattattgtaaatgataccttcaggattattatacttggtcacgacagccttgtagttaaatacattgaaaccgactccatagctaaaaccacatttcagtttatcattccaacttacagaaagttcccaaccacggttacgcaaagtggcattgttcactttagcacggtcatccgaagcaatgccactgatacttgggatagactctgccggaccaatcatgtcacgtgtcgtacgttggtagaagtcggcagttattgacaagcggttttttaataacattaagtcaaaacctaagttggcattatccactttctcccaggtgatgtatgggctgatcattttcggagtcttggcaattgttcctttggacgccgtggaagacgaaattccgggcagcagccaagcgttggtcccttgtgcatccaacggcatttgagcaatgtaatcatataggcctgcaccattctgatttcccagacgaccataagatacacgtactttcaactgagacacaggaagtgccaattgctggaaataaggagtgcgtgcaatatcataaccggcagagaatgacgggaagaatccccaacggtggcctggagcaaaacgggaagaaccatcataacgtccgctgaactccagaaaataaatattattgtagttccagttcagacgagtatagaatcccatcgtagcccagtgtgaacgggcttcacctgctatcacatttccgctggcattatcaaatgaataaatatcgttactcaacataccgtctttatacatatattcttccgaatactcctgcaattccatctggtaacccgccattgccttaaagaaatgatctccccactggtgagtataagaacttgacagattaggcgacagataataattaaacatgctaccacgtgtgtaagagccgaaatacatgtttttccagctaatgcccggataagcaaatccttgtcgctgattagtagcatcgcccggtttgaaagtgcctgcaggagtttcgtacttctggtcatctttcattttcaggttattattttcaacatcaaaacgtattttcatttctccggtgatatcccaaccttccaaaggagttacggtagccgaaaacgacaaggcatccgaaatacggtttctctgataattggaatttttcagatacaacatttcattccagctaggtatattatattctgattcaactggtagttcagtcacctgagtcggacggtggctaccgatcttattatacagaatcatctgattagccattgggcgtttgatcatctgcaaagtaatattgttattcaggttgaagcgcagccagtcacttgtcttaaactgtaacttggtattcaggttatatttactcagatcatcctgtaccttatccagcaaaccttcctgataggtatatcccataccaatataatagtttactttatcagaacctccctgcacgctcaaattgtgagaatggcggacagatttgtctttgaaataatattcaaaccagtctgtattaccgtattgattataataagcacctgcccagtcatcaccggtggtattcgcttcaatccccgggaactcagccgaataaggattctgcataaatcccttaatcttctcaattgtcttatccgaaatcttttgcaaaccggatgaagctcctccattatcatactgttggttattatacgcagcgtattccaacgcattcatcattttaggcatattgataggtgcactgaaacctaccgtgccacgataagtaacactggctctttcttttttaccgctcttcgttgttactagaaccacaccataagcagcacgcgcaccatatacagcagaagcagaagcatctttcagtacactgatactggcaatatcggccgggttcacattctgcatgctctgctccactccatccaccaatacataaggctcgccaccgttaatagaaccgataccgcgaatactgaatttaatatcggcaccgatttcaccaccgacaccaccgcctactgcatccgaagcaaagttcaaaccggctatattaccttgcaaagcactggtaacatccgtcacaggacgattcacaatcgcgtcatctttcaatgtagcgacagctgccgtaatggtatttcttttttgtgtatccatacctaccaccacaacttcatccagcaccttagcatcttccttcatcaccagtctgttaccttcctgtttagtgacttttacctgcaatggggcatatcccacatatgtaacagaaagagtgcttcctacttttccttgaatagagaaattaccgtcaatatctgtaatcgttcctccggttacaccttttaccatgactgtagcaccgataataggttctcccatttcgtctaccacctgtccctttatcaatttttgttgtgccaacgcacccagaggaaataataacaggagcatcagaaacagaacaaagcgttcttgttttctcacgaacttctttttttccataatattatatttactaattaagattctattttattctacagtaggattggcatagtaatcaagctcttctttcactgctttcaacaaagacatctcatgcgtcacgtctacgtctgtagccaagtcccagctcatgattcctccaaaaccattctcgcacacatattgtgtcttctggcgaatcgtattctggctgttgagcgtatagttctttccttcataactccatgtgtctgcagaagtattagtcaggttacccttaccgacaagatcaaaataagcagcctgctcgccggcagtacccgtagtcccgtagaaaggtactcccatgaccagtttatcctgaggtattccataatcgactgcagctttaccatccgatttgaaacgttccatagagaaaagttctactgaaggtccatagcattgcaacgagataaaatcgactgctgcaatagcttccgcacttattttgtaagaaacaggatgtagggatacggtcaaaaatacatctttccccaatacttcacgcaattgtacgatggctttactgtaattggataaatcagtacctgaataagcccattcaaagtcgaggtccgcaccatccagattatattgctcgatcaccttctttacgttattggcaaagttagtacgggcagttgcgttgccgaccattttcaaccattcgccgccagcaatacccaaacgtatcttccggtcacctgcctgtccattcaaggcagtacgaatctgctccagacgaatagcccatgtatgcgagtccttaccaggttttgcagcgtcatcatatttccagtaagcaagtgttttcgtgttattccaattatcaaaagagatgggatttcttcctaatgtacccatcagcagactgttcacaaatgtttcatccagataaccttttaggttctctcccatcacaaagtcagcacgggtattaggaaccgaagcaggcagagagcctgtaaagtcagtggcagtattgttcgtatctatatataacttggcagcgccaccatcataagtcaccgctacataatgccatgctcctgatttcaatgcgctattcgtcactgtggccgtagcacttccgacagtcagtttcagattaccttccgttgctcccaactggaaagcgatgacaacagaaccgccgtctacctttttaaacaagcaagctccgtccacccactcgctgacatatatataagtaccgaatgtgaatttcttgaatgctccgtccggtgaatgcaacagaccgtcgccggcgttcatcttgccggtaccatccaatttgagtactccgttgcgtccattataagaagcagcatacgttgctgcccctgtaagtgttgcatcattcacgggtaagtcaaaagtcaaatcaccgtcagcataaggacgtgccgtcagataaatcaaatcgttgcaagcacccatacttgctcccgaaattcgattcgtttcaaaaaaatcaccacggatataagaacagttgataaatgttttatctgtaggatcaggatcatcgggttcttcagtttcgcccggttttcccgtaactgaaccttcgggaggagtaccggtaggaacatctacccattttgtgtctttgcaagctgtcaacattccaaaaaggaagagacaaagaaataggaatttgcttctcataagtttattaattaagattaccttttatataagtagcgaagtctttcctgacattcactgccacaaatttaggttatatctaagatttaagatgttcgattttggctatgattcttccaaaaatgtctaaaatagtccattttatcgcatttttcgaggtcaacagacattatcagacaactttcgagacaaaaaaagaaaggcggcaatatccgtttccgaatatctccgcctttcattaactctaattacccgaatatactcatgatactatattctctcttaaaaactcttccgcccgtgccaacgtctccggcttgccgatatcaatcagttccagcttttccgtaagataaccgcaataatccgtttgcccgcaggtagccagataaaagtccataatagagaacttgccttcccagcacggcacttccatcaactggaagacagcaggcgaaaaaacatggataccgctaaaggcatactctctatacagcgactcatcatataggaaaccttcgggcctcacctgtcccgtatctttgttgatccatccgcacaatctttgttccgcatcaaaaaccagataacgggaagttttacgccggctggcgagcaaggtggctacacttccgttccgcaaatgaaagtcatacagttctttcagattcatatccgaaagaatatccacattatgcacaaggaagggttcatcggaattttcaaagaatcgacgggcttttctgattcctccccccgtatcgagcagcaggtcccgttcgtcggaaatatgcaacgtcagtccgaaatcattgttagctttcagaaaatcaataatctgctcaccgaaatgatggatattaatcactatttcggtaaaaccggaagctttcagtttcaaaatcacatgctccagcattggacgtccggccacgggaacaagggctttgggcatcgtatcggtcagtggtttcagccggctacccaacccggctgcaaatatcattgctttcattacacagttgcctcaaaagtacgttctatattctgttcgcggtgcaccagctccactttcacgccaaatttgcggttcaggtgctctgccagatgctgcgccgaataaaccgaacgatgctgtcctccggtacagccgaagcaaacggacaaattactgaagccacgttccatatatcgcttcaccgaagcatctaccaacgcatagacagagtcgaggaaacggagaatttcaccatcttcttcgagaaaactgatcaccggttcgtccagtcccgtgaaaggtttgtagcgttcgtacttaccgggattattcacggcacggcagtcaaagacataaccgccgccattaccggtaggatcatcgggaatccctttcttataagcaaaactcatcactttgacggtaagctgccgtttcttgagatcgtcggtgaattgcttgagttcggtaagttcgcgtagcacattgcaaagatacgggtattcagggtacgcctctttgagcaagtcacgcaggttctggatagcaaaaggaacactctggataaaatgaggtttcttctcaaaataccccctgaaaccgtaagctccgagcacttgcaacgtgcggaaaagaacaaaatgacgaagctgactatagaaatagggctcgtcgataggctgatatttgcgcagggcatcgatatactccttcagcaattcctgacggagactatcgggatacttcgcctttgcctgccacaggaaagaagcgacatcataatagaacggcccttttcgtccgccctgaaagtcgataaaccacggctcaccgtctttgatcatcacattgcggctctgaaaatcgcggtacataaaagtagcggaagaactgcgcagcagcacatcactcatcttctgaaagtcgtcctccagtttatcttcctgaaattccatgccggtagccttaaggaaacaatatttgaagtaattcaaatcccaaaggatagaacgctgattgaactccggctgcggataacaacgggaaaagtcgaagccgtcggctccggcaaactgtatggcaggaagcaaacggaccgtcttgcggagcaactctttttcctcttcggaaaatacgctggtagcacgtcctttctcgattgcatgaaacaaaagggtatctcccaaatcctcctgaagatagtaactcttattttcggaaacgatatgaacttcgggtacaggcaggccggacttgcggaaatgggctgccatataaaggaaagcatcattctcctcgacagacgtgccacatacgccgatcagggttttcgcacctgtcagccggaagtagcggcggttggaaccggaagatggtaattctgttatattctctacgggaactcccgtatattcctgatatagtttctgtagttcttcggtaatcatagtcgtacattttcgagcaaagataaagattatagataaattaatatcatctttgctcaaaactctatatcattttattcaatattcatccgaatgtattatctttgcttctgtttactcgacctaattcaatgaaagcaagactctatatcgtcctatgcatcgcatttatcacacaaatggccggtgtccttcctttacaggcggggcattactattacaagcagatttctctgaaagaaggactaccttccaccgtccggtgtatccttacggatgaacagggattcgtgtggataggcacccgctccggtctgggacggtttgacggccacgaactgaagaaatacatccatcatgcagacgatccgcattcgttgcctcacgacctcgtccttcagattgcagaagacgaacaatacaatatctggatcttgactgataaaggggtggcacgctaccaacggcaaagtgacgacttctacctgccaaccgacgaaaaaggaaagaacatcaccgcatattccacctgccctaccccagaggggttattattcggagccaaaaacaaaatttacttttacagctaccgggacggttctttccgcctgctgcaggaattcgaccagacaccggatttcagaaacttcaatatcacgatactcagcctttgggatgaagaaactgtactctgttgcagccgctggcaagggctactcctgctcaacctgaaaaccggagcatacagccgcccgcctttcgactgcggaaaggagattatgagcatgatcatcgactcgaagaaccggatatggattgccccctacaataacgggctctactgtttcgaccggaacggaaaacaactggcatcatacaccacccgcaactcctcgctgagcaacaatgtcatactcagccttgccgaacgggagaacaaactatggatcggaacggacggaggcggtatcaacatcctcgaaccggaaaccggacagctttccctgctggaacacatccccggcagagacaactattcgctccccgccaactccatcctcagcctctacaacgaccgtaacaacaatatatgggcaggaagtatccggaacggactgatcagcatccgcgaagtgtcaatggtgacctacacggacgtagtgcccggcaacgaccgtggactgagcaacaacaccatcctcagcctctatcagcagtccgacgataaaatatggatcggaacagacggaggcggagtcaaccttttcaatcctctcacggagaagttcacccattatctctctacgtgggaagacaaagtggcatctatctgtcagttcactcccgacaaactactgatctcgctcttctcacagggagtgttcgtcttcaatccgtctaccggagagaaacaaccgttcacaatcattgacgacgaaacgaccacccgcctctgcaatcggggaaaagcggtcaacctatatcaaaacagccccgacaacgtgctgctgctcggcgaccacgtctatcaatacgacctgaacaaacgcactttccggattgccaccgaacaggagggacaggacatcatcggcgctcttctgcccatcaccaatcacgaaaactatacctatctcaacgatacgaaacgtatctaccaactggacaaacggaacaaccgcctgacgtctctgttccgttgcttcaacgatacggtcatcaattccgttgcgcgtgacgaatacggagacttctggatagggagcaactacggactgatccactataatcccgctaccaaagtacgtactccctttaccaccacgctattcacggaagtaacgctcatcgtgtgcgaccagcagggaaaagtatggttcggaacgaatgacatgcttttcgcatggctcatcaaagaaaagaaattcgtactgttcggcgaatcggatggtgccattcaaaacgaatatctttccaaaccccgtctgctgagcagccacggagatgtctacatgggcggcgtcaaaggactgctgcatatcaacagcaatctgccgccggctacttccgagctgcccaaactgcaattatcggatgtcatcgtcaacggagaatccgtcaacaatgaactgtgcggtgacccgaccggaatttccgttccctggaacagtaatataagtatccgtatcatgtccaaagaagaggatatcttccggcagaaagtgtatcggtatcagatagaagggctgaacgaccagcaaatcgaatcgtacaacccggaactggtcatccgctcgcttccgcccggcgattatcagattatggcttcctgcacagcaaaggacggcagctggattcccagtcagcagatactggaactgaccgtactccctccctggtaccgcacatggtggttcacgctgggctgtgccttgttagtaaccggaatgattgtcgaaactttccggagaacactgaaacgaaaagaagataagttgaaatgggccatgaaggagcacgagcaacaggtgtacgaagaaaaagtacgtttcctgatcaatatcagccacgaactgcgtactccactgacactgatccacgctccgctcagccgcatattgaagtccttatccccggcagatacccaatacctgccgctgaaagcgatttaccggcagtctcaacgaatgaagaatctgatcaacatggtgctcgatgtgcgcaagatggaagtgggagaaagcaaactgctcatacagcctcacccgctcaacgaatggatcgaacatgtatcgcaagatttcgtcagcgaaggggaagcaaagaatatacagattcattaccggctcgatccacgcatcaaaatagtgagtttcgataaggacaaatgtgaaatcattctgagtaatctgctgatcaatgcactgaaacacagcccgcaagacacggaaatcaccatcacttcagaactgctgcccgaagaaaaaagagtacgcatctccattaccgaccaaggttgcggattgcagcaggtagatacacagaagctcttcacccgtttttatcagggcatgggcgaacagagcggaacgggcatcggcttgtcttactccaagattctggtggaactgcacggcggctccatcggcgcacgggacaattcggaatcgggagccaccttcttcttcgaactaccgctgaaactggaatcggaagagatcatctgccagcccaaagcgtatctgaatgaattgatgagcgacgacagcagcaagcagtcacaagaggaagacagcttcgccaccgctccctacagcattctggtggtagacgacaatcccgacctgacggacttcttaaagaaagcactgggagaatacttcaaacgtatattgactgcctctgatggtgtagaggcacttcagcttatcaaaagccatactcccgacatcatcgtaagtgacgtcatgatgccccgcatgaacggatatgagctttgcaaaaacataaaggaagacattgcgatcagtcacatccccgttatcctgctgacggcaagagacgacaaacaaagtcagatgagcggctacaaaaacggtgcggacgcctatctgaccaaaccgttcgaagtggaaatgctgatggaactgatccgtaaccgactaaaaaaccgtgaacataccaagaagagatatctgaacgcaggactgatccccgctccggaagaaagcaccttcagccaggcagatgaaacgttcctgctcaaactgaacaagatcattcaagagaatctggacagtagccgattggatattccttttatatgcaaagaaatcggcatgagccgggcctctctttacaacaaactgaaggcactgacggacatgggagccaatgactatatcaataagttccggatggagcaggcaattctactgatcaccggcacggaaatgtcatttacggaaattgcggagaaagtgggattcactacttcccgttatttcagcacgactttcaagcagtacacgggcgaaacaccgactcaatataaagagaaacataagagagagacatcaaaaacaattaatcaataaaacccctaatatataaatttcttaacacattatttttatgaactacaaattattttctttagtaagcggtacgcttattctttccagtctgtctgccagcggacagaaaaacaacacaaagccgaatatcctcttcatcctctgcgatgacatgggatatggcgatctgggatgctacggtcagccattcatccgcaccccccatctggatgcgatggcaagcgagggtatgcgcttcacacaggcatacgcaggaagtcccgtcagtgctccttcccgagcttcatttatgacagggcagcatacaggacattgcgaagtacggggcaacaaggaatattggacgaacgcccccacagtaatgtatggcaacaacaaggagtatgcagtagtcggtcagcatccttatgaccccgatcacgttatcctgcccgagataatgaaagagaacggatataccaccggtatgttcggcaaatgggcgggaggttatgaaggttcctgctccactccggacaaacgcgggatagacgaatatttcggctacatctgtcagttccaggcccacctttactaccctaatttcctcaatcgctacagcaaagcattaggcgacacaggcgtagtacgtgtcattatggacgagaacatcaagtatccgatgtacggtgccgattatcaaaaacgcccgcaatattcggcggatatgattcaccagaaagcaatggaatggctggatgagcaggacggcaaacaaccgttcttcggagtgctgacttataccctgccccatgcggaactggttcagccggaagactctatcttaaatgaatataaagagaaattcaatcctgacaagagctacaaaggcagcgaaggatcgcgatacaacgcgatcacgcatgtacacgcacaatttgcaggaatgattacccgactggactactacgtcggagaagtactgaaaaagctgaaagagaaaggactggacgagaatacactggtcattttctccagcgacaacggccctcacgaagaaggcggagctgatcctacattcttcggcagagacggtaaactgcgtggcttgaaacgccaatgctatgaaggaggtatccgtatcccatttatcgcccgctggccgggacgtgtacctgcaggtacagtaaacgaccacatctgcgctttctacgacctgatgcctactttctgcgagatcatcggcgaaaagaattacgtaaagaaatatgcgaacaaagacaaagaagtagattacttcgacggcatttccttcgccccgacattgctgggaaagaaaaagcagaaggaacatgacttcctttactgggaatttaatgaaacaaatcagattggcgtacgcatgggagactggaagatggtggtaaagaaagggatacctttcctttataatctggcaacggacattcatgaagacaacaatgtggccgaccagcatccggagattgtagaaaagatgaaggccgttatctttgcacagcacacgcctaaccctcacttctccgttacactaccggagaagaaataaggtaataaaagtttatcatttaggcacgaatttcgcggattacacggttttaagagttgagtaattaaaaaccgtgtagttccgcaaaatccgtgcctgactgttatcaatagccgaataatccgctattgatccgagagtttccgtgcggattctttttcttcctcccgtctcttcctataccggatataccgcagtgaccactcatgcattttctccagaaactcctcttctgtgagcgtatcatagtaaaaattaaatatacgctcgtaatagttcaaacacttatcatccctttttttagcatttcgtaagtttccttactcatgcctatagcttgacacatggctgaaacaaccactttctcacatttaagtacctcttcgataaaaaggccgaatgcaaaatgatgatactcttttttcattttttcttgttttaaacgttaataataatttagttgttataaaaatattcacattagttcggatatgtccgaactgccgttatatcactttgtcctaattttgcgctgcgtttcaaaaacagaaccgcattattaaaagaattaacgataaatgttatgacaaacaatttcagaatgtcttatttcatgcccccgattgctcccatcaggaacgaacaaggacaaaccgttacacccgccacactcactcccttctgcgaagtttcggtcgaacaggtatatcagatgatcacctgcaacgaaaacctcaaagcactgaccgaacaagtacgcggtgccggagacctgcgaatggcaaaagcctctttactcccctacgtaaccccatgcggcacattcatccgccggagtagtaaattcttcgcatcgccttccgggctcatagtggtagatatagataacctcgattcctatcagaaagccgtggaaatgcgtcgtacactgttcgacgaccttttcctctgccccatacttacattcatcagtcccagcggccggggcgtgaaagcattcgtaccttatagcaaactctacgcagacgatcagacacggaacgtaaaagaaagcataaactgggcaatgcaatacatagaaataacctacggatcagaaatggacgactccacagaaactccgccaaaagccgtagacacctccggcaaagacatcgtaagagcctgtttcctcagccacgacccacaagcactattcagagagtattaaattataatcacgaatgatcaacttcaattgtcaattatcatttgtcaattgtcaattctaaaaaaatgaccaatattgaatctttacgcctcatcactgaggcagtcgaaacggcaggtgccgacattgcaccctcttacgccgagtacgtacaattagcattcgccatcgcaacagactgtggcgaagcaggacgtgagttttttcaccgcctgtgccggatatccgccaaatatcagcgcgagcatgccgaacgaatgttctccaacgccctcatgaagcagcatggagaaatacatctgggaacggcttttcatctcgcagaatcgacaggagtgaaaatctgccgggaggaagttatgaacagccgaaaaaatgcagaaaatgcactaaatgcaccctacaatttctccacacacaggcgcgcgtataataaggaggaagaggaagaaaacgacaacgacgaaaacgccaacgcttccgaagaactctcgacagacagtgatcctctacaaccgctgcctactttccccgaagcagactggcctaaaatcctgatgctcattctgagctatgccacctctcctacacaacgggacatactcttgctcggagcactgaccgcactaggagctacgatggaacgctatgtgagatgttcctattccggaaaataccagtctccttgtctgcaaaccttctttgtagcccctcctgcttcgggtaaaagcggactttcacttatccgcctgctcgtagaacctattcatgacaaaattcgccaacaagtggacgaagaaatgaaagcctaccggaaagaaaagaaaaactatgagttgctgggcaaagagcgtgtcaatacagaagcacctcagatgcctcccaacaaaatgtttcttatctcgggcaataacagcggcaccggtattctgcaaaatatcatggacgccaacggaacaggactcatctgcgaaaccgaagcggacaccatcgcctccgccatcagttccgaatacgggcattggagcgacacgcttcgcaaagccttcgaccatgacagactgtcctacaaccgacgtaccgatcaggaataccgggaagtaaagagaatctttcttgccgtcctgctttcggggacacccgcacaggtgagagccctcatcccgtcggcagagaacggacttttctcccgccaactgttctactacatgcacggcatctatacatgggctgaccagtttgcgtgcggagagatagatctggacgaaatcttcaggtccataggcagggattggcaactaaagctggatatactgaaagaacacggcatccatacgcttcgcctcaccgacgagcagaaaaaggaattcaacgctctcttctccgatttgtttttccgttcggacattgccaatggcaacgaaatgagaagtttcatagcccgtctggctgtcaatatctgccgcatcatgtcaacgatagccatgttgcgggtgttggaaatcccccaaccctatcagcttaagagttctgacagatacgctcccgttccggacaaggaaattcccacagataacgtcaaggacggcattattacccgttgggatataactatcactcctgaagactttaaagctgttcttgggcttgtaaagcctctctatcggcatgccacgcatatattatctttccttccatcttcggaaatcccacacagggccaatgccgaccgtgacgccttcttcgatgcgctgggtgacgagttcacccgtacacagttgacggaacaggctacagctatgggaatcaaacccaacactgcactctcctggctgagacgtctcgtaaaaaagggactctttgccatgaaagaaaaggggacttacgtacgcgcacgtgtgtgcgtgtgttagggatgccccgtaaaagtgcatttttgcatcggttgataactttgtgtcatagggatataacgttttgtagaagctaaagcaccgctttagataccataaagctatgctttagaagtcgtaaagcatagctttagccaatacaaaacgccctcgcagtctacaacacttattacctgttacctaatacttattacctgctcatggttcgcccaacgcatccacgattgcccttacctccaacggagtgtaagaacggtgctgcggctgatagcctaaatcggacaggcgttcctgaagaccgggacagcggacaatccatttattcattttgcggtaagcggcaatgcccgtaagttcgggagaataaagctgtgccagttccatacgaccgtaagcacgtattttgaattctatcatgacaaataagtttctgttttacagtcacaaaagtaacaaaatatattcacattacctacgttttaccagggaataacagactataactgacaacaattgcacattaccgactgtcactgtacacaaccgatttttccgagttacagtatgctatctttgtgtcatcgaaagggagaaatcctcacgaaagtatgtttaactctttaaaattattattttatgattcgttacaaaatctatcagaaccagcaaaagaaaggcttgaatgcgggcaagtggttcgcccgggcggtaagcgacgagactttcgatctttccaaacttgccgaacatatgtcaaagcacaattcaccgtattctagtggggtgatcaaaggcgtgcttactgatatggtggactgcatcaaggaactgctgctcgacggcaaaagtgtgaaaattgatgatctagccatcttcggtgtaggaatccgaagcaaggctgccgaaacactggaagagttctcattggagaagaacatcacaggtatgcgactcaaagcacgtgccacaggaaacttatcgacaaccaacctgaaactcgacagccagctgaaacaacaggcagagtatcagaaaccgacaacgcccggaggaggaggctccggttcaggcaatacccctgatccgaaacctaatccggacgaaggagacgaagaggcaccggacccgactgtttaattcgtaatctgaaccctgccaaagtctttagcttatcccagctaaagactcattaaaaatcaatatttttttcatttaaaaccaaaagctatgagtaattcatcatcacgatccgtatggagtttcattatcaaagtaatcatcactgtcgctactgccgtaggtggtttaataggagtacaaagctgtatgtaaacttatgcggaccatcacactgattatcattcattgcagtgccacgccggagggaaaatccctctcggcggaggcttgccggcaggatcatatccgacatcggggattccgtgacatcgattaccatttctacatcacacgtgatggggaaatacatccgggacgaccgttagagaagatcggagcacattgccggaatcataacgcacattccataggaatctgttacgaaggaggactggatgcggaaggacaagcgaaagacacacgtacgctggcgcaacgaggggcgctgttagctctactccgtgagctaaagaaaaaatttccagaagcgttgattgtaggacatcatgatttaaatccgatgaaggaatgtccgtgttacccttgcgtagaagaatacagggaattgtaggttagtaaaatcaatcacaactatcaagctcttcaatgatttgtcccgaccacaaactgccgggacaaatcttttattattttaccatctgcgtttttttgcattctacatttttatactttttcaatcttccaatctcccaatgtacaactctcactatcaaagttgaccgctaccttcactatcggcaatccgcacagagcaaaacgttcgggataattcttcaggttaatctgctccatggcgacagtcgcattcttatccagtttcagttcaaaggtatacaacgtagttttagtacgaagcaccatatccacccgtccacgcggagtacgtacttcaacatctacatagaaacccaacaggctgaatatgatatagaatatctgctgataatgaccttcgtatttcgtattatcacactggggaatggtggataagaattcctgtaagcgacgtaatgccgcatccatatcaccattccgaatatcacgggaaagataagccaccatggtattcgttttttctgtaggcgaagatacataatgaggcaacaagcttttcattaatcctattcttacttccttattgggaatatcaagcgtataaagattcagttcctcatcataccctttaatagtgatatatccgctctgatacagtaatggagtgatatttgtcatcgtttctgtcggtgcatcaaaatcttctgctgtagccgttttcgccccaatttcagaaggtgctacatcaaatttatccagcatctttatcaaataggtaggagtgccgctaccaaaccaataagaattaaattttccatccgcaaaagcattgagtaaactgaacggattgtaaatatcaggtgacggataagtgaaatgatagccgtcataattctctttcaacttaaacaatacttcctccgcagtaatattcaatttgacagccagcctatccacatcctttttcatctgagtaagtatctcattccccgttataccacaaatagcagcataaggctcatccatgctgatatttttgatgttattgagttcactaaaaatactgagttgtgagaatttagtgatacctgtaagaaatatatagcgcaaataaggatcacaagctttcaacggactgtaaaagttacgcataacgtcacgcaatacacccaagttctcccgttcgtgtaccacatccagcaaaggagcgtcatattcatcaataaggaccacgacctttctgccagtctgctcataagaacgttttatcaaattagttaaacgcaaattagggtccgtacctgctgcgtcaattcccaatgtacgttcgtattctgcaagcatgaagcctaaaaggttcaccaagctatccttatccacatgctttgccatactcatgtcgaagtgtagaaccggatactgtatccattctttctccagtttctccatcgccaacccacggaacaaatcttcacgaccggaaaaatagctatgtaacgtagaagtaagcagtgatttcccgaaacgacgcggacgactcaaaaacatatatttagaggaggaatgcgtcatccggtaaacgtattctgtcttatctatatagaggtaatttctctcccgaatttccgaaaatgtctgtattccgatgggatataacctttgcaaatcttccatatcaattatctttttcacaaaactacgaaaaaatatcagattgacctattacttaacaattcttcatctatcataataatgcaatctcttctttcataacattttcataaaaaggagtgacaactttcccctatattttttaggtagaataaaagggtttattaaaatacctgtttctaattctattttataaggaggatcagtaatattcaactcatcttctgttgaaacaacttttttatctactaaaatcaaagagataaaagtctcaaatttcactactcaaaacttcttgccaaaacaaatatttataaatgtcttcaccaaaatcttaaaatcaaaccaccatgagcgatgttgcaaataaaacaaatcatatcggagacgacgtaacattttatccatcgtatctgtgtacccattgtatagcgtagcatacgaagttacgcccggtcgtatctgatacaaaaatacgtaacgagcatcgtgttccattatctgatctatgaaatatttccgttcgggacgaggaccaataaaagccatatgtccacaaaagacattccaaagttgcggcaattcatctaaatgatgttcacgcaaaaacttaccgactttagtcaatcgttcatctttcccacccttatatagcgcaggacccattttttccgcatccaaacgcatactacggaacttataaatataaaacggacgtccgaaacgtccgatacgttcctgcctgaagatagccggaccaccatcttcccgtttcacagctatatagcaggctaaaaataatggagaaaaaataatcattaatattcccgcaatcatgcaatcccccacccgttttacattgcgctcaaaagcattcattccgtcaggaatgaaagttgtttgttgttccataaattattaattatagtttggttaaagattattttctcaaagcttttttatacaagatagcccgtaaagaattgggcatcatcctggtaatcacccgtataaagacattatagagatattcagagaaagttatgaattctaaatttctcagcagattctgaaaacgtagttccgtagtcacatattttaagccacctcttcgtttaaacatagctgatgaaaaacgaaaatataataagctctcttggatattataaaatttcgcaccattctgtagcatacgtatccatagataataatcttcaaaaagagggaaatgctgatatccaccagctgctaatacagcttgcttacgaaacatgattaccggatgattttctggattacgcttctttgcaaattgacaaatatcatcatgaacttcaggtaattttcttgtagaaataatatttgaagtagtttcttcaaactcatcaatccatgctcctactacatccaattccggatgctcctgaaaaacccttatttgtttctcaaaacgattaggcttggctatatcgtctgtatccattcgggcaactaaatcgtaggagcaatgctttaagccttcatttagagctttaccaagtccttgattctgctttaaaggaacaactctaatctgaagatatttagcagtatattcagttattacattttccaactcaggcgtaagctctccatctttcaccaatacaacttctgctaattgtaaactttgattaaaaaggctatctattgattgtcggaaataatatggagattcgttataataaacggataataaaacggaaaacattaatttgaattcagatttatga

SEQ ID NO: 46 - DNA, 60268 bp, Bacteroides thetaiotaomicron
cactaatggcatgcgaacaaaatgaagactgggttgtaaatgaaccgatgcaatcatttgaagaaaatccagagtacgctcctctcaatactattcctgattgggttagtgaaaaagtgacacctaaagaatacgaactatggagaaccatgagttcaaggtatgaaataaattattcctttttaaaaaaggatatttcagaaaaaaggaaaaaagaaatctatgattgcatcaacaacatctgtgaaagaatagaaaaagggcagattaataaatatgaaggattcctaaatatagcagatgaagatggcaccaccctatcagactcacaatattttggcagaatagcaacaagatcaccagaaggaggagctgaatataagacaaatggatgtacattgtatacacatagcttaggtccctatataaaagctgctgttacttacaaaaaatccgatgatgatgttacaattacgtcatcgagtgtttatacgggatcaccatatttaggaaatgacccgagtttttctggtgcttccagtgtttcttacgataaggataagaaattaatagccgcatcgtgtagcggaactttatcattcaaagatggatccagaaaggttgaggtaactgtacaaaagacaggattcatgatcccatgatcaatttgaatatacacaagattaatcttggtacagttagtactcttttgtgattttctattcagatcttgaaaaaagttatagaacaattaaaaataatagtcaccatgaacaacattctaaataccaatcatacgtccatctataaattattattcgtcctattttttgcagggatttgtaatctgccatttaaatgcaatgctcaggaatactccaaattggacgaagtaccacagtgggtcaaagaaaaagttaatcatgaggaatataaattatgggaagtcatgagttctgtttttcaaattgactactcttttctcaaaaaagatatctctcaagaaagaaaaaaagaaatacttcacctcttgcaaaatactgtgtcaagaatccaaaatggttcatacaatatcgaaaaaggctctttattttgtgtagctgatgaatttaaaattgactccttgacaaattggaacaccgaaatcttagaatgcaggaaaaaaagcggtattatttattccagcagggacggctatgacgcgcattataaactaactgtgatttatggatatgacaaaatgaataaaaaagtatatccgataaaaaatgaattagagtgtattagttactctggaatagagattacatgcaacgacctgccaattgtaaaatataacgaagtcgaaggaaagctgcaaggaacctgctacggaaatcttttcttcaaagacgaaaaaggtgcgactcacagtgaagatttcaccaaatatttcgtcttagagccttgaaacagcaactaatataaataaatgaaaagcattccagtttcttctattctatattttctgttgagtttgggagtcttattcgtaaatgcaaacacatttacagattcccaaattttccctaaatggatgtttatgttcacaggattaggagtaattggatgttttttttcattttatcttttccgaggaaaaaggtttatttgcaatgcaaaatgttgttactacacggttattatatcttgttttcttcaagccggatacggtatattacaatttttcaatatactgtcttcacattccatcacctacaatgttgtcggtagctttgataatcctgccggttttgcaggaagtttatgcgcagggttaccatttaccttctattttttacaatattcaaacaaaaaggttcaatgggccagttggtgtgcattgtttgttattgtcttaggagtattgctatcagaatctcgcgccgggtcaattagtatatttaccgtattagtaatttactttattcaccaaaacaagaataagttccactataaaaaacatatcggtagcttcttactctgtctatcctttctgctgattagtatatttgtcatttctgtaacagtctatcatctaaaaaaagattcggctgatggtagattattaatatggcgttgcacatgggaaatgataaaacatgagccttttacaggatatggagtcggaggattcagcgcacactatatggattatcaagcccaatatttcaaggaacatccggatagtcaatttgcaattttagcagacaatattaagagtccttttaatgaatacctttctgtcggagtccagtttggtattctaacttgggtacttttgatagctgctggtattttcttgattctttgtcacaggaagcacccaaccaaagcaggatatgtgtctctgctctctttactttccattgcagttttttcttttttctcttatccattcacttatcccttcatttggattattagtgcattaagtgttagtactttaataggaaaagcctatgaaaataccttgtttcaaaaaacaacaattataaaaagaggaattgcttttttcttattaataggaagtttatttttgcttattgaagtggtgagcagaattaaagcagaactggaatggggaaaagtagcgcatatgtcgctctgtggacgaaccaatgacatgttaccacgataccataatttactacatacttttagaagaaatccttatttcttatataattactctgccgaactttgtgttgccgaaaaatataaagaatgcttagcaataacggctatttgctgtaattattggtcagattacaatttagaattagtacaagcagaggcatatattggcctaaaacaatatgatgcagccaaacatcatttagagaaagctaccttaatgtgtcctgtaaggtttatacctctttataggttacattatgtctacatgaaacagggaaaggcagaaaaggcaaataggctggctcaattaatcatagaaaaacctataaaaaagaattctacaatcattcaaaaaattaaggctgagatgaaacatcatttatcgagaaaaacatgtttgtactaaaagcatacacaacagtgcatttggaaggcgaaaacataaataagaatacgccttttatggtcgaagagattgccaaaactttaaaggcaaacaaataacggacataattataaactgcggcagttattgtctgatttaccgtttctcttcgtccaagcaaccctataatcgcttaattttcacttattgttatcagtttttcgtaaggacatcttcatcgttccacccgggtagaacgaactgtctacgtttgtgacacgatcggtttacctgggtgcaatgatcaattcacccgggtggaacgatgaagatgtcggtaagataatataagaatgtaagggagatatgctaaggacataagtgtcacaacatacaaatgataggtaaagtaaaatcaatacagctgtagtctgtagcagaaagaatgatgagagacaacttaaaaaaggatgagagatacactgtttgggagcatattatgggataaaacgatgagagacaccctgctccgaaggtatctctcattcattattcatctagttatctgatctttacagaaagacagtgagaccgtgagactaaaatattttttttatttcttgggagcgagcagattattccttatctacagaaaatttaaagatacactgactcatgtatttttctcccgggcgaagcacagccgaaggccattccggtttgttcggagtatccggatacttctgagtttcaagacatacggaagcacgctgattatatgtgatacctttctttcctgtcagagaaccatccagaaagttgccggcatatacctgaacacccggttcgttggtatatacatccagtacgatacccgttttgggagattcgagtgaagcacatttgcgggaaatatcccctttggcattcaatacccagttatggtcataaccatttccattcttcaattgtacaaaatcgtaatcgttaatgcgtgcccctaccggagtcggagtgcggaaatccatcggagtaccttctaccggaacaatctcgccggttgtcatgaatgtgctgtctaccggagtataataatcggcatccaccatcaacaagtggtctgcattgcttgctgcatcgccgtcaaggttaaaataagaatggttggtcatatttacgatagtcggcttatccgtttctgcttcatagcggatatcaattgcattatcgtctgtcagtttcatcaggactttacaggtaatgttacccgggaaaccttcttcgccatccgcagcgacataagtcagttccacttcttgcggattcggttgcacagcgtcaaacacacgatactggaatccattgggaccgccatgcaggcaatgaccgtaattattctgaggcaactgatattcaatgctgtccaatgtgaatcgaccttgattgatacggtttgcgtaacgaccgatgctggcaccaaaatcagaaggtttgctgatataatcctgaatagaatcgaaacctaaaactacatcctgcatcttaccgtctttatcggggaccatcacagaaacaatgcgtccaccgaaattcgtcacacaaacttccatgttgttcttgttacgaagggtgtacagatcggttttcttaccacctacttcagtctggaagttagttcttaacaggccggagtcggttggttgctcggctttcggggtacaagcagctacaaaaagggcagaaacagcccataatgctaaattcttcatggttgatataagtattattataaattagttcaacgaacatcttttatttagattgcaaaattggcgaaattctgatagtttggaggcaacattctttccaaataatagcacaaatcagtcatttcgccaatgatgcaatcataaacacttatatctttctaaatcaaaatgatttatcttataacaaattcaagtaaactgattccatcaccagttactcctttgtattcgggaaagccgatattctcaaccgggccgctcccatcggaatcaatgtaatctcttctttagcgcctttcaccgcatcttcttcgggcaatacaccgcaaagtccggtttcgtcaatctgccattcggggatcatctggccggtagctttcacttccaaaggcacattggccaccgtgaacgggaagttatcagcaggccaggacttacgaacgactttgaagttcttcaaaggctctttcttatccaataccaacgaatagttccagggactgttagcatagatttcagtagtaggccacttcttcgggtcagcacctttctgccatttggagtcaccgatagccgtttcacgactgtctttttctatatatttctcgtcaatcttcagagataaagtcaacggaccataatccacacttacactgttcttattgacttgccacgtacgcatggacaaagacatcggaagagtcatttctactttatcaccatccgcccattcgcgttcgatacaaaggtatttaccggatacaggtttcacactgatcttctttccgttgacacgcacttcggctccttcagtccatgaaggaatgcggaggtagaacgggaaatcgaccttttcatcggtagaaacggtgaatttgatgccttcttcaaaaggatagttagtctcttcgtgaaggacgatttcttttccattacccactttgatctttgctttgcaagcagcatagatggcagcagcaataccgttgtcgggagttgccaatatcagatgttccgaaaaataaggccagccttgtgcatggttatgctgacagcaacggctgctgaatggattcatggaaaggaacggaccacggttgtcaatacccggatgatggttctttgagtcactgacagtatgattcggacaagtgatgtagcgcaaagccttgaagtccggcatcacagcggcaggataagagttgaaagctacttcttcgcaatgctcagcccacatcggatcacctgtcatacagagcatgatctcatcggaagccatctgttccaccagtccgcaggtttccactccctgacgaggatcgatatatcccagacgggcattctcgtcggcactgaacataccgcccggaacctggccaaaagtgcgacggatcaaatgatgtacattataagaggctttgagcatggcggaatctccggtctgcatataataagtggcaggttcgcggaaacactgggcgatgttcacattgtgccagttgggcagggaggttgattttgtccagtcggctgtattgcggtgaatcttcttggcaaggtccagcaggaaggcatctccggtatggttataaagccaatagatactgatgatgttgtcaccgccacggctgttttcccaatagtcttccagaagtttatcgtcgggaacagtcatctgccatttgaagtagttcgtcatcaggtcaataacccgttggtcctgagaatattcataataagattgcagacaccagagcataatcatctgtgcccacaattcacgcttgccgttccgttcgttgacaggaccgaagtatccatcgggctggcaactggcaaatacaccttcaatccatgtttttgtttctgcaatcatcttcgggtcattcaggatataggcaaggttgccataacctttcagccagtaaggtacttcttcccagccatgatcaccaccggttgtcagccaggcgttattatctttctccagccaggcactgatttctcccagatgtccggtcagcccgtcacgttgcagttcgaggtacttctttacccagccttccggctggatgctgccgacaggcagcttaataaagttcaacggacggagcggggcccgatagctcacataattcacattcgtcgattctgtgtcggggcggtccatcacccttacagactcactggcagtgcgtgtagtaaaagctgctgtcagtaacccgacagtcagcagcgtacccgcaacacctattttaaaagatcgtttctgtttcattttgaatatttttttggagatactaccgactttttagtcagccttgttttaattcggtttatttataattataaatcaattctccgccttttatcagttcattgtgagatatacggtagtcagcaatctttttcccgttgaaatggatacttttgatcggtgcgtctttctttttccgtccttctgtctgaatagtaagtacgtttccattcgtcaaccgcaacagtaccctgtcgaaaagcggagaggtcagatcatagtattcatctcccacaagcagaggatagaaacccattgccccgaacacgtaccaggcactcatcgtaccgtcgtcttcgtccatttcgggactatacccttcgggggcattcttgaatgccttacccagataaggagtcttaaattccgagttgcctccatatttatggatcatcggttcggtcatcagactgcgtactatctgctgggttttctccggtgccccaagtcggttgaacaggtaaggaacatggatatccggttcgtttccctgattataaaggtgatggtcgaagaaataggtaagttgcaaacgaagagagtcctgccctacccattctatcattttatcaatgtattgtggagccgcccatcggtattgccaacgggttccctgatagagtccgttgttcttcatcacttcaaaagcgggagtcacattcataaattccttcttccatgtttcttcaaaaagagagaccgaacgttgccggtattgttcggaatccgccttttcaccgatgatttccgcaatctttgccattgcccacaagtcatatgccgattccatcttctggtcgggcgaacgcatgggcaaccgctccatttcctgcttcataccagcgtatcctttacggaaatcaaggttggtaattcctttccggtaagcgtccaacaaaagaattacggcatgttccgtacgtactgtcggggtagactcgaatccggtggaccagtctttctttcccgttgcatacagatgaatcagggaagtcgccatatcccgcatcttcgcaggttcggtcagtaccaacaaaggaaatttagtgcggaaggtatcccataacgaccagttactgtaatatcggaagtcttctgagatatacacttttccatccgtacccagataagctccgtccggagaactgacatccgccggactcaggtaagtacgatacagggaagtatagaaaatgaccctgtcatctttcttgcctcctttgacgtcgatagctgacaattgtttttcccactgatcagcggtccgggatttcacatcttcgaagtccatcttttcccaacgggcacattcccagctcgccagttcggaacttaacgcagacagtccgatacggacttccaccgaacgtacctttttgccaaaggtaaggcaggcagtcgtctctttctgttcttccaactggaaaggctggctggtatttaaggagaaatagagtttgtagcatccatgtccgcagacgttctttgcctgtacatagccttcgatgcaagtttccgatatacgtttgtaatggcaggtagctacgtcttcaaacgtagaggcgaagtctatccaaagggcagcggaaaggcttcggggaaatttatagcgttccaccgccatagcgttggtcgctgtcaattcagttttgataccattggtaaaagctgtcgagtaatatccgggagttgctttctcgcgggactttttaatatgcaattcctgtgaaggagctaccggacgaatgcgcaggtttcctcctccgccactacatcccactccggagaggcggttgacagagataccggagactttcgtcactgcataatcataaccggcatggctacgcggatcattatccggacacacacaaaccattccgaaaggagcggcagcgcccggagctacctgtccgttatcaccggaagtaccgataaacaagttgacatactttgtattttgtgcaactgacggtgtcatgatagataacacgactaaaagaagggcataccatctgcttcggttgtttttcatgcttctaaaatagtatcatcctgtcactcttcgctacgctctgaatgacaggataggataaactaatgatataatatacttatctttaattcttgtttacagagaacttaaagatacactgactcatatatttctcgcccggacgaagtactgccgaaggccattccggtttgttcggagtatcgggatacttctgagtttcgagacatacggaagcacgctggttgtaagtgatacctttctttccggtcaacgaaccatccaggaagtttcctgcatatacctgaatacccggttcgttagtatatacatcgagtacgataccagtcagcggtgattcgagagtagcacacttacgggtaatgtcgcccttagtattcaatacccagttatgatcgtaaccgttaccattcttcaactgtacgaaatcgtagtcattgatacgtgcgcctaccggagtcggagtgcggaagtccatcggagttccttcaaccggagcgatctcgcctgtagtcatgaaggtactgtctaccggagtataatagtcagcatcaattgtcagcagatgcgcctcattacgggctgcgtctccgtcaagattgaagtaagagtggttagtcatattcacaatggtcggcttgtcggtttccgcttcgtaacggatatcgatcgcattatcgtctgtcagcttcatcaacactttacaagtgatatttcccgggaaaccttcttcgccatcttctgccgtgtaagtcaattccagttcttgcggattcggctgaacggcatcaaacacacggtactggaatccttgcggaccgccatgcaggcagtgaccgtaattattctgaggcaactgatactcagtaccgtccaaagtaaatcgaccttggttgatacggttagcataacggccgatgcttgctccgaagtccgaaggcttgctgacataatcctgaatcgaatcgaagccgagcactacatcacgcatctgtccgtccttgtcgggtaccatcactgaaacgatacgaccaccgaagttcgttacacaaacttccatgttgttcttgttgcgcaaggtatacaaatctgttttctttccatccacttccatctggaagttactttgcaataaaccggaatccgttgttttctcggctttcggtgtacaagctgccattaagagggcggcaactgcccatacacataactttttcatggtattctattaattgatactattcaataaatctactttgccttcgttaaccaacttaagaatcagttctccgaaaagcgtattctgccaggcaaaccaggcacgggtgaagttcttcggatcgtctttgtggaaagattcatgcataaagcctgttccggcatcggtatccatcagcattttgatacaggttttgatttccgcatcatccttgctggtgaaggctttcatcatgatactcatcggccacaccatatcataaccgatatgcggtccgccgataccttcgcctgccttgcctttgaagaagtaaggattgtcttcgctccacacgaatttacgggtattctgatagataggatcgtttacatctacatcacccagataaggcatggcaagcaggctcggtacattggcatcatccatcaggaagtgatttccgaagccgtctacctcaaaagcatagattttaccatatttcgggtggttgtataccgcatatttcttcaatgctgtctctacttcctttgccaggtctttgcattccttagccaaagcagtcttcttatttaccttatcaagtatttcggctgctttgcgcaatgaagatacggcaaagaaattggaaggtaccagatattgaagagtcgtcgcatcatccgaaggacggaagcaggagacgatcagaccaaccggtttcactggtgctccgagtccgtcattattcaatgtatccaatgcacgttctgtcttacgctggaatttatacgggccaactccgtctttgcgctgttgttccttgaatgttttcagcacattggtgatagcctgaatccattcttctgagaagatgctggcatctccggttgttttccagtagtgataagccagacgcagcgggtagcaaagtgaatcgatttcccatttacgctcgtgcagttccggcttcatatcggtcaggtcactcatccagtgattgtcttcaacggcaccgtcattaaatgcgtttgcatacggatcgatattgatacatttgaactggcggaggataacacctgccagcatctctttcagttcgggatcggagtttgccaactgcacatacggccatacctgcgcacccgagtcacgaagccacattgcgtgaatgtcgcccgtataaacgaatgtatccggtttgccatccgcgcctttgcggaagtgtacggtagtatcgatggtattggggaaacagtttgcgaacatccatgccagtttctcgtttttcagaagtttctgcacacggatgatttccttttctaccgcattcgaacggaaaagacgtttggaaacttccggacgattgtctttctgaatagcgtccgtcacacatacatgcattccggacatcgtatttgcagcctgcatctgaccgccacaaaggagcatgcctgccagcatacccgcactgatatattttacttgcttcttcataaattactttttctttttaaattcgttggagaaagaataagggaaatcggtttctttggtaccacgctgctcattgggtttggaatccatcttgaaagtgatggaagcaccgttcataaggtcctcgtgagtcacgtagttctttgtatggtctttgccgttcaaggtcatggaagagatataacgtttgtcgtctccgttatttggagcggagatggttactgtctttccattttcaagatgcagcttcatctgtttgaagtaaggagtaccgagaatatactcatccgtacccggacataccggatagaagcccatagcagagaacacataccacgcagaagtctggccgttgtcctcatcaccacaataaccgtcgggagcaggagtataaagcttatccatcacttcacgaatccagtgctgcgctttccacggctgaccggagtagttgtacatatacagcatatgctggataggctggttaccgtgtgcatagttacccatattcataatctgcatctcacggatttcgtggatgacaccgccataatagctgtcgtcaaagacaggaggcaggataaatacagagtccatcatctggttgaagccgtcttttccgcccatcaggtcgatcaatccctgaggatcatggaatacggaccaggtataatgccagctgtttccttcggtgaaagcgtctccccacttcaacgggttgaacggagactggaatttgccatcctcattcttgccgcgcatcagtttatgttcgggatcatacagattcttatagttcatggctctctttgcaaagatctcaatttcctttttaggcttgttcaaggccttacccagctgatagatacaccagtcattataagcatactccagtgtgcgggctgcattttcattgatgcctacgttgtaaggaacataaccgagcttattgtagtagtcatagcccagacgtccggtagaagaaacctgcggatgtaccgcattagctccgtgctttacagcttcccaaagggtttcgatatcatatcctttcagacctttcaggtaagcatcggcaactactgaagccgaattgttgccaaccatacagcctctgtgtcccgggcttgcccattccggcaggaagccgctttctttgtaggtatttaccaatccttcctgcatcttcatgttcatagacggatacatcaggttcaggaaagggaaaagacaacggaacgtatcccaaaaaccggtatcggtaaacatatagccgggaagtacttcaccattataaggactgtagtgaacgatatctcctttcgcgtctatttcgtagaagcttctggggaaaagtaccgaacgatacaggcaggagtagaaagtacgcaaatggtcgatatcatcatcttccacttcgatgcgtcccaaaacgtcgttccataccttacggccttttgccgcaatctggtctatgttatctttgcccaactctttcaagttcagttccgcctgttcggggctgatgaaagaagaagctacacgtacatttacctgttcgcctttacgggttttaaagccgatcaatgcgccggcatgcttatcgttggcttccagtttattggtatcgatgttaccattggcaacagctgccgtataagtaaaaggcttgtcaaactccagtacgaagtaattcttgaagtttgcaggaacaccgccgctgttcttggtcgtataaccgataatcttgttttccgaagggatgactttcacaaacgaaccgttgtcgaaagcatctacaactacataagagtgatcgttctcagggaaagtgaagcggaatgctgccgctctttctgtcggagcaatctcggttactacatcatggtcggcaaggtatactttgtaatagtaaggagtagccgtttctgctttatgcgagaaccagctggcacgctgatcctgatcgaaaacggctttaccggtaatcggcatgatggagaactgaccgtaatcattgatccaggggctgggctggtgggtttgtttaaaacctctgattttatcggcatcataggtatatgcccagccatcccccatttttccggtctggggaacccaaaagttcattccccagggaagggcgatagcgggataagtgtttccggtagataaggcgtgcttggactgagtacctaccagcggactaacatagtccactggtccggtaatcgttttagcatccatattccacgcactaaataaagtaaaagctaatagagcgagttttttcatggtgttcttgttttatttagttagtttttcttcaagcatctttataaaatagccgccaactacggaacgcgcctggaaacctctctgaatcggattgtccgtaaatacccagtcggacatcggaacgcgggtagtcgtttcatccataaacagatataccggttcaataaacttctcgaaagtagctttgtcctgtgccatggtagctgtccacatgatccagtcagtcttggtataagtttcacggttatccagcggaaggccgtatttattttgcttcgtaagataataagcaatttctgtctcagcaactttttccgggaaaatctgtagtttcagcaatttgtcccacaccagattatacttctggctccaggttcccggtttatcgaatgtcagacggtagtggtcgccgtcatccgccatcttcacccattcggcagccatttctttcgccttcttcgtgtacttttcagcaatgtcttttttgcccagcatatctgccatgtagccgtaagaagcaatacccatgatagccttgatagaaagattggcattgtgcgcaaagtgtccggcaaagtcatccgtacaaagttggttctccggatcaagaccatactctaccagataatccgtccaggttgtcagagtttcccaatgcttttgtgcgtagtcggcatttccttctacagcagcaatcgctgcagcaaggactaccatattgccagattcttcgattggcatatcgcctccgtaagtctggccgttagccagcggatatgtacctacgtcgtgagcagcaaacggtttggtccattttccgctttcactataatagaagatatggttcatggtagctttgaccagttccggattgtaaagcagaagcaacggagctcccggataagtcagatcgactgttccgatggaaccattactgaaattctctttggaaaggaataccaggtcaccattcggagcttgtaccagtttatgggcagctaatgcctgacgataagccagagcgcaaagttcggcatacttgcgtccgccggccgcttcagcctccgccatcagtttcttatcgaaagctgcacaatttttcatttgagtcttatattcctgttctgctttctggaattgtgatacgattgtttcactgcctgtacgattccagtaaggacggaggttttcaccaaagtactggatagagtaaatatcatcgtaaccgatcagcaggtgtccgttcgctttctttgtttcacccagtgagcgtactaaagctagtttgtcataaccattggtggtaggagcttccagtttgttctctgtaaagctttggcgaagtttctttccgtcaccgatagcataggtgctgttctctttttcagcagccaggtagaagtgtccccagtcaatacgtacatcgtcacctttctttttcaggatgtcctgattacggctgccggtacgcaggaacaacagatcaccgtcagtaaagctgtcggctacggattcctgatgaggcagatcgagtgcccattgaggagcagcttcaaaatagagttcaacttggtgcgcctgtccgtcgttagaaatgacttcataagaaatatagttgacagggcgtgccatcaagtccagattgtccataaacaggggcgcggtaaatgtcaaattcaagtctaccggaccacaagtgaagttataataagtctgcataggttgaacatcggcagaagtctgctgtgcagtctgattgaagtaacggttattatccaattctaccagcaaaccaaaatccagcaagccattcgctccacggttgtgacaataagcggcaatcaggttttctccctgtttcagggacgctaccacttcttccgataacttcacctgtacgtgcttcttacaagcgtttcctgtgtctacaacctttattccgttgatatagataatcacatcatcatcatgagaatattccagatatacattcttacctgtcaggtcttcctgaatatcagcaacacggcgtacccagataaattcttcaccccactgggtcttggctacatgttcgttctccatggttccgaaggcaccttcaccttctttccaggcagcatcattgaagccgacattttgccatccgtcggcaggttgctgaattgtatattttcctgtccagttaccttgttccgaagttttcaccagaggtctcaactccagttcctccgttcccataaagcggtaagtctgtccgtcgactttagctacaccgattaaagggaaatctttaccgctccaatgtttgaccgaaccgtcgtataagttgtccgtgaaagaccatgcactggtatacgggtctatgctcaccagcggataagccggagcacgcaactcgctcttcacatgctgttccagctgggtctcacagctacaaaatacagaggctgctcccagcaacagcgtcatcagttgttgtttcataatttaattacctgttttatttaatctatttaccattctattgacacattcacaccggcaggatcgttctcgaaactcaacagaagagtttttgatgattcatcccattccggttgttcctcttttccattcacacgtattttctctggtttacgaggcaagaggactcttgatacattagttgtatttatcgggcttttggctacaaaagagtaactttgtttgctgactttctcatcatagatacgagaagctccgcagagcactttggcttttattttaccggatactttattcagatcataaagatacccctgttcacccggttggatttgtttggaagtcagtaccggcaggtctttgtcaaacaggtcgatatataatccggataacgtcagtggctctttggaaacgctttcgtccatgacagcagcaatggtatatggaccacgttctacaatgaagctgttcttggtttctatctctttgccaatctttttctgataagcggatgcgatcgtttcaaaatatttctgatcgtttccggctttcaaaacaaaatgtttggggtcttcacgcatcacaatcaccgttcctttaccatagcggtaagttccttcacccggattacgggatagattcatcttctcgaacaggtgttccgaaggcgctttatattcatttccatctgtattccaccattccagtaccgtttgataagggtcgatatcttctccacaatagataagtattccgcccttcttcacccaatcagccaaatagttgtgatattccagtttcatcggtttcatgtttgaataagacatgacaagtatgtggagtcctttgaaagtttctttgaaaggggtattttccatgtgtaccagctctaccggaataccacgcttcaacagaggcaaagtttgtccgtagaaactggaaaattgcggatcatcgtaaccgttatgattcggaaaacgttgaaacatcagtgagtttgccatcagtacaccgatgccctgtgtacctgtaatctttttatcggaagtacggatatcattcagtgtattaaccattgtctgcatctgggtggaataagagcggggaatgcgttctttctgatccgttcccgctatccggtacagtccctgatagatacggtccggccagggcattacttcgtaggtatctaccataggatacatcaactgtgctgcaaaagtggcctgataattgattttatagtccagccagtctttcgcacggtcttcgatcgggtctgtcaggaaatacattttccggttcagcggtgcagtcatcgacttcatacacccgtattccagaaacgcattctcgaatacacgttctttctgcacgccgttatagaaattcggttcgcgggcagtccctgtccatacctgggcaatgtagccgtctacacaatccaatgaagccaggctggcttccggacttacaatctgccaggaagtataattaatcaaagaatgcgtcggcacataacatttgatatccagtcctttcgattttccgtattctttggcataagtgaatatcttatccagcgcattatagtacagatgatatttcagtttgttggaaaggtatgtgttttcgggagattcgtgctgagctctccaggggaaattataatatttctgccattcggatttaaaagcttcgctatatccgccacgcatccaaaactccggttcttccagatatatggatgttatcccggcgtcaatcacccgtttgatctgtgtttcctgcatatagcggataaaactttcggtaggtacgatataagggatcagatgaccatgagctatttcatttccattacggtcgcgctgtccttctttcagatgcccgtctactccatcccatttccccagaaagtagtccttgtagtctccccaggcaactccggtcataaattccgtcagataacctttgtctctccatgactgaatgcgttgttcaaaagttactccgggcttatccagtgtaccatataccatcgtggcatcagcacgtacgtctgtttcgggtttccagggttcagaagtctgaaacgtggtctttgcttctttgctttttcctttttgcgcataagtagcatgattgcaggcaagaagcaagccgagagcaatcagtaaatgtttattgttcatgatattcaggtgtattttcatttttatatctggtcgttgccccgtttctcttcggattatttttctgccggaaacagaagcatcaatgccggtataccggaagccgagtagctgtctatctcagcaccggccggtaatgctttctcatattctccgccacatacattacgtgtcttatccctgtttgcccaaccggactcgatattacgtttcaggaacgggatatattgtgtttgtccgcaatcgtataccagcatagctatgtattctgcaaaaatagccgtatagataccttgctcgattcctctttcaaagggcagcaggttatgcttcgcagacatttcattgactgtatagtctgctgcaaggattgcattatccaggtagcgtttttctttagtcgctttgtaaagcaatacggaagcaccgataaaggtagcttgattatatacatgcgctttccaggcaggattaccgttgccatgacgactatcagctatccggcccgtcttcttgtccaacaggttttctactccccattcataaatctctttgcctttagccaaatactgttctcttgtctgatacttgggtgattcttcggttgattcttttctcttcttcggaacattattgtacagtgtaagtgctgctaccacggtagggaaattgatacaagccatctttccgtcccccggtctgttcggcttgggattatggatcggctgccattgccagaacatccctccgttctctttgtcatatgatcctgtatcgcctacttttttagaaccgtaccatacacggctgaagctctcttcagacagtttcagatattcatccacaccaaacagttcgtatgcacgtgccaaagagatcgtccaccacatgatatcatcatagataaaccatccggtattttcattattattatcgaaatcaaagtgacaatattgggctttatttccagcgaatatcttttcgcagagctctttgtaataggctcttttctttttatctttctgagccttcgccagtttataggcgttcattgacatatcccagtaaataggctgacaccagatagcagctgcgccatgaccacggtctaccgcctgttcataggccgaagtcgttttatagatatatttatccgggtcgagcagcgtattattaaatccttcgtatgccgcccacacgtcttcattggtgtaagaccctgtcttctggttcgttttttctgagctatcagccgcccatacactagtagttgatatcgccagcagtaaagctaccgccaaaagaattttgcttttcatgatagttgataagttttaatatttttcctgttacaaagattgcagaaatagacgaaaaagaacgataatctctattcaataaagaacaaatacagaccaaaacacccttttgctatttgcaaacgcagataatgacttaaaaaaatccccttgccctgcattatgcaaagcaaagggaagcactgatataatttaatacactattgaaaaatctgcattaatcactgtgcgatagtcgtactttccacccattgatatgttccttccggaccttttagagtagcgacatgacgtcctgtaatatcagtgattgtcgttccggtaggttgtgctcccaagacttcaaagtcccaggctgcaaccagattcggatcattcggatctacgtcaacctgccccatagcagataagcgaagatcatcgcgacttctgatacctttccatatacgcatatatttgatataaccggagaagtattcttcacgagtcgttttatctgtattcaaacggcagaaggcagtcataggcattttctcttcaatacaaccattgttaatataagttctccaagcctcacctacacgaatcacctcgccggattgcgaaccattcacaaatacacaggatttagtatgttcctgaggtggatcaaatcccggaacaccattatccgctacagcaaaagcaaagtgtgtccatttatctttgggattgtttacgatggctctcggctcccaccattccggatcttttggaccttcattctgccaatgtgccatagaacctctcagccagtgttcattgccaccattcactttacgatactgaacacgccagccgcttcggggagaattaacaaatgcagcaaggaaggtactattgtcttcccctgacttagaacagaattctttgatatttatccaaagctcaatcgtaaaattctgattattatcatcaccaaatttcacaaaatcctcgctatatccaaagtcgatgtaaccacccttattaccatccacaaataaattccagacaagattatcttccggccatgcggaattttccacttcttgcagtttcttatcagcagccgcaatggcatcatcatatatctcctgcgtcatatctgtgatggcactggttttgattctgtctgccaaactctccaaatcttccgctgcactttccagtgtagccttaccttctaccggatattgtccctgatgatttccccacaatgcttcattagctatcatttctcttaactcatctgcttttgccatcagatcactaatgaacttctgggcttccggagaaaggttatagtatttagagtttttgaactcatctattgcctgatttaccttagctattgtagcctcaaaggtcgcctcatcaaacatctcaccgccctttaccttggtaatcaactggtccagttccgctattgcattattcagtatctccttgctggcttccggaaaagttcccggcgctgttccaaaggtagagtttttcaacaaatatgataaagaagtccgattgtcctctaatatgctaagttgcgtatcagatatatattcattatctttatcatccgaacaagctgtaaaagtccatgtgaggcaaagcgccatcagaagggaaaagagcatactctctccccatttattaattaattgtttcatgtctttcattatttctctctttattattctagaatacgttcccacttataggtacctataattttcgctgtatgacgaccagtcaagtcaataatctcgttatctgttcccgatggtttagatgtaaagtcccatccggctgccaaatccgtttcttttccggttacttctgctgttccttcataagactgctttacataatctgccccttttgccgttttccagatacggattttcttcatatatccggagaatccttcttcatacaaatcatcgctcactctcatgtaacgaccaaatgcagtcatcggttttgagtaatctgaataatgtcctgactgataaactctcgttgtaggagaaactgtttcttctttcttcaactcaccatttaagtataattttgcacgtaatgtagaattgccgtccaaaccttcatcactatatactgctacaaaatgctgccatttattcaaatcatcagaaatctggaatttcggttcccaaagatccctgtcaccattggtcgtattcaatccaccccaagtagtacggtaaacaccattatcatctttacgccagtacatcatccagccattacgccagctactgtctgacatgtatgagcacaggaacaggcaattatcccatctgccgcgctccgtaacctttacccacaactctacggtaaatgattgatgaccttgttctccaaacttaacatattcttcactacgtccgaaatcaatatatgaattgccgcctttaccatcaacaaacagttctgcaggtgttgtttcagcatcttccgtacgaatagtacccttaaacttatcaattgcagattttgcactggcaacgtaacgctgcttttcctgctccgacggaacaggattctgatatttgatcaacagaactgaacgattggcatcatcgatagcatctgtcaggatggcacgactctctgtaggatattgccctttcttttctccatattccgagttcttctgcaaatccttcatcttattaatcagttcttccagctggtcaatatagatatcttcgacctccggtgctgcagtatatgactcgtgagtctcttccgtacaagctattagctgaagagtcattatcatacaaagcagatagtaccatactttcttaatagaatattttgtattcattattcttttcatttataggttatacttatttatcggttggaaacaataacatcagagcagggatacccgaggccgaataactttcaacagcatcaccttctacctgtagcttggtatagtcgcctccgcatatatcacgcgttttgtctctgttagcccagccgtaattaatgttgcgtttcacaaaaggtatatattgcgtctgatcacaatcatataccagcattgcgatatattgtgcaaagaccgcagtataaataccttgctcagcacctgtctcaaaaggcaagaggtcgaatgttcccgaaatcgtattcatcgtataatccgcagccattactgcattatccagatactgtttttcaccagtcgctttataaagcagcaccgaagcgccaatatatgaagcctgattgtatacatgatctttccatgcaggattaccattaccatgtctgctgtccgctacctgtccggtagtaacatcaacgaggttctccactgcccaggcataaatttctttacctttagccaaatactgttccttcgtttgatagctcggatgggagtctgtcgattctgtccttccggtcggtacgttgttgtataatgtcagagctgccaccacagtcggaaagttgatacaggccatcttaccgtggtcagcttcgttaggattcggattcttgataggttgccattgccagaacataccacctcccagccctttttcagggtctgcataagaaccggtatcacctaccttctctgagccataccatacacggccaaagctttcttcagaaaggctcagatattcctcaactccgaatagctcataggcacgtgccaatgtaactgtccaccacataatgtcatcataaataaaccagccggtattctcgttattatcatcaaaatcaaaattcgcataatgagctttattgccggcaaacagatcatcacaaagctgtttaaatttttgttctttctgagtatcaccctcagcctttgcacgcttataagcattcattgccatatcccagtaagtcggctgacaccaaattgcggcagcaccattccaacggtctacagctgccttgtcagcagtgctacttttatatataaacttattctgatctaacagatgttcattaaatgcctcataagctttccatgtatctgcgtttgtatattcaggcacaatctcgtaatccggagtataaggtctagcttctttatcatcattacaagacgacaaacaaaacgcacctgagactaagcataatgcagaaaatatatattgtttcatcatatattgcgatttattaatcaattaattaaaagccttcattttgaaccagatttttatcaatatcaatttcactctgcggaatcgggaagaagtattgacgatcaaaattacgggaagtgatttctgtacgtttgtagaactcatttccatcatagttcacgttcataccatgcactggtttgttaaagaactcattcgtcagtccccaacgacgcacatcaaaatagcgacagttctcaaagcttaactcaatgcgcttctctttctggatcagtttcatgatttcactggtagtggttgctttcggcaaactggcagtaccatatcccggaatacctgcacgttcacggatcagattcatgtatttccaaatatctgcatgacttggatctacatatgctaatgcttcgatataatcaaagtaaatattcgtcaagcggagcaacacacaaaccaagttttgattacggtcacccgaatccatattcttacgtaccagatagcctgtactggtaaagtcattgttaccctgagccttaccacagtttccactataagtgaagtcaactgtataatcgccttctgtacctgagaaccatttagaattactgaaagtgatatcagcatagaaacgcggttcgcggttaacatacatattgcgtgttccagccggtgcataaagagtaccatctgccgatttatagtctgatgaagaagtgccgtcctctttatagcccgaagcctcattgataatcggagtgacaccatcagctgcatagcctgtaacaggtgacataccattggccataaaataggcatcaaccatctcttgtgtagctcccaacaaactgccacctctgtaatcatttgtattacctgacttattgggcatacgatcatactgcatagtacctgccgcattatccatacgataaaaaatcatttctttgttattacccatttctgagaataacgttctgatagcacggcgataagactcataaggattgaatccctcagcatcagggcctgctaccgattttcctgatttatctgtatacatcaattggaaacgattgccataatcagcgaagaatttttgacattcagtaactaccttctgccagtcagccttgatagtggctgcatccggttgactggggaataatctcgtcccatccggatttgccatatcggcataataagtgcactctccattaaacaaccagctggcacgataagtcaatgcttcaattataaatgcctgggctatagccttgtctatacgtcccacacctgttgttttatctgacgaagcatcttccagcagaccagcattctgtgcttctttcaattcggacacaataaaatcaaaacatctgtctacagtgctacgagacaattgcaattcattactgggagtatccaaagcataatcgtcttccaaaacaggcacaggaccatatgtacgaaccagatagaagtaataaatagcacgcagagctttagcttcagctttccattgtgctctttccgatgccgtaagcggagcctgatctacatatttggtaaatacagcagattcatgaatacccgaataccagcttttccaacgatacaataccattgtgttttcggttgcatcaatagagttattattgatcagtttggctttattgcctgatgaagtccattcggtttcatcactcgctccggtccatggtcccggtgtacgatacaagctggtttcatgtacctggcgctgattaaactcatccggcaagaaggtataaacattcgaaagatatttcaatgctccatctctggtcttaaaaatttcttccaaagataatcggtcatcgggcacttgatcaaaataatctgaacaggaagtaagtgttgtcacaaaaaagagtgataacatacccaatagtatatagttatattttttcattgttattggtttttagaatgtgaaattaacgcctacagaataagaggttgtattcggataagaagcaccgttatctgtattcaactccggatcccataatttgaatttgctaagagtaaacaagtttgttcccatcacatagactgccgcatttttcaaacgtactttattcacccagtctttcggtaagttataggagatctgcattgtttttaagcgcaggaaactaaaatcacgaacccaccatgtactcggctggaaattgttaatattactggaagtttcagctccataggacaaacgcgggtaaaaagcattctgattcgggttatcttcagtccagcggtcatcaatattgctatacagattaccggaaccgccaccgccgttaaacggttgaatactgctaccgctcattatacgttctgcatcatgagtaccctgaaacatcatacctaatgaaaggttcttccaacccagcgtgaagccaaaaccgtataccatagtaggtacatcaccacggcagatataagttttatcataagcgtcaatctgaccatcattattaaggtctttatacttgatatcacccgcttttaccgtaccaaactgagaagcaaacggcttcggagtagtagctttatttgcctgggacaaagactcccaacgtgccatatcatcaatttcagcctgtgtaaacaaaccttctgcgatatatcctttttttcctagaatattctgtccatattgattcatccaatcatagcgttgttccggtaattcaccttcaatccatttatccttattataggtaatattaccgcgaatagcaagcgtccagtctttattaaatcttttattgtattctactgtagcatcgaaacctttattttcaacaataccaatatttccataaggagcagatgtattatatcctaagaatgacggaatagagttttcacgttttaacaagatattttcacggcgctctttgaagatatcgaagattattgaaagatcatcattaaacagtttcaagtcaatacctaagtcttgtttgcgtgcttcttcccaaatcaagtccacagccatattcaatgtttcatatcctgaatatttcgtcccgttaggtcccagtttataaccatagtctccattttctttcatctgattcaaatacatgaaacgacggtcggaaacatcactattaccgactttaccgtccgtatagcggatcttcaggaatgatacgacctttgacagcggttcccaaaacttttcatttgaaatcacccaaccaacaccatacgcagggaaagtaccataacgatttttaggagagaagttctccgcaccattataaccaatattgaactctgcaaaatagcggtctttccatgaataagtagcacgtccggcaatacccatcatacgataagggatggcatcttccagtgttcctttgggataaagaagtttctgttgctgattaaagaggaataatccgcttacacgatgatcgccaaatgcgcggtcgtaatttaaagaagcttccagatatgttttcttattaccactcgtttcctgcttataactcaagacattggtgcccgtatagattctttgcagaatcggctgtccgtccaagtcataaggaacattcgtatccaagaaataataagtagactctgcacgatcctgatgaacatgtatttcattatatacatcgaatgcgtacatagctgtcaatttcaatcccttagtaagcatatccaggtcttgcgtaatgcgtaaattagaataaatctgattcttggtcagattatcatatccacgacgtgtagcttgtgaataagggttgttgaagttgttattggtggaacgccccggaatatatgcctcaccgttaataaagaacattttcggatattctaccggagaaatggacatagcagcattatacaagtctttggaagatatggccggataattaccttcacccagataaccctgagcaccaatttccactttagttgtcggagtcacatcgatactcagattggtagtaaagttatagcggctatacttcatctttgaatcaaaggtattgatgctcttatctgtcactgtcataccagtctcattgaagtagctgaccgaagcgtagtatgaaactttctcactaccaccacgtacattcacgttaacacgacgattgtgtccccaatcattaaatatctcattcagccagtccacattcggatacagatactggtctttacctaagattgtattctggatttgtgaatctgtaaatttagttgccagtccatcatttcttaacgcttcattagccgccttcatataagagacaccatctgtcaaatccaccattttagtgaaacgggtaaatgattcataataatcagcactaattgtcggtttacctattttacccggctttgttttgattatgattacaccattcgcaccacgtacaccataaacagcagttgctgatgcatctttcaaagtagtcaatgattcgatatcttcaggatcaatatcgttgaatgcacgttctactccgtccaccaaaatcaagggagtagccgtattgggagtagcaataccacgaatccagatatctgctgcatcttttccaggctcacctgtacgttgtacagcaactacaccagccagacgaccggccaaggtggtagtcaaactagccgaaggagtttttatatcttccagcttcatactggattgtgcaccgatattactgattttacgttgtgtaccgtaaccgacaatcacagtttcttccagttcgtttacctgttcttccagtacaacatcatagatatttgtagatgagtttattcttacctccgaaggtttaaatccgatataagtaaacttaagaacagcattcttcttgctgacacgcaattcaaataacccatccatattggttattgaaccattggtatctccatccacagtaacattcacaccaataagtggctctcctttggtgtccgttacacgacctgtgatttttcgagcattctgttgttgcgcggcagaaacggcagctgactttcctgagataaaaacttgtctgtcagagattctataagtacaggacgtaccttcaaagagttcagtaaggatttcgtctatcttcttgtctttgctatcaatggataccttacgatccagatttattgcatcatccaaatagaaaaagacaaactggctggttttctctattgtttgaaagacttctctcaacgtcttattgttcacgttcaccgagagagttttgagctgggaataattattgttattagcgaaagaataacttactcccaaaagtaagaagcaaagaaatagcttgagtattttgctctttcttcccttaattgaatttttcatattaacaatgtccaaatttctcataatattattattttataacttaatacttacaggcatatgagccccatctggataatacagcagtattatccactctttataaaaatcgccataaattcttgagatttattttattaattactatatttttctgtgtctattttttcacgacccgataagttttatactgtccatcataggcataagatattggtgctacaaaggttaatccattaattactgtctcaaagttgtctttcaaatcaatttttccggaacattttatcttacttagcgctgagtcaaattcgacatttattccatagtaagtggacagacgtttcaatacaattcccaaatcggcactattgaaacaatagagaccatttacccatgaaatcatttgttccacatctacctgtgaaatattttccttcccttctacagaactgaacatctggttaggagctaaaatagcttttggggtttgcgtcgtctcaacctgcacacacccttgagccagcaccacactgcgaattggctcagattcataagctgtcacattgaatttagtacccagcaccctaacgttcatatctttagtacgtacataaaaaggacgttcttcatctctagctacttcaatatagatttctccgtcaacatagatttcgcgtttatccttttcaaattctgtaggataaatgactctggtacctgcattcacccatactttagagccatcagaaaatgtcagtacagaacgctttccacgtgggataaccaactgattataaaccgccagttcttttttggatatattttcttcgttagctttaattgctacagaatcataggtaattgtagtctctttttctttcagacttacgactttatcttctgccagaatcaacaatgtttcctctgtagccggtaattcggtcttagtctgaactgcaaatgtcgcaatatcaggagccaaaaccgcctgataattctttaataaaaagaaactaccaaccaaaatagctacactggctgcggcagtcaaccctatcagaaaaaagtttttatgtttaatcttatcatttttaatatttgttgtctggatatcagcccacaactctcccagttcctgatccgaaagcaaatcaccttctgaagtagaaatcgtttctatatattctcttgccgcaaaataatcatctatattagaaggagtagatttctcaaaacgatcccaaaactcttgtatctcttctgttggatatttaacagaagaaataaaaaaatcattttgaaggaattcttcaaaagtatatctagaaaaatcagtatgtttcagttctgaattaatcatttttattgtctttacattaggataacagttctactttgattttatactcacttttctcaaactattttcgatatttttttgatgggcaggaaaaagctgaatattcttctctcctattctcgcttgaatagattccgtacacgccccaaagcccgctggatagagttagatacagactgataattcatgtccgtgattttactaatttcatcaatactcatatccttaatataccgataataaacaatttcacgttgcctggtggttaaggaggacatcatagcatgcaccttcatatgagtattcttctcttgttccttatttatataaatagtttccggagtagaaaaatgctcttcggactggtcttctttctcatcagcttcgtccaatgaaaaagaatcagatgttttctttaacgcattaaagagtgtatttttcagtgccaccatcaaataagctataatgttatcagtaggggttaatttggcacggttggtgtaaatcttcacaaacacatcatgaatacaatctttgaccaactccctgtccgaagtatacagtaaaccatatcggaacagctcttgtacagtctgattatatatttgagaatacgcactcgaatctccttcgagaaacctcttccataaaagagaatcagagagagtgtgtatatctgaggccatctataacaagtttatgagtttacaaggacaaaaataaaacaataaatcaaaaaaaagcccacctttatagaaaaagttaattgcaaagagaaaagccatcatttcctatagataaatagttttctctttgcaatttccccaatactttttctattctggataaagtgtctggataaaatttatttgtttaaacttcaactacattttatatgctcatttttcattgtaaagaaatgaatagccatatgaaaaaacttatctgaagtccggagcagcagtctccaaggaaggtacagcgcctttcacaaacggccagccacctttccactgcacacgatccatcatcaatacacggccctccggattagcaacactgaccgcatgatagaacatccaatcgtttcctttcttatctgtcaccagttcagaattatgccccggaccgacaaatgccttattcttctgaatcaatatctcatgatgattatctgacattgaacgccctttcttgtcaacataagggccgaacagattcttcgaacgccccacaactgtagtatatgtgctcttcaaaccttcacagcagcggccgatggaagcaaacaaataataataaccatcccgtttatgaatatacgtaccttcataagcagtaccggctatttgctctattggagcacctttcttcaaagagagaccatcatctgtcagttccgtaccatatattccgtggaagctcccccaaaaaaggtatttctttccattatcttcaatataaaaaggatcaatgcaattctgtatattgatttcattgctccggaataacttacccaaatcagtaaatggtccttccggcttatcagcagtagcaataccaataccacatgtccactcacctccccaagtggacatagaataatacattacgtatttatcaccgattttattaatatccggtgcccatattctccctttaggttcgaagtttggacgggtagcatctgtaaaagcagtacctacataataccagtttaccaagtctcttgatcgatgaataggtacatttttaatactttcagttgcgtatagatagtaatattcatcgtctccttttataatagtaggatcgggcaaactaaagtttattacaggattagcatatgttttagcgcgaacaggggttgccaaagggctagctcctactccttcaaaagtcatacggacaggctctatttttccgtctttattaaaatacatacggtctatacaagttgcacggctgttcgctgcagtttcgcccaacggacgacggtgataaatgatataccattcatctgatccgggacctttaactaccgaatgatgaccagcaccggttgctatattagtatcttgctgcagaatttttccgactctttcaaacggaccgaacggtgaatccgcaatggcataggctacactataatccggacctccccagccaccttccgaccacataaaataatattttccattatgtttcagcataaacggcccttccacataattttggggagtcacttccttatagatagtaccatcctcaaaaggtacaatactcaataaatccggtgccatcttcaccatattacaatgtccccaaccaccataatacatataatattgtccatcatcatccttaaatacaaactgatcaatcggctgagcaccatttacaatcttatcaatcaacggttttcccaacgcatctttaaaaggtcctgcaggattgtctgctacagcaactccaattccgcctaactcattattattttggatatcattggctccgaagaagaaataatatttatcattagcatggattactgccggggcccacaatgcacgtctgagccagctgatattttctttggaaagtactttcggatgcttggtccagtttaccaaatcttttgatgagaaagcatccatgaatatctgatcatcataagcggcagaataggtaggataaatccagtattcgtctccaaacacaatcccttccggatcggcataccaaccagggaaaataggattaccactcgttttcggaagcttacttttgttttgggcagatatagatacagaacagcaaattacacagaaaagaaaaagatgtctaagtttcatatattatttatttaaaagttcacttcgcaaagatgagaaaaaacaaagaaaagtttcagaaattacagttcatttaacaacaaaaactgaccattctacttccatttgcatgatttatcaatattttatgcttactttgcattgtcattatcaaatgagaagtaccatgagaagcagattgtttttattatccattatcttattaatcggtgtctcttgccagcataagaaggctacaacagagaaagaaactgtagccgcaggaaatacctatacgaacccgttacttgaacgtggagcagagccatgggctatttttcatgaaggcaaatattattatacacagggctcagaaaacagagtcatactttgggaaaccgatgatataacagacctctcacatgctactcaaaaagatgtatggatacccaccgaccccagcaactcctatcatctgtgggcacccgaaattcatcgtataaataacaaatggtatatttactttgccgcagacgacggcaatatggataatcaccagatttatgttgtcgagaatgaagccgccaaccccatggaaggaacatttgtgatgaaaggacgcatacagacagataaagacaacaactgggcaatccatgccagcacctttgaacatgatggccaacgctatatgatatggtgcggctggcaaaaacgaaggatagacagtgaaacccaatgtatctacatcgctactatgaagaatccatggacactgtcttctgacaggattctcatctccaaacctgaatatgaatgggaatgccaatgggtaaatccggatggcagcaaaacagcctatccgatacatgtaaacgaagcaccccaatattttgaatcaaagaataaagacaaagcatgcatcttctattcagccagtggtagctggactccttattattgtgtcggattactgactgcagacgcaaaagctaacttactcaatccggcttcctggaagaagtctccggttccggtactacaacaagaccctgaaaacaatgtatacggtcccggcggaatatctttcactccgtctccggatgggaaagaatggtatatgctatatcatgcccgccagataccgaatgacgctcctggcgcatccgattcccgttctccccgtttacagaagatagactgggacaaagacggaatgcccgtgctgggaacccctcaaaaagaagaggaaccaatggcaaggccatccggttcccctattcataaaaaacagaactaattacagattgtactctgagggccgagataagaacgcttcattcctcccaagtcaatgacaatcttttgaataacgacgcccggatcaccacagcgtatctgcaaagtgtgcttaccgggcttctttacatacaaagtagacttattcactctgcaattcttcaatacgctatcataccagatttgagaatattcgatagctgaagtagaaggagtagaaatggaaccatcatctatacggacactatactttgtatccgagttagtatgttccggcaatttgtagtcccgctcagcatgcaagggaaatgtcggcaaaacatacgtatatacatcataaatcccggcattaaatgtatagaaatcatattccaccctggggacatcacctgcacgatacatttgtaagggagctgtcggattccccaactgcaaagagcgcccctcaaaaccaagtcccggaaggatactcatccgaatgtcattactctcaaacttccggtggaaatcggctgccggaatagaaatgtaaccattctcctctacatacaatccttgtacttctgtgcgtgcaggagactcaggattgaatacagaaaccagtacagtctccttctgggtgccggaagttatatcaatttgtcctttcaccttttctcctgccggcaccttatcccagtcaacagatatatagatacggttttccgcagacgtcttaccacttttctgagagatcagtatccagtcttccgaaggcgtgatactccagcttagctctccggtcccctgattatatatatctatccaatgacttttacgtgaataagtgctgtaggcgggcaatgtatgaaaactcattcctcctttatccaaattttcgctttctgcctgaagccccagcttaggaaagccaacaggtgtgtattcctcttccatcaatgggatcatgaaataggaactcgtaccatcatagttctgttttaaagacatcatgtgcttccattttccatccagcagagagttgtatccatcggttatgatttcgagactatcatgatagcacttcacctgagccttaagccgattggcggcagcacgttgctgacggacatactgacggtaaaactgtcctttgatggtcatatgattcatcagttcggcccctttcaccggatagtataataattgatagaaagccggtttactcttttcgtccaatgaagctaacaaatcctccgtttttttcccaatacggctatactcagtcaagcgtctttccgcttcattatagttagcaaaagagaactccgtatccgtacgtttctctccgcctccccaatagttattccaatatccccagcccatgtactccggctttctggaaaaagccaaatttatatgagaacaagttatatcttccaatgtatcgtagtactcctcaccaaacatctttgccagccaacgtgccggataagtggcgacattatccgcattgaagctgtctatatcataagccatatcaaggaaaagggagatttgtgtttcagcccctttcaagtctccgcaattcgccagccagacacgatcggcagtggtatcatacgccttacgaagttcttcatacatcaatgccggaggggtagtactataccacaaatagctatgaggaacacccaaataagatatatgatagtaaacgcctgcacgtccggagcgcttttgctcctgcggaccactcagacgtttcatataaccgaaattatcatccgcccagataattgtaacatcatccggcaattccagtccgttcgaatagatttccagcacttccttataaggcgtaaatgcctgtgggattgtttcaacaggtttgtcgatatgccgggcaatgatctctctctgagcattcagtgcactttccagcatcttaaccttttcccgcatcggcacatctccgccacccatagctgcatcatgcaagcctcttaaagccagcgtatatacattttcatacgcacagttttccttcacacgattactcaatacctcgttgatcttatctttgttcttgttataatcccatggtcccatcgtcttgctgtcccattcgctggcagtgttcagcaataacggttcgcagtgactggaccccataacaatggcaaaggtatcagctaccagtttattttccggtatcttataaaatgcggtagaaacggggtgcatggccggtgccagatgattagctttcagtcgcagcaacagctcgcatattttggcataggtacgaggaccgatatttcctctttctttctcgaatgtcttggcagcccaaggtttcagtccccagtcttcgtcatttaagaaaattcctctgtacttcaccgaaggagtcttggacaaagtggcgggggcatcgacataaagcgtcttatgtttcttcaccggaacatcagcccaccagtaccaaggagacactcccatcatttccgaaagcgaaaaaagtccgtacgcagctccccgcctgtcgctccccgctactaccagcgctttgctgactccggggaatggacgggaaaccgtctgaatcagaaatcgttcccatgtcccttccaaagaagagatatctagcttgcccttctcagctaactggcggatcagccgatttttctcaactgtacccacaataataatctctttgtcgcctttcagtttgtccgtcaaccgtaattgttgtccggtcactgattcgacgtccgaaacaaaaagctccgcagtcttacgtaccaccaaatagtcatcagtatcataaactactacagctttcgctttcgaagtaaccaagggaaaagcatacttactctgaatagcattctctttaatgactacctgcgactgtagggcagaagtaaccgacaatactactaataaaaaaagaattctcattgataaagtttattatagttgtttttcagtttatttacgactatccgcggaaacatacgattgttctccctccaaaagtcataattatctccggtaatataagctacttattattcaattaaggacaaaaaataaccattatcgcataaaaaactgtcattcactataaaatgacgagcatttatcatttattgaacagcaaatttcctttattcttctctgattagcttttctttgcaatattccttttatgaatattaattcttctatttaatacatataaagataattaccatgaaaaagaattttctagcagtgctattcgcattggctctttgtagcccgacattcgctcaatggaagcccgccggtgataagataaagactccgtggggtgagcagttgaatcctaaaaacgtattaccggaatacccacgccccattatggaacgccaggattggaagaatctgaatggtagctggaattatgcgattactaaaaaaggagaaccggcaccaaacaattaccaaggagagattttagtaccttttgcagtcgaatcttccctgtcaggagtaggtaaaaccattaacgagcatcaggaattatggtatcagcgtacttttgatgtaccgtcagcatggaaaggcaaacaaatattactgcacttcggagctgtggactggaaagccgatgtatgggtaaatgacgtaaaagtaggacaacatacaggaggcttcactccattctactttgatattacttccgcattgaataaaggcaataaccagttggttgtgaaagtgtgggacccctctgaccgtggcgaacagccgagaggaaaacaagtagaaagaccggaaggaatctggtatacaccagtcacaggtatctggcagactgtatggctggaaccggtagctgcccagcatatcgcccaactgaaaacaactccggatatcgacaagaagactgtcaaagtggaagtagccaccaacgtatgctctccagacaaagtggaagtgaaagtattcgacggcaaaaacctcgtagccaaaggagcagcgctcaatggcgtaccggtagaattaacaatgccggaagacgttaaattatggacacccgagtctccttcactttataatatggaagtcactctttataaagacggcaaagctgtagaccaagtgaagagttacaccgctctccgcaaattctcaactcataaagacaagaatggtattacacgcctgcaactcaacaacaaagactatttccagtttggtccgctcgaccagggttggtggccggacggcttatacacagcgccaacagacgaagcattggtatatgacttgaagaagatcaaagatttcggctacaacatggtgcgcaagcacgtaaaagtagaaccggcacgctggtatacttattgcgaccaactcggactgatcgtatggcaagatatgccgaacggaggtcgcggtcctgccgaatggcagatgcacaagtactatgacggcgcagacgccatccgctccgcagcatcagaagctaactatcgcaaagaatggaaagaaattatcgactacctgtattcttatccgagcatcggcgtatgggtacctttcaacgaagcatggggacaattcaagactcctgaaatcactaaatggacgaaagaatacgaccccagccgtctggtaaaccctgccagtggaggtaaccactacacgtgcggagatattctcgaccttcataactatcccggaccgaacctctatctctacgatccgatacgcgctaccgtactgggcgaatatggcggtataggtatggcactgaaaggacatctgtggctggcagacaagaactggggctacgtgaagttcaacacgccggaagaagtgactaatgaatacataaaatatgcagaccatttattggaactgatcgagaaaggcttctcggctgccgtatacacacaaatcacagatgtggaagaagaagtgaacggtctggttacttacgaccggaaagttattaaagtagacgagcctaaaatcaaagccatcaaccagaaaatttgtaactcgctaaataaataaaagtttcatattaatgaataaactattctctacaatcatgtcagtttgcctcgcatgcaatgtgcaggcaactgacctgtttaaaacgagtcaggatatcgctttgcgtgcaccgtccgtacctctgatcacttccgacacttatcttgctatctggtctccctacaacgaactgaacgaagggaacaccgaacactggacagccgccacccatcctttactgggagcgctccgggtggacgggaaagtatatcgtttcatgggcaaggacaagctaaacctcgaaacaatccttccgatgacaaacaccgaacgttgggaagcaaagttcaccatgagccaaccggcggccaactggatacagccccagttcgatgattccggatggaccaagggcaaagccgctttcggcaccaaagacatgaaacgcatcggcacagagtggaacaccgaagacatctgggtacgccgtagtttcaacctcaatcaagacctgacaaacgacattatctacttacgttattcacacgacgatgtattcgagctctatctgaacggagaaaaactggtggcaaccgattattcctggaatgacgatgttaccatcgaactatccgcatcagctaaagccaagctccgtaaaggaacaaacattattgcagcacactgtcacaacacaaccggcggagcatacgttgatttcggcctgttccgtgagaacaaacagctcagcaacttcaaggaagctgctatccagaagtctgtcgatgtattaccgacacagacctactatacattcacctgcggtccggtagaactggatctcgtattcacagcacctctgctgatggaagatcttgatcttatctcgacccctatcaactacatctcctatcgggtacgttcactcgacaagaaacaacatgatgtgcaagtgtatatcgaaacaaccccgcaacttgccgtacacgaaccgtcacaaccaaccatctcagaaaagatcagcaaaaacggaatggattacctcaaggcaggtaccatcgaccagccttacgtaaaacgtaaaggagacggtgtacgcatcgactggggatatgcttatctgggaagcaacagcgcacccaacaaggacttaagcataggtaactactatgacatgaagcaagccttcatcaccaacggcaaactattgccaaactcccaggatttcatcacccgcagcgaaagcgatatgcccgccatggcttataccgaaaacttaggcaaggtagacaatcaagggaaaagcggatatgtgatgttaggctacgacgatatctactcgatcgaatatttctacgaacgccgcatggcatactggaaacacaacggtcaagtcagcatctttgatgctttcgaacgtgcgcaggcttcttatccctcattgatgaaacgttgccgtgccttcgaccaacaactgatggctgatgcagaaaaagccggaggcaggaaatatgccgaactactcgcattgacttaccgccactccattaccgcccataaactccttaccgacaaggaaggcaacctgcttttcttatccaaagagaaccatagtaacggctgtatcaacacagtagacctaacttatccatccgctccactataccttatttacaatacggaactgatgaagggaatgctcaactctatcttctactacagcgaaagcggacgctggaacaagccttaccccgctcatgacttaggaacttatccaatagccaacgggcaactttatggtgaagatatgcctatcgaagaagccggaaacatgattctggtaactacagccatctctatgatggaaggcaatgccaactatgcttccaaatactgggaaacattatcaacatgggcaaactatctgattgagaacggtctggaccctgaaaaccaactttgtacagatgactttgccggacatctggcacacaatgccaatctttccgccaaagcgatcatggcaatcgccggatacggagaaatggcacgtatgctgggcaaagaaacaactgcgaacaaatacatcgaaaccgccaaaagactggcgatagaatgggagaagatggcatttgacgacgatcactacaaactggcatttgacaaaccgggaacgtggagtcagaaatacaatctgatatgggacaaagtgtttaacatgaacattttcccgcagaaagtatttgatacggaaattcctttctatctgaccaagcaaaataaatatggtttgctattggactcccgcgcacaatataccaaatccgactgggtactatggagtgcctgtatgtctccagacgatgctacgttccaaaagttcatcgacccgatctatacttatgcgaacgaaacaacttcccgtgtgcctatcagcgactggcatgatacgaatacaggaaagatgatgaatttcaaggcacgttccgtagtaggtggctactacatgaagctactgatggaaaaagtcaaagaacagaaataaaacgaatactcttttcctcgttgaatatagacaaacagcccttttgcctagcgtaaaagatgctgtttgtcttttttcatatcatttaatgatacgatcagttttccggagttatatcatcaatcagatattgtccgtcaacgttaaccactctgaccgggatactcacggcacgttcatactggctgcctttagccgaagtatagttaacctcataccaattatcattcagatgtttcaccgacaatgttttcatgtcattttcacctaaatcttgcgcacgaatgatcggatcggcatctgtcgcctctatcagcctatcaactttctctatcagctctttggtcagaaacttttgcttaattgaatccccaagtgcgagagcttctttaccggtggacatgaaactggcagcataagcctcataaaagtcttcaatcatgccgatggcttcttgttcaattctactactgtccgacacattcgcctgtacgtcagctggttctgccgatgtatccatattcttccggctctgattggaacaggaaagaagaagcattacggactgcaataataacaaatgtacaattctcaatttcataacattaatggttcttgttttaaactaataatcagatttccaaactaatcagcctcccccttcagaatctcttcagttttatcctgaccggtataaaaatctatatttgcaaaataacacaaatatttccagaaataaagcgtcaggaacattcgcacatcacgatctgttttaaaatcactgcaaaaatgatccgtgttcctggcaatttcccaaaatatcataaccgaagaaactcctcctgtcgcattttccgctttgacatacgctttcaaggccggatgaatggccggttccaattctctttgccaatatgtgaagccatccaaccgtttcttaaacggcaatattatatactcaacctgagctttcatatacgcatattgtagtgaatcggcaacaaggctaagagagccaccatgctcctgctgattcttggatgcttgttgataagcatcagactgacgatattctgacggagaaacaccatccggaacaaacagcgtgcaagaatcattcagaatagctccatcaacaaaataggaatgaagtaaaccacccgcaatccctatgttttcatttaccacctagcatctcatgaattacatcctctcttttattgctaagttcatctatcaactttttcgtgtgttgtcttattgctggactgaagatttggggatactccttttcgatttcatccaaagaataatttttgttatccctcaaaaagagtacgaatacataattcatcaggtctgcttcagttggtttctccttcaagcgttttttgaaaagagaggcagcttgtttgtaagcatccatagccaggctctttttagcattctcttccagcatcattcccttacctaaaatatagtaaggatcatccggagagaatttctccatttgcaacatggtttgcagtgctttctccttctgtcccaacgccattaagtatttaatcttatttgcatatgccagtttgtatgaaggctccaaagctatcgcctcatctgaaagatgaatagccttatttaaagaatcggaatcattaaagaaacccgcagttttcacagattggttattcttctcaactgctttgggagaaatctgagctatcgcaaaactcgtgttcgtgcataaaagcaaaataataagtgttctcataattctatttattatcattgattagattttgtttaatgtgatacacaaagaacgacaaaaaacaatagaaacacgaacattttctattcaaaaaatgataaaatctattcaacaataaaaataaggcagcctttctcattcagtacaaacgaattttgataaaaagaattatcaacatgaaacagcaatccgattagtatttatagagtaatgaacagtttctttcttagattgaacgttttttttccttctttattcatcgaaaccgctatctttgtagtagttcacatgatactaaaatagcacagagaaagtgctgaacataaaaatcatacaataaaatagacaactaaaaatagacagcactaatatgaaaaacaaaccgttattatttttactctcagtatgcggacttttagcaatatctgcacgtggagaaaatccacccgctaaagtgatattcgaacagtacatgaatcaagctcaaacttttgccgataactatccgcgtgaaaaagcatatctgcattttgataatacaagctattatgtgggcgacacgatatggttcaaagcatatgtcactcttgccgaaaaacaagttttcagttcaatcagccgtcctttgtatgtggaactggtagatcaggcagggcacgttactgataaacagatcattaaactatcacaaggagaaggcaacgggcagtttgtactcccccagtcaatgctatccggttattacgaagtacgtgcttacacccgctggatgcttgcattcagtgatccgcagtacttttcacgtactttccctgtctatcagctttctcatagcgaccagttggagcgtagtatcagcacctatgagttgagtccgtctatggagaaaaggccggaagaaacaagagagaagctgagtctgcgtttctttccggaaggaggacagttagtcgaagggataacttcgcaggttgctttcaaagcagaaagcaaaaatgaaggaaatattcaattatcaggcacactttataccaaagaagggcaagaaatcacgtcttttgaaactttacacgatggaatgggagcttttgagtatacgccttctgctctgccggcaatcgctaaagtaaactttcaaggaaaacagtatgaatttaccctccctaaagcactgccaagcgggtatattctgaaagtaggcaataatgcaggggctatttctgtgacggtatcatgtaatgcagcgaccccgcaggatacattagccgtttttataagccatcagggacgtccccatgcctatcagcttatccactgtcaggcaaataagcctcagcaatttacagtattgtcgcgcaagttaccggcaggagtcttacaaatcagtctgctcaatcgtgccggaaatactttatgcgaccgctttatctttgcttctccacgggctcctttacaaatctcgcccaaaggtttaaaagagatttacgctccttatgctcccatccgctgcgaactgcagttgaacaacgccataggagaaccgatacccggcaaattatcagtcagtatccgtgacgccgtccgctctgattatatggaatatgataacaatatcttcaccgaccttctacttacatcggacttgaaaggctacattcatcaacccggctactacttcacagagagttctctccggaaacagaaggaactggatatactgttaatggtacacggatggcgtaaatatgatatgacacaacagatcggtatcagcccattcaccccacttcagttgccagaaagccaactggtactttatggacaagtcaaatctacgattctcaaaaacaagctgaaggatatagctctcagcgtaatggtgaagagagatgcagagattattaccggtcagaccgttacggatgagaacggacatttcagcattccgctggaagatttcgagggatcaatggaagctgtgatccagactcgcaaagtgggaaaagaacgaaataaggacgcttctattctcatcgaccggcatttctcgcctgctacgcgtgcatacggttacagagagttgcacccggagtggagcaacattgcccactggcaacaggaagctgaaaaattcgactctttatatatggattccatccgtcgggtagacgggctttatcttttggacgaagttgaaatcaaaagtaagcggcgcagtcaaagtacgaatatggcgactaaaattaatgagcaaagtattgatgcctactatgatatacgccaggctgtcgatcagcttcgcgacaatggcaaagttgtcaccactatcccggaggtgatggaaaaattaaatccactcttttactgggaccgttccaatgataactgtacttaccgccagaaaccgatctgttatattatggataacaaaattctatcgtcaacagaagtaaacatgatgctgactgaaatagacggtttggcttctattatcatcagtaaaggcacaggaggagtagatgatgaaattatccagaataccaaaatgtctaattccaatgatgtagatgtatcggaactggacaaatatagtattttctacctcattccattgcccagacatgatgttctgaataaacacgagactgcggctcttggtacccggcagactgttatgcagggatatacaccggcattggagtattattctcctgcttatatagataaagaattatacatggataaagcagacaaaagacgaactctttactggaatccgactgtgcagacggatgaaaatggaaaggcagtgatcgaatgttacaataatcagtattccacgccattgattattcaagctgagacactgagtaatgacgggaagctagggagcgtgacgtattctacagttgcagaaacgaaatagtatgctttaggatatttgacaataaacggcacacaatcagtcctaaaataacttttcaaaataagagaagagggtgaattcaataacttgaacttcaccctcttcttgaatcattagattagcgattaatagaaactaccattcaattgcttgatcttcgtctggaatctgagtattgatatcacgtgataatgtcaatgtaccttttacatgatagcgaatgatggtaccttccactggtatataattgaaataataatcaacattattaattattacataacggtgttccagataaggcttcgcgtcatccattgatgaagaaatacgaaatgaaggagtcacgtccttgtttaattcaaatccaatctcttctgcattatcacaggaaatagtaaccgaaccattcgtctcaccattaaaagcaaatttgattttatactttctacggtctgtataatcctcatctactattcctgcatacgtaaaaatagtctgttcatctatcacataccctcttattgacgattttgtgatagattctgctgtttctatcggtttaccatctccatcatatcccgtcaccaccttgttggttattcctgtaccagaataatcgccagagtaatcattaaatgggaagattctcaatatcgccttagcatagtctttacgtggatgagctacgtagttgtaagacgcgtcgtctacaatctgcaatggaagtacccatttttctgacatatcaatgttgcgaaaatcaaatttaagatccagtaaacctttattttctcctgcttttatctgtagagattctggatatgaagcgtatgccaatccttctgctcccatatcctcataatatagttctgtacgtgtagcgtaacgagcgtaattcaaaatattcaatgtatcagcatcatgtgctacgtgtacagtgacattacttggattatcggtagaaccactaacaagtatcggtaactgataattggacctcccttctcctccttctgcataatttccttctgcatcatggcggctataaggtacatatatattcgtcactcccttactatccagttgtgaactgaaagaaatgtagtgctcatattgttcatcttcccattccgaattgcaggaagttcccaacattgtcattgcagccaaagctgccaaagtatatattttcttcatatataagtctttatgtttagaattaatcatacattgtccatcctgggttctgtgttaaacgtgaattacgtttcaactcactatgtttgataggccataaccatagcttttccgagaaagtagacgggagattgtaaacaggaattgccgaatggaattcgtctctcttagcttcaccaacaaagacattacaaccgtatatttgcagagattcttctactggcgcatctttccaacggcgaatgtcaaagtaacgttttccttcgcccattaactctatcatacgttcacgttttaatgctttacgcatatcatcaaccccactctgcagataaaattcgtctggatagtcaggcaacccggcacgaatacgtaccggatgaatacctctttccatttgttctttatcacggctgatagtgtaggttgtcgcctcattccaagaaggtatattgtatgttccagtcaactcattcaatgcttcagcataaagcagtagaatatccgcatagcgaattgctgtttcagctttcgcaacataattgcctggatagtcgtttggatgaacaaactttttgattcctatacctgtacgcaagtagaaaccgtcattacgataaccatcggaacttccaaagtagtaccaaacttgttgatttacatcggcaggtttgctttcagtctggctcaaataataccaggtacagccattataagcaacagaagcatagaatcgtggttcgcgttctacatattgcaaagaaacattcatcccagttttggcctgatcgttatctcctttcttcggatcatatttccaacctaattccggatatttattatccttcaagtcttgcaaatcagtaaatccggttctacgttcacgagtatctacaataccttgataattagctactccttgatacatagagttcatacccggctcattactaccattattcatataatatgcatccagcattttctgtgtcataccatgacagttccagccgccatcatctttgggcatctgatgaagtaccaacatatctatatttgttgccccgcgtgtaaatatcagttctttattgtttgcaggtaatatagtaccatcaaagatagtacgatatgatctgagcgggtcaatatttgtccatccttttggccagggttgattggaaaactcgccatcagccggtggagtaacagtcggacgttcagaaggtccattatcagatgtggatttatttacaatattcaactcataaacatctaaatcgatgacatcacggcaagcggcagcagcttttgcccatttttcttcactatattcggaagaaagcaaacgacgcccttcatcatctaccaattgctgcgcatattcatcattatttccattagcaaacggactagctgcaaaaatcagtgcataagcacgaactgccaatgcagctccacgagtaggtcggcctatagcataattatcagtacgacgatcatattgtaactctttagtagcctgtaccatttcgtcactgatatattgtgccacttcttcgtatgagctacgtggagtagctatttgatcataactttgagtataatccactccttcgtccggcataataggcactggaccataacgacgtaagagcaaccagtaatagtaagcacgaacaaaacgagcctgccccttataatctagtatttcccaatcagccatctcttgacaccggtcaacattatggataaatactgatgcttggaaaattcctttataacatgccccccatgccccaacattataagtattctcatcatattctcctaacttgaacatattatatgacaattcattctttgttgcatcgattgtcttatcgcggtcaccataatacatatcgtctgaaaaacaaaacgaattctcacttggtcctttagtcgtcacctcatagttttcattttttataaatgaaaaagcataagctaaccattcttccacatgatccttactttcgaaagttttctccagtgtcagacgatccttaaaatatttctccgaattcaggtaatcagagcaagaagaaattactcccatccctaatacggttaataataatatataaatcttctttatcataatctcttagtatttttataagttaacagataaacccatagtaactgattttgttagcggataggcttcaccccgcggattgccagtttccgggtcccatgttttgaacttagaccatgtaatcaggtttgatcctgcaatatagatacgaatattattgaagtgcagtttattgactatgctttttggcaaagtataaccgatatccagattcttcaaacgaatatatcgaccatcacgcatccaataagtagaggtttgttggttgtttttattttccccataagttaaacgcggatatgttgcattggggttctcattagcatgcaatcccagtttggcagcagtctctgaatctacccaacgatcacttatcatatctttaaagatatttccccagtcactttcgctgaatgcatatacacacttaccataaatagggaaagtggatttaccggcaccttggaagtgaacatttacatcaattcctttccatgcgaaagatgcccctataccatatactaagtttggagtggtagtagcgccaatagcaactttatcattatcgtttacaacaccatcaccatttacatctttatatttgatatctccaggctgcactgtaccaaactcttgtttcgggctggtacgaatatcatcgtaatcagcaaacaatccttcagctatcaatcctttaacttgatctacacgataccctttttgatataaataagaatagacttgattctcttcatccttttcgagcacttcattcttactataagttatattcccacgaatagtcatatccacctcacccagtttctgcttaagagcaaaattgccatcgaaaccttgagatttcacttcacctacattcgctttaggtttgctctcaagacctgtaatgtcaggcaagaactcacgtgttaaaaaaatacctgtacgtttttcgtggaaatagtcaactgtcgctgtaaatttgtcattaaacaaagaaagatcaatccccaggtcatccttagtcgcaacttcccaagtaatgccattagaagccatctgtgtgtaatgagttcctatgaatgattttccataatcaccaaatccccagttatatacataattaggcttgccttcgctgttatatcctgtagtggctatagtatataagtatgggaaacggttgttatccccaatattatcattacctaccttaccatgagaataacgtattttaaacatattcatccacttcaagttattcttaacaaatgactcttcggcaacgttccatgcaagagaaaaagccgggaagaaaccgaattgatttcctggtgcaaaattttccgatccggtataaccaaaattaaaatcaacaaagtaacgatagttccagttataagtaaatcgtcctgctaacccttgattacgttttgatactccattcttaatatccgtaccaatgtctactgtccgcttctcactatcttgtgtgtaacggaaagtaactcctccatgatgatttccgaaagcacgttcccagcttaacagtaaatcaaggaattcacgacgtttgccagagctaccacttgattgtgtcatgtcatatgcggagaacattttctcataaataatctctcccgtttcttgtctacgtccgttcgctttatacaaatctggttgacgatgacgattaatccagttactgttgtctgtatcatagccaaaacgtcctacaaacttcaatcccttggtaatgaaatcaaaattttgttctaatgtaacattagtttgtacattattctgccaatcttcattgtatccagtttgcgtagatgcaacccagggattaagtttgtttacgttatcccggtgggaaataggcgcatatccattggaatagtatacaggcgttgcaataggattgtatccgaaaagcatgccccataacatctcgttatcagccagtcctggactattacgtttggctaatgaacctgctatacctagtttcaataaagtcgatttggtgatatctatatcaacattcatacgataattccactttttatagttggcatttgtatcgtaatcatcacgtaacgtttggtctgtgttatacataccttgatcttccgtataacttgcagaaacaaaataacgagcagtgttaccaccaccattcatgttcaagttagcgcgataactccatgctccgttttttaggatcaaatccatccagtccacattcggatagaaatccggatccatttgtgtacgaaataactctaattcttccggttgataggccattcctaaattgcgagtcactaatgcttcgttcatcagactggcatacgaaagaccgtctacaaattccggagtgatagtacgcgtattataagaagtttctaccttggcatcaatattgatttttccagctttaccacgttttgttgtaatcaatactacaccatttgcacctttagaaccataaatagcagtagctgacgcatctttcaatactgtgaatgattcgatgtcttcaatgttaagttcatccaaactgctacgttcaaagccatccaccagaatataagcacttgaactagctccaaaagtagaaataccacgtatccaaaactcagaagtactttttcccggttgtccggaagtttgtcgggcaataatacccggaacattaccggccaaagcgttagacatattggaagtagggaaacgttttaaatctcccacattcacattggttacagctcccgtcactgtcagttttttctgtgcccccataccagttaccacaacctcatccagtacactagcctctgattctttcatctttacattaacagtatgctgttcttttacaagtacttccacatcatcatatccgatgtatgagaagactagtcgatgataaggttccatctttatagaaaaattaccattgatatccgtaatggttcccaaacctgctacatcctttacagtgatattaacaccaatcatcggctcatcttgtgtgtcggtaaccgtaccagtcacggtaattgtttgttgtgcagaaatcgtcaatgggacaaccagcatcaacaaaaaaatggctaaatattttttcataatctgataaatgtgtttattcgttagattccactgttgattcatcttccggtatattctcgtcaccggctacattctcttcttgctccattgaaatagtgcgaatagtatgtcccacctgatcatgtacataaaacatctctttcacatcatcataaacaagtccacttacatcacggaaacgagccacttctcgtaggtcaccatcatcagttccccattggtttccgtcagctaaggaagttgacgctcctcgtcccgcataggtcgatacgataccttctggagttactttacgtacacagaagtttaatcgatctacaaaatagaaatcatactcttcttcaccagtataatccggatttttcacaaatactccttgacaaggattattcatacgtgcctcagttcctacatcatccctataacctgactgtttatatcccccgacaaaattatacggggtaataaattccttttttatctcgtcatagtcggaacgcatgaaataatgattgttaatcacaccaaaataagcatactttccagtaggatgaatgaaaatctgaaattcccaacttgggtcagcaatagtgaataactgcttaaaagtattaggattgttctttactataggatcccaacttccaccattcttaatagttttaaagtaatcaaccaagtctaaacgaaatacttgtcccttttcataactattaaaatacaattctccgttgattggatgaatagtagctccattacattgtttgtaagcagctatcaattgtatatcagatctatcatcgaatgtaccatccgcattacgtttaataatatatacactaggactttcatctcccttaccatcataatcaatagctacaatcatatattctgcctcatcagcatatccttctatcttcttattgaaagcaatgcttcgtatacgattagtaggtatagtattgatattcaaaggagaagaaagcatacgattttttaaatcgatcaactgtatagctttatgtccatcgtaacaaatatacaaatgatccttattcaacggatcaaaagctaatcgtccgttatcgctaaagccacagcatttgacaccttccggtccatcaaatggtccgtctctccaaccttgatcatcacgattattgcgatagccacaaagcgtacctacaaccatctttttctcatagctaaaagtagtactcgcagtcgttgttactgcattctctccttctcctacagtgatttcaatttcaccactaaaagctcctgaaggaacaaaacagtaaacataagtactttttacattaataacaatagcatctttgccaccaatcttcacttttaccttcgaaacatctgttccgaaattttcaccataaatcaatagtttctgataggctcctccttctttcggagtaaaatcagaaattgctacaggttttgatggatcaaaggctccagtctctacattgtcatcgtccttacaactacaaatgcaaatcgtgaataatgccagcaatatccaccgccattccttcaatacttttttcattttacatttcatgtttttcattctagttaataataaatgtatagttaattaaacatttcatcgagttttgtccattaacacttgcatccagtatcctccaataaccgaacgcgctttaaacccaacccattcaccactgtctgtgtgatgccaatcactgataggtacccgcgaagtagtttcattgatatatttatagagtggatctatgaatttcttgaaagtttctaaatctgaagacatagcagctgtccacataatccagtcagactttgtatactctttgcgggagtccaatggcaatccgtaaggattctgtttcgtcaaataatagttaatttctttgtcgattacattatttgggaataaattcaaattccacattttgtcccaaatcatattatatttctgactccaggtattctcacggtcgaaagcaaggcggtaatgattaccttcatttgccatttcttcccatttcaccgccattttcttggctatacctgcatatttctctgcaacatcatataaaccaagcatatgcgccatttcgctatatccggctacacccatgatcgcttttactgaaagattggcattatgagcccaatgaccggcgaagtcatcagtgcataattggttctccgggtcctgtccatactctacgagatagtttgtccaagtagttaagagatcccaatatttttttacatagtcagcgtttccttcgattttgctaatagcagcagcaagaattaccatgttacctccttcttcaattggcatgtcacctccatacacttgaccattagcaataggataagtccctaaatcgtgtgctggaaaaggtttgttccaacgaccgctagcactatactcaaagatgctagtcatcatagctttctgtaattcagggttataaaccaaaaatagtggtgcggatggataagttaggtctactgtatttacacaaccattactgttgttttctttagagaaccataacaagttaccttctttatcagtaaagagtttatgagcagagatcacttggcgataagatgccgaacagatttctgcatattttttgccacctgccttttctgcatcgtcataaataagttcgtcaaaggcgcgacaacgttccataatagcctgatagttgtctctcaatttttcgaaagcatcgaagatagtcactttgccatcatgcttccaatagcccatacgcttctcgtacatatactcaatagagtaaatgtcatcataaccaagcatcatgaatccttctttcccgctattggagacagaaccgagattgtgaacatatgccatagccggattatcttcctctttacgagttgtccatttagtctttgtagtggctaatgtaccatttttcacgaatgattctttcattccgtaatagtctcccaaactgactgatttacctgatccattcgtactagcaagatatgcataaccccaatcagcacaaatcaagtcacctcttcggtcacatattggttgatcgattgaacctgcttctacataactgataccattctttgataaggtacgagcaacagtaggctggttactttcgttaatagccagttcaggagttgtctccatatagaattgtacatcatgagtttttttatctaatgaacgtacatgataagaaacatagtttataggagttgacaataaatcaagatcatcaattaattgaggagcggtaaacacgacatcaagctctacaggaccacaagtgaaagtatagtaggtggaagtagccaatacgtctacagatttctgaacagcttcatttgcaaacttaacagcattttccttctcacgaaacaatccgaaatcgacatatgaaccacctgtagtattgtggcaatgggcagcgattacgttcttacctttacgaagtttcttttttgcttcttctgaaagtttcagatatacattattcttccagacaagtcctgtagaaacaagcttttccccatttagatacaactcaaatacatcatcatgggaatagatcagataaatatcttcagcgatattcggttcattaaaatcgaaagtgcgacgaatgtagatatcggtattgtctcctttccattctgtgtgaatacgttccatatcacgactaccaaacgctgctttacctttcttccaattgctatcatcaaactgaaattcttgccatccgtttgatggttggctgttagtgtacgctgcttcccaacgttctacattagtcataggagcaataggtaccagattaattttatctttccccaaaaaacgatatacttttccgtcaacacgcagagcacccaataaaggtttcttcgcacttgtccaatgctctgtactaccttccattaatttatcatagggtgaccagatcgaaaaataaggatctgaaacgataataggcaccgacggagcacgtagcactatatcttttgcaggttttaataagtcaacggtctgggcatttgccaacaagccgactgaaagagccattatggctagcaatttcttcataaatatttgctttaaattaatcttcaaatccaaggttatccatccatcaatcttatttacctcataaaaaaacaagccctaagtattcttttaaatccactttttaccttaatactatctcacctttgaataattgcaatctttatacccgttttcctatacctttaatatataatatcagtactgtcatatttaggatgaaatgttatggagaagcggctaacaaatcgtgtatttctagcaaatatcgagctttaacaaactctttattttccatagtatctcatcttgatgacacaaaataatggaattaataaaagaaacaaggaaaatctgtgttcaagaaaggacaaaatctattcttttttggatttcaaacgttcttttaacatacggaataggggctctgacgttgtttgagcagtatttatccttttttgagcagattttatccttaccaacccaaaatgaaggtctattaattgatgacttctaactttaacaaaagagatattggtcatttcagatagctttcgtaaatttgcaacacgaatgcaatactgattataccatcgcaaaatatataccatatattaaacccaagtacgttacccaagagggaactactgtcctttatgttcgatataattacaatcggaacaagcgcacgcttatctctaccggatacaatatcaaaccggaacattgggatgcaaaaaggaaatggattaagcgtgcatgtccccattatgaagaaattgatgcctgcttgattaagataacatctaagctcggtgatattctcacctatgctaaagtaaacggcatagatccgacagttgattttgtcttgcttgaattagaaaagaacagggaatatgatctgcgtcctaatcgggtagatatgtttgatgtattagaacggtatatagtggaaaaagcaccatccgtctctgcagatcaaataaaagactatcgaacactccgcaagcatctgaccgccttcaaagaatactcatcacaacctgtaacattccgcaacttgaatctgacattttacaacgagtttatggattatctatttcataaagtagtaaaaccaaacggaactgtagggctgctcaccaattctgcaggaaaaatcatacgtttgttgaaaggctttgttaattatcaaatagtaaaaggaattattccaccgattgacctaaagaatttcaaagttgtagaagaggaaaccgatgctatttatctaaatgaaaaggagctggctgcaatatacgaacttgatttatcagatgataagcaattggaagagatacgggatgtattcattaccgggtgtttcacaggattacgatacagtgacctttcaactttaagtcctgagcatattgatttggataatgagaatataaatctcaaacagcggaaggtacacaaggctgtagtgattcccatgattgattatgtgcccgagattcttaaaaaatataattatgatttgcctaaaatcccacgatacatgtttaatgagagagtcaaagagttggggcggaagataaaattgagccaaaagattgaagttgtccgcaggaaaggtaaagagcgagaaaagagggtatatgagaaatgggaaatgatctcttcccatacctgtcggcgatcgttttgtacaaacatgtatctatctggttttcctgcagcagaactaatgcgtatatccggacataaaagtccatctgcgtttatgcgatatattaaagtggataatcagcaggctgctaaaagactaaaagagttgcgtgccaaattagccagatgaattccttagggagataaaactataaccatttttagaataagacaacaggcgttagtttcctcggaggaaacgccagttccctttaaaaggaacggtcgtttccattaaaaggaacgtccgttccctcaccgggaaacgacagtttccattccaagaaatgacaggaaactataagttgctgatgtgtactggttttagttgacaacttcgtttgttataactgaattagtttactcaatatactttaatatctaaataggtttacttttgttattcttattcctatgt

SEQ ID NO: 47 - DNA, 58647 bp, Bacteroides thetaiotaomicron
tgataagactcatctgagagacctctttgataaaactaaatttcaaaatgacaaagaacgattcggaccaaatgggccaagtttatttaatttttaattcgtcccaattttaatgggacactaatgttttacaaaggtaaaacaattaagtaaaattcatctatcattgcttttcatatttattgtgtctttctcttttgcatcggaagtattagcacttacagcaaccagacagtatgacatcgccacgtttgatcataccgctggaaaacaacgatatacaatctgaatcaaaacagattgtatatcaccaatttctttttttgtgccttgttaaacgtataagaagttcctccggcagattttccatcccaataggcaatcagcctacaggcgtgtgaaatcatgtaatcattacggtgggcatagcattgggcataataatattcggatagaactaccaccttgtcggcttggcgcaaaatatcagcatacctctgtttgtcctctttgttgaaatacacatcttgcccgacataaggaacaaccgccaccaaaaccatatcgggatattgtttcctttgttcaagtacggtatgagcagccatcatgtcaaatccaaccgcacaaccaatatagaaaaaacggattccattctcatagcagaaacgtacctcttcattcaacgatacggacaaagcatatttatttgttcgtatcgttctatgaccggtaaaagcaacggacatcattttcatccatttatcacgtgcctttctacatatatccaacgaacctgccgaagtttcatacaccattccattcacctcataacgataagtgaaccaagtagtatctccaaagatatccttctgcttctctatataactctctttttctttcatcttataacatacggacaactgttttacctaaaaagaaacctcccaaaacctcacctcctattttttccaactgacatgcgaaacgagcatacgaaaacccttttgttaaaatatcgtcaaataccaagattttcttaccccgaaaaaagtccttgtcaaattctatcacttgtactttttgaagcgacttgctgtcaaatttctcgtgaatagccaaacgatctccactgacacgtatatgttcatacgcattgatagcacctgaaaacttacacacagccgaagcaaaccccttataacgaagttcattcttatcagcggaagaagccggaacacaagcaaaaacaatattcttaacatcatcaccaaaaacttgatgtaacttattcgctatcatccaagctatattcaaataagcttttccatccttaaaactccatatcatcttacgaatttgccattctctttccgttgcctgccgatattgcataggaagatactcaaagaaagaaaacatcatcttatgccattgtctgtctaaactaggatatttactctgatgtgccatagtcttttatctattaaaattaaacttatgcttcagctagatttaaagacctttttttaaacccctttccgggatggccttttctttctgccgactttttttttgagctttcatgccccatctgagtttatgagccttttttttacggcacgcatcaataaggaaggagggattaagaaaagttttggacgacaaaaaatgttggggacagcgaagccgtccggcgttatttttttcgggacaaagggcgaagaccggaactctttcgtatccatccaccgaaataaatttgccgttcaaaaacaaaggatctcagatggagctatgaaaaaagcacattaggggaggcagaaaacaaggaaaagggcagtacggaaagtaaaacaagccatacggttttgcaagcaaaaccatactcctatctccctgccacaagtgacaggggggaacgggttagcaacggactgccgggacaaacggtaaaaggaagggactgcaatacggaagaaggaggttgtttcggcaatgccgaagctccggatgatgaccattgcaatcccgcccacgtttggaacttctcttttccggtttacccataatcagccgcatagcggatgattacgggtaaaccgggaatgagaacagtcattccgatgaaggggagggtgggaaagaatactgcgtgaacgcaaattaatgggattaccagtaactccaagcgttttttgctacttttttggggtgcttgccaaaaagtagcggacagcaaaataccctcccttccctaatccaaaagaagggagaatgtgcttcattgaaggtatataggttccgttccctgattataacaatacatagtgttatttctgaaaccatcaaagcatatatgaaaatcatcgaaatcctgttccgtggccaaacgaaccttatcactcaacaaaaccatgcattgtttattgacagatgtagccaaagaggtagtacgtcccggctttatctccaatgccaccacataagaagtccttcgtggatagatatacccaataatttcctcattgagtacaaccaaacgaataacatcttcattcaaaacgggaatattattaattttgcccatcattgttataatataaatcagtttataatcattaaaatacaatatcattacaaatgatacctataatttttataggtaaacttttccaccgagaccacctcataaagatagtcttcatggcaagaagccattatacagttctcacattcaagaataggatttataactacacggaatttaatagtgccgtccaccagaacaaactccacccgattaaagaacccttgtagagaatgcccttccttatccatcagacgcactacttcacctgtaaaaacagccaattccttagcctgccatttcgctttacgcaaacaactgttcgccgctttgacgttctcattcacctcttttgttcttattgctttcataccaaaatcctttttacatatttatcttgtcaaaaatcaaaagtcagctgcgtagcccttgcgttgctctgaatcgacctcttcaattcagaattatcctccattgcattttcaagtttcctaataaaagaagtgtcacctgcttccgttatctttaaaataggcaaccatactccggctatcagctgtaaatctatatgataacttctccaatgctgcattgtcaatgtattcatccatgcgacttcaccgggtacgctattcatcatcagattgacaacggtcatctttacacaaatcaaatctatatccgagccataacaaaaaagccttcctccatcattctcttccgcacatttttttacagcggaaagtagcatcctgccggaaccacagcacgaatcacagaccgactgtttaggtttcagcctatttccccccatacatgccatcaaatcagcaacgtgtatcggggtaaagaactgtccgttattcccatgactgacacactccatgaacatatctcccaagacatcgcaaaatccttccgaatattcagacaccctataaaacatttgaacaaaaagttccatttcatatggcttatatcttttttccactctacgataatcctccgccaacatcccgacagacaaatagtaaagacaaacatccaaaaaatcccgaaaggcttcttcatatccccgactgaaagcaagcttttcataaagtttcattatctcctttggtatcatacttttctgacttcattattcacaacattctatattccttgtgccatagattttatcaaaagccgcttttatctccgagcgatatttacagtccttctcaaaacaaagttgttttgtccaaaaatcgaaatcaaaaccatcggtattatcaatcgttacagaaacataatcagtcataccactctgacatacaaccgtatgccgatttacacaaaagtggtcatttaaagcagtttcttttcgggtaatgcgttctaccatcttatctatccacttcatacttataatattttatgtaattgccccattccaagaggcagttacggttatactcattaaaaatcgttctcgttcaaaaacagcacatcgcctttcatcaccatccaattaatctcactcagatgatagccacaatgcccactcaaaaaaatctcaatctcttcagtggtctgcaatctcctgtctgggcttatcaccgcaacattaccggaattacaatccaatacagccagtttctcataagcccactcaccaaactggcagaactcgataaaattggtataggttatccgtatgctattgtttgcatcaaattcaaggggtgactttgtaatgaatgaacctgcatgattcaccaccacagaggggctaatctctgccaatgaagataagctgtcatcccatctaatctcataaaggaaaaatccttttggcaatgaattgcggtctatacgataactggaaaaaagaccgtctatcgtttcattaataactaactgttcataatctccttctaaatagtgtactcgtgacataactcgttgttttttgggattgttaaacttctaattttatgcttcagctagatttaaagacctttttttaaaacccctttccgggatggccttttctttctgccgactttttttttgagctttcatgccccatctgagtttatgagccttttttttacggcacacaacaataaggaaggagggattaagaaaagttttggacgacaaaaaatgttggggacagcgaagccgtccggcgttatttttttcgggacaaagggcgaagaccggaactctttcgtatccatccaccgaaataaatttgccgttcaaaaacaaagggtctcagatggggctatgaaaaacgcacattaagggaggcagaaaactaggaaaagggcagtacggaaagtaaaacaagccatacggttttgcctgcaaaaccgtattcctatctccctgccacaagtggcaggggggaacgggttagcaacggactgccgggacaaacggtaaaaggacggggctgcaatacggaagaaggaggttgtttcggcaatgccgaagctccggatgatgaccattgcaatcccgcccacgtttggaacttctcttttctggtttgcccataatcagccgcatagcggatgactacgggtaaaccggaaatgagaacagtcattccgatgaaggggagggtgggaaagaatactgcgtgaacgcaaaaacacagtatgtcatcttaaaacaatatctttaaaaagtttttcagaagaaatgcttaccaatatcctaataattattacttttgataacataatacaacgatatggaaaagaaaaagattacaatagaggtagaaccagctacagccgtagctaccgtcggtttattgcgtgggatatttcccagtatcatcgaacaactggaaaggcaagccgcaacaaacggcagccccttaaaattcaataaagtagaaaatatgcaagaagtattggatgagatttatgaaaagtgcattgccgaaacgaacctccgggagtttgcccaggcgcacttaaatagtgacggattacctaactgatacagaaatacggaatctgccagccatccttattccaaataacaaatggtacagaattacacacctgtcatgtgggatgacaaagcatttgcctttgtcccctacgaagcattcagtgatttgccacattatcccaaagaaaaatgtgagcaaatttgcaaagagctgaacagccttataagactatgtacttataggccgaaaaaggaagatatttattttcatccggtaagttatgtacgtcgttccggaggtttcatagttacggataatcaggcatcctttgagaaatgcccctatcctgcttgcgcagaccgtcatagctgccaaaaaatatgtgatttgatgaaccgtatcattgaagagtcttaattatataaaataccatggaacatccaaactccaaatgcagaatagcacaagctgaatatttaagtcggctacctgaagaagaacgggaaaataaggccagagatattagaatcggaaacgccagctatatttaccaccaacaagcggttccaatccaagaaaacagattgataatgtattataaagagtggttggaaggtcttcctcccaacatttcacgccatatgagaatgcttggatttgaagcatgtaagacaatgattccgtttacgagatatgtgaacgaaagaaacgatattggtatgcgtgactggatgcaagagcatctttcaccgagtgacttcaactattggcaggaactttcgaaaaaagcaggttcgccaacattttaatcccatcccgttcaatacgctgcctgaagaataaaaggtgcgtattaaacgagaatattttttagcgtttagtcatctcttcccgcaccagttccgtttctgtcggggagagtttcggcaatttgacagttgccggactttctaactggtaagccttcacctcattgataagcagctgccagtcaaaaagaaattcttcggaacaaccatgtttacgataaatttcttttgctgcttccaaaatctcaggagcgcaaaaatcgtctccctgaaagacaactgccggacgatcattattgatacagtctctcaataatcgtaactgatctttcattgtgtttacctattatgcgttctgttgttttaccattttcaaaaattcgtcagacggtttaaatgccggtatgttatgagccggaataatcatagtagtattcttagagatattccgagctgtcttttgcgctctcttcttcactatgaaactaccgaatccacgaagatagacattttcctccttacccaacgaagtctttacctcgttcatgaatccttccaaaacagcaagcaccgctttgccgtcgatgccggttctggcagatatttcctttacgatttccgatttagtcatttctttataatttgaaaattagcgtgcaaagataattaatccaatggattatttaaagtctggcatccgcagcaagccctgccttcgcccaatgaagtgttaaattgttgcgtatgggtcaagttccttaatccgcttacacaaataatcaaagcgtttcttggtaagcggtgtgagtgtatcgaggttcttgccatcgaaattctctccgaaaataaggtcgtccactcctatgccgtgattgtaattctcgcgcacgcaatcacgcagaatccaaaggttatgcaggttcacccagtcggctgtaatgtttctgattttactgaacagcagcgcagcagtgtaaaggtagtgtccgcaatggttgtagtcatgcaacaccagcttgccctggtaatagatgtcgaaatccttgttttcttcatcttcctttgtatcgcagtagaagaatggaatgtctttcagaccgtcccaattaatataagtagttggcttcataatatcttttttgaatacgctacataacctgttatttgcacactttccattattcacagaacatttgatgaaacacttccttcagtctttttatctcactgaaattcaaatctccaatctttcttttcagccggcttttgtccaccgtgcgaatctgatccgtggctatctccccatcacgcccggctacagaacacagaacccggtaaggatagttccttatggtggaggttatcggagcaatgactactattgtaaggtacatattcaaatctgaaggagttacaacaacacatggccgtgtctttgccatttcacccccacgggtagggtctaactctacccaatacactccatactgttctaccatgtccaatcctcaaacttttcatcctcaaacacatcagggataagcaactcatcatccccattctcatgggcacgtttggcagcttccgcccatccctgccgtggttgtgcctttatcacaatattgttcccgtccaaagaaatgctcacagccgatttcaaggacaaacgcaactgtttcaatatctcggaaggaagtattatccccttgctgtttccaatctgaataatgtttgttaccataatgttataactttaaaattgattatcacaacacaaatatagacaaagttataacaataccaaaagaaaagccaacttttttccattttcaccgataacccggccaacggctgcactcgtcgggaggctagtgccccccttgccgtgcggcgctccccgacctatgattcttatcatgtcttgtgtccttttctccgcttctaacaaacaaatctgcataaaatatagatttgcgtttccatttgaattttagttatttgataccctaactatgaatagcaaacagataactgatttttaaaacagcagaatgtttctgttttattaaaataaaaagggaacaaatttttaaggtaatacttacggaaaaaacagactttataacgtttctttttcgtacatttgcaacaatataataaaagcgaaacatataatggagaagcaaggagaaatcatactataccaaccggatgaagctgtaaggttggaagtacgtttagaagatgaaaccgtttggctcacacaagcgcagatagcagaactttttcaacgtgacagaaccgttattaccaaacatataaataatgtttttaaggaaaaggaattggaagagaaaagcaatgtgcattttttgcacattgctaattccgataagcctgtcaagttctttagtctagacgtaataatttcagttggatacagagttaaaagcgtaagaggtacgcaattcaggcaatgggcaaataaaattttaaaagaatatttattgaaaggttattctataaaccaacggctcaatgacatggaatatagaatgaacaatagattcttccaaatagagaaaaccattgctgaacatgatgcaaagatagacttctttgtacgcacctcattgcctccggtggaaggtatattctttgacggtcagatattcgatgcgtataagtttgctacagatttaataaagtctgccaaatgctcacttgtgcttatcgacaactatgtagatgaatccgtgttactcatgttgagcaaacgaaacagtggagtatcagctactatttatacacaaaataaacgcacagctccaacttgatttaaacaaacacaatgaccaatatcctcccattgaagctagaacctacaaaagtagtcatgaccgcttcttaatcattgataatacggaagtatatcatattggggcatcgctaaaggatttgggcaagaaaatgtttgctttctccaaactggaacttcctgcccatacgataattgatgtattatgaaataagctaatcacccatgcgagaagcggaagagaatataaaattcaagatggaaattgacgtattggttcccattccacgtactgtcacccgtgatttcaccagtttgaagcacctgcgtcaatggcagaaacggaatgacatcgatggttctctttactgttttgcacaccgggaatacctgctcaacgaaaagggagaatgggaacaatttaccgttatcggcaaacaggtagtgactatcggagaactggaaaggcttcttttggcaatgaagcaaaaggggttcaaccaatacagccgtgaggaatatgaagaattaatgtcttcatatttgaaaaagtgaagaattaaaaccttcattacacatttaaatacgaaaacaggatgaaaataggatatgcccgtgtttccaccaaggaacaacatctggatatgcaactggaagcgttgaaggctgccggatgcgagaaaatcttctctgagaaaatgaccggacgtcaacaaaaccgcccggaactggatgcctgcctgagctttctccgggaaggcgacacacttgtcgtatataagctggaccggcttggccgttcgctgaagaatatccttacgctattggaagatttcaagaataggggcatccaattcacctcactgcaagacaacatcagtacggaaggcgcaatcggccaactgatgaacaacattctcggtgctttcgctcagtttgaaagagaccttatctatgagagaacccaagaaggcagaagaatcgccaaggaaaaaggtgtcaaattcggcagaaagacacttatcaacaaaaacaacatcgccaagcagaaaagctgcatccaactctatgaatccggaacgccggtaagggagatacagaaaatattaaacataggcagtagcggaacagtatatcgcctattaagaaggaatggaattgcgctgaaatccgagaacaaaaataacaaataacgaataaacctctgcccatccttcaaagatgattctcaaagatcgtctgcaattccacctctcagcaagattataggaaagtccccttcacggggactgattttttttaattttaatacaataactccatgcactcctgtaccgctttttccaatgcttcttccaaacaacaaaaagcgtccgcattactttcggagtcatacaacacataatctccagccctcacaaccacatgccagaccgccacgttttgttctgtttgaaacgtatattcacgagtctgtatcatccattggatacatgctgccagtgtcgggcactcgcacatatacatcggggtattccttccctcaatatcggtgcgtagcctatcctgtttgtcataccaatactcacaaggcacgtaatagtataattccttcatcataagagctgtgtcgctattaaccaatctctctttgttgatttgtgtaatcaaattttccatattagcattatttaagttgaacatctgatttattcttcagctagattcaagaccttttcattttttgtatcgggaaggtctttggtcagccgaccttttttttgatgtcattccccatctgagttctgagccttttttcggcatatcaaggtctggattgcaagcaataagccaagtttcacttatggaaaatgtcgggaagacacttcttcatcgttattttccatacagtaaaggcgcatggccgtaacttgccatttgcggaatcccgaaacctttgccgagcaaaaagccggactcggatcggaggaaagaagccgggggaggcagcccacagaaagggcaatccgatacaatcaagaaattaacctgctatacccttgtgcgagtgaaataatccatcatagacactacatacctaagtagtggtatcaatacaccgatcacatatatcatagcgtagcccaaaaggacaaaaggtaatgttttacgataaagacatgcaacagcgagcaatataaacgaaaaagaaaagccataaaccccatattgaaaaccgggtatcaactcataaacaggtacgggttccggatgaagcatggctccggccacaatagaataaaggctggtcaataatataagcagcgtatataagcaactcttaagaatcctgggatcattccttttacaatagagaatcgttcggatatcacttctaagaaactcaatgcccagtaagagagccaccataacgcctgtatcaaaagtagaaaatacattcattccgatcacctttggcgcgaagatatgtatttattctgaaaagccacgtctttgcgtattttacgatgtcgcatccgatagtccgggaagcatttttttggttcttttttggggtgactgccaaaaaagaaccccgaagccgaaatcccgggcagacgggatttctcccgtccaccttacctattttgcaatcttccctcgtccgcatagctataatagttattgcctgccacaatcacatggtcaaccaaacggatgtctaatgtttcagcggcttttttaactgcttccgtcaagcggtcatccgcactgctgggcttgcgtgctcctgatgggtggttatgtaccatgataaaagatacggcgttataatacaatgcctgcttcatgataacccgtatatccacaggggcggtatttatcccgccgcatgagatacggactttacggatgagtttggacgaactgttcagcaacagcacccacatctcttcagtagctatatcgcacaaaacaggatgcatcattttataaacattattgctggataaaagcgcaggactttcaacttgcccttctttcagccgtttatatagctcaatcgccgcataagcgacttttttacggctgggtgttagtgtttccagtacatcagacaagcacaatccttctatttccatctgttcatacttatattcttcacgtttcagtttctcactgttcgtcaaggtataaatcaactcgctgttttccatcacccgataaacgtcattcacttcaaatacggttctcttcgttttcatactgccaaaaattaaaagattaatactcgcaaacatcgcttgtcgccccaaccataaatttttcctcaactgattgggaacagtgcattgaagagaaagcgggaaagacggatcagaacgggattgaactggtaaatactacctcccggaatgggaggatggagatttggcttttcaatatcgggcgttccggccacgcctaccttcgcaatgttcctatcagttcaggaaaaaatcatcatacctctcttccggcatagccggagcgtagagcgttagggatagcagggaaaagcctggagggtaacgaggacttgcaacgaatagcccggtcagaagggaacgccctgaaaaactaattcggatacagaagatgaacagaaccgccttccaatcatataaaaaaacgtgaaaatcaacacatacttccgaaaaatctttttccgaaagtacgtatagggcatgtgaagggaaaatttattttcccagtcatttctatgttatcgctttggggatatttaaaggggttaggagtttaggtctttattatgtattttggtggatggttttacacagccgataccttttatttaaaaatttctctcttttatttcactgatataccgacatataaaaaaaacagggattacctattcccttcattaacgggtggacggttttacacagctgacaagtgaaaccgaacgcttttacacaactaaagcaaaaggagtggacggttctacacaactagaagcaacaaacgggacacttctacacaactaaaacaggcaaagcggatgactccacacatctaatcaccccaatagggacacttctacacaactaattctataaaaaaccgtgaaacgtggacggttctacacagctggatcgtccatgttcaccgccccgtccgtctccggagatatgaactcttcaggagcaggagcaacttccgttccattggcactctccaactcttcctgtgcccatccttccggaaacctgccgaatacagccacgaaatcactgatatatatctgtttcttcttttctacgctttccggggagtttgcccataaaaggaactctttatacagtccggcatcttcctccacctctttgatcttcttcctcctgacagccatatccgtgtccgggtaggcaatctcgacatacagcccaagcaggttcttatagaatttcttcaccacgacagcatattgtccttcatcaaaatagtgcagcgtatgcctaggaaacgagaacaacacggtatatgcccatctctcatgatcgcctttcacaaaagagaaattgaaattggtatatttcaggtaagtattcatctttttcagtatcgaggcgaccttctttttccggtctttgggttcggcaatctctatgccgagctttttagccagctgatcgactgtcagcacataaaaaggagcctcattcttggtggtcttatacttgatcaggtaaaccatcttggaaagttccagatagaaatagcggtaacggctgggcaggctacggtaatcctgaagttccaagaggttatagagcgagaacatgaaattctttatctccgggcttaccactgccgagtacagccttttcgttgacttcttcgtcttgaaatcggtcattatgtcgaaacgtttcaagatctgcacgaaattataggatgtacggccatcctcgccaatggtcggatagcagaggttctccaatcccagtttatagagagccgcctcaaaaaccgtctcgataggatggctgattctctgtcctgccgtgtcggtacatacatattccggctgcatattctttccgaacatggccgcgagctgccggctatccagcttgcgctgcaagttggtacggtcataccccatcttacggcagaagtcttctacggagaaccaggaagtcccgaacaagtctttgaggtgatagctgcccaggtatatgatcagatcgagcatgacatttccacctgcctcatacaaccgttcaatcagcacggaattatagctttccccaagcaccctagggacacgaatcagttcttttgccatgataatacttacaaaatcaatcctttctctgttttcattgccacaaagataggcataccggccaacatacgcgtcataattatcaatcagttttaacggtatgaccggtatgggaaaaggagaagtactttcctgaagaatgctttatccgcccttcatcagaaagaaagcatcttacacctgtaccccatagacatcctatattactttttcagttcttccgataaaaaggaacggtctatcaatacttgcaccaatggtttctctttgacaaactcatcaagctcacgctttatcaatttattgcccaaccctatgcgtcgtccaaattcctcgaaatccttccgccctacctgatgagcaatttgactccacattgtcatctgtaatcgactcaaccctcggtctaaggtgtagatcgttaggttatcagtacagcgaaatcatccgttctctcatgagtatctacttctgtggtggctcatgtattgaggatgtcactactcatttgatgaaccatctctcgcttcatccgacacttcatacttgtagttctgatactatcctcagagcgataaaggaactgacgcaagaaaacatctcatacacatcagatacgggtaagaactacgatttcaacacggctgacactctcaatactttactgctcaattgtatgtttgcatctgaccaactgaaagagggtgagaagtatgatgcaaagcctacatacaagaagttctctggttatcgccctggcgtggcggttattggtgacttgattgttggcattgagaatagcgatggtaacacaaaagttccatttcatggcacgttttctcgccatggcagagcttaagtaaacttagctctgctcatctggcttaacgaaaaccttcgttttcatcagaaggacacgctgaagaggttctttgagagatttgaacagaacaggctcactatcaatcgtttcagagctgattgcggatcatgttccgaggaaatcgtggaggaaatagagaaacactgcaagtccttctatatccgcactaaccgctgcagttcgctctacaatgacatatttgctctcagaggctggaagactgaggaaatcaatggcattgagtttgaattgaactctatccttgttgagaagtggaagggtaaagcataccgacttgtgattcaaagacagaaacggatggatggtgtgcaggatctttgggaaggagaatacacataccgttgtatcctgactaacgactatgaatcttccgtaagagaaattgtcgagttctataaccttcgtggaggaaaggaacgtatctttgatgatatgaacaatggtttcgggtgggacagattgcccaaatccttcatggccgagaacactgtgttccttcttcttacagcacttatccgtaacttctacaaggccattatccaaagacttgacgtaaagaggttcggactcaatgcaacaagtcgcataaaagcgtttgtcttcaggtttatctctgtaccagccaagtggatcaggacatcaaggcggtatgtgctgaatatctatacctgtaacaatgcttacgcagatatttttcagactgattttggataacgcctacaacttatgggtatgatactgcgtattgtctcaagtcgcattgtggggtaaggggatgttgtaggcagaagtgggtgtttctgcctcaatttatctgataattcagtaatgagaggacgtgtacacgcaagaaggacgttgaagggcttagttgcggatttgaggcaggtaagaaaatacaaagaattaacagcaaccgagaaactgaaataccgtatcgcagtgaaaatgacggcagccgactacttccgcctgctgacacgatcgcatgaggcgggcgtatcaccaagcgagtacatgagggaatgtttccgtaacggtcatgtgaaagaacggctgtcggaggaacatgccggatacatccgccaactctgcggcatggctaacaatctcaaccagcttgcgcgtaaggcaaacgccggaggcttccacgatgaacggtgggactgcaaggtggcagtggcaaggattcatgaacttataaccaagatagggatatgatggcgaaaatcgtaaaaggaagcgacttcaagggtgcggtggattacatcatcgacaagaagaaggatacgcagatagtagcaagcgaaggcttgtttatggaaaatctggaaactatcgccatgagtttcaatgcccagtcacggatgaacgataaggtgacaaaacctgtcggacatatcgcgttgagtttttccaaagaggatgagttacggctgacgaaccgtatcatggcaggcatcgcgcttgaatatatggaacggatgggaatcaagaatacgcagttcttcatcgcccagcatttcgacaaggagcatccgcacgtgcatattgctttcaaccgcatagacaacaacggcaataccatatcggacaggcacgagcgtctgcgcagtacccgcatctgcaaggaattgaccttgaaatacggcttgcatatggctggcggaaaggacaatgtcaaacgcaaccgcctgaaagagccagacaggacgaaatatgcgctttacgacatcatcaaaatggaagtcggcagatgcggcaactggaacgtgcttatcgccaacctgaaacggcagggagtggaagtacatttcaagcataaggggcagaccagcgaggtgcagggtgttgtattctccatgaatggctaccatttcaacggctccaaagtggacaggcgtttcagttattccaagattgacgcggctttgcagcacaacagatgcagggaacgtatgggaataacagccggaatatatgaaacggctacaccaagcgcaccgtccggcacggcacaaagcgagttgttcaacggctcttggggattgctaaaaagcagtggctcatcttataacactgctgatgcggaagccaatcaggaaatggtggatatacttcgcagaaggaagaaagttaagcgcaagagaggtgttgggttctaatattctgtactaatccaattctcacgacacttgcgctctatattcattcggagtgtaacctacctctttcttgaacagtcgggtaaaatgttgcgggtactgaaaaccgagattataggcgatttcattaacggtgtcgtctgtagatgcaagttccgtcttggctatttcaatagacttgtcatgaatgaaatgcagggcggttgaacctgtttcttttttcaataaatcactgaaatagttgggcgagaggcagagcttgtctgcacaatactgtacagtgggcaagcctatccgtttagcagccccatcatggaagtattcgtcaagcaaccgctcaaatcttgcgaggatgtctcggttttggttgtcgcgtgtgatgaactgacggtcatagaaacgtgtgcagtaatcaaggaacgtcttgatgctgtctgtgatgaggttcttgctgtgacggtgtatcggatggttcaattcatattgaatcttgtggaagcaatccatgatgatttgccgttcttccacactaaggtgcaatgcctcgtttgtctcgtaggaaaagaacgaatattcacgcattatccgcccgagaggtgtattccgcagcaggtcgggatggaacataagcaggtagccatctggttggaactgcatgccgtcatcttccgcaccgaacacctgtccgggcgcgataaatatcagtgtgcataattattcctaagtctgtgaaaccggaacgcatgaagcagaatctcgacatattagacttcaccctgtcggccgacgacatggcacggataaagacgctggataccgacaagcctttcttactcggctcgcacgaagatccagaaatcgtaaaatggttcatgcagtacaaaaacgcctgaacatcaacaaccatatttcgatagccgctatcgactatattaagaagttattcgtatatgcctttattgtaatccgtcatgtactgagtaaatgttttgcctgtttgctgtttgaagaagcgcatgagatggctcggatcagagaaattgaaatcatccgccatttcactgacagtgcggttggagaatagcaattcgttcttcagttcctcaagcagacgttgttttatcaaatgggtagctgatactccgaattgggcttttactgagttattgagtgtgatgcgactgacatgaagcatgtctgcatattcctgcacccgctggtgggtgcggatattctgttccaacaagtccttgaaccgaaaagcgaaattgtttttagcaatttcagcgggcaagcaataggcggcagcgtatgtacgattgataatcagcaaaagataatatagtaaggaaacaatgatattgtacgtatcggacactggattcatcagctcatacttaatctttccgagcagccgcatatattccttcatttcgtcatgtgtggcattgatgtaaggcggcgtatctgtctggtaacaatacaaaaggcgaaaaacgaagaacttgtcggcgataaaagtacgcatgaaatcttcgcggaatataaggaacgtgtaatccaacgccgtctcatctacatgccactcttgttgctgatggggtgaaagcaggagaaccatgccgtcgcgcagttcaatcttgcggaagttcagtagcaaatatccgtttgccttacggaaaaagtagaagctgaagaagtctgtcttaaaccgcttgttttctgtcagcacaagtccgatgtccttgtttatggcagtattgatgtaaaaatccacgccgcagcgtgtcttgttgaacggtacgctgaccagtcgatcagggttgattatctcgtccatatccttgtcgtttttgcaaagataataatttcatttatcaaaatggcataattaccgttttttcaggcatagatgtttcgccggattcttccgaactttgcacccgtaatcaataacaagacatatagtcatgaaaaagacatctacagtacaattggtgcgcaatgccaccttgaaaatcaggtatgcgggacacaccatgctaattgaccccgttttagccgacaaaggcactttgatatcggccctcggtgtgaataaaacaccgagggtacacctcaccattcctattcaggatattatcggaggcgtggacatggtgctcctgacccacaatcacatcgaccattacgagccgagtgtccccacacatttgcccaaagaaattcctttctacgttcagccccaggacgcggacgccatcagaaacgacggatttacaaatgtgatacccatcgaagaaataaaaacaatagacggcatatccatttaccgcacgaccggacatcatggtttcgggcagatcgggcagatgatgggacctgtatcaggttatgtgctaaaagccgagggcttcccgaccgtttatataatgggtgactgccgatgggaagcatgtatccgagacaccgtggaacggttcaatcctgactatatcgtggtaaactccggaggtgcaatctttcccgaattttccaaaacggacggtcctatcatccccgacgagaacgaagtgatgcagatacttgacgaattgccttcgcatatcaagctgatagccgtacacatggatgccatcgaccattgccagaccacccgtgcaattctgcgcaatgaggcaacgcatcacgaagccgacatgagccggctgattatcccggaggacggagaaacagttgtgttatgagtgtctgcattaaatccctgataaaaaacatgaacatagtggtagggtgcactataggatgcccttactgctatgcccgtaacaactgccgccgtttccacattaccgacgacttttccgtgcctgaatacatggaacgaaaactgcgcatcatcgatacgtcccgtcctcatgtgtggctcatgacaggaatgagcgatttctccgattggaagcctgaatggaacgcagaaattttcgagcggatcagcagcaatccccagcacgcctatatctttctgacgaagcgccctgacaaaatcagtttctcctctgacgacgagaacgtatggatgggcgtgaccgttacgcgcagttccgagaaaaggaggattgatgatttgaaaaagaatatcaaagcacgacactaccatgtcacgtttgaacctctcttcgatgatatcggcgagattgatttcgagggaattgactggattgtcataggcacagagaccggaaaccgaaaaggaaagtcatattcgcgccccgaatgggtgcttagcattgcagaacaggcaaaggctcatggcataccggtgttcatgaaagaggatttgctgccgattatgggcgacgaaagaatgattcaggaattgccggaacaatttaccagacgaatacaatgaatatggatacaataaaggaaatagatgtaaagagtgtaatgaccaaatcctctctgccggtgggaggatattcggtcaacccttatgtagggtgtccccacgcctgcaggtattgctacgcatcgttcatgaaacggttcaccgggcacaccgagccgtggggtacgtttttagatgtaaaaaactggaagccgataacgaatcctcataaatacgacggtgaacgtgttgtaatagggtctgtgacggacggttacaatccgtatgaagaagaattccaccgtacccgaaggctgctcgaagagctgcgaggaagcgatgccgagattatgatatgcacaaagtccgatcttgtccttcgcgatctcgacctgttgaagagttttcccaaagtgactgtgtcatggtctgtcaatacgctcgacgagcagttctgcgcagatatggacaacgccgtaagcattgaacgccgtctgaaagcgatgcgtcagacatacgaggcaggtatccgcaccgtatgcttcgtctcgcccatattccccagaataacagacgtaaaggcaataatagaggaggtaaaagattatgctgatttaatctggcttgaaaacctgaatttacgcgggcagttcaaaggcgggataatgacgtatatccgtgagaagtatcctgacctcataccgctttacgaggaaatttacaataaaaaaaggcttgaatactggcaggcattggagcaggacatttcaaattacgccaaggagcagggcttcccgtatcgtataaacgatctgccatacggacgctcggaaaaaggcaaacctgtcatcgtaaactacttctaccacgaaaaaatacgattgacaaaatgaggctatgccggactgatgcagaaaagttgtagcgcggataaaagcaccatgtatgtggataatatccggcaatcttccgagcgtatgcgggagatgctcaacacgctgctggatttcttccgtctggacaacggcaaggagcaacccaacctttccccttgcaggatttccgcaatcacgcatattcttgaaacggagttcatgcccattgccatgaacaaggggctgactttgatagtggagagccacaccgatgcggtggttttgaccgacaaggaacgtatcctgcaaatcggcaacaacttgttgtcaaacgccatcaagttcacggataacggtagtgtatcattggcagcggattatgataacggtttgctgaaacttatcgttgaagataccggtacgggcatgaccgaagatgagcaacaacgagtattcggtgcatttgaacgtctttcaaatgccgccgcaaaagacggcttcggattaggcttcctgcaaccagccgttatccaacagccgggttaaatgcgtcctccctatctcggccgtcccttgcaggacgacacagcggtctttctcctggagctttcttaattcctccagtgaagccgccattttctccgccattgttgccataaccgtttttatttagattctgattattttcgtgcaaatactcgtttttagacacgtgtaaatactcgtttttaattatgtgcatttactcgtatttgttgcaaaaatacaatatttgttccgataatcagctactaatgaagtctttttttacttgttgtatcgtcgaaacggcctttcccgtgagcttcgccacgttccggatcgagtagcctttctttaacaaggcgatcgcctcccggtattcctctttcctctgttcggccgttttccggcttcccggcttccgtcccagcctgccccctttctggatgtacaactcccgtccgctattaaggcggtcgatgatcccctggcgttcgatcgcggccagttcccccaacagggtagtgatcagagaggacaaggggtttaccgtcttgtccggccgtaacgtttccaggttcaggttttgaatatacacgcatattttatgcgtgtgcagcgtatcgagtgactttaggatctccagggttgaacgccccaggcgtgagatctcggtcagcaacaacatatccacccggttctgcggatctgtgcagtattccaggcaacggcttaaaaccgggcgttcgatattggcctttcgtccgcttatcttttcctcaaagaccgccgtcacctcgtacccccgtccggctgcgaacctctccagatcgacaacctgccgttcggtcgattgcctggccgactgcgagcttacacgtgaataaataaccacattcatcccttttgcttttgttcttccttatctattgttttaatcaccttatccacctctttcaaggaggcattatttccggatctatccaaaaaagaaattcgctaattaacctataattactatctttgcattgtaatgcttggtaaagcctctgttatcaaaacacgtaaccaagtcaaggatatacccgttcatcaagaacgggtttttcttttgcgacagcccattcataagacaaaggatattataacaggtcagtaatcacagccgccggaatatccagctttgagaaagcgaacatctttttccccagatcctttaacgaggctccgatatggtacacgtccgtttcatcaacgatcaggaaacggtcgtgactgtcccggtacgtcctgatgtcgataggtgggtactggctgttatgcctgtcaagatcaagttggagttgctgcgtgatacgctgtgtgtaaatggtggccgagacaccgacgctgcgtttactcaacatgagcaagaccgtttcgtccacatagttgtcgataagcacgatcgaacgcctggccgactttaccagatcggtagcgaacttgtacgcatcgaaaatctggccgttataaaaaatgccttcgaccgggggcaaggcagtacgcacaaaaaaatctatcttctcggtatgttgagcgacagtcctttcaagttctgacaaacgtttattaatggaatacccttttaaaagatagtcctttaaaaccttattcgcccattgcctaaataaaatacctcttttactattgacacgaaacccaatggatatgatcgcatccaaattgtaataagtcagattgcgcatcacttgccgtttgccttcctgtcgaactgttcggaaatcccgaacagttgaactttcctctaattctttctgatcatatatgttttttatatgctcgcttatatttgctttgctggattgaaaaagatccacaatttgcgcctgtgtcagccaaacggtttcatcttccagcctcacttccaacttgaccgcttcatccggctggtataatatgatttctccctgttccattacttatttaccttttcttaattcatcaagcctctgcatcgcaccgctgaacttctcactaaacatcatatcatcgggcaaaacaaaccaggtgggaatacctctcgactgtggattacctatacattcatcttgcccgttctgtttgcggtaatcgtcccattcactataagcgatgttccaacgaatacctaatttataggtattttcccatttaataatagccagtgaataggccggatcatctttgccgtcataaatcacttctacaacttcaaccatccctttaggggaatttataaacttcggatttttatacgaataagtgctcatgtcttttattttttatttatagcacacaaagatactcaaaaacaaatatatacatatatacatacgtatgattaacgtataaaaacatttatggttattctaatctttgattaattccggtacagaaacaaaacgtaccgaaaggtggaaaccggatttatttcggtacgcttccccgatcggcacaaaaaacacgcaaaaaacgaaaaatactacttttagtattttagtatattagtttttgactatatttgcggacatgacaaccatttaaaaaactgaatttatgagcaaagcaaaagtaatctccgtattgaatcacaaagggggagtaggaaagactacaaccacgatcaacctgggcggcgcgttacgtcaaaaagggtacaaggttcttttgatcgaccttgacggacaagccaacctgactgaatcgctgggcttctctgcggagcttccccaaacgatctacggcgcgatgaaaggcgaatacgacctgccgatctacgagcataaggacggccttagcgtcgttccctcctgcctggatctctcggccgttgaaacggagttaatcaacgaggccgggcgggaacttatcttagcccaccttatcaagggccaaaaggagaaattcgattatatcctgatcgactgtcccccctcgctgtcgctgctcacgcttaacgcactgacggcctcggatcggctgattatcccggttcaggctcaattcctggcaatgcgtggaatggccaaacttatgcaggtcgtccacaaggtgcagcaacgtttgaactcggatctttcgatagccggggttctgataacccagtacgacggaagaaagaacctgaacaagagcgtttcggaactggtacaggaaacattccagggcaaagtgttcagcacccatatacgcaactccattgcgctggccgaagccccgacacaagggcaggatatttttcactatgcccccaaatctgccggggcagaggactacgaaaaggtatgtaacgaactgctaacagaaataaagtaaccatatggcaaagaagaacgatttaaaaaacagtatgtcggccgggctgaccgggggattagacagcctgatccaatccacggccgggcaaaaagaggctcaaaagccgaagaaagcgaaaaccgtgcattgtaattttgtcatggacgaaacctatcaccagaacttaaagctgatcgcgatccgcaaaggcgattcgctaaaatcggtattgcaagaggctatatctgactacttggataaaaacagttccctgctataacagcgtatcgggaatatacagggcaaacactccacaaaagaaattctccaggaaaaaggtacgcaaaaagcacccctacacatcaaaaagtatattgaaaatgcgattccctataaagaacccgttggcaggattaatcttgcgtatgtttaacctgccaacgggtacgatattaataaacgtttggattaaggttggggttggacgtttacgtctttatctgcatcaacccagcctgttgtctctgcatcaaactggatcggattcaacacagccactccctgatcagtataaccaccaccgaaaatcaacgtgtagatatgacgcttgcccgctacccatgtatctccgaacggaacataaattgttccgtaactatctgctgaacccaacagataacctccggactgctggattttgcaggtgatcgacaggtaacattgatgcgcaccgtcggcttttatcttggtattggtggcttcttcggaaactttccatgctgtcagcttctgtggtatattcagcataggagttttttcggaaatatcggtagctgtggtattactattgacctcgatggatttgccttgcactacggtaataaaacctcctcctgtagagctttcaggccaatcacccacagcccaacttcccgttccatcggctgtcgcaggcaatgtgtagacgccgcccatttttacattaaaaatcttgatgtcctttatattcacctgcatgttatcgtattcggtctttgctttgaatacgacctgtgacagaatatgcttgaagttaaatttcactactccgttgttcttgtcttttgtctggcctttggctatggcatacatcacgtcgtagttttcatgagcattgataccagatccatactcatcggagcaggaataagttatcttttgagtatccttggtggcttcccacatataactccactgcatggcttcatcaaccgttccgggattgaacgcgtaaaagtccaaaggctcggtaggccaataacgaagatcgcccgcatttttataatcccacttattatctttgtacacgatattcactccgtcatgtccaaattccgtgtcgacctttcccatgaaggcagtaccatccgccgtaaaagcgaacacgtcgaaatcggtgttcttcaagttggtgttggtagtaggggtagccctcgtttccgccgcattacttaacacgttaaaaccaatcgcatttcgtgaggaggtttccacattcgcaatctcctcgtctgagcaacccatgagtagtgctccaaagattgcccaaagcattactgtactttttttcataaataaaaataaattaaattgatacatataattaataaactcgattacttaatagttgacatagcgtttacccggcatccaatccgcactgaaaactcaaatatccgtttataacactatatccacattcacatcatcccaatcatcaacgtccacatcaaatcccgcaccgtcacttcccggctcgaatggtacctcataatcaaaattcaacaccagatgcacatcaccgacatgccccgctaccgggacatcatgcacttggtcgctcacgtcctgttccaatacagacatgctgccggaacggttcttgagatacagccggaaaacattgggctctccttcaagtgcggaatgtccaaacgtatagaatccgcctataatctgattccgtgaaaccattccatcaaagagcaggctctccgaaagaccggcgggcaaactgtcgccggacatgttaagcgagccggacatgccggaaagagcggcccgcaaatccgccaccctatccagtccccgaagaccgttcacctcatacgtgtagtgacataccatgtttacgggagttagccgtactatctccgcgcttcctcccggaatgtccttgaggataactccgtctatatggtcgccacacagccagggtggggtgacagccattgtccggttatccggtgaccgaacatcacgcgtatcggcagtaaaaagcgtgtaactgccgtttcctttccaaaccatcccgtcggtatcgtagttgaagcaaattacccggtaatcattctcggggagctccacttcccccccctctcctccggggaaatcaaatatccacgtgttgctttcatcatcggtcggataaaatacgaccctcatgccttcaggcttgtcatgattggaaatcttggtccagtcgaatattacccgcaccgtggcaaagtgcggatgatcgtaacataaatccttatgctcacaagccgtcagtcctatccataaaaatatgaacaccagactaaagcgtatccgtatcactgcctgcctcctttcttccggctataattcccccgcccgatcaaccacaccaaagagatacccgccttggtcgggccgaaccagcggcggtttttagtggtctgccatacatagtgaccgtccaaagggatgtactccttgtacgatcctccaaggtagccgattcccaacgtgaaatccacattgaaccgatgtcccacaggtaacgagtagccgtaagccacgcctcccccgtaactccatttatcccccaagtaacctttcccacccaattcgaaatcataggtgacgatctgcccgtacaatccgacatgatgcccggaaaacggtttttccaccgctctccgaccgaaccagcggcgcaactccacatctcccccatagatacgccaataattatgcttccgatcacttttccaccaggcatacatccaattcccggccacagaccagttcttccccaaacagaactcaaccccgatgtcaggtatcaaaacagcgtcataaagcaagtttgttttcaccgccatgcaaaacggccgtttctttaccggagctatgacggtaacggtatcacggatgcacaacgtatcacgtgtatgtatatataccgtatctctgacgggatttatcggatcactatcatagcatattttcaccatcgacgaacgaagtttcggaaaatggaatttatacaaatatgagtatggcctcccccctttcagtcttttcagttctcccccccaataagggctgtcctggttttccaaacgtacgatcttctccaacaaacgaaggacatcctccctctccggaacattcacatccgctctcaccatcgttataagtccgttccagtcacttcccgaaaaatgaaaatccttctccaataccggaatctttatataaggtgatatataccgccacaaaacctctgctcgtttttcagacagccttccattcaacagcccccctccttccggggaagctcctcctattatttgaattttcctgataagacggacggagtcgttcaatgcggaacagattttagcaaaccgctccatctcgttcccattgtcaagtaaacatgtatctatatttacctttccttgatgaaaatagatccttaccgaatcacgcttctcctgagcggatatttctccgcttatactcaacacgagcacgaacaatacacatttaatataaaaaaaacatcttttcgtcatttaatcatttgttaatatgacaatccaaacccaggcttttacaccccctgaatttcaaccgctaaagatatgcacttataaaccaacctccaaagcaaaaaacaagtattttaaacttataaatacttaaaaagacaaccacacaacagctacaacacttaccacagcagccaatcacgcttacacaacaattaaaaacacttaacatcataaagaaaagtacttaaacatacaaaaaaaaaaaaaaaacagttatttttgcaggaaacattatacttaataacacttaaaacaataaaacacatgaaaatcagcacaaaagccgctacttttctaagttcaataaaaactcaaacttacgacaaaaaagaaagagaaatgataataacgtatcaacaaaaacgtgtctttcatctatccctgctcatgctggccttatgcgcacccatatacatatattcagttccatttcccaatgaacagttttattatattaacagcgtattattcctgtttatcattatgtgcactctcgcttattttaaaaagagagtaaatctgaccacgaccttttccattatactgatagccatacatatcgagatttttatcgaaataatttattgctcaatatgtagcggatatgaatatagttatcaaagagcattgataatgagtaacattagtatctctctcttatttaccatgctttccatctgtgcctatatgagtaatatctccatcctattgtcctcccttaccatagcttcctatacaatctgcacacttatcaccgacgaaccgttcctatacagttatctgcctttgatcatcatcatatacaccatgatccccttattaggaagatccttacacagtaatatcagcagcttgctaaaaagtagcaacttgctaaaagaggaagaggaaatgcttttgaaacgtctccaaatgaaaaaggaagaactattcgcgttcgccgagttgttaagcgagaataacccggaagaaaagacaagctccctgttaagcataataggggaacaatccaaagaaaatctttttacagcccttgccgcataccagaaaaaggaaaaaagtaaacttgatacaatcaggagaatatatcccaatttatccccgtccgaattaaacatctgccgtttaatactgcaagacaagaccgtcagccaaatatgcgaattattacatcggagtagcggaaacataaccagccaacgagcgaacatacgtgccaaactcggactgaaaaaaagcgacaatttaaaagaagcattacaagaacgcatgaggctgtatgaagaagaacaccggcaagaggacttttcagccatgcgttagggattgcagagtaaagcccacagcctttaggcgaggacttgcaacggaaagcctgaccgtcccacaggaacgcccaaaagaaaaagaatcccccgaacattcatccgggggacatccaagccgtcacatcaattataatacagattcagatcatccgtgccaatctcctttccgtcccggaaaacaaggcgtaaatcaatcctctctctgttttcattgccacaaagatagacataccggccaacatacgcatcatacttatcaatcagttctaacggtatgaccggcatgggaaaaggatacacctatattgcatatagcggaaaatttgtaagattaccctgtactttataaggcaacatagaaaatctctccgcatgcaattccggtctttttcccagtaatgctgtcaacgaattggcccggacattcccttcggccttcacttctatcggcaccatttgggcattacgttgaataacaaaatccaactcaagacgcgaattgtctgtgttatggtaataaatcggtgacacgcccttacttttcatctgctgcaatacatactgttcagtcattcctcccttgtattccttaaatatgtcgtttttaatcaagacttgggccggatctgtcttgaccatagcacccataagccccaaatcaaccatatagagtttgaaagccgacaggtcttcataaatatcaagcggaagctccggtttggtacatcgaggcactttatacaacaacccggcatttacaagccattgaatggccatctcaaaatcattggctctggcaccttttcgcaaagctccgtaaatgaatttcttgttttctttaaataattgggaaggaatgctgttccataccattcggacacgcggaacctgttctttgggcgcatgttttgagaagtcaagatcatagccttgcaaaatctccgactgtattcttctgacttccagcaaggaatccgtttctacatatttgagtacaacttccggcataccacctacataataatattgccgaaggagatccgtatatttgtcatgcaggaggcttatcgtttcaaaatccccactcataagcaatttacaagcttcttcttctcccttggcgacaagaaactcttcaaagttcataggaaatatattgatgacatttaccttccctacgggataagacacatcctgatgaagggatatccccaaaagtgaacctgccacagctatatgatactccggaacctcctctttaaaatacttcaaagattccagtgcttccgggatatcttgtatctcatcaaggataataagcgtatcacccggagtaatgtcaacggaagtcatcgcacgcagcccccgtaaaattctgtcaacattgaaatcctgagaaaaaagctggcgtgcaaggttattcttacggcataccacataagcctcttttttgtattcaagtttggcaaactcatggagcagccatgttttcccaacttgtcgggcaccatttaaaatcagaggttttctatcctcacggtttttccattctataagttgttgcaaaacaaatcttttcatctacaaacagcatttttatacatgtaaaaacagcgtataatacatttatccgcacttatttaaagcacaaatatactaaaataaacagataatagaagcaatcttatacatttttccgcactttaatcaactccaatggaaagcagtagccaatttaggattgccttctccacgctcgatggccaccagcgtattgatgcccacgcccgccagttcggagaagttccagctgattgaccttcaaactcttcctgcactctttaatcatctttcctagctctttcatattcacaacacattgtgattttagtcagttttcatcctagttcaaagaaaaaaacagccgataaagcaactataatcattgtattcatatagattaacatcatatattcaagttaatctatatatttacatggattatttgtatatttgcaaaaaaggaacaaccatgtggaatgaaatgagcaatccagctgtgctgatgagaatcggccagcgcatcaaagagacacgtatcaggcagcatatcacgcaggaagaactggcaacggcttccggtgtaagccccttgaccgttgcgaacatcgagaagggcaaatcggtatcgctgctgttgttcatcagcgtactccgctcgctcggcctgctggagaacctggagcaactggtaccggaaatccgggtcagcccgatagagctcaaaaaactgcaaggaaagaaacgctaccgtgtacgccatttaaaacaagataaccatgaatgatttgatagtagatgtaaagctatggggagaaagcgtaggctctctctattgggaaaaggaaagcaatgccgccttgttcgactatgaacggaagttcatccgctccggtcttgacatttctcccatcatcatgcccatcagccagtacaggaacaccccctaccggttccttgaaaaccgtaccgactgtttcaaggggttgcccggcctgtttgccgattcactgccggacactttcggaaaccagatcatcaatgaatggtttgccagcaagggattgtccggagaagagattacccctttagacaggctttgctatgtaggcaaacgtggcatgggcgcactggagtttgagccgtcctcgccaatcaacggcatgaacgaatcatcagtgctccatatcgaggaactgactgagcttgccaaatccgtattcacggacagaatggcttttcaggtccaactgcgccaggaaggaagaaacattctggatatactgaaagtgggaacatctgccggaggtgccaagcccaaggccatcatcgcctacaacgatattaccggagaggtacgctccggacaggtaaaagctcctgaaggattcgggtattggctgttgaaatttgatggcggcaaatacagcgaacacacgcagataacggacaatccacaaggaataggaaatatcgaatatgcctatcaccggatggcaaaagcctgcggtatcgatatgatggaatgccggttacttcaggaaaaagagtcatatcactttatgacacgacgttttgaccgtatggaagacggagagaagatccatgtacagacattggccgggcttgcccactatgaccgtgaccaacgccattcatacgaagagatattccgtatcatgcggcagatgaacctcccttatccagagcaggaggaactataccgaagaatggtgttcaacgtcatgagccggaaccatgacgaccatagcaagaacttatctttcctgatggatagacaagggaagtggaaactggccccagcatacgacctctgctactcatacacaccgggcggcaaatggacgaaccgccaccagctgtcactcaacggcaaacaagacaatttcacgatggaagatctgcaaaaggtaggtgagaacatgggtatccggaaacacaaacagattatcgaagagatacaggaaaccgtatcgcattggcatgagactgccaaggattgcggggtcaagccggaacacgccgattttatcggagaaaacctgctcttgttcggcaagcaactgcatacgatccatatgccggacattgccaacgaacaagagcaggctttcatgaaggctatgcgaaatgatgacttcaataccattctgaaactgaagatgagaggatatcagccatcggagaacacactgaaaagcctccagccggatgtatccgccaccaccttcatcgctgccgccaaaatcttccaaatggaagggatgctaaaaagccttcaggacataaaacccgcgcaaagcccgattacaggcggcaataaacgtagcatggaattgggggattagcacacaaactacatcgcgcacaattcaatataacagtaaatatattaattgttatatatcatattttgatttaacaattaatatatttacctttgtaaaatgacaacgaatcacatcacccaagccatggccaatccggaaatcatagtggaactgggcagacgatttaaggaatacaggctaacctataggctcacccaaaaagaggctgccgagaaagccggtgtcagccttatcaccttacgccagtttgagaacgggaaggcctataacatcaatatgggcaactttcttgccctgttacgagtagtggactgtctggaacagatggatgatctgatgccggaaatacctgtttcagcctatacaatggaacgaataatgaataaaaagccgaaaaggataagacatggaaaataatgttgtgagtgttatgttatggggagaagaagtcggaaagctctattgggacgaaagaaacaaaagagccgtcttcaactatcatccggatttcatcaagaaaggagtggaaatcgccccactgaccgcttctgtcaaaggaccggcggcaaagggtatgcccatactcggaaacaaagaaaagacttatcaaggtctcccaccgtttttggcagattcattgcctgatcggtggggtaacatggtcttcgaccaatgggcggcacaaaaccatatccccaagcgcaaactcacaccggtagataaactgtctttcatcgggaaacggggaatgggagcctttgagttcatcccggccactcctggattggaatcctcttccactctccagatagagagtttataccaactggcacgccgtatctttgaggaacgggaggaaatatccgtgcaagatgacgaagcactgcaactgcaaagtatctatgagataggtacatcagccggagggcagcacccgaaagccatcatcgccatcaatgaaacgacacatgatatacgttccggccaagtccctttaccggagggctatacctactacatattgaagtttgcagaaggggacgattttccgttcacgcaaatggaaatggtatattatgagatggcaaaggaagccgggattacgatgatgccttcccgactcattcaaattgagggaaaacatcacttcctgacggagcgttacgataggataaacggagagaagatacatacacagacacttgctgccatgaatccggatgcaacgagctatgaggatttgtttgaagtctgccgaaaactgaacatcccggcaagcgaacagtccgaactctaccgtaggacggtattcaatatcatgggcggcaatgtggatgaccacatcaagaatttctctttcctgatggaaagaaacggcacatggcacatcaccccagcctacgacatgacattcaccaccaatttggacggtgcggcatacgaaaacgcacactccatgagcattgcaggaaaagataacgacatcacggaagatgacctgatgcaatttgccaaacagaacggaataaagaatgcgaaaaggataatcgaagaagtcagccttgccatcagccatttttacgattatgccaccaatcatcaaatcgatgactattggaaagaccgcatcgaagagcatctttccggtttggtatctccgatcatagggaaaaccatgaaacactacctgcccaccattgtcgaaccctacgagacagaggatggctttttggtatcagaaatcaacatcatcgaaaacacccggcatgatttccgtatcgaggccttcataaacggaaagcgacagaaatacattgccgggcgtaaaagcgatttggctgctgaagtcattgccaaaggcagaaacaagatgcccgttgagaacaagaaagaacttgtggaacggttgttactgcctttagctagaagataaaaacagacgaatagcgacactattacattaataaaaagtctgttcttgttcggcaagcaactgcatacgatccaaatccggacattgccaacgaacaagaggaggctttcatgaaggctatgcgaaatgatgacttcaataccattctggaactgaagatgagaggatatcagccatcggagaacacactgaaaagcctccagccggatatatcctccaccaccttcatcgctgctgtcaaaatcttccaaatggaaggggtactaaaaagccttcaggacataaagtctgcgcaaagcccgattacaagcggtaataaacgtaacatggagcaaacaaatttactattcaattttcagtttttttctatttctatactactgtacgccataaaataacgaagaaacttattcctatatcaattcataatcaataacatacaattcaccaagaatattagggaatgctacagtatcatatatcacctgccctactccattaaaattacccggagatattacagatgctacaacaccatgataagctgtgggagaaaaagaaagatctgctaatccatttatcccaataacatttttctgtacaccagcattattaacattacaaaaaattgcataatgaatagtttgatgtaaatttacagcagcattaggaagatgcacaaaatataatatatctccattattacatttagctaaatcatgataggtatttattttttgtatcatactttctaaagaagctccaaaaggattaactgaaattctttttcctgttgcctgttctataattcctctaactaaattagcacaccctccaccatttgtaggtaaattaacattcaaattctgagtattagtaataaattgtgtaatcaattgtctatcatttatacttatagccatatattataactcatgttctcctactctctcaaaggcttttcggaacctgcctataaaaactgtctctgtaagcttaccccacaaatctaccctataatccccaaaccgctatcatcccttttctgaatgccatggaattttttccgaatacataagttagaagatgaaaaaagattgtattcaaagtttttggttcttttttgaaaaaagaaccgctggccaaaaatccaacggttactttactttcggaaaaatatgcaatgaagtttataggccgaatgaggaacgcagcttcttcatggcattctccacatcaaagaaagacacatccataagatcttctccccatgcttccggaaagtcaagaatggaacgtccgttattaagaaccgcatcacggatggctttcatcacattctgccgagtcggttccagcttgaagaaaaggcaatgcctgactgccattgtaagggtatcatcatctataaagaaacggatggtgacggtcatgtgtacctgcgtccgtttctccagtttcttctttttagtttccagtttggccaaccgggaaacatagaatgaagggatatgtttcccggattcaacgcaagtcttcatcgcttcatgtatttcagcgatgccgtcacgtatatccgtcaagtcggtgcagttggatgcaaccgtataagccgataactttttcatctcaaaagccgtttttatatggcaaaagccctgtttgtgaaacttataatatatgaatctccttatcacctaccttctcgtccgatacgaccaatacctcgtacttcatcctcttgtaattatagactacggcaagcgtattaaagccaccgttatcataccgcctgtcataaacggtatgtacatactcatacatcgcattccccatcatgaactttacggaaacatccgtaaagtaaaatgccaccgcataagccagcgttttctttttatcaaccttttttgttttcataaccatttgtcctttattgttttctgataaaatattcaatggccgaatgaaccaatatataatgtgtgggtgtctgcctgcactgttccgcataaggattatagaactggagagccagcgcatggtataattccggcaattcccgcttgattctcgccgtaagcagccgataggagcattttctaccgtacttcatcagctcacgccatttgtcctgtgttatttccgtgcaattcgtctcgtaaaccataacttccgtttttaagttcaatattccggttggaaagcggaaaggggttgttccctctccgtttattctctaatcaattcaggcaagcttttaccgttataccggttttcagtcctttatccagctgcacggtcaacccacgaacattcacctcttgaatttgagaaagaagcacataaccccattcccattcttgaatatggcaataaccgaaaaaaagccagtcaccgtcttcctgctgttcggcttccgttaccaaccataccaccgaagaaaaaggaaggaaaaaccttgcgatgacttccgcattaagcccctgcccctcttttgagtacaaagggttggcttcaaacacattctttagttgttccgtcactgtaatcatatgtcacatttttaaagggttaaacttctaattttatgcttcagctagatttaaagacctttttttaaaacccctttccgggatgaccttttctttctgccgactttttttttgagctttcatgccccatctgagtttataagccttttttttacggcacacaacaagaaggaaggagggattgagaaaagttttggacgacaaaaaatgttggggacagcgaagccgtccggcgttatttttttcggtacaaagggcgaagaccggaactctttcgtatccatccaccgaaataaatttgccgttcaaaaacaaaggctctcagacggggctatgaaaaaacgtacattaggggaggcagaaaacaaggaaaagggcagtacggaaataaaagaagaataaaatccaacattattcacattgatatataatagccaagtatttcgccatatcaatataaatccaactataatcaaaatcaaacagttatctaatttattggttattaaacatataatacgccaaaacatttattttggagaatataatattaattaaacaaaaaaatggcatcattaaaaataaagtatcgacattcctctatagaaggaaaagcgggaacattgttctatcaagtaattcataatcgtgtagcaaggcagataaattcaggatacaagatttatcctgacgagtgggatattttcaattcccaaataatcataccagcaaagacaggagaaaaccggcatcggtatttggtttctttaaaaaaatgtattgaggaagacacctcacgtctaaaagatattatgataagatttgagaatcttggatacaaatatacggcagacgaaatcattgaatattattccgctcctcctgtgaacgagtactttgtgtcattttgtgagaatctcattgaagaattgagacaaataggtaaaatacgcaccacagaaacttataccactacgctcaatagcttcaagcgattcatgaatttcagaaagaaaggcagagacatccctttcgacaatatagactccaacctgatgatggaatatgaacaatatctaaaatctaatgacatttgtccgaacagtacttcctattacatgagaaacctcagagccatgtataatcgtgccgtagaaaaagaattggttatacagcgatatccgtttaaacatgtatatacgggcatagataaaactgtaaaacgggcagttccggccaaaattatccgacagatacgcgatatggatttaagtcacgactcctctttggaatatgcaagagacctatttatgttcagtttttatacccgagggatgtcatttatagacatggcttatctaaagaaaagtaatttgcaaaacggttttttatcatatcgcagaaaaaagaccaaccaacagctagtaatcaaatgggaaaagcccatgcaagaaatcatagataaatacgataccataggttcttcttatctattgccgatcattctcgacgcaaaaacggatgaacggaaacaatacaagaatgcagcccagctggtgaattcaaaactaaagaaattgggaaaacaaatcggccttcctattccgctgacgagttatgtggcacgtcacgcctgggcttctatcgccagaagcaaaaacattccgttggctaccatcagcgaagctatgggacatgattcagaaagcactacacggatttatcttgcatcgttagacacctccgtagtggataaagcgaacagtattattttaaatacactttaattcacattataaaacagtttacgccataggtttcagcatacgtgcccaatcggcccgctgttattctatggcaattattatttttatttatctgacaaaaaataagttggaattatgttatacaaattgaagttttctttctgagagaaagatttgtaaatgcaaaagtacaaaagataacacaaaaaacactaaaaatcagaagaaaaatattagtcataccataaaaaataagaggtatgattagaaaaaactgattatttgttgagcaaattgattataccaatcttataaatatttgatatacatcaaaataccaatcaccccatttctctcagaaagagaaacaccgaaaataggagaaatttcctatacgaatgccataggaatataatgaacaagtatataccctatactttcagttgtatgacaagatggattcagaaaggaaaaagccccgtgaaagtacaaaattcttgcttgaaaaagattgaataaatgacggttttctccataagagaaatgttttgaatatgcaaaaatacataaattattgaacataatagcataaaacaaagaaaaaccttaatagccacctcgttaaatgtcgtggttacataacaaatgttgagtaaactagattgtatttacagcgaataatccctgtaaatcaattatatatgttaaatatttatgtcctctatttctcttatggagaaaaataggaatgcggcaagataaaagacggcatgaatggttgatatgacagccaaaaaagacataaattactataatacagaccaatacataagttgggatgaactatgggtatatcttgacctgccgtaataactaaaaaacacacgacgaatgagtactcccataaccacaagggaagatctaactagaatccaatggttcgccatgagcgcttataaaaacgagaaaaaggcggaagagatgctcaaaggcaaggatggtctagagtatttcataccgaaacactatgccgtaagggtctatcacggagtgaaatccaaaaggcttgtaccagtcatcccgaatctcgtcttcgtgcatgcttcccgaaaacagatcacggatttcaaaaaaaaatataatttcttacaattcatgatgtgggagaaaagcacgggactgaaatatatcgtggtgccggataagcaaatggagagctttatcaagattgcctcgcagtatgaagaaaacactatttattataaaccggaagagattgacatacggaaaggtacccacatatgtatttacggtggcaagttcaatggagtaaagggcgtattcatgcgggtgaaaggaaaacgtcgccgccgggtggttgtgatgcttgaagggattatgggtatatcggtagaagttcatcccgatttgattgaagtcatcaatgattccgattgtgacaaattttgagagatgacacaaaaaggagatgatgaagttccccttcctcgtggccttacacaaataaaataatatttgaatatatgtatttttggattgtaaattgttcactggcatttttgctttgtgttctctgtgcgggtatcgtcattccccagattctgctaatcgctttccgtaagaaattgttcgactttcccgatgagcggaaggtacatcattgtgcggtgccccgattgggtggtatcgcattcaagccggtagtgtttttcaccatagccctgttgctaggaatcaatatggtgctgggacattcggagatattgtccgaaatcgggaacgacgtgtgctctttggcttttgctttctgctccatcatggtactatatctggttggcatggccgatgacctgatcggtatccgttatcgtgccaagtttgtcatccagattctgtgcggcgtgatgcttattgccggtggggtatatatcaacaacctatacggtgttctgggcatccatgcggtgccgttatggttaggatatcccctgaccatcctgatcgtggtcttcatcatcaatgccatcaacctgattgacggcattgacgggctggcttccgggctatgcagtatcgcctgcctattttatggactgactttctttatgctccatcagtatgtttatgccatgctggcgtttgccacattgggagtgttggtaccattcttctattacaatgttttcgggaacgccaaacacggaaggaagatcttcatgggcgacacaggcagtttgaccatcggcatgatgctctgtttcctcagtctcaaactgaccatgtgcggactagacgataatacaggaaatgtacatccgatggtgctggccttctcacccttgctggttccatgctgtgacgtggtcagggtttacctgcatcgggtacgcaacggaaagaacccgttcctgccggacaagaaccatatccaccataagctgcttgctctcggaataaagcagcgcaataccatgatcatcattgtttccgtgtcaactatattcatactgctcaatattcttctgtccctttatctcaatgtgaactggatcgttttgggtgatatattgatatggactctcgccaacatcaggctgacaaaatctatcgcacaacttcaatcggaacagaaaaccaacaaataaaaatcaataaatatgaaaatcagatacattttatccttattaaccgtggcctttctattgggatcatgtgccacaccgaaagtcgcttatttcacggacctgaaacggggtaccgcagagcaagtcttgaacccgctggaaatccggatacgtccagaagacaagatttccatacaggtcaacagcaaagaccccttattaatgaaccttttcaaccttccgatcatatcccgacagattggtacgacatcaggtacatccaatagtcagggaatatcaggatatacaataaataaggatggggatattgattttcctgtgctgggacatatccatgtggcaggaatgacacgcgcggagatcgcctcgtatataaaagaggaattggtttcaaagaatctcgtgaaagaccccgttgttacagtggagtttatgaacctgaccgtttcagtgttgggcgaggttgccacccccggacgtttcaatatcgaaaaggacaagctgacacttttggaggccttaagcatggccggggaccttaccgtctatgggaaacgggaaaacgtgctggtacaacgggaggaaaacgggaaaaaaaccctgtatcaggtcaacctgaattcgggatatgacctttatgcctctcctgtgtattatttgcagcagaacgatatcgtttatgtggaacccaactcaatgaaagcacggcaggcgaccgtcaacggcaataacgtccgctcagcctctttctggatgtcattggcctcgttgctgacgaccattaccgtgttgattgtaaaataatatagaatcagatatgatgaccgtaaatcaaaagaatataaaaccggggcagcaggatgatttcctgcgaatacaggacctgttatacctgtgcctcgcaagatggaagtggttcgtcttgtctttagcggtaacgatcggtgccgctactgcctatctgttacgcactcctgccgtatatacacgtaccgcttcggtattgatcaaagaggattccaaaggcaagtcggtctcctcggatttggaatccttctcggagttcgggctgtttcaatccggtacaaatgtgaataacgaactcatcacctttcgatcaccgtctttaatgaccgaagtggttaaacggttgcgtctggatatgaattacttcgttcggggaaaattccaccgtcaggtagcctatggactgacattaccggtggatgtaacgataaatgacttgcctgagaatgaatcagccggttttacgttggaaatacagccggacggtacgttatacctatccgactttatacgtaacgggacagatcttgaagaaaaggacgtaaagggaagcttgctcgactccatcactacgccattgggaaaaatcattatccatacaacacccaattacgtgaaaggcgaggcatatacattatatgtaggcaaatccagtctgtataacgccgtcaactcctgctcgtccaatctgtccgtttcattgaacagcgagaaagcgtcagtcatagacttgtcattcaaggataactccacacagcgggcagaagatgtattgagcatgttgatttccgtttataacgagaattgggtgaaggacaaaaaccagatcgctgtcagcacctcaatgttcatcaacgagcgtctgggcgtaatcgaacgggaactgggaaatgtggacgaggatatctcctcttacaagtcagaacatctgttgcccgacgtgcaggcggcatcgagtatgtatatggctcaaagcagtgcggccaacgcgcagatcctgtccctgaacaaccagctttatatgacccgttacatccggaactatttagccaacgatgccaaccgtacccaactgcttccggccaactccggcattgaaagcgccaatattgaatcgcagattgccgaatacaacaagcaactgttgcagcgcaacagtctggttgcgaacagcagcacggaaaatccgctggtcgtggatatggatcaggctctggcatccatgcgtggggcgataatcagatctatcgacaatcagatagtgaccttgaattcgcagataaaaagtttgcggcagacggagcaacagacgacatcacgtatagcggccaacccaacacaggccaagtacctgctttcggtggagcgccaacagaaggtaaaggaagctctttacctattcctgttgcaaaagcgtgaagagaacgaactctcacaggcgttcacggcttataatacccgcattgttaccccgccacacggcagcatgttgccgacatcccctgtgcataaaaatatctttatggtcgcattcgctctggggctgctcattccgatagtcattatcttcatgcgcgagaatatgaatacccgtgtacggggaaggaaagacctggaaaacctgactataccgttcatcggtgaaattccgctgttcacaagaaagaaaaaagggatattaggaaagaaaccgcaggaagtcaaggccgttatcgtcaaggagggcaaccgtgacatcatcaacgaggcattccgcgtattgcgtaccaacctggaatttatgaccggcaaggacaagacttcgaatgtcatcatcatgacctcattcaatccgggcagcggcaaatcgtttctgaccatgaacatcgccgtgagccttgccatcaaaggaaaaaaagtgctggtaatcgacggagacctgcgccacgcctctgcatcatcctatatcgactctcctgacaagggattgagcgactatctgggaggtcgtatcgataatctggatgagatcatcgtacccgatccgaaacataaatctatggatatactacccgtgggaacgattcctcctaacccaacggaattattgttcgacgagcggttaaagcagacaatcgatactgtaagggagcaatatgactatgtgctgatcgactgtccgcccgttgaactggtggccgacacgcaaattattgagaaactggccgaccgtaccgttttcgtagttcgtgcaggattacttgaacggagtatgcttgctgaattggagaaaatctacgaggagaaaaaatacaagaacatgtccctgatcttgaacgggaccgagggaagtggcggtcgctatggataccgttatggctatcgatatggttatcactacggttacggctcaggataccactaaggttccgacggaaaacagggtggggataaatggatgattattaattaaaaaaaataaaatgttttatataaaaatactcgtatcattgtgtggccattcaggaaacgtatatcgctgaaagatagcggtatattcaagaattttaccgactgtcactcgcacattctgccgggtgtggacgacggtgtgcagacgatggaagaagcattggaaatactgcgcctgtatgaagagttgggcataaaatccgtatggcttacaccgcatatcatggaagatatgcccaacaccacactgcacctccgggagcgttacgctgaacttcaagccacctatagcggtccgataaaactgcatctggcctcagagaacatgcttgacaacctcttcgaggaacggttggaaaagaacgatctgctgcccttgggtgaaagcggtgaccatctactggtggaaacctcctactttaaccctccgatgggattgaacaacattctgctccgcatcaaggctaaaggctattatcccattcttgcccatccggaacggtatgtttatatgggtgagtcggattatcaacaattaaaagacatgggagtgaagtttcagttcaatcttccgtcaatagcgggtatgtatggcaaccggattaagaaaaaagccatgctgctattaaaagaaaaggctattactcatataggaacggacattcacaattacaatatatttcaaaagttcatttgtacgagtattacaaaaaatatacaaaactgtttaattgatagtcagactgttatagtttaaatagattataattatcggttattaagacctgtagattctgtttaactttttctctctaggtggatttgcataaaatacatacaaaaaaatccaacaggctggaattcaatggaaattgtaacaatcgacttggagcagatacacacaatctctcttttatccaaaccagtcttaaaataaatcattacacccctatcaagcaataggcttgcaacttcaacataaaacaacaatccatatgtcattaacaaaagttttagttactggtggagcgggattcatcggctccaatttatgtgagtatttattggctcacgactatgatgtaatctgtttggataatttttccacaggtaaacctgaaaacatttttccatttctacaacgatatccgaataagtttaaacttatcgtaggagatatacggaatctgaacgattgtaagaaagctgtagaaaatgtagattacgttatgcatgaaggagcattaggctcagttccacgttctatcaaagatcctataactacaaatgaaactaatatatcgggattcttaaatatgctgacagccgctcgcgatgccaatgtaaagcgttttatatatgcagcaagttcttctacatatggagacagtcagtctcttcccaaagtagaagatgtgattggtaaaccgctttcgccttatgccataacaaagtatgtaaacgagctttacgccgatgtgtttgccaaaacctatggaatggaatgtatcggcttacgatatttcaatgttttcggtcgtcgtcaagatccattcggggcatatgctgcggtgattcctttgttcgttaagaaattcatggctcatgagagtcctgtcattaacggagatggtgaatatagccgcgattttacttatatagacaatgtgattcaaatgaacatgctggctatgaccacgacaaatccgaatgcaaccaaccaagtatacaatactgctttcggagaacgcaccacattaaaccagttggtcggttacttgaaagaatttttgagtgaatttgaccccgaaattgccaacgtgaaaataattcatggtcccaaccgcttgggggatattccccattccttggcatgtattgataaagcaaaatcccttttaggttacaatcctcaatacagtatgcgtgacggtttgaaagaggctgtcaaatggtattggaagaatatttaaagtaataataacagatgaaattatgaatgaaactaaaatttgcgtaattggtcttggttacgtagggctccctttggctcgtcttttctcgacaaagtataaaacgataggttttgacatgaaccaagctcgtgtgactgctttgatggcaggtcatgatgcgacactcgaagtgtcagatgaactactccaatctgcccttgccaatggttttaagtgtactgccaatatagaggaaatccgtgattacaatttttatgtagttgccgttcccactccggtagacaaaaacaacaatccggatttgactccgctttacggtgccagcacaactgttggtaaggtaatctccaaaggggatattgtggtgtatgaatctactgtttatccaggtgttacagaagacgaatgtatcccggttgtggaaaaagtgtccggattgaaatttaatgaagatttctttgctggctatagccctgaacgtataaatccgggagataaacttcatacagtagaaaaaatcaaaaaggttacttccggttctacgcctgaaataggtaagaaagtaaatgaggtatatgcttctgtaattaccgccggtacacatctcgctcctacgatgaaagtagcggaagcagccaaagtaatagaaaactcacagcgtgatatcaatatcgcatttgtgaatgagctatccaagatatttactaaaatgggcattgatacacaggatgtactggaagcagcttctaccaaatggaatttcctgccatttaagcctgggctggttggaggccattgcattggagttgatccgtattatttggctcaatgtgcacaacgtcacggttataatcctgagataatcttagccggtcgccgaatgaacgacggtatgggggaatatgtggccaaccaagttgcgaaattgatgctgaagaaaggaatacaggtgctcaactctcatatcctcatattagggtttacttttaaagaaaactgtcctgatgtgcggaacacaaaggttatagatatttacaatgctttgcgagagtataacgtacatatcaccgtatatgatccttgggccaatcctgatatagttatgcgagaatatggaatctcggtaacgaaccaacatcctttggataagaaattcgatgcggcaattatagctgtagcacacgaacagtttataggctttgatgtaaaaacgttactaaatgctcaacacgtcatattcgatgttaaagctatctttgaaaaaaacgttgtagatggtagactctaatcggattgtctcctttgacatattgaaagggggaggaattttattggtcatccttggtcatatacaaatcccttacatgttgaaaaccgttatttacagttttcacatgcccctttttttttttgtgtcaggctgtttctttcgtccaatcagtttgagagagttttttgcaaaaaagaccagacaattactgattccttgggccttttttgcctttttgttgttcgcatatttgttcgttttgaaacttaacgaaactcataattgggcaaaagcgatctcgctccctgtaacgagtatgtttgatggttttctcggtgatgaaaactcttttattttatttcatgtaatttggtttttaatttgtttgttcgaggtttcattcgtttatttattgatacataaaatcacccctacaataaagcattaacaatcagcgcattatgtatattattatatggagtaggatattggttaaatgctaataacattgatttgccatattttattgacacaacaatgtctaccttgatttattaccatcttggtttttgcttcatgcggaacaaatggtacggcatgaaggtttcaccgatatactcattattcttgcttattatcgccattgttttcatcgttctatttccctcttacgttgacttaaaatcaaacaattttccattgcatctattgttgctttcaatggtttttattatgaatttttattggtttatcaattcatattttaattcgagaaagctgaaacttattccattggataaaatattgatttggtgtggaattaacagtttggcattattggggctacatatattatttgtagatacattctggatcgtgcgcaataagttacatcttgtaaactacagttggaccatattggaatttgcactcattgttgcaatatgctattttgcgacaaccttaataaaaagatacattccgtctgtattaggaagatcataagcttgctatgaataagacatcgtccgtaaataataaaaaaatattcaagaatacagtggcactttatgcacgtatgttgctgtccatgattgtatcactatatacatcacggatcgtgttaaatgcacttggtgtagatgattatggcatttatggacttgtcggcggtattgttgtcctatttagctttttgaatgtaacgatgagtggagcgacttcacgctttcttacagtcgaacttgccaaaaatgaccctcgacaactccaacaaacattcaatacagcctttatattacatataggaattgcaattatagtcttgtttttggctgaaacggtcggactttggctgttattcgaaaaattgaacattccagatgagagaatgagtgcagctgtttgggtgtatcaattttcaataatttcctcaatggtcagcatcactcaagttccatacaatgcgactcttatttcgcacgaaaaaatggacgtgtatgctattgtggaaattgttggatcactgttgaagttgctgatcgctacacttctacttattacagtatgtgataagctcattttatatggaggacttatgctcttatcttcattcttgattgcaatgacatatcgcatttattgcattaggcattatgacgaatgccggattaattgggaatggaataaggttatcggccgttctctgtttagcttttcaggatggaatctttattccaatatttgctttactactcgtcaacagggaacaaatatgttgcttaatatatttggcagtacagctgttaatgccgcagccggattggcaacaactgtgcaactgatgattgaacaagtatcaaccaatttggtaatggcttcgaggccgcaaattataaagcaatacgcattgaccgatttcaatgccatgatacaattactaaagcaaactacttgtttggcaaatgtgttatatctgttggttgctattccttttatctctgaaatacattatgtaatgaatttatggctcgtggaagttcctccatatacaattgaattctgtattttattgatagtctcaagcttcatatcattgaataataatattatatatattggaatacaagctgtcggacgtttgaaattttattcatttatggcggggacagtatcattatcagtcattccgatactttggttattgtttagtaaaggtatcggcttgacttgggcttttggattgcctatagtgagcacattattgatttatatcgtttgctcatatacactccatcattatgttgaagatttcaaaccgatacgttttttcttcacaacgatggtagtgaatcttttcataagtattccttcttttaccgcaatcctactcatacaacatatcttggttgagtcctttacaagagtgattatcgtggctcttagttcttcaataatattggttgttctgtcctattatgtgctattagacaaagaaaataagaaaaaagtaaaagcattgattttaaacaaattaaaacgatgaataaaaacatacttataattactcctttttttccgccacagactcatgctgcggtatttagggcatttaaacttgtaaaatatcttaaacgtacaggttggaatccgatagtactgacggttaatcgtaattatctatatttagaagatcctgatttgttggacgaagtccaagacgtgcctatttatcaagccaattatatagaaccgacattgcgcggccttagaatgttgcttggaggagaagatacttcactcaaagccattacagccaaagcaaaaactattggtgcacagtcaaaaagcacggatacagtcacctctaacaagcaatctttattcggtaagttttataaatatatactagaccgatggattcaagttcccgaccgctttagattctgggaaagaagtgccgtgaggatgggacgaaaaataattaaagaacatgatatatctatcatatataccacttgcctgccttttacctcaaatagaatcggtatgcgacttaaacatctaaccggagtaaaatgggttgctgatttcagggatcctaccacatacgctaagcgaatgtattctgattattttcctgtttttgccaagcaaaagaaaattgaacaagatacttttaaatacgctgatgctattactggtctgtcgggagcatacctgaatatatttaatgatttatatgagggacgatactcaaataaatcatattttattccaactggagtagatgatgattatttgccttcttttcaaaatagagaaaaagagaattatataatattcgtgggtgaatacctccatgaatataaagataatttcttgaaaatatttgccgaagatgtcaattctaaggaattaaaaggcaagggttgcacccttaaaattgtgggtaataagaatatcaatcaaaaacaaacggaagaatttgtcaatgatttgggaatctgtaacaacgtggaatatatcaatcatgtaccgcagcgtaaattgtatgaattgatagttaatgcaaaagcagcagtacttattcccggacacacggctttatggtggactaatttcgcaaaaatggtcgattatatcgcattacaagtgcctgtattagcaatggtgcccatgactagcgaagcacgaaccgaattgataaaagcaggcataggtatttttatagatactcctcagcaaggtgttactgtcatcaaacaagtatttagcgaaaaatttccaatgacggcaaacaaagaatattgccgccgttacttggcatcgcaacaaacaaaatctttcattgatattttccaaaaaatacaatagagatgcatatagcgtttttaactacagaatatccgatattgggtatgaaatgtggcggaatcggaatttttatcaaacatttgtctcatcttatcgttaagagtgagactggtgtgaaggtatcagttgtgtattggggcaataagtttacagaaactgtgtgggacgatggtatatctgtgatacctataaaccagcctcataagtctccattttcttcttttatcaatagaaggtatctaaataaaaagttaaatctattagtggcaaagattggcatcgacctcgttgaatctatcgactgggagggacctttggctttttgtagtttatctgtaccagtagttacaagattacatggttcaaatgtgtatttcgatcatttgtctggaaacaaaactccatggaacgtacggcttatggaatataatgctttgcgtaattctgatgcctatataggagttagccgacaggctctcgacctgacggataaattattcagtctgtcttcgaataagagaaaatgtgtaatatataatcctgtggatataaacatgccccctctttcatctagtgacatgaacaaaaatacaataacgatactttattgggggacaattgttgagaaaaagggggtacttgatttgcctcttattttcaacaggatatgcgagcaaaacgacaatgtcaaactcattctcatcggacaggatgcagtagtgaatggttcttcgacatgggaaaaatgcaaatctctcttttcaaagcaatcgatcggttgtgtatcgtatttaggtcgcttaccttatgacaagactatgtcatacgctaacagtgccgatatttgcatatttccaagccatgcagaaactttcggtttggtcttactggaggcaatgttactgcggaaggcaattgtttgttccgatatcgattgttttcaagagattataggagacagtaactgtgtttgcaaatgcagggtgaaacgtatcgatgaatttgcagaggctttgcaacggctaatctcgaatcccatttataggtgtgaacaagccgacagggcttatctaaatgcaactgctagattcaacaccaacgagatagtggcacaaaacatcgaattttacaatcgagttataagagatagctccaaacatcatgtagaagaatcctaactcaactgctttattagaaaatttaaacggactttttatttataaaatcacatattcatacgaaggggagttaaggctttttttgtattgccatcttgaagaaagtcaaacatttcagtacaactacgtaaaatatagaaatgcttcattatagtgaaatttctgatagagtataattcctaaacgaagtgattaatttcttaactcttgattcatattattcataaacgccttatgcaaaaagggataagcattattttgcccacacttaatcgggctgattatctggcaagtacagttgattgcttaatagagcaagattttggggagccgtatgaaataattattgtagaccaatcggcagccattgacagtactatgtatagtcgtgcaaaagatagtgatacattgattaagtactatcatgtgactgaatttagagggctacctgaagctcgtaatttcggtgtgcaacacacacaatacgcctacatcctatttctagatgatgatatcgagtgtgactgcaacctgctcaaagagcattacaagttcttgtcacaacctgatatcgcagtagtggcagggggaattacagaaaaatataagaataatcccaaatcgaaaaatgtaggcaagttccatttctatacggcaactccagaacggggattccacattaatcataaagaatatgtagatcatggcggaggtggaaattatagcataaaaaaagacatatttttagaagttggtggtgttgatgaatatttgaattatggagctgctctatatgaagaaaccgaaatatgtttacgagtaaaggaacttggatacaaagttttttttaattatgatgctcatgtatggcacttggctgctgatacaggcggttgcagggttctggatatcaatcgctatattgcttcattagtacataaccgggctttattgattagccgtcatctcaaatggtatcataggccgactgcttacatctatttgttgcgtcttgttgcatcatacgcttttacttaccgcaatcccggactgtttagactttttgcaaaaacttataaagaaggttataaaaaaggaaaactaactcctaaatatactcattatgcaaacatctaacaaacacatttttattgtaacctatgattatccaccaagtaatggtggtattgcaaggctttgttttgaactgaaaaaatatttagagaaaaaaggactgaatgttacagtcatttgtccccaaagtacttctaccgatgcagaggaggataataatgtggtgagattgcatggaagaagaggaatattggagttgcgtacattgaagtatttacgcaaaaaaactgttcccggtgatattgtaattaccgggaattatcatccagagggaatgctgtctctattgtcaaacagagaaacctatatattggcacatggagccgaatatcttgccggaaagagttttttccgacgctgtatttggcctacttatcgacgttttatactaagaaacgcctcttgcgtgattgctaacagtcattatacagagacattagtaaaacattgttctccaaatgctaaaacaatcgctattccgttagcggttgatgcaattcattttcgccctacttgtgaaaaatataaggatggcttgctacacctctgttctatttctcgattggaaaaatttaaaggacatgattttattatccggacgatagcttctttaccggcaaagtataagcaacaagtgcgattgcatctcggaggtaaaggaaaatataagagtgcacttgagcggatggttaccgatttaggattgtcagatattgtatcatttgaaggtttcattgatgataataaactttgcgatttctattcagcctcgcatatattcattctctgtacacgtgaagaagcggataataggaatgtagaaggatacgggcttgtttttgccgaagcgcaagcttgtggaaccgccgttataggtactcgtacaggtggcattcccgatgctgtcgaggagaataatggcggttggttgatacatcaggacgcccacgaagaattggagaatttactcattaagttaatcgacgataaatctcttgctataaatgaaggtcgtaatgcacgtcggcgcatagaagctaaaattacgtgggaacattatgtggaccaaatttgtgatgtcattttatgagtattagtctatatatagccttatattacaacttgttgctgctattagttgtttacatcgctattcaaccggtcagggcagaaacagtaagacagccttatatcaacaaccagatatttagccttgctttactcttgattgtatatgttcatgtaactttccgaccgaccgattatcactactttggagatacttcagcttatgccatggctttccaaaagaaagccttctatggtacggttgctataagagatagagatattggttttgagtatcttacctattggctttcacaactcgtcaatttaaaagggtattggtttgttctttgctcattatatatattgcctgttttctttgctttaaagaaacgattcaaacaacaatatgctgtagcactagtgttgttcgtttgttctttgagtttttggggatacggagtaaatggactgcgtaacggaatagctacatcgttagttatcttctcttttcttgttccaaacaacgatattaaacgaattcctgtttggattatagcatgtcttttccatcaatccgtcatgttgccaattggctgtttcttgctgacccgactttcaaataatcccaaacactacttatacttatggggaacgtttttcctgcttatgcttgttgcacgtgattctttctccactttgttgacaaacattccttggtttgaacaggataaaaggatgtctgaatatttgaatatgtcttataaaggcatggagcaaatgttctctaatattggatttcgctgggacttcattatttatagtttgatacccattatcgcaggagtgaaatatatctatacatattgctacgaagacaaattgtttatccgtttatttaatacttatatagcaagtaatgcgttctggctattgaccattcatgtaccgtataataacagatttgcttatctatcttggtttctttatcctatagtattgatatatcccttgctaaaagataacttaataaataaccagggagaacgaataaaatggattattctatgt

SEQ ID NO: 48 - DNA, 56439 bp, Bacteroides thetaiotaomicron
actagatacttatgcgaaaagaatgaaattctttatcgctattaatctaaaattaatatggcattaaggactggaattctatatttgcttcagaaacggacgggatatcctccactatgtttctgatgacttgagcggatcgaactataaccttataaaatgatggaaatatgaaaaacgacacttcttaactactgcttggacttacttgtcagagaaagttttcttgagatgaaaacggtttgaatcaattaatgttaatctataaattatgaaaacaggaaagagcaaagatcatttgcaaagagtttttttaaggttcctttatttgataatggggagcatcctttctttggattctgttatggcgcaggaaaacctgaaaatttccgggcaggtgacagacaataaaggagaagccattatcggagcctcagtgaaagttctgaaaacgggtacggggactatttcggatatggatggtaagtttactattcaggttcctgtgggagctgaactggagataggatatgtcggctataatccgaagagagtgaaagtggtgaataaaaacttcgtaacggtagtccttgaggagaatgtggtagcattgggcgatgtagttgttgtcggatatggcattcagaaaaaggaaagtctgacaggagctatcggaaacctgaaagtagatgatatcgtaaagaccaaggcacctagtttggcacaggctattcaaggaaaggtagccggtctgcggatcagacaggagaatggagagccgggtaagttcagttccaatatcaatgtccgtggcttcggaactcctttgtttgtgattgacggagtggtgagagacggttccagcgaatttcaacggttgaatccggaagatattgaaagcatatcttttctgaaagatgctactgcctctatctatggtatgaattcggcgaatggtgccgtgattgttaccaccaagaaaggggctacaggcaaaccgcgtattacgttgaacgccaatgtcggcattacttctcctaccaatgtgccggagatggccaacgccagacaatatatgaccatgcgaaatgaggcggaaatcaatgcaggcagaccggcttatatcacaaaggacgaattgaccaaatggcagcaaggtgctcccggttatgagagtgtagacttgtatgatgccgttttcaataagcacgccacacagttccagacgactctgtccctggaaggtggtaccgacaaagtaagttattacggtagtttcggttatgccaccgataacagcttgttgaagaataacgcattgacttatgataaatatacattccgttccaatgtcagtctgaagattaccaaagacctgacagccagtatcaatcttggcggacgttatgataccaccaaccgtccctggtttcctttctatgatatatttaagagtacgcgtgtaaatccgccgactacttctatctatgccaatgacaatccggattattataataacttctcttatgttcctaatccggcagctatgatcgatgccgattataccggcagcgctaaagagcggaataagaacttgcagacacagtttgcattagagtataatattccttatgtaaaggggctgaaggtgaaaggtacttttatctacgattacaataactacggatataaggctacgcggaaaggttttaagacatatacctatggcgaatatacgggcgagtatacagcggcagatgccaactatccggctttgcttcaggataatcgcagagaatcggaacgggtggatatgcagtttcagacaaactataacagaacgttcggcaaccataccatcggagctacttatgtcttcgaaagacgcgaagagaaagcaaactggatgaatggtgagcgcaagtttgactttttcacaatcggtgaactggacaatgcacgcgaatctgaccagaaagtatccggttcctcggaacaccaggcttatctttctcatatcgggcgtctgacctatgattataaaggcaaatatctggcagagcttgcttgcagatacgacggttcttatcgatatgctccgggcagcagatgggcattctttccgtccgcttccgtaggatggagaatttcggaagagagctttatcaaagacaacttcaagtttgtcgataatctgaaacttcgtttctctgccggtcgttcggggcaagatgccggtgatccgttccaatacttctccggttacacgttgaacagtggcggatatgtattcagccagggaaattataccaatggagtagcttctcctgtgatgatcaataagaatctgacctggattaaagtgaatatgtataatattggtattgacttttcaatctttaaccggctgatcgcagtagagtttgatatttatcagcgtgaccgcagcggcctgttggccgaccgttacggttctcttcccaatacgttcggttccaagttgccacaggaaaacctgaacggcgaccgtacgaggggtattgaatttacattgactcataccaacaaaatcggtgatttccactacagtgtatccggtaactttaacttggcgcgtacccaacgccgttatatagagagcggtccttacaagagcagtatggaaagatggagaaaccagtcatccaaccgctggggagattttatctgggggtatcagacggacggacgtttccagaactttgacgagattaatacatatccgattcagaatggggataacggaaattccaaggaacttcccggtgactacatcctgaaagacgtaaacggtgacggagtggtgaatgatctggacaagacccctttattctggtccggcagcccgttgattcactatggtttcaatgtggaagcatcctggaagaacttcgacttctatgctctttttcaaggttctgccctgtacacggtgcagtttgacgaggtatacgcaaagatgctctgtttcaagggtggcaatacccccgaatacttctacgaccgttggcatctgtccgacccgtatgatgcgaacagtgaatggataccgggagaatggccggccatccgtctggagcaggacatgggatcgttctatacgagggattcgcagatatggcgtaagaacgcttcttatctgagactgaaaacaattgagatcggctacaccttcagtccccgactgatgcataaactgggtatcggtagtttaagaatctatgcgaacggaaataacctgtttactgtctgtgacccgtttgtaaaggcattcgatccggaaaagattgaaggagactatagtgccggcttgaattatcctctgaataagagctttaactttggattgaccttgaacttttaaagaagatgattatgaaaatatatagttatttattattgggagctatgttcctgctgggcggatgtagcgatttgcttgatatcgatccgaagaataaaattccggcggatgaattgttctctactccggaaggagtacaggcacatatggccaatctgtacggtcgtttgcctatcgaagattttacctattcaccgaatcgcggcttcaatgtgggagtcggtacggatgtgaataatgccggttttatggctgctcatttctgtgatgaggctatccatccggagtacaatgactttggagaagagtggttcgattattgggaagacggttataaactcattcgtgatttaaacagtctgttggttactattcctacattgaccagtattaccgaacagcaaaagaatgagatcaatgcggaaactcatttcctgagagcttatacctattttgccttagccaaaagatacggtggggtacctatcattaaagaaccgcaggagtataacggtaatatcgaagaactgcgtgtccccagaaatacggagaaagatacttgggactttgtcttggaagaatgtgaccaggcagtatcgctttttggagatgcgaatgaaaatgatgtgctgagagcgaacaaatgggtagcattggcactgaagtcaagagcagctctgtatgcagcttccgttgccaagtttactcatcagccttatgtctctttctctggtccggctgttgaccagaagctggtaggtatagaagttatatcggctgatcattattatgatgaatgtatatcagcttcacaggaaatcatgaatagtggtaagttcggtctttacaaaccttcccccgctactccggaagaagcgacaaccaactatcaaaagttatttgaacaacctttccaatgtctggacggattgaaagagcctatcttcatgaaggcctatgctgcaaataccattctggcacataactatgatgtctggttcagcccccgtcagatgatcctcgacccgaatctctatcccggtcgtatgaatccgacactggattttgtcgactctttcgaagattatacggatgacggaaccggaacacccaagccgatcagcactcgtgtggatggaaatgaaagtgattataatggatttaacttatccacccgatacctgtctttcccgatagataaaccttaccaggcatttgccggtcgtgatgcccgtttgagtgccatggtgttattcccgggacagaacttcggaagtacgaagatcattatccagggtggtctggtgaaagctgacggttccggttatcattataggactcaggcttcggagaagggacaggatggtctgatctattatacttacggagcggagaaaagcacggaatattcaggattcgatccgactttgggacattatacccgcagcggattcctgtttaagaagttcttgcagatagaaagtccggttgagcaggcatggagtaaaggtacacagccttggatcgatttccgttatggggaaattcttctcaactatgcagaagctgttatcgaaaagacaacctctacttctgctgaaaaacaggctgcacaagacgctttgaatgcggtccgcaaaagagcggctcacaaagatgacattgcattgactcaggcgaatgttcgcaaagaacgttttgtcgagctggcatttgaaaacaaacgcagatgggatttgtcgcgctggagaactttccataaggaatttgaaaaccgggtgagaaagggacttgtacctttccttgacctgcggacaaatcctgcgcattatgtatttgtacgtgtcaatccgttgggcattgaatcaaagacctttgattatagctggtattataagagtattccgggtacgggggctaatggtctggtacagaatccttaattagtatattctaaaatatagattagatatgaaaaagcttctatttttattatgcgttgtagtagcaggcagtatgttttactcttgtgaaaaagataatctcgaagggccggatgcaatctttgccggcgaactgagagaccggaagaccggagaactcattcaacaggagatatcggacggttcccgcgtttatttcatcgaacaggggtggggagataatcctcctgttcagaatatggtcgttaaaaaagacggaacgttttataacggtatgattttctccggtgactataaaatcatcctgaatcgtgggaactacgttcctttggatactctggatatgaaaataaagccgggaaagaattatcaggtcttcgaagtgaatccttatctgcggatcattgaaccggaaatatctgtgatcggaagaaaggtagtggcgaaattcaaactggagcaggtgaccagtaacgaggtctatcgtatttcgttgtttgcacactctcacatcgatgtatccaacaaactgaatattgtcaaccggacagaagaactaaaccgttccattactgatggtgaggctttcgaattgtctatcaatctggaagactacacttccacgctggttccgggcaagagttattatttccggatcggtgcacagtctcacggaagtgagacaaagtacaattattcggcatctgtacagttggatatttagcataaaaacggaaaagccatgagaaagtatttacagttggtattccttgcggtctctgtcttttgttcagagatattgttggcagaatctcgtgatccggtccggatactggatttgagaacgctcaatgaacttgatctgaaagaacaggagaaggcggagcaactatgggacattatgcatacgacagctaccttgcaaggcattgtgaatcggaatagtccgagattgtacattcgctatgtcaagaacgggcagggagagaatgtcgatgattattggtggaataaataccgtcaggcaggacagtggctggcgggacgtgatacgatagcttacacggaactgtcggatgtcgtgaccgttttcagaaaagaaatacgcggagtggttgtttatgactcaaaagtagcatctaccagtaatattgcttcatctgtggcaggaatcgagaatctgatagctgtgcgctatgacatatctcccaatagtctctatacccgtttggtactgcaaggaccgaagctggctgtgaaatgctggctggtgaacaaagatggttcttctcttttcacgggcaaaggaaggattgccggaaccggtcaaccttcgacaggatctctgaaaatcgatccctatgtatggtttatagagaaatacctgaagaaagggttatgcaatacggagtacgccgcttattacatcgaccagttctggcgtaccgatcctacccggacggtaacgaaccatcaccaattgaccaatcatgacttttttgtcagcaagaaagcttttttctttgacctttctccttggggagacgagccggcaacggatgatccgacacaagaagaaggactggacttgcagatactgaaaacttttctgcaagaagcctataagcaaaataaaggagagaaattctgctatatcggaggtttcccgagctggatttataaatatacgcagcatgctggaggaaagcatgaagatgtagctaccgagtgggaattttcccgtattatcagtgcttataatgcctttaaggatgccgatgccatcggactgggagcattggctaactcctccttctggcaacattttcctcttcaggaaaagtatccccaaaagtgggtgacacatcaggaactgatggacagaggctatctgaaccgtgacggaacaatcaactttcagggacggaactttatcctcttctatgtaggcgattatgattcctcctcctggattgctcagactacccctttcctgtgggacgaacctagccggggagaagtgcctttgatgtggtctgtcagtcctgtacttgcagaacgcgttccgatggtgatgcataattatcgggtgacggctactccgaatgattattttgccgctgctgacaatggtgccggatatttaatgccgggtatgttgcaagagcctcgctcggtgtccggattgaaaagcggattgagtgcatgggcaaagcattgcagcaaatattatcagaagtggggattgaccattacaggatttgtgattgacggcgaagcccccggactggattcagacggattggactgttacgcatcgttcagtccgaatggaatagttccgcagaagatgcctttgacattgctgcacaatgatatgccggtgatccgggcagattatgatattgtagatcatgattaccgcagggcaacggatgtgattgtggaaagagtggagaaacgtccggttcctttccattggttcagagccatattgaagtcaccttcctggtataaagggatttgtgatgagttgaaacagcggcatacgaatattgaattgctggatgcaccgacattttttgaactctatcgtatctatctgaagcagcatccggatgctgctgccggaaagataacgatgaactaacctgattaatgaacagacatattcatatagaatgatgatgaacagattgaatataaaaagaacagtcggctcctgtttgatggcgatggcgtttttttcgtgtacccatacggatcagacgcccacgaaagactttgtcgattatgtaaatccatatatcggcaatatcagccatctgctggtgcctacttacccaaccgtacatctgccgaactcgatgctcagggtctatccggaaaggggagactatacatcggacagggtaaacggccttccggtcgtggtgaccagtcatagaggcagctcggcttttaacctgagtccggtgcagggagaggtatcccgaccgattgtatcttactcctatgatttggagaatattaccccctatagttattccgtatacctggatgaggctgatatacaggttgagtatgccccttcacatcaggctggtatttatcatatcagttttgggacggaaggtgataatgctctggtggtgaatacgaagaacggaaagctggtcgctgaagaaaaaggagtcagtggctatcaggttattgacaacactcctaccaaaatctatctgtatctcgaaaccagtcaactacctttacgcaaaggggtactggcagatggaaaagttgatatggaaagtaaggaaggcagtgccatcgctttgtattatggaagcgagaagaacctgaatctacgttacggaatttcctttatcagtgccgagcaggcaaagaagaatctgcaacgtgacatcaccacctatgatgtaaaggcggtggcggatgccggacgcaggatatggaacaagacattgggcaagattgtgatagaaggcggttcggaagacgaaaaagaaatcttctacacttccctttatcgtacctacgaacgcatgatcaatctttcggaggacgggaaatattacagtgctttcgatggcaagattcatgaagatggcggagtacctttttatacagatgactggatatgggatacttaccgggctacacatccgttgcgtatcttgatagaaccgcagaaggaactcgatatgattcgttcatatatacggatggcagaacagtcggacagaagatggatgcctaccttccccgaggtgaccggagacagtcaccggatgaatggcaatcatgcagtggcagttatctgggatgcttattgcaaaggattgaaagactttgatctggaggctgcttatgaagcctgcaaaggagcgattacagaaaaaacgttgttgccctggctgagatgtccgttgacggagctcgataagttctatcaggaaaaaggatttttccctgcactgaaccctggcgaagaagaaacttgcaaggctgttcattcgttcgagagacgacaagcggttgcggttatgttgggtaactgttacgataattggtgtctggcacagatagccagaacattaaacaagaccgatgactataagaagtttatgaggatgtcttatacgtaccggaatgtttataatgcggaaacgggtttctttcatcccaagaacaaggacggaaagtttatcgaaccgtttgactatcgatattcgggaggacagggggcacgtggctattatggtgaaaacaacggttggatctatcgttgggatgtgcagcacaatccggcggatttgattgccttgatgggtggacaggcttcatttatcgagagattgaatcagacattcaatgaaccgttggggcggagcaagtttgatttctatcatcagttgccggaccataccggtaatgtcggccagttctctatggcaaatgaaccttgtctgcatattccttatttgtataactatgccggtcagccgtggatgacacaaaaaaggattcgcgttttgctgaaccagtggttccgtaatgacttgatgggcgttcccggtgatgaagacggaggtggaatgactgcatttgtggtattctccatgatgggcttttatccggtaactcccggttctccaacttataatatcggcagtccggtattccaatccgcaaagatggaggtaggtgacggatattattttgagatcatagcggagaattatgcgccggaccataagtacatccagtcggctaccttgaatggaacgccgtggaataagccgtggttcagccatgcggatattcaaaacggcggacgtctggttttgcagatgggagataagcccaataagaagtgggggatagcttcggatgccgtgccgccctcttcagagagtttgccggaataaagtcagaataataatattaaaatctaaaatataacacaatgaaaaagatgattgtactcaccagtctatggtcgtttttatttatcttttccttttcaatgttcggttgcagcgaggatgacgatgaatttggaacaacggccgaaagaggaaatgaagtccgtactccccgtgtggaggagatcaatggaaaagcagtggtcacctggattgatccttatattacggatatcaaggaggtgcaggtaaaggatttgcagactaatgagcaacagacggttgccaaaggagtgcagagcgcggaatttgcgattacggacaatagcctgttgtcttaccgatatgaaatgaaagttgtcagaacgaccggagagatgtctgccggagtgactgcccgtctggtgaagaactgggcgcaaaagctgcatcctttgatggattatcatagtgatgcgactcctcaaagtggtatgttctttaagaatcagccggtggcgaaagtgaatgtattcgatattcgtgatgacgaaaatatatcgaagctgaccactgctgtcatgcagggagtgattaaccaggaacaggcactgacttatctgatctggttacagcaggatttgacgcagctggatgatgccgaagtgcagtatgagatgcagcctttggcgaatacttcccgcaacagaggctttgcggcattatataatatgtataaagaccgcttcaactgcctggtagtctgggatgagaatcagccttggtcatggagtatggcacagatgatttcgtcacaggagaaaggcattccggttacggaatccatgagaaagtttatagaggatgagctgggaataggaaatctggaagttagggatatacgtaaccaatggtcatcaaaggcagaagcttatggctgggcgatagcgcactatgccgacaaatgccatccgaagctaactttctccggtggattgcggagtgattataaagataatccgtggagaatgtacgattacgtagctgcttctaaaggctttgtcttctggttggacgactctaatggagatgacaaacagatcatggataatatcttcaatagcggatcttatccggtgggttcttcggtatttggttatggaatgaatgccaatggcgacgaactgaataagattaccaacatccataatgcaggatttgtagtgagtgactattatgcgaatggcagttattggtgcagtttcccgagcaaagccttccagcagcgtaaagggatagccggagaagtgaagccgggtaagatatatgtcgctatcagtctgagtgacggagacaatattcagttcgatgcaaattctctttatcagatattcaaggaaggaaagcgcagaggcgaagttccggtaggagtgactttggcggcaggcttgcaggaattgaatccgaagctacttgaattttactataagaatatgactccgaacgatgaattgacggcagggccttccggtttccagtttatctatggtgattattatgcgcagagcggtaaatatgcggaatggttggaaatgaacaagaagtggttatccactgccggtttccacacggcgcatctctggaatacagacgagcagatgtatttcgaacaatacatgaagagcaaggctgtcgatgcgattatggacggatctaaccggacacataccacaggctcatcttacaaattggtagatggcgtggtgcgtattgatcaggggactatgtgccgcaataatggagacgtataccgtgatctgatgtctgtatctcccagcccgcggcgtcctttattccggcatgtctatctgttgaccaactattacggatttgaaggaaataaagtggtagtgtacgagagactgatcaaggaactcgaacgggttgaacaggattgtccggatacgtatgaatttatgctcccgatggatttggccgcttctatcaggaagtacatagaagaaggcggtatttattaaaggaattataaacgaatctaaaacaaatgagatatgaaaaatagatatagtatccggttactggttatagtctttctttcggctttcgctatgggtatctgctactcatgttcggatgatgacggagaaggagtgaaggtatatgagtatcgtgaacagataggcaagaagataaaagtgttgaccgacctgcaggctgaatcccagttcgggcttcgggaaggaatgtatcctgaaacaagccgggcgattctggaagatgcgatagccaagctgaaagatttccttcagacgataaaagaagcgggagtggcggaagctcggattcccgaagagacagccagactgctgaaagaatcggacgaaaagatagccgagtttaaggcgactgtccggacggaagacttactggttccggcagagctggaagtaagcggaaagaatggcggatatattgactttggcgctcatccggagtattccacattcggtgaagttggcaagcaggcatttactgttgagttttgggtaaagctgaaggatgtagaaggcttcttctatctgatctctacctttacggatgatgatacgaacaatcacgaacgcaaaggctggtgcgtgaatagctacaactatggtggcaacaacatgcgtatgacatacggaatgggctttaatgacctgatggaacctgccttcggatttgccaccgttaatgagtgggtacacttggctgtggtgacggatgaaaccggagtagacggcgagatgaatggaggcagacctgtcatgaccaaaatgtatatgaacggtgaactgaaactttcgaccacctctcatcaggatgcttccaaaccgtatgcttctaacgacagcaatgtcccgatggtggcatttggcggcatgagtgctacaggcaaccgtatcggtgataaaggtgctaacggaagtatgaaacatctgcatatctggcgtaccgccaagactcaggatgaaatccgccggttgatggagcatccggagaatgtgacgggcgaagaggacgatttggtttgcggatggactttcgcgaagatggcgcttgacgaccaggaaattaaagacttgaccggaaagtatacggcaaagctggtcggagactataggtggattgaattagaatgatacgaaacagaaaatacaggatagatatgaaaaataactatttatataattgggtagtgatagtgtttatgatgcttcagatgctggcatttacttcttgttctgatgatgatgacaatagcggctggccgacggaaacggacaagaccgaaatcttcatagagcgcttcagtacattggtgactaacctgactgcgctgcgggatggagctacatatggcgaactgaaagataactatccggtatccagtaaagccatgctggatgatgaaattgtttatctggaggaaacgatcgctaaactgaaagaaggaaacaaaaagttggctgacagtgaagccgaccgcattatccgtgaagctaaccagatagagaagaacttcagagcgaccagacgtaccgaagactttttaccggttgccgctgaactgttggtcaacggaaagaatggcggatacattgattttggtgttcatccggagtattcagcttttggcgagcaggggcaacaagcattcacagtcgagttctgggtgaagctgacagatgtggacgaatatctcaatagctttgtattcttgctttccaccttcacggatgatgatacgaaagatcacgagcgtaaaggatgggcggtaaacagtcacttcggcagattacgtatgacgtatggtataggctatagtgacttgtttgaaccgggcttctcattcagcacactaaatcagtgggttcatgtggcagttgtcactaacgagaacggagtggacggagaagtcagagacggaattccggtgatgaccaagatttacgtcaacggtcagttgatgttgtcggaaagaggccgggatgaccgtttgccatatactccgaatgataaggaagtggctatggttgcctttaccgggcttagcgcaactgccaaccgtatcggagaaaagagcaccaatggatgtatgcgtcatctgcatatctggaaatcggcgaagacacaggccgaaatacaacatctgatggatactccggaatccgtgactggaagcgaatcggatctggtatgcggatggacattgaataagactgtttcggataacaataacatcaaagatctgacgggcaaattctcagccaggctgatcggagattttcaatgggtagagaatagataattgttttacgaaccgggtagttcccaaggccgtcggatagctggctttgggactactttcttaaacaaacgaacatgaggaaagaacttgtttttgttttattggcattatttctgtgtgccggctgtaacggtaacaaaaagaaaatgaacggtgaacacgatttggatgcggcaaacattacgttggatgaccatacgatcagtttttattataattggtatggaaatccgtcagtggatggagaaatgaagcactggatgcacccgatagcccttgctccgggacattcgggagatgtcggtgccatatccggacttaatgatgacatcgcctgtaatttttatccggagctcggaacgtacagcagcaatgatcctgaaatcattcggaaacatatccggatgcatataaaagcgaatgtcggtgtactgtctgtcacttggtggggagaaagcgattatggcaaccaaagtgtgtctctcctgctggatgaggctgcaaaagtaggggcaaaggtgtgctttcatatagagccttttaatggacgcagcccgcaaacggtaagggagaatattcaatatatagtggatacttatggtgatcatccggctttttaccgtacgcacggcaaacctcttttctttatctatgattcttatctgatcaaacctgccgagtgggcgaagttgtttgctgccgggggagagataagtgtgcgtaataccaagtacgacggtctttttattggtctgacattgaaggaaagcgagttgcccgacattgagacagcgtgcatggatggcttttacacttactttgccgcaacaggtttcacaaatgcttctactccggccaactggaaatccatgcagcaatgggcaaaggcacataataaattgtttattccgagtgtcggtccgggatatattgatacccggattcgtccttggaacggaagtaccacccgagaccgtgagaatggaaaatattacgatgatatgtataaagctgccatagaaagcggtgcttcttatatttcgattacgtctttcaatgaatggcatgaaggaactcagatagagccggctgtctcaaagaagtgcgatgcttttgaatatttggattataaaccattggctgatgattactatttgataagaactgcctattgggtagatgaattccggaaagcaagatctgcttcggaagatgttcaataatatgctatatcttgtcggttttgcccatttgtaattaaaatgttctatatttgtgatacataactcaaatatagaacattatgggtgaactttatggcacatgtgcattgcttgctgcagtgttgttttttgttctgctgcaaaagtttgaaagccggttcggcaaggtagacaaagagcttggcgagataaagaaacgaatggacgacctgctcaaagctcaggagaaaatggcttccggccctgtaagggccaaagaggatgtaacggcagagactttggacaatacggatatactgccttatgtaacagaagaattgcccgattcgacagtgacagccttgaaggaagagaaagctgtcgaagaaaaagctgttgaaggcatacagcccattatggcggaaactacaccgcagaaattaaatgcttcccttgaaaaagaatctgctgaggccactttgcaggaaacttctccagaggctcctctcgaaataccgtctgtttccaaacggaagcaggttaattatgaaaagtttatcggtgaaaatcttttcggtaagattggtattcttgtattcgtcatcggagtcggcttctttgtaaaatatgccattgataaagactggattaacgaaacattgcgtaccgtacttggtttcctgaccggctccgcattgctggtggttgccgaacgcctgcaaaagaagtaccgcacattcagctccttgcttgcgggtggcgcctttgccgttttctatctcacggtcgccattgcctttcatttttatcaccttttccctcagacggtcgcctttattattctgatagctacaacgctgttcatgtctatcctgtccattctgtatgacaggcgcgaactggctatcatctcacttgtcgggggatttctggcacctttccttgttagcaccgggaatggtaactacttggtactgttcacttatatgagtatcttgaatcttggaatgttcggactgtccatctatatgaaatggggagaacttccggtgattgcatttgtttttacttatgtggtaatgggaatcttcctgttgacaggctttactacaggatcgacacatatttccgtccatctcttcatctttgcgacgctgttttatttcatcttcctcctgccgatattatcgatactccggatagaagccgtgaaaaagaacaggggattgctgctggtcatcataaccaacaatttcatttatctgttattaggaatcctgttcctgcgtaatatgggactgccgtttaaatcggaaggattactgagtttattgatcgctatcatcaatttagttttagtcatctggctacggatgagcaagaaagattataagttcctcatttatgcgatgttgggactggtactgacatttgtctccatcactatacctattcagctggatggaaattatatcacgctgttctgggcagcggaaatggtgctgctgttatggctttacgtaaaatcgaagattggagtatacgaacgtgcaacacaggtattgatgggactgacccttgtttcatatctgatggatatatataatgtactgatgacctcttcctcctccgaaaccattttcctgaacagttcttttgctacttccctgtttgtcggtctggccaccggagcattcgctttactgatggggcgttaccgttctctctttaccgaagcccgttatctgagatacactccctggaattcgatcatgcttcttgctgctgccgccatcctctattatacatttatggcagagtttgccttgcacttggcaggagctacaagaagcggaatgatgctggcgtttacttctgctgccatctttatccttagctatactttcaaaaagcgcttcccgataaaacaatacacaatcccttatctgacagctatgggaatgaacgtgctgatctatgtgatcaatatatggggagaccagtgggtatacacgagcctgactcctgctttgctccgatggtttgcggcagcgtttgttatagctaatctgtactacgttgcccgtcaatactatacattaataggattgaaaactcctttcaccgtttatctgaatgtcttggcgctcttcctttggctgacgatggcacgttctttcctcctgcaagcaggagtagaagatttcgatgccggcttctccgtttcactgagtatcgcaggatttattcaaatggcactgggtatgcgtctgcatcagaaagtactgcgaatcatcagtctttcaacttttggaatcgtcctgttgaagctgattctgaaagacttatgggcaatgccaacaatcggtaagatcattgtatttatcattttaggattgatcctgctgatcctctcattcctttatcagaaactaaaagacgtactctttaaaaatgatgaagatgaaactgattgagcagactatataataaagtaaaggctgcctgttcgaaagtggacggcagcctttactttattatattcgtctttattatctttattcctgtgaagccgcgaagcgtttcacctgctcttcaatcagttctttgtcatcgaaatagttgatcttcatagccttcttcacatccgccaatgtttcggcagcggcagctctggctacttcgcatcctttttgtagcatctcgtaaacggcaggaatatccttgctgaactctttacgacgattgcggatcggttccagtgtttcctgcatgatagcgttcaggaagcgttttaccttcacatcacccagtccaccgcgttgataatgcgctttcagttcatccagattcggataatccggcagatagcgttcgaagtgttccggacggcagaaagcatccaggtatgtaaatacggtattaccttcaatcttgcccggatcctgtacgcggaggtgtcccggatcggtatacatactcatgattttcttctgaatttcttccggttcttccgacaggtagatacagttgccgagtgatttactcatcttggctttgccgtccgttcccggcagacgcaggcaggcagcgttgtccggcaacaggatttccggttctaccagcgtttcgccatagatatagttgaaacggcggacgatttcacgagcctgttcgagcatcggttcctggtcttcaccgacggggacggtggttgcccggaaggcagtaatgtccgcagcctgactgataggataagtgaagaaccctacagggatgcttgcctcaaagttacgcatctgtatttctgatttcacagtcgggttacgttgtaagcgggatacgcttacgaggtccatatagtagaaactaagttcgcaaagttccggaatctgtgactggatgaagatggtagccttggacgggtctattccacatgccagatagtcaagagcaacctcaattacattttgacgtaccttctccggattatctatattgtccgtcaacgcttgtgaatcggcaataaagataaacatcttactataatcacctgcatcttgcaggtcaactctgcgcttcaatgaacctacatagtgtccgatatgaagtctcccggtagggcggtcaccggtgagtatgattttttcttttcccattgttgttaccttattataatagatttagcgacaaagataaggataaaaaatgaaagatgcgtcaaaatggagctacttcgttactaatgcttactattgctggcttttggtatcagatggcagggggacggcgcctgttttcacagcaacaaagcaaataaaagagaatattcttcttcaaattctttgtagttttagaaatatgtcgttactttgcacaaattttgaaatcgacaatgaatcaacaagaaataagaagtaagtattatctacattcggatgttttccacccggaatcaacaaccttcttcttttttctccaaaaacgatattttagttctttggtaatgcgttaatccttttacgagggtaacgcattttttttattggcaaaacttagaaataacaacttactataacaacaaaagaaatggaaaaggaaatcaagaaagttctcgttttgggttctggagcactcaaaatcggacaagccggagaatttgactactcaggctcacaagcactgaaagctttgaaagaagaaggtatcagctcagtattggtaaacccgaacatcgcaaccattcagacttctgaaggaattgccgataaagtgtatttccttcccgtaactacttatttcgtagaagagattatcaagaaagaacgtcccgacggcatcctgctggcatttggcggacagactgcattgaactgcggcgccgaactgtacacacaaggtattcttgataaatatggagtgaaagtactcggtacatcggtagaagctatcatgtacacggaagaccgtgacctgttcgtgaagaaactggatgaaatcaatatgaagactccggtaagtcaggcggtagaaagcatggaggatgccatcgctgctgcccgcaagatcggttatccggtgatggtacgttcggcttacgcgttgggaggtctgggtagcggtatctgcgctaacgaagaagaattcctgaaactggccgaaagctctttcgccttctccaagcagatcctggtagaagaatctctgaaaggctggaaagaaatcgagttcgaagtgatccgcgacgcgaacgaccactgcttcactgtagccagcatggaaaacttcgacccgctgggtatccacaccggtgaatctattgtagtagctccgacttgctcattggacgacaaagaactgaaactgttgcaggaactgtctacgaaatgtatccgtcacctcggcatcgtaggtgaatgtaacatccagtatgcgttcaactcagatacggacgactaccgtgtgatcgaagtaaatgctcgtctgagtcgttcttccgcgctggcatccaaggctaccggttatccgctggcattcgttgccgccaagatcgcattgggttactcactcgaccagatcggtgaaatgggcactccgaactctgcatatcttgctccgcaactggactactatatctgtaaaatccctcgttgggacttgacgaaattcgccggtgtatcccgcgaaatcggttcaagcatgaagtcggtaggtgaaatcatgtctatcggccgctctttcgaagaaatcatccagaaaggtcttcgtatgatcggacaaggcatgcacggttttgtcggtaatgacgatgtacacttcgacgaccttgacaaagaactttcacgtccgacagacttgcgtatcttctctatcgcacaagctatggaagaaggatattccatcgaccgcatccacgaactgactaagatcgatccttggttcctcggcaagctgaagaacattgttgactacaaggcaaaactgtctacatataataaggtggaagatattccggctgacgtgatgcgcgaagctaaaattcttggtttctctgacttccagattgcccgcttcgtactgaacccgaccggcaacatggaaaaggaaaatctggcagtacgcgctcaccgtaaagccctgggcatccttccggcagtaaaacgtatcaatacggttgcttccgaacatccggaactgactaactacctgtatatgacttatgcagtagaaggttatgatgtaaactattataagaatgagaaatcagtagtcgtactgggttcgggcgcttaccgtatcggtagctcggttgaatttgactggtgctcggtgaacgccgttcagactgcccgcaaactgggttacaagtctatcatgatcaactacaaccccgaaacggtttctactgactacgatatgtgcgaccgtctgtacttcgacgaactctctttcgaacgtgtacttgacgtgatcgaccttgaacaaccgcgcggtgtgatcgtatccgtaggcggacagattccgaacaatctggctatgaagttgtatcgccagtcagttcctgtactgggtacttctccggtttccatcgaccgtgccgaaaaccgtaacaagttctcggcaatgctcgaccagcttggcatcgaccagccggcttggatggaactgaccagccttgaagaagtgaagggatttgtagaaaaagtaggttatccggtattggttcgtccttcttacgtactctcgggtgcggctatgaacgtttgctacgatgacgaagagctggaaaacttcctgaagatggctgccgaagtatctaaagaatatccggtagttgtttctcagttcctcgaaaatacaaaggaaattgagttcgacgcggtagctcagaacggtgaagtggttgaatacgctatttccgagcacgtagaatttgccggtgtacactccggtgacgctacactggtattcccagcacagaagatttactttgcaactgcccgccgcatcaagaagatcagccgtcagattgctaaagaactgaatatctccggtccgttcaacatccagttccttgcccgcaacaacgaggtgaaggtaattgaatgtaacctgcgtgcttcccgtagcttcccgttcgtatctaaggtgctgaaacgcaactttatcgaaacagctacccgcatcatgctggatgctccgtacagccagccggacaagactgcgttcgacatcgattggatcggtgtgaaagcttctcagttctctttctcccgtcttcacaaggctgaccctgttttgggcgtggatatgtcttctaccggtgaagtaggttgtatcggcgacgatttctctgaagcattgctgaacgcaatgatcgctacaggattcaagattccggaaaaggcggtgatgttctcttccggtgctatgaagtctaaagtagatttgctggatgcgagccgtatgttgtttgccaagggatatcagatttatgctactgccggaacggctgcattcctaaatgctcacggtgtagaaacgactccggtttactggccggatgaaaaaccgggtgctgaaaacaacgtgatgaagatgatcgctgaccataagttcgacttgatcgtcaacattccgaagaaccacagcaaacgtgagttgacgaatggttaccgtatccgtcgtggtgctatcgaccataacattccgttgatcaccaatgcccgtctggcaagtgctttcatcgaagcattctgtgaactgaaactgagtgatattcagattaagagctggcaggaatataaataaactgctttagctgtatatatattgaggagactctctctttggcataccaaagagggagtctcttcttttgtagatatgactcttctttttgtttgttgtctgcggtgtaatgagtcgtaagatagtgctaatgttctcttcagctccttatatacttgctttttcctataaggaaagtaggaatagagtgccgttctctttagctcttcacggccgtgaacaggtctgctcatggctgtgatcaactcttgtcacgaccgtgaacaatacttgccacggccgtgaacaactaaagagatcggtgtcttaatggaacaataaaggcactataagagaaagataccggtagtatacggtatttgttgcgtaggatcaggactcggatgaagtaggcttgatggggagatagcagtaggtgagatgaacagtgagattgggagggaagtgacaataaaatgtatggatgtagctattgtcaccgtattatcaccgcttattatcaccgatgatatgtttataatcagttagttaacttcgaaaagtgataagtgacaataaaaaagcgttttattgcttagggaagaaacgtttgtgtagcttttggttatacaggtttgaattgattcgtaacggttcaaaaatgaatgaaacagtagtatctccattgggggcacccccattttaagatactattactatcattttgctcaaatccgtacgtaaatgaaatgaatgattgtgcttcttccagaagcggattacacagattgatacggtttttggtagattgtaccgctaaaaaaatgtgaaatctgtgtaatccgtatctaaatcttatggtttgcttacgcaataattgtatactttcagattctgtaccttactattaaagtttcctgctttctccagcgggaaaactagtgtacgtacatagttcattgaatcttttcccgcattaaagtaaagtttctgcgtattcatttcatcaaccactttaccgttgactctcagcgttgtactgcaattgtctccttctatctgaattgttgctttttctcccggattcactttgtaggggaaggtattcagatagccgtcgcgtgcaaatcccatcatcccccgaatagggtctgacagatagaatacggcgttaggcgaacggaacaattcggttccttcactttcttttgctccggtaatgtcgaaactgacagtgtaattatagccaatttccggataatcggaagtgctgccgggagcgactgtggaacgttcgtataccaattccggctttttgccgattcttgccagttggttgactccgggcgcttcgctgaggagggcacgtttttcattgaatgtttcataaggaatgcctgtttgagcgcctgtccacatctttacagagagtgtttgcaggggcgagaatatacggtgatggatgtctttcaccgagataccgttcccgacatggtcgttccagatggcaaacataccgccaagaatggaaggatgtttttcgtcgaatacagctttgccgatatgggcgggtgtccactccttatataagtatggttcgttgaggtaatcataatagtagccggctttcggaacgatatataccagtccgtccggaatactgatcagttgatatccgtctttgatcatagttgccggatcggcgtatccgttgtaccaagcattcatgacgacattttctgatttgacgggcgtatcgcctttggcatggctgagcgcgccccatacgactgcttgcttgccgaaaccttccacaaaacggatgtaatggtcggtgaaagcacggaatttttctaccacgtctttcttcgcgttcgagtattcgtctgtaccgatatgtacacgcttgcctacgaataccggattgtcgccttccagatattctttgaacagagcatctacgaattcgtaagtttccggcttgaacaagtcgagatgatccatgccgtactccttgcttccgatttccggtttgtaatgggtgagcgccagtgagtgggcgggaacgtcaatttccggaatgatttccacgaagttggatgccgcttgtttctggaaatcgatgaattctttcttggagtacgagccgtcacgggctgtcaatcccggataaatctccgattctagccggaaggcagcgtaagtcttgtcccagttgtgttcgaagtattgcttgaatccattatcgttcagatggacttgcagggtgttcattttgtagtaagccatgattttcaccaggtcctgcagataagccatcggaatgaacttacggccacagtctatcatgaaaccgcgaagcggataatcgggataatcacgaatcgttccttgcgggagtgagcgttcctgattttgttccgccagttgcaggagtgtgcgtgtgctccagtaaagaccggtcggggtgggagcggagatggctacacggtcggttatcttgatggcgtaaccttcctcaccgagcttcttgtctgccgacaaggataggacgaaatcgccggacgtggctttgccttgcgctacgcttaatgtctgcccgaacatctgttgataatcgtcggcaaacattcgggctattctcagtaattcgggattttgggaagtgcagacgattcgggtgtcttttcccggggtgaagttaccgtcttttcccgtccattgtttgagttcggggacaacaaacggtttcgggttgacagcggcacgggttaagctacccgtcagacaaaagatgaccaataaggccagagcttgcaaagatacaaacttgtttctcataagggggatttttgtgtttttgttaattaataaatgattatagttaattattggctgaaagtaggcataatttggatatctgtcaacaagtgaagctatttattttttatttttgtgtttttcaaaatgattaaacccgattcagaatgttagtacttctatcttgtgccaagacgatgagtgcggtgtcgaaggtgaaagttcctttgaccacgagtccccgttttcagaaggaagcggcggaaatagcgttgcagatgtcccagttttctgtagacgaattagaacgtctgctgcgtgtaaacgcaaagattgctgtggagaattataaacgttatcaggcttttcatgcggaagccactccggaattgcctgctttgctggcatataccggtattgtattcaaacggctgaatccgaaggacttctctgcagaagatttcgggtatgcgcaggaacatttgcggctgacttctttctgttacggtctgttgcgtcctttggacgtgattcgtgcttatcggctggagggggatgtcgtattgccggaattggggaatcagactttgttttcttattggcggtcgcgtctgacggatacgttcatagaggacatccgatcggcaggaggaatcttgtgtaatcttgccagtgacgagatgaaaagcctgtttgactggaagcgggtggagagcgaagtccgtgtggtcactcccgaatttcatgtctggaagaatggaaagctggctacgatagtggtgtataccaagatgtcccgtggcgagatgacacgtttcatattgaaaaataagatcggaaatccggaggaactgaaaggattctcgtgggaagggttcgagtttgacgaatcgctttcggatgaaaagaaattggtatttattaatgggatgggagaataaggaatatgacagaagtagagaagatgcgtagcagccagttggctgatatgtccgtgccggagttgcaggtgcgttttgagcatgccaagaagttgctggcgatcatgcgcgggttgagcacgtatgatgacgggtacagagaattgctggaagaactggtgccgagtattcctgaaacttcggtgatctgtcctcctttccattgcgatcacggagacgggataaagttgggcgaacacgtctttgtcaatgccaactgtacttttctggacggagggtatatcacaatcggtgcccatacgctagtcggcccttgcgtacagatttatacaccgcatcatccgatgaattatctggagcgtcgcggttcgaaagagtatgcttatccggttacgatcggcgaggattgctggattggcggcggtgctgtcatttgtcccggtgtgacgattggcaaccgttgtgtgataggagcgggaagcgtcgtgacgaaagatattcccgacgacagtgttgcagttgggaatccggcgcgccttatccgtaagcaggcttgaccgggaatcttatttcccggatttgagtgttcccgcattgttggctttatcttgttctgtttagtggacaggcttggagaagggaaagttgcatgaaaaaaaacttttttcattatttgttgataatcagttggtttttacttttgataaaaagtttcttgaaaaataatatgcaaaatgtttggaggtttcaaaaaaagccgtacctttgcatcgcttttgaaacggaagtgtacgggcgcttagctcagctggttcagagcatctggtttacacccagagggtcgggggttcgaatccctcagcgcccacaaagaataccgaagcacttccgtcaacaaaagggcgcttagctcagctggttcagagcatctggtttacacccagagggtcgggggttcgaatccctcagcgcccacgaaatagaagtcttacgaagaaattcgtgagactttttttatttcttaccgcttttatacaaactttctttatccttttgccttataactcaggaaaaagagttaattttgcagtctgataattatctaagaaaacgtatggaacttgatgtattaacggccatatctccgattgatggtcgatatagaggcaaaactaaagctttggcagcttatttctctgaatttgcactgattaaataccgtgtacaggtagaggtggaatactttatcaccttgtgcgaacttcctttgccgcagttgaaaggaatcgatagcagcgtgtttgaaactttacggaatatctaccgtaacttctcggaagcagatgcgcaacgcattaaagatatcgaaagtgtaaccaaccatgatgtaaaagccgtagaatatttcctgaaagaagaattcgataagctgggtggaatggatgactataaagaattcattcacttcggattgacttctcaagacattaataatacgtctgtgcctctttctatcaaggaagctttggataaagtctattatccgctgatcgaagaactgattgcacaactgaaaacgtatgcaacagaatgggctgaaatcccgatgcttgccaaaactcatgggcaaccggcttctccgactcgtctgggtaaggaagtgatggtattcgtttaccgcctggaacgtcagctggctatgctgaaagcatgtccgatcactgcaaaattcggtggcgctaccggaaattacaatgctcatcatgtagcatatcctcaatatgactggaaacaattcggtaatcggtttgttgcagagaaactgggactggaacgcgaagaatataccactcagatttcgaactacgataacttgtctgctgtttttgacgcgatgaaacgtatcaacaccataatggtggatatgaaccgtgacttctggcaatatatttctatggaatacttcaagcagaagatcaaagccggtgaggtaggatcaagcgcgatgccgcataaagtgaatccgatcgactttgaaaatgcggaaggtaatttgggtatcgcaacttctattctggaacacctggctgtgaaactgcctgtttcccgtttgcagcgtgacctgacagactctacggtgctccgtaatgtaggcgtacctttcggtcatatcgtgattgctattcagagttcactgaaaggacttcgcaaactgttgctgaacgaaccggctatttaccgtgatttggacaactgctggagcgtagtggctgaggcaatccagacgattttacgccgcgaggcttacccgcgtccgtatgaagcattgaaagctttgacccggaccaaccaggctattacagaaagttctattaaagagtttatcgaaggcttgaacgtaagcgaagatattaaaaaagagttaagagcaattactccgcatacatatacgggactttaattgtttacttatacaataaacgtgtttttttaataggccgtgaggccaaagtctaattttattcgaataaaaaaatgagcacagaaaacgaagaatggcgcgaaaattcttacaatgaggagaatacaggtgccggccgtgatggtaacaagtcttacaacagagaaggtggagaacgtccgtatcgtccttcttacaaccgtgaaggtggggatcgtccgtatcgcccgcgatttaatccgaatagtgaaggtggagagcgcccacagcgttcttatggtgaacgttcttatgatcgcccccaacgtccttcttacaatcgtgaaggtggagaccgtccgtatcgtcctcgcttcaatagcaacaatgaaggaggcgaacgtccgcaacgtccttacaaccgcgaaggtggtgaacaacgttcttatgatcgtcctcaacgcccttcttacaaccgtgaaggtggagaccgtccgtatcgtccgagatttaatccgaacggcgaaggtggcgatcgtccgcagcgtccttacaatcgtgaaggtggcgagcaacgctcttatggcgaccgtccgtaccgtccccgttttaacagtggcgaaggtggcgaccgtcctcagcgtccttataaccgcgaaggtggtgatcgtccatatcgtccccgcttcaacagtggtgaaggtggtggctaccgtaataacaacggtggtggctatcgtccgagatttaacaatgaccgttcgcagggtggctatcgtccgcgtccgcgtaccagtgattacgatccgaatgctaagtatagcatcaagaagcagattgagtacaaggaacagtttgttgatccgaacgaaccgattcgtctgaataagttcttggctaatgccggtgtttgctcacgtcgcgaagctgatgagtttatcacagcaggtgtggtttctgtaaacggtgaagtagtaactgaattgggtacaaagatcaaacgctcggatgtggtgaagttccacgatgaaccggtaagcatcgaacgtaaggtatacgtactgttgaataagccgaaagatacggttactacatcggatgatccgcaggaacgccgcacggtaatggatctggtaaaaggcgcttgcaacgaacgcatttatccggtagggcgtcttgaccgcaacacgactggtgtacttctgttgacaaatgacggtgacctggcttccaagctgacacacccgaaattcttgaaaaagaaaatatatcatgttcatctggacaagaacctgacaaaagcagatatggatcagattgcagccggcgtacagttggaagacggtgaaatccatgcagatgctatcagctacacagatgatttcaagaaagaccaggtaggtatcgagattcactccggcaagaaccgtatcgttcgccgtattttcgaatcactgggatataaagtagtaaaactcgaccgtgtattctttgccggactgaccaaaaaaggtctgcgccgcggagactggcgttacctgtcggaagcagaagtaaactacctccgcatggggtcgtttgagtaatatataatattgtattaaaaaagttttatggaaaagattggtagaacaaaaattgttgatctgttgaagcgcgaagatattggcgctatggtcaatgtgaaaggatgggttcgcacccgcagaggtagcaaacaagttaactttatcgcactgaatgacggttctacaataaataatgtgcagatcgtagtagatctggctaatttcgatgaagagatgctgaaactgattactaccggggcttgtattagcgtgaacggagtaatggtggaatctgtgggttccggtcagaaggtggaagtgcaggctaaagaaatcgaagtgctgggtacttgcgacaatacatatccattgcagaaaaaaggtcactccatggaattcttgcgcgagatcgctcacttgcgtccgcgtaccaatacctttggtgcagtgttccgcattcgtcacaacatggcgattgctattcacaagtttttccatgaaaagggatttttctatttccatacaccgattattacaggttccgactgtgaaggtgccggacagatgtttcaggtaactaccatgaatctgtatgacttgaagaaagacgaaagaggttctatctcttatgatgacgacttcttcggcaagcaggcaagtttgacagtatccggtcagttggaaggtgaattggctgccactgctttgggcgctatctacacattcggtcctactttccgtgccgaaaactccaatactccccgccatttggcagagttctggatgattgagccggaagttgcgttcaacgacattgccgataatatggacctggcagaagagtttatcaaatattgtgtgaaatgggcgttggataactgtgcggatgatgtgaagttcctgaacgatatgttcgataagggcttgattgaacgtctgcaaggtgtattgaaggatgatttcgttcgtttgccttatacggatggtatcaagattctggaagatgccgttgcgaaaggtcacaagttcgaattccctgtttactggggggtagacttggcttccgagcacgaacgttatctggtggaagaacacttcaaacgtccggtgattctgactgattatccgaaggaaatcaaagccttctatatgaagcagaacgaggatgggaagacagtacgtgcaatggacgttcttttcccgaagatcggtgagatcattggtggttctgaacgtgaagcggattataacaagttgatgactcgtattgaagaaatgcatatcccgatgaaggatatgtggtggtatctggatacccgtaagttcggtacttgtcctcactccggtttcggactcggttttgaacgtctgttgctgtttgtaacaggtatgtcaaatatccgtgacgtgataccgttcccgcgtacaccgagaaatgctgatttctaatatttcggtatatttatgtaaaactcgcataatcttttgattgtgcgagtttttttatgcatttgattgttactttctcaaaataaatctttatatttggacatgcgcattcaagagtgttaactaaaatcatattgtcatgaaaaaactctatttctttaccatgctttcaatcatgttgttagcggtaacaggtgcgacggcccaaaagaaaaccaaattcaaaccggccgatttgaaagggatctggcagttgtgccattatgtatcagaatctcccgatgttccgggatcgttgaaacccagtaatacatttaaggtattgagtgatgacggcagaatcgtgaattttaccattattcccggttctgatgcgattatcacaggatatggtacatataaacagttgaccgatgattcttataaggagagtatcgagaagaatatccaccttccgatgctcgataatcaggataatattctggagtttgaaataaaggataatgattatttgcatttgaaatacttcatcaagaatgatctgaacggaaacgaactgaatgcctggtattatgagacctggaaacgggtggagatgccggctaagtttccggaagatattgtgcgataaatgagattgcaatatagattctttgttgttttttgacctccccggtgtaaatccggaggaggcctttttattttctgttccttatttgtaaatatagtaagttccccttgtcatacaacccgataaatccaaaaaaaactggaaatagtttgccaattcaaagaaaagccgtacttttgcaagccgattattatcacaaaatgataagagattaattcatagcaagttagtcctcctttgtccggggaaggctgatatgtggtgaagaaaatttttagtagtaacatttaaaaaacaaaattagagtggatactttaagttacaagaccatttctgcaaacaaagcgaccgtaaccaaagaatgggttatcgttgacgctacagaccaaactttaggtcgtctgggagcaaaagttgcaaaattgctgagaggaaagtacaaaccaaactttactcctcacgtagactgcggtgataacgttattatcatcaatgcagacaaagtaaaactgactggtaacaaatggaatgacagagtatatttgtcatatacaggctaccctggtggtcagagagaaatgactcctgcccgtttgatcactaaaccgaacggtgaagagagattactgaaaaaagtagtgaaaggtatgcttcctaagaatatcctgggagctaaattgctgggtaacctgtatgtatacgctggtagcgaacacaaacatgaagctcagagcccgaaaatgattgatattaattcatataaataagatataatggaagtagtaaatgcattaggcagacgtaaacgtgcaattgcacgtgtattcgtaagcgaaggtacaggaaagattactattaacaagagagaccttgcagagtactttccatcaactatacttcagtatgttgtaaaacaaccattgaacaagctgggtgctgctgagaagtatgacatcaaagtaaacttgtgtggtggtggcttcactggccagtctcaggcattgcgtttggcaatcgctcgcgcattgattaagatgaacgctgaagataaggctgcacttcgtgctgaaggcttcatgactcgtgacccacgttctgtagagcgtaagaaaccgggacagccgaaagctcgtagaagattccagttcagcaagcgttaatgtgctgcctgaccgaggaatatgtttagtatctaaactactgggactctgctcatagactacccagcggttggtttagaaaaaacaaaaaagaaagtaaacgatttaaagaaaaaacaagatgtcaagaacaaattttgatactttattggaagccggttgccacttcggacaccttaagagaaagtggaaccctgcaatggctccttatattttcatggaacgcaatggtattcacatcattgacctccacaaaacagttgcaaaagtagacgaagctgctgaagctttgaaacagattgccaaatcaggcaagaaagttctttttgttgctactaaaaaacaagcaaagcaggttgtagctgagaaagctcagtctgttaatatgccttatgtaatcgagcgctggccgggtggtatgttgaccaacttcccgactatccgtaaggctgtgaagaagatggctactatcgataaattgactaacgatggtacatattctaacctttctaagagagaagttcttcagatctctcgtcaacgtgcaaaattggacaagactttgggttctatcgctgacttgactcgtctgccgtctgcattgttcgttatcgacgtaatgaaagaaaatatcgcagttcgtgaagctaaccgtctgggtatccctgtattcggtatcgttgatactaactctgatcctacaaacgttgacttcgtaattcctgctaacgatgacgctactaaatcagtagaagttatcctggatgcttgctgtgctgcaatgatcgaaggtttggaagaaagaaaagctgaaaagatcgatatggaagctgctggtgaagctcctgcaaacaaaggcaagaagaaatcagtaaaagcaagactcgacaagtctgatgaagaagctatcaatgcagcgaaagctgctgccttcatcaaggaagacgaagaggcttaaatatataaatgtgccaatttgctagcgtgcaggcgtgtggtagttacctcatcctgcattgtattggcagattggcacattttttgttttgaaaattattattcatttaaataaaggaaattattatggctgtaactatggctgatattaccaagctgcgcaaaatgaccggagctggtatgatggattgcaagaatgcattaacagaagctgaaggcgattacgacaaggcaatggaaattatccgtaagaaaggacaagctgttgctgctaagcgttcagaacgtgatgcttctgaaggttgcgttttggctaagactaccggtgactatgccgttgtcattgctctgaagtgtgaaactgactttgtggctcagaatgctgattttgtgaaactgactcaggatattcttgatcttgctgtggctaacaaatgcaagacattggacgaagtaaaagctttgccgatgggtaacggtactgtacaggatgcagtggttgaccgtagcggtatcacaggtgagaaaatggagcttgatggttacatgactgtagaaggaacaagcactgctgtttacaatcacatgaacagaaacggtctttgcaccattgttgcttttaacaagaacgttgacgaccagttggctaagcaagtagctatgcagattgctgccatgaatccgattgctattgatgaagatggcgtttctgaagaagtaaaggaaaaggaaattgctgttgctatcgagaaaacaaaagctgaacaggtacagaaagctgtagaagctgctttgaagaaagctaacatcaaccctgctcatgtagatagcgaagagcacatggaaagcaatatggctaagggctggattacagctgaagatatagctaaggcaaaggaaattattgctaccgtttctgctgaaaaggctgcacatctgccggaacaaatgattcagaacatcgctaagggtcgtctgggcaagttcttgaaagaagtttgtctgctgaatcaggaagatattatggacgctaagaagactgtaagagaagtattggcagctgctgatcctgaactgaaggttcttgactttaagcgcttcactctgaaagctgaataatttatctcaaaaagataatagagaagggcggaactttgatggtttccgcccttttttattatcctccgacccctttggtctttgtatatccttcttttatcagcaggtctatcactttctgcttgaaatctccctgtacgatgatttctccgtctttggccgaacctccgactccgcatttactttttagcatttttccgagttctttttggtcattctctgttccaacgaatccggtgatgagtgtaactactttgccgccacggttttttcggtcgagagaaacccgaaggttctgtttgctcttgtccagcgtcacttgttcctgatcgtcatccatgtcatagttgaaatcaggatttgtagagtagaccacgttcaatctatctttccaatcattatttttcatatacttcaacttttattgtgtcaaaagtaatattttgtggggaactttgcaatcttttgtttactttggcgtctaataataaaacgaaataagactaataaacagaaaatgatgaaacgatccatagcgtttgctctcatatgttcttttactatttctctttgggcacaaacatttaaaggcagagtagttgatcttgcaggaaatccgatcccctatgcggcactctatctgaaagaacttaaaacaggcttcaccaccgatgataacggctgttttcagacctcgctcccggcgggacaatatacctgtgaggtttcttctttaggtttcgctggacaaacattctccttttccatatctgccggagatgtggaaaagaatattgtgctctccgaacaaatatatagtctgcgggaagtgaatgtggtgaaagatgcggaagatccggcctattccgtaatgcgtaaggcgattgcgaatgctccttattaccggacacaggtgaagggatttagggccggaacctatctgaaaggcacaggaaaaatgaagactattcccgcaattctaaagctgtcgaaggaagtcagaaaagagtcgaaagagtttcctgatgggcaaaacctatcgtacttcagacaagaaagcatggattggctggaaaggcttgccttcctatgtgtctgagtataattttgtggatggcttctggctgggagctaagtttgaaacagggttgaagctatcggaggcatctactttgcgattcactccttctgcttattataccactgcccgtaaagcggtagcagggcaaagtgaactctccttgagttatgctccgaggcgacggggatatctggaactgtccggcggagttctttctgccgattataatggagaaagtggagaatcccgtctgataaataccgttgcctcttctttcttcgggcggaatgatgtgaaactctatgagaagcgtttcctgtctttccaaaataagatcgaactggcgaatagtttgttgctttctacctcgctttcctggcagcgacgacagatgctggagaatcatatacaccggagctggttcaagaaagaagcggagtcgaatattccggacagccgggcattctatccgatgccggaaaatgaattattgaaagcttcctttgccttggaatatacaccggctcattattaccggatgtacagaggaaagaaagtatatgaagaatccaaatgccctacctttacattgcgttatgaccgtgctttcccgttgaaaggggctttgccttctccgtcctatcacttggcggagttttcggccaggcagagcatagagttcggaatgtttaatacactagactgggctgttaatgccggaacattctggaataagagcggtatgcaattccccgatttcaagcattttgcgaccacaggtttgccggtgacggaacgctcgtttgatacaggattctctttgctggataattatgcatactctaccaatacccgttgggtacaagctaatatttcctggtacacaccctgtctgttgctgaaatttcttccttttctgaaaaagaagaacctcgatgaagcgctgcatctccgtacacttgtggaatacgaccgccgtccctattcggaaatcggttactccatcggattcatgaaactggcacggttaggcgtcttccttggcttcgacagtttgaaataccgctcggcgggagtttccgtcagcattccgttgtcaacgtttgcgggagaatagcacctgtgtagaaatagtatgaatcattcttgcaattccgaaaaaaaacgtatttttgtcaatcttataacctgaataaataaaagaaatggccgagaaccaaaagatacagcagatagattgtacgaaagtgccggagcctactttgcgcagactgccttggtacttgtcgaatgtcaagttgctgaagcaaagaggcgaacgttttgtctcttctacgcagatatctaaggaaataaatattgacgcttcacagatagcaaaagacttgtcgtatgtgaatatctccgggcgtacacgtgtagggtacgaggtcgatgcgctcattgaggttttagagcacttcctggggtttacggagatacataaggcttttctttttggagtcggcagtctgggaggcgcacttttgcaggactccggtctgaagcatttcgggcttgagattgtggctgcttttgatgtagacccgactttggtcggcactaacctcaacgggattcctatctaccattcggacgactttctgaagaagatggaagaatatgacgtgcagattggcgtgctgaccgttcctatcgagattgcccagtgcatcacagatatgatggtggacgggggaatcaaggcagtctggaactttaccccgttccgtatccgtgtacctgaggacatcgtggtacagaatacatccctttacgctcatctggcggtgatgttcaaccgccttaattttaatgaaatcaaataatgaagattattgccgtaggaatgaactatgccctgcacaatcaggagctgggacatacatccgtaaataaagaaccggttattttcatgaagcccgattcggctattctgaaagatggcaaaccgttctttatccccgatttttcgaatgaagtacattatgagacggagcttgtagtacgcatcaaccgtttgggaaagaatatttctccccgttttgccagtcgttattatgatgcattgacggtaggcattgactttaccgcccgtgacctgcaacggaaattccgcgaagcgggcaatccgtgggaactttgcaaaggtttcgactcttctgccgctatcggcacctttgttccggtagaccgctacaaagatatccagtctctgaatttcaatctgatgattgacggcaaggaagtgcagcgcggctgtacagccgatatgcttttcaaagttgatgacatcattgcctacgtcagtaagtttgtgactttgaagattggcgatttactatttacgggcacgcctgccggagtagggccggtcagtatcggtcagcacttgcagggatatcttgaaggagaaaagctgcttgacttctacatacgttgacccgtgtattctttatttgactcatttattaaatagcttatgaaaataagagtaggttttggcttcgacgtacatcagttggtcgaaggtcgtgaattgtggctgggcggtatccgtctggaacattccaaagggttgttgggacattcggatgctgacgtattgctgcatacggtttgcgatgccttgttgggagccgccaatatgcgcgatatcggttatcattttccggatactgccggagagtacaagaatatcgacagcaagattcttttgaaaaagacagtggaactgattgcgaccaaaggataccgtgtcgggaatatcgatgcgactatttgcgcggagcgtcccaaactgaaagcccatatccctttgatgcaggaaacgatggcagccgtcatgggaatcgatgcggaagatatctcgatcaaggcaactacgacggagaaactcggttttaccggacgggaagaaggcatttccgcttatgctactgtgttgatagagaaggactgacaaagcagattactaacccccttaaacaataaatagtatgaatcgaactttaaaattattcttagcactggtctctttgtgtatgaccgtcttctgcttcgcccaaaagagcgaattacgcttcaataaagacggtaaatttaaaatcgtacagttcaccgacgtccatttcaagtataagaatcccgcttccgacatcgcattggaacgtattaatcaggtactcgacgaagaacaacctgattttgtaatcttcaccggagatgtcgtttattctgctccggcagataaaggtatgttgcaggtgctggaacaggtatcgaagcgtaagctgccgtttgttgtcactttcggcaatcatgataatgaacagggaatgacgcgggaacagctatatgacatcatccgtcaggtacccggcaatctgatgccggatcgtggctcggtcctttctccggattatgtcttgaccgtgaaagcctcttccgatgcgaagaaggatgcagccgtcctgtattgcatggactctcattcttactccccgctgaaggatgtgaaaggttacgcatggctcacgttcgatcaggtcaactggtatcgtcagcagagcgcagcctatacagcacagaacggcgggaagccattgccggcacttgctttcttccacattcctgtgccggaatacaatgaagcagcttccgacgaaaatgccatcctgcgcggaacccgcatggaagaagcctgtgctccgaaactgaatacaggcatgtttgctgccatgaaagagtccggagatgtgatgggaatattcgtgggacatgatcatgacaatgattatgcagtgatgtggaaaggaatcctgttggcttacggtcgtttcacaggcggaaatacagaatacaatcacctgccgaacggtgcccgtatcatcgtgcttgatgaaggcgcccgcacgttcacttcctggattcgtcagaaagacggtattgtcgacaaagtgacctatccggcaagtttcgtcaaagacgactggaccaagcgttaactattgccagcttcacattgctgaggcgggtatatttggaaccgtagctttcgaacaggcgtgacacccgcgccgatgctacatatataatttctcccgggcgatattcatgctctattccggatagagtgcatgataccgtactgggagtttttgatgggatgctcatcgtcaccaggttgccgctggcgtcgttcagagtcagtatctgcttgacgaaaaattgcggagtcgttccgtatactcttgttttatacggatcgtcttccaggcgtacccgcatgactttcaactttaagtccgtcagcttctcgttcacttctcctagatagcggctttttcggcgtacctctttgctcttccgcagcatcacgtccagatgtaccgaatgatatgcctgcgctattttgacgaaacgctcctgtttgggaatcttcggagtaaacttataggcgatccagcttagataggcaggatcgactttgaggatttcgtgcaggaagtgtcccctgtatttgccgaaaaagatgaggtcgtcaccgttgctctgcattctcttctcgttgtaatccatcaggatgaggcaccgtcgcgaataataaaacatggtgcttgctatccgcagggactcgttgatatccggagataaatcgtgtatatagagaatcgattgcttttcgggcaggggagagtagagccaaagggaatagttgggctttcccggtcggggcaacaccaccagataaacccctgcctctttaaaggaggctctgcctcggttgtattcattcagtttggcatacaataaggcttgctcgctttcggaaattcccggtaattttggattagccataattgttctcgcttttggtataattcaaatatactgattttctttcagaaaagcaagccttggcgggagtttcttcgaataaagcctgttggtgaagttaactcgtttccgattcagatttgaatcaaccgctgattcgcattaatagctaataaagcgaaaataaaaattaagtccgaagattattcttctcataacatcataaggtgttcagatcaatgacacaaaaagagaaaggtagtattgtagcaataattcatcgatttacctagaaaataaagaatctttcaaaatcagcacccacatctatacgaaagactttgactaattatgcggtaacagccaatcatttattaataaattctttcatcgtttattataaacgtcctccaagtttattataaactctaatttcgttattcctgcaataaacatccattttaagcaacaaaaagggctgcaattcccataaggaatcgcagcccttagcttgtatcagactatccaacaagcattacccggagtgggaatgcctgcaatctgttattatataatacttattattgctcatttttcgtctatattatcaatgttattgaatttgcttccggtttacacttacaaagatacaacattaaaagcggtttgtcaagtcctccatgcttctttcatacatctgattacaaatcatacggatttgcgccgaatgatagtcagtagtatcttgaatcatttttaaaccgttttgaataattaaagagacagtaggaaatgattgtctgatgatggcaatggggctgttgcctgttcattcattaggggacacaaacttttcatttccttttttatggctgtctgactataatcttgtacttttgtattcttctaatgattggaaattcggatgaaagaacgaaataaaagagtattggttggcatgagtggcggtatagacagtaccgctacctgtctgatgctacaagagcagggatatgaaatagtaggagtcacgatgcgtgtttggggagacgagcctcaggatgcccgcgaactggctgcacgaatgggaattgaacattatgtggctgacgagcgtataccttttaaggagaccatcgtgaagaactttatcgatgagtacaagcaaggacgtaccccgaatccgtgcgtgatgtgcaaccccttatttaaattccgtgtactggcggaatgggccgacaagctggactgcgcctacattgcgaccggacattactcccggctggaagagcggagcgggcacatctatattgtagcgggagatgatgataaaaaagatcagtcctacttcctatggcggctggggcaggatatactgaagcggtgtatcttcccgttgggcgactatacgaaaataaaggtgcgtgagtacttggcggagaaaggatatgaagctaagtctaaggaaggcgaaagtatggaagtctgtttcattcagggagattaccgtgattttctgcgcgagcaatgtccggaactggatacggagatcggtccgggatggtttgtcaactccgaaggagtgaagttgggacagcataagggagcaccttattataccatcggtcagcggaaaggactggaaattgccttgggcaagcccgcttatgtgctgaaaatcaacccgcagaagaatacagtgatgctgggagatgccgaacaactgcagacggaatatatgctggcggaacaagaccggatagtagatgagcaagaactgttctcatgcgagaatcttgcggtgagaatccgttatcgcagccgcccgataccttgtcgggtgaaacgtctcgaagacggacgcttgttggtgcgctttcgtgagacggcttcggctgttgcccccggtcagtctgccgtgttctacgatggacggcgggtacttggcggtgcgtttatcgcttcgcagcgggggatcggactggtgatcatagagaataaagacaaattgtagaataaaataaatagagagatttagatgaaaagattagtattagcggcattgatcctgactacagcggtgggagcatctgctcaatttacctctaccgataccttgaaatatcggatcagcctcacagataaggctgcaaccacttattccatccagcaaccggaggagttcctttccagaaaatccatcgaccgcaggttgagacagaagctggctatcgactctaccgacttgccggtatgcaagaagtatgtagatgccatacgaaagaaaggcgtccatgtgcttgtcaccggaaaatgggataatttcgttacagtctcctgcaatgacagtatgctgatcgatgaaatagccaaactgccttttgtccgttccaccgagaaagtgtggcagggaaaagtgtcggcagttaccaaaagagattcgctgatcaatgatccgcagcgttcggacagcctgtatgggcccgctatcactcagattgaaatgagccgagccaaccttctccacgatgccggattcaagggacagggcatgacgattgccgttatcgacgccggatttcataatgcggacagaatcgaagcgatgaagaatatccgcatactcgggacacgcgactttgtgaaccccgaagcggacatctatgccgaaagcaaccacggtatgtcagtactgtcttgtatggcaatgaatcagccgaatgtcatggtcggcaccgcaccggaagcctcctactggttgcttcgcagtgaggatgaggcttccgagcatttggtagagcaggattactgggcggcagccatcgaatttgccgatagtgtgggcgtggatgttgtgaatacctcactgggttattatacctttgacgacccgaccaagaactatcgttaccgtgacctgaacggacactatgcactgatgtcaagggaggcttcgaaggcggcagataagggtatggtcctcgtttgcagtgccggtaactctggcagcggctcatggaagaaaatcactcctccgggcgatgccgagaatgtactgactgtgggtgctattgataagaagaagttactggccccgttctcttctgtcggcaatactgccgacggacgtgtgaaaccggatgtcgtagcagtcggcctcaaggcggatatagtgggcacagacggtaatcttcgtctggccaacggaacctctttctcttctcctatcatgtgcggaatggtagcttgcctgtggcaggcctgcccgaggttgaccgccaaagaagtgatcgaactggtgcgcagcgtaggcgacagatccgattttccggacaacatctacggttatggcattccggatctctggaaagcataccaaatgagcaaagaataacgaacggtccgctattcttcgttgttaggctatatcaaattcgcatctcattatagaaatgtgtcattcatttatcgttaattatgcctatggattctctttccctactagagctaaacgcgcttgtccggcgaagtctggagcaatgcctgcccgatgaatattggatacaggcagaactgagcgatgtccgttccaacactaccggacactgctatctggagtttgtgcagaaagacccgcgcagcaacaatctcgtagccaaggcacggggtatgatctggagtaatatctaccgcttgctgaaaccttactttgaggaaactactggacagttatttgcttccggcatcaaagtcctggtgaaagtaacagtccagtttcacgaactctacggttacagtctgactgttctcgatatcgaccctgcctatacgctgggcgatatggcccgccgccgtcgtgagatactcatgcaactcgaagaagaaggagtactgactttgaataaagaattggaaatgccggttcttcctcaacgtatagcggtcatttcctctgccaccgcagccggatacggagatttctgtcatcagttgcagcacaattctggcggattctttttctataccgaactgtttccggcgttgatgcagggcaatcaggtggaagagtccgtattggctgcattggatcgcatcaatgaccgggtgaacgagtttgatgtagtggttatcatacgaggcggaggggcgacttcggatttatccggttttgatacgtacctcttggcggccgcttgtgcccagttcccgttgcccgtcatcaccggtatcggtcacgagcgggacgatacggtgctcgactctgtggcacatacccgggtgaagactccgacggctgctgccgaacttctgattcaccggatcaccgaatcggcagatcatctggaagagttatccgcccgtctgcaacaaggggcgtatgccctgctcgaacaggaaggacggaggctggaaatgattcagacccgcatcccgaaccttgttcaccgaaaacttacagatgcccgctttgccttgctggcagccggaaaagacttggcgcaagccactcagaccctgttgtcccgtcatcgtcaccgactggaacttttgcggcaacgtgtggcggatgcttctcccgacaaactgctgagtcgtggatatagcatcacgctgaaagacggaaaagcggtcacggatgccgcttcgctgaaccccggagaccagttagtgacccgtctggctaagggaagtttcacttccgaagtccggctcgatgagcattattattcatcttaaatacaataaatatggcagctaaaaaagaaacatactctcaggcaatggagcgtcttgagaagatagtccgtcagatagacaacaacgaactggatatcgacactttgagcgaaaaaataaaagaagccaatgaaattattgccttttgcaccgagaaactgacaaaagcggatcgggaagtcgaaaaattgttgcaagaaaggcggcagtctgaataataaaagttatttttgcgaatcaaagcgtaaaataaactaatacataacgatatgaaagaaatagactgggcgaatctgtcgttcggatacatgaagacagattacaatgtgagaatcaatttccgtaacggcgcatggggcgaactggaagtcagcagtgatgaacatctcaatctgcacatggcagctacttgtctgcactatggtcaggaagcttttgaaggtttgaaggctttccgcggcaaagacggtaaagtacgtatcttccgtctggaagaaaatgcggcacgtctgcaatctacttgtcagggcattctgatggccgaactgccgaccgaacgtttcaaggaagcgattctgaaagttgtaaagctgaacgaacgtttcattccgccttatgaaaccggtgcttctctatacattcgtccgttactgatcggaacaagtgcccaggtaggcgtacatcctgccgaagaatatatgttcgtggtatttgtaactccggtagggccttacttcaaaggtggtttctctaccaatccgtatgtgattatccgcgagttcgaccgtgccgctcctcatggaactggtatctacaaggtaggcggtaactatgcggccagtctgcgtgccaacaagaaagcgcacgatctgggctattcctgcgagttctatctggatgcaaaagaaaagaaatatatcgacgagtgcggcgcagccaacttcttcggaattaaagataatacgtacattactccgaagtcatcttctatcctgccttcgatcaccaacaagagtctgatgcagctggcagaagacatgggcatcaaggtagaacgacgcccgataccggaagaagaactggaaacgttcgaagaagcgggtgcttgcggtacagctgcggtaatcagtccgattcagcgtatcgatgacctggagaacggaaaatcatacgttatctctaaagacggcaagccgggaccgatctgcacgaaactgtataataagttgcgtggcattcagtacggtgacgaaccggatacacatggttgggtgacgattgtagaataattgatctttaagtataatctcttttaattgcgtaattactatgttaaaacaaaattcagagttgcgtgctcaggcacgtgaagcccttcggggtaagtggcctatggcagccgttgctgctcttatttattcggctatcgccggtggtttgtcttccattccttttattggatggatcggttctttgttggtcggactgcctgttgcatacggttttgctattttgatgctggctgtattcagaggagcggaagaagttgatttgggagtgctgtttgctggatttcaggaatatagtcgtatcttgactactaaactgctgcaggctgtttatactttcctgtggtcattactgttgctgattccgggtatcattaagcattattcttatgcgatgacggactatattctgaaagacgaacctgaattgtgtaacaatgctgccattgaaagaagtatggcaatgatggaaggcaacaagatgaaattgttcctgcttgatttgagcttcatcggttgggctatcctttgcctctttactttcggtatcggattcttcgttttgcaaccctacgtgcaagtatctcacgctgctttctatgaagatttgaaagctcagcaaggcggtattaatatcaatgtagaagtaactgtagaaagctaataagcgaataaatatcattctatagaatggagtacggagcaatctgtactccatttatttttgtagtttacgccaaaagtaagtacctttgcgttctaatcagtaatgagatgggaaagaataaattagagaagtttgccgatatggcgagttacccgcacgtgttcgaatatccttattcggcggtggataatgtgccttttgacatgaagggaaaatggcatcaggagtttttcggaaatgatcatccgattgtgctcgaactgggctgcggacggggtgaatataccgtcggactgggccggatgtttcccgataagaactttatagcagttgatatcaaaggctccagaatgtggacaggcgccacggagtccttgcaggcaggaatgaagaatgtcgctttcctgcgtacaaatatcgaaatcatcgaacgtttttttgcagcaggtgaagtcagcgaaatctggctgaccttctccgatccgcagatgaaaaaggctaccaagcggctgacctccacttacttcatggagcgctaccgtaaattcctgaaaccggatggaatcatccatctgaaaaccgacagtaactttatgttcacttatacaaagtacatgatagaagccaatcagcttcctgtcgagtttatcaccgaagatttgtatcattcggatttggtagacgatattctgagtattaagacttattatgaacaacagtggctcgatcgtggtttaaatatcaaatatatcaagttccgtcttccgcaagagggagttttgcaggaaccggatgtggaaattgaacttgatccgtaccgtagctacaaccgtagcaagcggagcggactgcaaacgagcaaatgataagtaataagtgacaagtaataagtaacaagtaataatagtaattgggtggaactatcaattttccactctcaattctgaactaattatgactctttatccgaaattaatattggatgcgctggcaacggtgcgttatcccggtacgggaaagaatttgctggaagcggagatggtcgccgataatctccgcattgatggcatggcggttagcttttcattgatatttgaaaaaccgaccgatccgttcatgaaatcaatgctgaaggctgctgaaacagctatccatacatatgtatcaccggatgtgcaggtaactattacaacggaaagcaagcaggcagcccgtccggaagtgggcaaactgcttccgcaagtaaagaatataatcggtatctcttccggtaagggaggggtaggcaaatctaccgtatccgcaaatctggcggtggctttggctaagttgggctacaaggtcggtttgcttgatgctgacattttcggtccttccatgccgaagatgttccaggtggaagatgcccgtccgtatgcggaaaaaatcaatggacgtgacttgattattccggtagagaaatacggtgtaaaactgctttctatcggtttcttcgttgatccggatcaggctacactttggcgtggcggtatggcgagcaacgcattgaagcagctgattggcgatgccgattggggggatcttgattatttcctgattgaccttcctcccggcacaagtgacattcatctgactgttgtccagacgttggcaatgacgggggcaattgttgttagtactccgcaggcggtagcgctggcggatgcccgcaagggaatcaatatgtttacgaatgataaagtgaatgtgcctattttaggactagttgagaatatggcttggtttacgcctgccgaactgccggagaataagtactatatctttggtaaggaaggagccaagaaactggcggaagaaatgaatgtgcctctgctaggtcagattcctattgtacaaagtatctgcgaaggtggggacaatggtactccggtggcgctggatgaagatacggtaaccggtcgcgctttcttgtcattggctgccagcgtagttcgtcaggtagatcgccggaatgtggagatggctccgactaagattgtagagatgcattaataagtgctcttattctatttattctaaacacaaaagaggctggtttaaaccagcctcttttgtgttgtttatcgtagtctaaacatgatagggatagtatatttcacggaaacaggtactccattattttctcccggttcccatttgggcatattgctgatgatgcggagagcttctgcatccagcgttggagagacactgcgtaccactcgtgcatctgttatctgaccatcttttctcacaatgaaagtcacaatgactcttccttcttctttttgtttggctgcgtttttccaatacgtaatgtgctgtttcagatactgatccagttctccttgttctttgggaaacctcggcatcttttgtgcagtcataaagaccttgtcggtagtactgtcaggttgttgttctcctgttgctttggtggtagctgcaggggttgggtgaaaattaattggaagggtaaactttacgttgaccacttttccatctttttttcccggtgtccaggttggcatagctgtgatggcttgaatagcttgtttatccagttccggatgtaaactgcggactacggctacactggtgatttctccttttttgctgatgacaaattgagtaatcacacgtcctgctataccaagtttctgcacttcttccgggtattgaatgttttctcccagatatttgaataaggcttgggtgcctccgggaaacttaggcatttcgtctactgcttcatagattgtttcatctttatctttgttgttatcgttaatgattaacgaatcaacatttgaagtgaacgcttccgttggttgcactttagcttccgcataatggcagaaaccgagactgaacgcgattagtgctaagaggaaaggacgtttcgttccgttcgctcttgatagttgttggtgtttcattttgttgtatgctttttagttaattgttactctttgattagatgatcttacttttccaatgctttcatcaattgttctttcatggtgtccactccggggaatccggtttgtttataagtgatgtttccttctttgtcaataacaaagtaagtaggaacgccccggatactgaacttctcacgcagatagctccactgttcatccgtcacacggaaatgttctccgtgaatgtcaggaatcatgtttttccaggttcccagtggagacgtttcacctgtgatgtaaaggtagataatgtctttgtctttcagttcttctttcatcgggagaatctgtttgttggcagaccggcatggaccacaccatgttgcccaaaaatcaactaacagcgtatgtccccggaatttggagataatggaggggaataaatcttcattcgaaacttctcctgtctcattaacggtgaatcctgttttcttcttgttgatttctatttgtttcagcaggtcgttgttcatagccagagccatgtcgttgtatgctgcgggcatcgttgacagttctgccttttgcttatcgttaagtggattgagatctctcatggagactccaatcatctgtgccttcagattttgtattaagtaactggcagctgtatgattgctcagactcttaagaatcttatcatctatacctatacggcgtatgatgtcaaacagtatcgggtatctgctgttgtaacaggctttaggtgaaaggatatacgtgaagtcctgaagactttcataatatccttgcggaatatcaatcttagtctcggcatagtatttatttgctttttctccttccagcccattcgtcatgatatgaactaatttcaagttcctttcagtttcgataatctttagtgcggcagacaattcgaggtctgtattaataatctccttatatgcagggcttcctttcgactgtgtgatttgttttctgaactcagggagtcgggcaagtatttgagctttatattcttcagctgttttaccattcagctttttaatctgttgttggtattcttcataactattaccttcagtgaaactgaaactcataggatgatcagccagctcttgctgtactccggctaaataacctccgtaatagatttcttttccgtatggcttttctgcttggcggagatgtgactgcttgcgggcattttcgcgaagattgataacgaccgaagtggtttctcccggtgctaataagtagctgacagctccaaaaggaaacctgatcatgcatggggtgaccatgaagacattcatctcatgataaaacgttccgtcatcctggatgcggatttttccttcctgagcttcgtctcttattacatcttgaaaataaagactgcctttgttgggcatccctttttggtagtcaaggattcttcctttgagaattgctttggcgtatttaacgactggttcgggcagcgtcgttttatggtctgctttggtgactgtaacgtctttaggcagtttgaacttgctgaatgttttcttgtccagctgtatgccccatatcttatatgctccctcaaagtctccttcagagaaatccaggcaagtcacgttttgaggaatgggtgggaaagttaattggaattcggcttcgccggattcgggcatccagaactctttgtccagtgtaatgccgattcccttccggacagggtataggttgccattgttgtctttcagtacactgccggttgcgatctttatccagtatttgggccgatagaaagctttgatatacacagtggtgactgtgtcactcatgacaattttgtctatctctatacttgaggaactctgagctaaaaagggaggacgttctacgattctgtctttagcttgtgtcatacaaagtatgcttagcagcaaacttatcattaatgcgaatcttttcatacgattaggcttttatctccaacaaatgtaatcatattattgtaattatctatgcgaaaacagaaaaaggagcagaatcgtttacgattgctccttttttctgttatttacttgttaggggaataatgatattttcggttttgcttattgaagtcggaatgtaatagggaatgtatattctacggcaacggcttgtccgttctgttttcccggttcccacttaggcataccccgcactacacgaatcgcttcagcgtccaaccatgccgacgcgccttctaatatttttatattcgacacgttaccgtcttttccgatgacaatctggaccagcacttttccttgttccttattctgctgggccatagtcggatattttatatttttggctaagtagcgcattaatccctcctgtcctccgggaaatttaggcatctcgtctacgactttgaaagttggttcattattgggtgtggcttctttaggaccatagcccaccactacgacctcttcaaacttttctattgctactgcttcgggtgtttctgccggttttgcaggttccggaccggacagacggaaagttacgggaaccgtaaatcttacgttcacagcttgtcctctttgcttgccgggtttccaattaggcatggcagcaatcactcgttcagcttccttgtcaagataggggtctacgcctcgaactgttttaacgtcggaaatactaccgtcttttttgactacgaacatcacaatcacacgtccttgctttccattttcatgagctgttgccggatatttgatgttcttggcgagatattccatcaatgctgattgtccaccggggaagtcgggcatttcttctacaacttcaaatacgacagaatcatttacagtagcacttttaacgggtgccggagggggaggaggagctacctcttttgttttctgcattccttttttatcctgtaatgtcgctactcccgtcattccatcgggaagttccggaccattggcgagttcggtttgcgaaacaccttgttcttccggtgctgccatcatttctttggcaaattctttcgttgtacgagctactacttcgatgttgctgataatcatcaacagggcagccaagggaaggaacatcagatatttagtccttcctatttctttggttcttcgtttattcatcattttgatacgatttttaagtggtaaaacattgaaactattagataaatttgctgcagccttgtgatgtgccagtcccagcaagtggtactggtatgatttactatcatgtcccgtctctaatacccggtgatctgccatgtattccagattacctctgacttcccgtttcatcagccagacgaagggattgaaccagcagaaagtacacataatctcgctgacgagtacatctgctgagtgatattggcgggcatgagtctcttcatgcgtgattatttcgctgatctcggattctgtatgcgattccggatgtatgaatatccagtggaagaaggaaaaggggcctgtacctttctttaatatgtgtacacgtgatccttgtatcgtgcttttcgggcataggaaatgcaatcgtatgatactgcccagctggatcaggaagcgtagggcaagaagtaatacaccggtccagtagataaatcccagaatttgtgggattagctcctgccagttggccgttgtttcctgtggtgcctcgatgatttgctccggaagtatgatcgtagcataaagatctgccattgccaccatcggctcctgctcctttatccactcttgaatattcagtaagggatagagcagagagatgccaaagaagcataacagagcggtccgtcgccagtggaagaaggtgtctttatgaaaaaacaaccgatagaaagcgtagaacaatgcgatggctacgtttatctttaagaaataggcaagttccggagtcatatcgataaagtttcagtttatttttcttttcctttctctatcagttcgataatgtccttaaggtcatccgtagatatcttctggtcctttgcaaagaaagaaaccatttccttataggagttctcgaaatagttgcggacaactccactcatgaagtggcgtttgtattcattttcacgaatagagggagtatattggtaggtattccctatatgtttcgatttaacgtatcctttccgttcgagatttttcacgatggacgcaacggtggtataaggtggtgccggttgcggaaacttggatacgatgtcctttacgaaacagtcttgtaactcccaaatgtagatcattacttcttcttcttgtatagttaacttttccatggagatgatgtttaattacgattctttcgcaaagctacgaatatttcgtaataaagcaatagctagtcggttaaatattgtaaatgcctgtttggaatggggtgatttgcgggtaaaagcccctaattctcgtaagcatgaaaataatgtggataaacgttatattcatccaaataagcaatctttaggacatttaggtgaacaaaaagcctatcgtggcttttttatataaaataaatgaaatacttttgtagagtataat

SEQ ID NO: 49 - DNA, 56189 bp, Bacteroides thetaiotaomicron
aatcaattctatacattatggcgaaaaagaaagaaaagaaagagaaaaaggccggcaaaaggatgagtaagaaagagctggcagcgttattgatagactttttccatgccaaacccagcgaaacgcttagtatgaagtatattttctcggagttgcatctcactacccatccgcagaaaatgctatgcgctgacctgttacacgacctttcagatgacgattatatttccgaaattgaaaaaggaaagttccgcctcaacaatcacggaacggagatgatcggtaccttccaacgcaagagcaacggaaagaactcatttatccccgaaggtggaggcgatccgatctttgttgccgaacgcaattcggcacatgccatgaacaatgacaaagtaaagatcactttctacgccaagcggaagaataaagacgcggaaggagaagtcatcgagattctggaacgtgccaatgacacctttgtaggtacactggaagtagccaagtcgtatgccttcttagttacggaaaaccgtacgcttgccaacgacatcttcatcccgaaagagaagctgaaaggaggaaaaaccggtgacaaggcaatcgtgaaagtaaccgaatggcccgacaaagcaaagaatcctatcggacaagtgatcgacatcctcggggtagcaggagacaatacaacagaaatgcacgccatcctcgctgagttcggcctgccctacgtatatccgaaagcggtagaaacagcagctgataagatccccgcagaaattactccggaagagatagccagacgcgaagacttccgtaaggtaacgactttcaccatcgacccgaaagacgccaaggacttcgacgacgcactttcgatccgccccatcaaagacggattgtgggaagtaggcgtacatatcgccgatgtgactcactatgtaaaagaaggcggcatcatcgacaaagaagcagagaagcgggcgacttccgtttatctggtagaccgcaccattccgatgcttcccgaacgcctgtgcaacttcatctgctccctgcgtccgaatgaagagaaactcgcattctccgtcatctttgacattaccgaaaaaggagaagtaagagactcccgcatcgtacataccgtcatcaactccgaccgtcgcttcacatacgaagaggcgcaacagatcatcgaaacgaaaacaggcgattttaaagaagaagttctcatgctggataccatcgccaaagcacttcgcgagaaacgtttcgcagcaggagctatcaacttcgaccgctacgaggtgaagtttgaaatcgacgaaaagggcaaacctatcagcgtatacttcaaagaatccaaagatgccaacaagctggtagaagaattcatgctgctcgctaacaggacagttgcagagaaagtgggacgagtgcctaaaaacaagaaacctaaagtacttccttatcgtatccacgatctgcccgatccggaaaagttggaaaacctgtcacagttcatcgcccgcttcggctataaggtacgtacaagcggaacgaaaacagatatatcaaagtcgatcaaccatttgctggacgatattcatggcaagaaggaggaaaacctgattgaaaccgtatccatccgcgccatgcagaaagcgcgttattctacgcacaatattggtcactacggactggcattcgactattacacccacttcacttcacccatccgccgattcccggatatgatggtgcaccgcttggttacgaagtatatggatggcggtcgtagcgtatccgaaagcaagtacgaggacctctgcgaccatagttcgaacatggaacagattgcagccaatgccgaacgtgcttctatcaaatacaaacaggtagaattcatgagcgaacgtctcggacagatttatgacggtgtgatctccggtgtaacggaatgggggctttacgttgaactcaacgagaacaaatgcgaaggtatggttccgatccgtgacctggatgatgactattatgaattcgacgaaaagaattattgcctccggggacgccgtaagaacaagatatatagtctgggagatgccatcactatccgtgtggcacgtgccaatctggagaagaagcaattagactttgcgctgattgagaaatagaaacaagtactgtaaaaacgaattaatagtatactcttctgtgccaccctattggcacgcttgtgccaaaggctgggcatagtagtgccaatgcgatggcacaactgtgccagaggcttggcacaaacctgtaaaaactgacattagaatgaaaacaatcgttatcgaagacaagcaacgaatcgaatccattattcttcaagccgatgcctgctttgtaggcataacggacctggaaggcaatccatatgtagttcctatgaacttcggttatgaaaacgatactctttacctccattccggtcccgaagggggaaagatagaaatgctgcaacgtaataacaacgtgtgtatcacgtttagcctcggacacaaacttgtctatcagcacaagcaggtagcttgcagctacagtatgcgctcggagagtgccatgtgccgtgggaaagtagaattcatagaagatatggaggaaaaacgtcatgcactggacattatcatgcgccattacacaaaggatcagttcagctattccgatcctgccgtacggaatgtcaaagtatggaaagtacctgtagatcagatgacaggaaaagttttcggtctgcgggcagacgaaaagccatgagatgtacaaatctcatggaatcacctgcaaaatcatgtattttcatgatgttataagtcagtctatcaggcattaatactcaagttctcaggtgttaatacctgatacgacaagtattaacatctgagaagtcaagtgttaatgactgagaagtgaaatgctaatatatgaaactctatcagtattgatttacttcaccatctatatactctgccctatttttcaaccaattcttcagttctatcactttcgcatcaaaggaacgggtgttttcccataattcactatttctcgttacagatggtttaataagcttggcctgatcatctatatactgcaacaactcatttaatttatttgacttaaagtcttgccaaaagtttttatagagtttccttacccgactatcttgtaggaagcgttggaaaaaggcggttcccactccattcatatcatcagaaaagagcggagtttcataactcctgaaatgtgtctctttaccttcgtaatcatacgcccagtcaaagtcccaaatcggtcccataacatacttacccttcccctctttatgaataaagatacttttcggatggttaatctccatattgtgtaccaaattaaaggtaatcagatattttgcaactgattcaatatcaatcatatccacatacatatttccttctaacggctcctttgcaaactgcacggtaaatgcattaaaatctttcttccaatactcaaactgctctgtagtcaaatcagggtctttcaccatcaccggaagattgaatgcttcggacttgaatttcggatcttcatcaaaataggaatcaagctcccacatcacgctgttattctcatccaaatccacacgattttctttgatttctatctgttccgtcagtagataggaacctttgtatttgccattcagaaccacatccaccggaatggcatgattggtgaaaggaatattcagcaattgcccgactttgaaggcaactgagttaagcatcaaggtaggatcgatatgattagccagtaatacataattcttcgcttttcccaaaccacaaatctcagatttcttatcaagctttaaccggtaaggtttcttcggatatccccatgtggagtttccccttcctttcacctctgtcttgcctgtatagttctcataaatccccttgccatccacggtgagagtcgcattcaaataataatccttacttggtatttccgttatactagggtcttctgtcgtgatcgtaaactgaggaatcaggataaagtccagcgtcaggatgtatcggactacttctccattccgcatcacaaactgataagtgaccggagaggcgaaatcaatttccgtcacaccgctgacctgttctacatcatctaccattactttcacggcatcagtcataaagacaggaatcagtttcgattgtgggaatgtgtaggaagatacaatagtctcatcttcaatcgtacatgaaacatcagcagtcagcaaagcattatcttttctcaaaaagcgaaattcggataacacctgcgcatctttcaagacaacttcgactgtatattgttccctgctgccgtcttctgcttctacgagaatcatcagcggccgggaaaaatcattcgaagtgatgccggattcctgcccgactccattcacgcttacagacgttccttcatacttgaatgtagcaatcaatgacttcaggtcatcatattgatccattgacagcgttatcacattccctttaatggaacctctcacgtcattcttaattttaccttgattgtcactcttctgaatcgaatagctgattaattgcttcgttgaagagagaggagtttcttcatctttacaggcagaaaacagcaggagaataatcatcagaatccctaacgtcttgttttgcatagtattaaataaaaatggttacttggcaaatatacggttttgccaagtaaccacaggattattctctatatttctttcaaaaaaacgttcctttacaaaggatactcttcaaacgcgtacaggatagtagataaataacgctctcccgtatcgggcaataaggctacgatcatcttcccttcgttttcgggacgtttcgccagttcggtagccgcatagacggctgctcccgaagatatgccgaccaacagcccttcttcctccgccagcgcacgactggtacggatagcgtcgtcattctgcacctgaataatttcatctacgacagaagcattataagtcttcggtacgaaaccggcgccgattccctgaatcttgtgaggtccgggctttccgccggacagtaccggagagtcggcaggttctaccgccaccgccttcacactgggatcgcgcatcttcaatgcttctcctactccgctaattgtcccgccagtacctacaccggcaacgaagatatcgactttcccctcggtatctctccatatttccagtccggtagtgcgtagatgcatagcgggattagcaggattttcaaattgctgtaagataacgctgcccggagtggcagctttcaactcttccgctttggcaatcgcccctttcattccgtcggcaccgggagtgagcacaagttccgctcccagagctttcaaaaggttacgacgttcgacgctcatcgtatcgggcatcgtcaaaatcagtttgtaccccttggcggcagcaacgaatgccaatcctactcccgtatttccactggtaggctcgatgatcgttgcgccgggagtcaagacgcctttcatttcggcatcttcaatcattgccaatgccacgcggtcttttacactgcccgcgggattgaatgattcgattttcacgatcagacgagccttcaagccgttactcttattataattacttagttccaacaacggagtgttacctaccaaatccgtcaatttccttgcaatcttttccatatatctgtttttaatttcctttgtttttaagatattacaaagatagtgcagtttttgttgacaggaaataccatatatgtggtaaatttataccatcattatccggtaacctaccattcatcaggaactattccagaaaatcagcccgcatgggactgaatgtgtctatcaatactcccgcttccagacagacgcatccatgcggttcgtcgggtgctacatagtagccatcgccggtcgacagtatctctttccggtcgccgatggtcagttcaaactttccacttgccacgtaggtagcctgactgtggtaatgttcatgcaacgtaccgaccgctcctttctcaaattctaccttgaccatcatcaactgtccgtcgtatcccattatctgacgacggattcccggagcggggtgctcccatttcaactctttctcaaactgaaaaacttcactacgcgttttcatattctctttcctatttaaataactgaaaacaaagatagcttttgatttccgtctaccaaatggattctacggaaaagacttgcaggtctttcacttcgatacggtttccccagaagtggagtccttctctgttgttagtgtcagggcggcgttccatggaataagaatacagtccgccgtcgataaatacttcgatagaggtgcggtcaatgtaaatatcggcactcaactccatgctggtcgggtcttggggagagtagaaacggccgttcagggtattggagttcatgtcgtagccgatcatgcgctggccgaaaaggttgaatccggcatccgtggcatgagagagtttgatcgttgtcttaatgcggagacagtcggcatcataaaactctttcagatggcggttggcctcatccgaagaaagagatttccaggaacgaagaggcttacacaaggattcgacctcctttacgggaacgttgacaaggcggatgccgtctttggtggtacgcaaagtcagttcggtggggagcatcatcattccgttgaaaggcataccggggtgggagattcttccccagcctatctggatacgtctgccgtcacttgccggaatattggtaaaggtctgggctgcatagatacttccggtggtatagcagtattttccggcttcgggagtaaataccttgccgtcgaaagagcctagcatatacgtaccggtggcaccgtacatcacccacttcgtatggttcttgtcaccgtcaaccggcagttcaaacaattcgggacattcccaaaagcctgtaacatggctctcgtatttccagtctttgagattggaagaggtataaatggagtgtccgtcgcgctcgttcagtaccagtacccaatgtttggagggcgcataccagaacactttcgggtcgcgtgtgtcctgagagttccatttctccttggagttgatcaccggattcttgtcgtacttcgtgaaggtacgtcctttgtcaaggctataggctatcccctgcacttgtctgtcactgctggcggcagtgaaggcggcaaccatggctggagtcttgcctttattgaatccggcggtattatcatagtcgatgactgccgaaccggagaacatcgttcctaaatggtcgggatacagagcgtccggtaattctgtccagtgtatcaagtccttgctgaccgcatggccccagtgcatattctcccagtctctttcgaaaggattgtgctggtagaacaggtggtattcgccctcataatagattaatccgttagggtcattgatccagcctctccgggtagtgaagtggaattgcggacggttcttttccttatacagttcagcttgtccttcgatttcgtcggactggtatattttactcaatcccttctcattgccgtcgtaggttatcttgatcgtctttcctttgaaagccgacacatctttaaacacccagtattccgcttcatccggcgccagacggataacgacggataaatccggcttgccgtttacttcaaaagtcatccttcctctgttctctttatgggagatggggaagttcagatattgcttggttattttaaaagatacttctccggctatcgctgccaaacaggagaaggataaaacaaaaagagtaagtacagttctgcttaatgtcttcatagctattttatttattagtttgtaaaatcggagtaaatgtagccaatacgaccgatttctgatataataaatgattcacagactatgagaaacgttacatttcacagatattttccttaaatgacctgtatttttcatcacttggccatttctctctattctttatcccacgttattattcagcagctctttcgtcttatccgcaagaaataaaggaatattaatcagattgccgtcttgtttcaaattcagcatcgaatatcgaatccggcaagcaggttgataaagtttctcgtactgaatcagacttttacctgttatattctggtctgctttcacttctaccggataaatatgattaccatgctgaagtaaaaaatccacttctgctttattaccggaagtccagtaacggaacgaagcctgaagttgtgctgtaagactttgcaatacataattctctgccaatgcccctttatattccgtatatccgggagtggacaataacaaaacacttgcatccagttcggacaattgcctcaacaaccctatgtctaatgcatagagcttaaaagtgctcaaatcatcgtaggctttcagtggcagcctaggcgacttgctcaaaactactttgttgacaagaccagcttgttccaaccataaaatagcatcttcgtattcacgcgcacgtgctccgggacgaaccagttgataaacaaacttacgattttctttcgccaattgagagggcagagagttccatacataattgatacggggcgccaacgtaggtgtagtatgtttcacaaaatccagagcatagtcattcaatatatcccgaagcgatgaatccactttttgcatatcattaaagtcaaccatcaaagaagcaggttcgggcataccgccacaaatagaataggcaatgaaggcttcccgcagtttgtcgaagaagatttggggaagaggcgctatttctttgacagagcacatatattgatacatcgccggatctttcgtattcagaaactccgtaaaagtcagcggatacatagacagatgatttacttttccaaccggaaaggaattgcctatgtgattcaggtaaattccaagtaaagaaccagcgcaagccactgcatattcgggtgcttcttcgcagaaatatttcaaagagttcagcgcttcattgcactcctgaatctcatccaatatcagcaaagtagtctgaggattaatttttcgtccatgcaaaaaggacaattgctgtataatgcgttcggggtctttagtcgttttaaagatatcgcaaagtccgctttcatctttatccagactaaaataggcaacatcttcaaagtatttctgaccgaaatacttcaaagcccacgtcttacccacttgtctcgccccatgaataaccaaaggcttcctgtttacatccgttttccaagccgctaacagctgaataattcctctttcaaacataccgagtcacatttttgatatctgaaatgtgagaacttacacatttttgatatgagtttcgtgcaaatatacacattatccatatcaaatgaaaggatatcacaggtctattacttgaacctcttcacataattaacgatcagatagcaggcaggaccgagtacctgtccgtggtcaaatccttgcagttcatataaagagactttccgattgccgatattcttcaataccgatgccagcagtgcattctcttcgtaccggtcagccatttccagattcttatcccccgtaatcagcacaacaggggcggtatccttgcgggccttgtttaccggagcaaattcgtcaatgatggggattccgttgggcaggccacgttctttgcggatggtaaaatgagtgacagtctgtccgctgaccggaagataggcagctacactatccgcatcggctccatatgcagccatgtatttcttatccattgccagaatcaacgtaaggtaacctcctgccgaatgaccggaaacaaagatacgatccttgcgaccgccatacttttcgatattccggaatgtccatgccacggcttcggcggcatcttctatataagccggattctttgctttcggactcaaacgataattaaccgccactactgcaaagccttgatccgtcagttccctgggaacaaatttacttcctccttccataccaccgccatgaaaccatacaatggtggaaaaatcttttttattctcgggataataaacatccaatttacaacgttccagacgataagcatctgtttcggagccggaaatgtaaggtacatccttgtcggtacgatacgtatcctgtgcctgaacgaggcaggcacaaagcaaaaagagaaggagaaaacaattctttttcatggttttattctttttcattcttaaacaaggacaaatataaaaccttatttttagaatcacggtcaaaaaaagaagatattaatatctcccgtcacaaacattaatatatgtcgtgacaggtcactttatctgacttctcaggtattaatacttgataccgcatctgttttattcctatatttgcaatattcttttattgcattttagtggaaaatcgcatttcagaagtctattttaatataaccatgataaaataaactataatgagaaaactattactcaacctttttctatccacagtaggtctcctgtttgccgggcaagcatccgctcaagaagaaattgctccgggaatcatcaagctgcaagcgggagaaattgacacttttaccccttattccttattcggcgggaaacctgccgtagaagcaatgaaacaacttccggctgcaaagccgcccttcagccccgacgaagtgcaaataaagataaccgaccgtggctgtctgatcgaagtccctctggaggacaacgaacaaatatacggtttcggacttcaattcgaaactttcggtcagcgtggcctgcgcaagcgcccgatagtaaacgacaatccgctgaacggactcggatatacacatgctccgcagacattctacgtctctaccaaagggtacggtattctggtcaacacggcacggtataccactttcctatgcggctccaatcagaaaaccgagcatagtcgtcaactgcaagcggaagaaagaaaacacattgctaccaccacagaagacttgtataagaacagaagcaacggaaataaagtccatatcgacgtacccggcgccaaaggcattgaggtatttatcatcaccggaccggaagtgctggatgtagtcaagagatacaacctcctctccggcggcggatgtcttcctccgatgtggggactcggattcaaataccgtgtcaaaggagatgcgacgcaagactccgtcatgcgttttgccaactatttccgcgagaaacagattccgtgcgacgtactgggactcgaaccgggatggcagacggccacttactcctgttcttatcgctggagcgacgaccgtttcccaaggcacaaagaaatgctggaccagttgcagcagaaaggatacaaagtaaacctgtgggaacacgcgtatgttcatccttcttcccccatccggaaggcgctggagccctactcaggcgatttccttgtatggaacggactggtaccggacttcatccagccggaagcacacaaaatatttaccgattaccaccgcacactgatagaagaaggcatctccggcttcaaactggacgaatgtgacaactcgaacatatcttttgcttccgccacatggtgcttcccggatatggcacagttcccttcgggcatcgacggagaaaagatgcaccaggtattcggttccctctatgtgaatgcgatggacagtatctatcgtgaaaagaatacccgcacctatcaggattaccggtcgtccggtatgttcatgtcttcacgcaacgccgtactttatagtgatacatacgatcccaaagagtacattcaggcactttgcaactcggcattcggaggactgttgtggtgtcccgaagtgcgtgaggcacattctgccgaagatttcttccatcgtctgcaaacggtgattctttctccgcaggctatggtcaatgcatggtatctgcaatacgctccgtggctgcaattcgaccgtggaaagaacgaacgtggcgagttcctgccggaagcaaagaggtatgaagaatatgcccgtacactgattaatctgcgtatgcagctgattccttatctgtacagtgctttttatacatattataaagaaggtgtacctcctttccgtccgttattgatggattatcccaaagatgaacgtttgcgcactatcagtgaccagtatatgatgggagacggattgatggctgcccctttataccagaacaagaaaacgagaacggtctacttccccgaaggaacatggtacaacttcaataccaatgagaaatatgaaggcaaccgtgaatatgagattacgacggaattagatcagttgccactctacgtccgccagggaacgttattgccattggccgcacctgtcccctatgtagatgctcaaaccgtattcgatctgcattgcaaagtatacggcgctccttcggcaacgttcctccttctcgaagatgacggtataagttacgatttccaaaaaggacaattcaacgaagtaacgctggaagctgcaaaaggaaaggtaaaacttaaaagaacaaaagaatacaagcagaaaagatatcaactgacagattacgagttcatcaattgatttcttaattagtttcactgcttgaaactagagtttcatcagtgagaaactgtagttccaaaggcttgaaaccaaaagttccaagcgtatgaaactatagtttcaagtaatgggaaccaaagtttcaagcaatgggaactgtagtttcataccttaaaacaaactcggcttattaatagctgaaatgaatgacagcgtgacggcaaatctttccgtcacgctgctgtcacaggttgctgtcacggtcttatgatttaattatcagactattgtcacaggtttagtgacagatgacagcaattcttcaaatttatatctttatgtaggcgttgagttcaagtcataaacgcagggaaatccgactttcttcccctcggtccggcatacgaaggctgcaaataccggtcgccttatcccaactccacaccatactttcagtgtcatcgtccggattctcttccagacgttccggcttcaccttctttactttcttgccttgcacggtaactcctttgggagccgtcttcagatacatacggaaaataaagtttcggggagcgggcactgcatacccttttccttcacgggcaccaaccgaaagaagataaccaccctcctccgtccggaagcgaacgggagttttggcaaactcatcccgttgatagccgaggtcttctccctcatcttcgtacaaagtgaacgaggcctcctctccttttggtgccggaaatacttcaaagatcagcggatagaccggtttctcatgcgtgtagttcatcaccggcatggtggggatgatggaaccctgctttacaaacatcgggatgcacgacaagggagcttccacggtagtccactgttctccggtatagactgtttgtttattgttgtagtcaatccaagtgccttcgggcagatagacattcttcgtacgtgcccccttcttcaccaccggagctaccagcagctcttgtccgaacaagaactgcccatcggtagagaacgtttccatatccgccggatattccaaaaagagaggacgcatgatgggcaatcccgtatcatgagcttcgcgggcatacgtatagatataaggcaataaacgatatttcagttcgatggcctccttcgcgttcttttccgcttccggaccgaagagccacggttctaccggattatccccctcatgatgaatacggctcaaaggattgaatgcaccgaactgtatccatcgggtataaagttccgccatggatggatagtcttcgatgtctccgcaataccccgtaatgtcacaggtagtaaacggaatcactcccagccctgcggaaagaatcaccggaatctgattagccagttgcccccagccctgcaatacatcgtctccatttccgcaatctcccgtccaaccgaacgtataacgctgcaatcccgcataagcggcacgggtcatctgaaagacgcgacggttcggattccgtttctcgaactgctctttgaccactttatcccaagtcagtccgtagacattatggatttcgtcgtgcatacccaggtgatgtttcatcacaaggcgttcggtctgctcttcgttgctccatgcgggttctcccatatccgtccagaagccggagatgccatcgtcaatgggtttctgctgataggttccccaccagtcggctacggcaggtaaggtaaaatccactaccccacaatttccgccccaaggccacggcatgtcataactcttcccgttcgtgctgtccttgacaaaatatcccagacggtccgcttcctcccattgcttcttgttggcttgcgagatgaccgggtcttgcgatacgactaccttgaatcccatttctttcagatcggcaagcatctttttcggatgcccgtagttgcccttccgccattcgaagtcctgtagatgttccgtccagccgatgtcctgatagataatatcacaggggatgccgcgtgtccggtagccttcggctatttcgcggctcagtttctcgcttgtcagcaggccacggcattgcgcaaagcccaatgcccatttcggaggcatgataggtttgcccgtcagtcctacatactgactcaggatttccttatagtccttgccgaagatgaagtagtaaatcatctccccgtccggcgcctcgaagctgtaataatcacggctttccgttccgaacttaaattctgtcttatacgtattatcaaggaaaataccataccggtaactgctcataaagaaagggatgctcttgtaaagagggtcttccaccacactgtaacaaggtttatcgctgttccacatcttgtaagattctcctctgcggtccatcttgccggtcttctccccaagcccgaagaaatgctcgtcacggcgaagcgttttatattccaccttcttcgtaccttcgcttacgtgtcctttatcggcatagtcactgaagaggagtttctgatatttgtcgaatatctggatgctcatcggcgacttgttcacccgtatgcgcagcttcgaggtaaatatctcatagcaggcggcctgttcgtccacatgaaccgttcccacatcttccagttcttcattgatcacggcaaaggaagcgtttctccgttgcagcttcccgtccggcgagaaccagattcttaccacggaagggctgcaaagttgcagttgcagcgcggcactgtccgccaggtgaaaaatcacctgacgtccctgctgcgtaaaagaggtacatatactttttgcgttttctgcccagaccaacgccggaaacatcagacacaacatccacaccccaaacttatatctaatcttcatacctatcgtttttagttattccgttgcaactgccttattcagctacaatcattgtccagtatttcaaggcaggcagtgtgaaggagactaccccgttctcctgcgtaaatgccagttcctgcaaggctcctccgtgtacatccggtgatgccacccacaatttattcactttggcgggcaggttcatctgcaaggtcgctttcgtgatcagggcaggttcgggcatggtgccgtccacgtcccgccagctaaggctgttcgcctgcgagaagttaagcagatgcactacttgcttgccgtctacctgcttggcgtaagtagtgaccgaccccaactttggaggccatacgttgagtttcatttctccgttggtacagttcatagcgatgctgttctccgttccgccatcgcggagcaggttctgataagacgtgaggaagtcgtagtagtgaaccattgccgttttcagttcctcgctcatcgtcaggttgtcgttcgggaaatattctttgcacagcatatggtcaccacccagttcgagatgcgagccacccaaagcgaacatcaccgcatccgtcagcaggatgcccgctgtattgaactctccccgatgatccgccttattatagttcatataggcagcgaaaaccgtattcagctgattattgccatacactccgttttcatacaggacggctttcagatgggtaaagtccgcctcatccgcccacatctcattatagaagaaatctactttaccggtttctccgatctgacgggcaccgtagcggcttacggcattcatcaccagactcttgtcgggatgcgcctgcttcatggcttcgataaaagaagcatatccttcgcggaggttgaccggtgtaccgttgtagttgtaaagcgttccccgcttgcccaactggtcgatctgatagccgtcgaaggcgaagttcgcatacacgtcgtcattccgttccgccatatattgctgccattccttgtcggaaggatctaccagatagatattgctcttccatccgcttggcaggtcgtgactgtctttcgtggtatgcgaagcgtccttaaacagataccattcttctttcaccccgtcggaagccgcatccttcaatgccccgaaacaaagattatagaacatggacttcattccaaaatgttgttgtgccttgatataattcttcacagagcttgtatggacagggcggttcgcaatgtcgagatattcctcgtccaactgcgtgcgtgtgccgcccagcggccaatgatgtttattgtgccagtcctgaaactgtacccagttgatgtgatggcggttcagataggccatctcttccagtgttttctcttctgtcttgactccgtcgaaatctgccacgaagccatatcgggggaaacgtgccggatggctggatacatctaccgcaatcgtaccgacgatgacatccgtaccgttttcctgccggtaaagttctgccatgtatcctttgaaatcggtggaaggagccttccatgtccagttcgtaccgctgaccggttcttctccgactatttctcccaaaaggcgatagcgtacctttgttccggcaggcaaggcatcggcggcagtgaaagtcactgtctcgttcggtttataaaaagccttgtcagttgtcagttccacgcataagtccgatgtcaccggagttacttcggtcacactgcccgacgctcctccgttctgtgggttcgattcatgatcgtcgctgcaagacagacacaggaaggcagccaccaaatatattatcttcttcatcttgaatacttgtttattgttttacaattgaaatcgtttctttcaactggtcaatcgtaatccgatacgagccagcttcctgaatattccatttattgtccagactgccgaggtctgtatccggatacatattcttcagttccgcatccgttttactggtaaataaggctgtctccacttcaccggtcggtgcctttccgctcttgtccgccatcagccagtctccgttccagtcggactgcttgtcgcaggagatcttcatctcccctgtattcagtgtaccgctccaggtaaagatgtaagggctgtcggcacttttagccatcggggtggcgttgtcgatgctccatccgttcggagtggcatcgcctaccagatacagtccttcgtagggggtaaacggacgcatcagcatcttttcctttcccttggctgtgaggaacagcactttataggccttgccgcattcgctttccttcatttgccatttattgtcttcacctcccagtacaactgaagtggaagtatacggagcgttcccttcggtgggatggaagaaagcatccgactgaccgaagtccgtcacggaagtaaacttaaaatcaccgtccgccttccacggaatcacggcaccataatggaacagattcatctgaacggcatctttagacagtgcctcgaatccccagccattatcgccggtaaaggagccgacaatatagaattcttcaaagcgccatccgatgttttccgtttcggtcatggtcattgtcaggtcgagcaggtctaccttgactatataggtcgcttccttgctgactgtaaacggttcgtccggttcgtcgcccgatgtgcggtagataagccgtagttcttctccggcagcggcatcccggttgtaggatggaagaaattctcccaatgtcgttataaacttgaatacaccggtattcagctttcctgtccacgtaaactgtccgttgtccgtgcgctccataggcgtcgcttgatcggcgctccatccgttaggggcagcttctccgatgaggtaaagcgtcggagtaaccggttgataagtagtcacatccagcgcaactgtggcacgctgctccttttcttccattccggcaacagtagcggtaatgcgtgcttccagcgatactttttcggcatagccgacgcctagctgcgtgttcagaaactgattgagttcttccgttttcttcgtccactgataagttcccgttcctaaatctacggaataggcacgggcgaagtctgttcccgccttggctatttccagtgtataagagatgcggttcccgcttccgtagtttgttcccgtagtccatgaaagcgttaacgcttcctgagtgtgattcttttcgttcagtacgatctcctgctgattcaccgtaagagtcagcgtatcatgtcccttgtccgtctccatatagtcctcggcgcaggaaaccatcgctccaccgatgaaaagagaacacagtatctgatatatatatttcttcatcatatgatctgtctaaatgaatgattgtaaaagcaattaataaccgggattctgagtcatcagattgttagagtccatctctgtctgcgggatgggcagcagcaggcgttccttcgtcacctgattcttgccgatagatttcaggaactcaatcgcatagttaccattattgatgcgaatcatgtcaaaccagcgatgtccctcaaaagcaagttccatccggcgttcgtgaataatcttttcccgcattgtttcctgattcaaggtagtcggtacatccgccagtccggcacgctgacggacgatattcagaggtgcggcagcctgatcgggatgtcccagttcgttcagcgcttccgccttcttcaacaggacatccgcataacggtataccacgaagttattcgggttggtattatattccggcgaaacggtcttcgacacaaggaacttccggacgttgtaacctgtattcgaccacgaacgtctgtactccatgccgtcgaaagcaggacagccttgatataacacggtcacatctttgcgcaaatcgcccgcttcgtactctttgataaattcttccgtaggcagattccatccgtaagcgcctgccaccatgccggagttacggggtcccatgaaggtcgacagccaggaagactggttatcccctccccagaaatcgtattccgtactgccggagtattgtacttcgaaaagggattccgcaccgttattgatcgtagcgtcgaaattatcggcatacttgcactgagacaaatcatatcccatcgcagtaatctggtcgcacaacgtaacaacttcattgtaataatcccgatgattgggcgccagcgtcaggtaaatatctgccagcatagccatcgccgcctctttgcaggcacgtcccttgtcattttctccgtaactgctctttgggggaagcatatccaccgcattcttacagtccgaaagaatctgcgcatatacctcatctaccgtattgcgggcaatatccgtcgactgtcccggctcaaagggctgtagccgcaaaggtacgccaccataaagacggacgaggatatagtagtaatgagcacgcaggaaatatgcctcacccatgcaacggtcttttatctcatcggagatggcagccgaaggcagattggaaagcacgatattacaacgtccgatgcctacccacggagaacgccatacgtacagggcaaaaccgttgtcgctctgcgctataaagttagccgcctgaacagtttccagtccgtcggttcctcccccggcgcctacctcgctgttgccggcaaggatgtcgaggctccacaggcgctgattatacatattggacgactgcaacgtcttatagcaggcagtagtcagtgctacggcaatctcattggtcacttccgattcggggtccacaccgtatttggggtacttatccagaaaatcactgcacgatgtcaaggcaagtacggcaagtatcattataaaagtcagtttctttttcattttcttcctcctgatttaaaagttaaagttcaagcccatactgaatgtacgcgagatagggtaacggctgctgtctataccgttgacatccacctcggggtcgaagcccgaatatctggtgatagtcgccacattctcgcaagagaaggagatacgggcgttttccagttgaatcttttgcaaccactttttaggcagtgtatacgaaagggtgatatttttcagacggagatacgagccgttttccacaaatcggtcggatacgcggcagttctggttcgggtcgccccagatggcacgcggcatggagtagcttgtgccttctcctgtccagcggttcagtacggctgtggtctggttgtaggcggcagccattccttcgttgtccacattgttggcattataaatcttgttgcctgccactccttgcaggaaaacggagagttcccatcctttgtaagataggttgttggagagtgagaagaaccagttcggattcggattgccaagaatcgtacggtcttcgtcgttaatcactccgtcgttgttcaagtctctgaagcggatgtcccccggagctgcgcccggctgggtggcgtggcggttgacttctccccagttctggaaaagcccgtcggtaacgtatccatagaaaacgttgatcgggtaaccggctttcagcatggtcacgtatgaattgcctatctggttgataaacatcggagtttcgctgttcagatccagaatctcattcttattataggtagccgttaaagcggattcccaggagaagatgcctttcaggttgatggtacgcaatgtcatttccactcctttgttgcgcatcttgccggcattggtgaaagtctcggtagtatcttcaaagcccgaagtgatggggatggaagccttcaccagcatatcgttcgtattcttgatataagcatccagtgagaggctgacacgcgaatcgaacaggctcatgtccacaccgaagttggcctggcgcacttcttcccaatggatgttcggattggagagagtggtagataccaaagcagtggagttattgtttccgaaaggatagacacccgtgttgtaggatgcgacaaatccatagttaccgatttcctgattaccggtcacaccgtatccgacacgcagtttgagatcgttcatcaggaagttatctttcgggaaccagtcttcctgagaaacacgccaagccagagatacggaagggaatgttccccatcggttgttcttaccaaagcgggaagagccgtcacgacgtacggtagccgtcaggaggtatttgtcttcgtatgagtagttgagacgtgccatcagtgagagcagtgcccagtcgctctggctgccgccaaggctgtacatcttttctccgttgtccatctcatggatattgtcgaacatgaagatgtttttctgtgcgttcagataatcgtagttattccactgtgcggaagaacctgccatcacacctacacggtgtttctttgcaaaagtatgatcgaatacgaagtagttgtcccacaggtaggtgaatgatttgttgtcgcttttgtagcgggaagattcttctaccggattcggtttccagtcgtatgccggcgtgaagttgtcggcaaaccagaacttggcgtcatagccgaaggtacttttcagtttcagccatttagtgaaggtgatctctccggtgatgttcgcgagaaagttatatcctttcgtctcgttagtcatcatgtgaagcgtaccgatcggattgcggatacttccgtaccattgcgcctcctgtccgggaccgctccaactgccgtcgtcattcttcaccggttgggtgggaagggctttcatcgcatcaccgatactatatgttcctccttcttttacgtctgtgctgaatgtcaggttggtggtgaatttcagccatttgttgacttgggcgtcactgttcgcctgaaaattgaaacggcgataattgacactcttcacaataccggactgatcgagaaaaccgccggatacataataatgcgccttttccgtgccgccggaatagctgaccgaataactctgcttcactcccgtgcgcagcatctcgtcgagccagttggttccttttcccaatgaagaagggtctgcccagtaagggttggtgttatcgtcattgtttgagagcatatcattgctcaatgctgcatattgggcggcattcagcatatcaggcactttggttgcattctgtatcgcccagttcgcattgaccgttacctttccggcgccttcggcaccgcgtttgctggtaatcatcactacaccgttggcaccgcgcgaaccgtagatggcagttgccgaagcatctttcagcacgtctacccgttccacatcggccatattcagagaagacagacctaagtcggtagggattccgtcgatcaccaccagcgggttgctgttgttgatcgtgcccagaccacggattttaatggttacattgtcccccggtttgccggcatcgataatttgcacgccggatacttttccctgcattgcctgaccgatattggctaccggagagtctttgatatctttgactcctacggaagatacggcgccggtcaggtcgctctttttcatcgttccgtaacctactacaacgacttcgtccaatacttcggtatcttcctgcaaggttactttcagtgcggtttttccgttcaccgaaacagtctgcgtcttatagccgacaaaagaaatggtcaatgcgctgttagcagaaacatttaatgagaagttaccgtcgatatcggtaatcgtgccgttcgtggacttgccttctatcacactggctccgatcaccggttcgcccgtggcgtccactacatgtccttttactgtaatctgctgtgcgaatgcactaagagatagtaacaagccccacattattaataggaggcgatgttcaaagcctttcgactttatactctgttccatgtacatcaatttaaagttaatattaggattactttttgttttcactgaaacaaaagtatccacaattaaatgcgcttcttttgccagatagcaaaaatatagtggtttatacagtacaaaacagcataaaacactaataataagaatattatagaatagcgaccgtgctaaaaaagtagtggatttcttactcttccaccttccctattttcattactttagcctcaaactcatcccgttcgccgagtgccttgttgcggacacgtgtccggtaattataaatagtggtcacagagtagcggaggaactgggcgatcttggtactatccgtaatccccagacgaatcagggcaaagatacgaagttcggtattcagcagttcgccctgcttgggctgcatcggttcgacaagtaacgcattaaactcttccacaaagttagggaagagttgcaggaaggtcatatcaaagtttgcgtagaagtctttcagctcttcttcgaggaattgggaggatttaatagctttatacaactcttctaccctgccggcagccgcaatcttattcagagaacgacggtataagtccatcttatccagataggtggaacactggtccatgtagcggccgatgtattcctctttaatatagttagcttccgaaagggtatggttcatctctttcagttgcgaattggagtcatgaagttcaccattcagctcttgcagaagcgtattcgtgtcaatcacttcccgacgggcggcagccactttcttcatctgcttgtaaacgaagaatatagccaccagcaaaaagacggaaagcagactgatacaaatcagagatatcttcatttcctgttgctgccgcttggttttcagctggtaagcctgatcgatgatggggaagacttgcgagatttccagtgtacgaaggcgggcgttgcagagcgtagcatcttcgagcgagcatttcagatagttgtatgcacggtcaatgtctccgtcttcatatacaagagaggcgagtttccgcagggagacgtattccttgactgccgattttaaatcggcgatggccgagagagccagaaagtgtttctgccctttcttgtctcctttgaggcgataggcttctgacaaggtataagtaatcatcgccttggaatgatcgtccagagagggtttccggtagaagtcggtcagcatggttattgcctgatcatattgggcgtgtacggtgcatttgtcggccatcaccagcacatgacccaatgagtcggaggcattagtctgtaaaagggaatcccgatacaggtccgtcatccggtaatactctttcttctctttctcagtaacggcataatctcccatcaacccgtaaatagtacgatacaagtggtaataatagggatagagataatcagacagggttttcttgtctatctgtcccaactgctccaaagcttccttgtacattccggtggttcccatcacctctgccatattcatggcggcatcatccagataatcctgtttgttcaaatgagaagccagttcctgcttccgctgtgcatatacatacgaagagtccagattataagcccgatattcgtcgaaaagcctgccgcaaaatccataacgctgctcatcggaggtagcctcggacagcaacttcttcaaatcggagatacgtgcttctttttctgcaccgtaagtctgacggttcctgataattccgtcaatctcacgaagcagcatatctgtactcttatcatcatttcttgcgcaaagcaaacagggaagaacaattgtcacgaaaatcaaaataatctttctcatagcgccatatgtattatatctgcaaagataaaagtctttcagaaaccgacagccttctttgagaaattattgcaagtcttgggaataaaaacgtgtccgatcagtaagccctcaaaccgaaatcaaagctcatctttttagtttcccgtacttcgattttcaactcattctttccttttcgcaaatatcggcaataattactgatattgtactgattatattgcctggtttgtttcacctcctgcgaaaagacctccactccattcaaccataccttcacatctccggtagcacgcacccacaaagacaaatggctgaattcatcattgacatcaaatgaagtttccgacacaatttccgaacggggagggcaatcgaaaggcaaagaggtcattttcgactcctgcccgttaaggctgactgcacggctgaccgcactcccattctgagcgtcgggcaccaaagtaatgactttcgccggattgacatgatataaacgatcgtgcatgatatgcaacaagccttccggaattttaataactttccggtcataagtaatcagaccatttacttcaccttcgacatcagtggtttgtgtataaatcgccgcactcagcccctgtgctatcaatgtctccaaatcatagaccagacgaccatagttatccatcagcgccattgctccatcaatatttttatatccccagttccgcataccgggattccacagatgttctttgatggcccatccataccctccgaattctcctaagacagaaatccgattgccattacaagcgggcaaaatcatggaagcagacggataattgtgtacatcatacatatggcctactcctctgtctgtccagccggttactccgtcaatgatacggcttttatcgtattccattaccttttccactatttctaccgtattatgctgtccccatccttcattgaagattacccacgttgtgatacaggaataaaaacgcagacggtcaatcatctcgaacatctcctgttgccattggttagtatgtgatgcgggtgcattccagtccgtttgcgcattgggcttaatatgttcttcgtcttttctttcggtagagaagccggataccatatcctgccacatcatcaaacccaacgaatcggcataataataatattgctccggttctactttaatgtgtttgcgtatggtattaaatcccatatttttgagctgaaccatatcccaaagcattgcttcttcggaaggaggtgtcagcaaaccatccggccaccagccttgatccagtgttccatactggaatattggatcaccattcagacaaatacgctggtaaccacattcatctttgcggatactgacctcacgcatcgcaaaatagctttttacctgatctattacttgtccttgacttaacaactcaatattcagatggtaaagtttcggagaagacggactccaaagaacagcctccggaacttccatttctatctttgaggctaatttttgctctgtcgtacccactaccttaccttcgtccagtaattccacttttactttttctcctcctttggctttagctacactgatgtccagactaaccgtctttttatgaatatcagctgtaggaagaacctgaagaatatgggttgaatttacagcctccaaccacacagtctgccaaataccggataccggagaataccagatacctttcggctccaactgttgcttgccacgggaaattgactccgtatccgtagggtcgataacagcaacctcaacaagttgcgaaccaccttttctcagcaatttggttacatcgaaagagaaaggattattcccccctttatgaatgcccgccaatttgttgtttacccatacctgacattcataatctacagctccgaaatgcaaaatcactgtttttcctttccatgcgtcatcaagggtaaagttacgctgataccacaatttctcggtaggcagaaaagaacgctgcacccccgaaagggaagattcgatagcaaacggaacgagaatctgtccctcgaacttcacttcttttttaggtgtatcctgagtagtaaccgcatactgccataacccgttcagattcatccattgcgaacgttgtaactgaggacgcggataactctgccatacattttccgacgtaactttatcagcccaaactgttttcattctattttctttcgggcttgctgcgcaagcgaacgtatgtgccatagcacttacaaatactgcaattagtagtttcttgttcataagttcctatcttttctttcctactgtgttttcctacttatctctatattctttaaagtccttccggcgtcctttattataagtattccaaaccttcgggaaataaagcacatcactatggtctgcccactcaaaataagcgtcttccagttcctttgccatttcagggtattcctttatcagattatgttgttctgtgcggtcttctttgatattatagagttcccattcatcacctctaaaattcgcagagaccagtttccagtcacctttgcgtaccatacgattaccttcatgttccgcatagatataacggtccggcatttcttcaccgcgtacaataggaaggattgacttgcccggtgtaggtacaatctttcttccttcgtattcttcgggatatttagtccctgccagttcgatgcaagttgccatgatatccgagaattgtgccggttgatggtcaatactgcctttgtgcttaatctgtttaccccactggataatgcaaggagtggatattccaccttcatgcgcataatgtttataaagtgtaaatggggtacaacaaacgtttgcccagccggttccgtaatgatgataagttcccggtagtcccatctggtctaattcagcaccaacatgagtatgatattctgttccagtttgcttgtcgaaaccaaattcatgccattcggcacaagctccgttgtccgacatgaacatgataaatgtattatccagttcaccgttcttctgtaaagtatccaatacccgaccaatattggtatccataatatctatcatggcagcataaatagccatacggcgagccaggtcagtctgctgttcctttgttaaagaatcccaggcaggcagcggatgtgtctcatcctcaaacaaactttcgggaacaacaccacgcgggcttaatgctggttttccttgcaaaagccccatctttactattcgtttccaacgttgatctcgaatcttatcccaaccctgcaggtaaatcttcatatatttatccgttacttctttcggagcgtgcaacggaaaatgagcagcattgtatgccaaatacagaaacaaaggtttttcttcctgatgtgcctgattaataaagtctatggcataatcggttattacgttagtagcataaaattctccctctttatattgacgtgggttacgatccttaggcaatcgggtatatacgtccggattccaaaaagaattgaatccacctaacaaaccataatattccaggaaacctcggtttatcggattggcggttttgcccagatgccatttaccggacatggctgtgaaatatccggcatcttttaatacttcggcaatggtaacgttgtcagaattggaacgaaagccggcatatcctttcggccatgccggacgggttgcatccatgtgtcctaaccctgtctgatgcggataaagtccggttaataaattggcacgtgacggacaactccgcgcactgttatacatttgtgtcatacggacaccctgtttggccatcttatccaataccggtgtctgtacttctcctccgtagcaacctaaatcggagaaacccagatcgtccgccaatataacaatgatattaggcttttcttgtgcaaaagtcattgctccgaaagccaatcccccggttatcaatagtgatgttttcattttgcctgataattgtgattaggtttaaattttccgttttcataaagcatcggaatcaatcccggccgacatgtcactttatattcggccgcctgtgcgccacgagggttaaaaaacatggttgcccaccagttgccatccttatcctgaaacagattgttgtgtccgccgccggtaattgcgttataccgtttaccataaggaccatatacattgtcggcagtggcaatgatacaatcatagctataacgagttttcttattagttaacccttccttctcgacataagtgtcccccttcaccgtgcggtgtgcccagatagcttgtaccaaatgatattttccatcatatttaaagatgaatgctccttcaacatacggctccggagagtatttactttcttttaatgtctttatctcttctgccaaaccactcatatctggtttcatgcgtgctatatagtggttgtgaccgacaaaatatacggtaccatccgtatcttcaaacaggcttccgtcaatgtttggaaaaatggctttatcctcgttaccttcgatattttcataaggtccctccggcttcccggtagtactccgcagaataaaagagcctcttccgcctgccgattgattcatgcaggctacaataaaccaatttttcgcactctttatatagtgcatttccggtgcccatacagcgtggaaacggttatccatcggatcattattgatagacttcttcgcatatttctctccctctttatatactttgggatctttctgccaggtaccgtctttttccattgaccagattcgtcccatggcttcccatatcttcaggtctttggagcgccaaagatacaaaccgtcattccaatcccagcaatgtctctgtcccggaaagtgacggtcgggggtagaagtggttccagtgatatagtagtaaccgtcggggcctagtgttgcccatgtgtcacgcatccagtagtcaaatgccggttgaacagattttgggacacgcagctccggagcgtttgtatcagcagttccatatgcttgtgccgatgctgtgctgactgagacaaatcctgtcagtaaagcaagtcctaatcgcaatataaatttcatagattacagttttattatttacggatacaaaagtagactgttacaggattgagctcatggaacaatgtctttaatatccgtcaatatgtacattcttttgatttattattgttcgggttggagataattataaggatcctgtttaaaatgataacgtttccggggaagagggagtggatcctgcagacgtaattcccatgcgactaacttcgtcagaagctctgtctgaacagcagtgtatttctttttaccaaacaggttatctacttccgaaggatctttcttaagattatatagttctccgtttccatagttatccatcaccagtttccagtcgtcttttctgaccatacgagaggtaccgctttgagtccaggtattgagttcatcaaagtatgcaatcttacccggcgtcaatgccccttcctgttcgaaagtaagagaagaatccagtccgacatgtgctcctccaaaaccttgttgtacgacaatgctggaaaactcttctttggggtattcttttccggtcaacatcggccataagctacgaccttgaacaccagccggaatcttggcaccgattgcagaacaaagagtaggaaaaatatcagcaattgacacatggctatccataggggctgattgattcttgacatgatatcctgcccataccatcgggatacgtgcgagactttcagaaagtccggctcctttgcggatcaacccgtattctccccaataatcgccatgatctgaaagaacaacaaagattgtattttcaaactgcccgctggcttttaacgattcgatcagtctctttatctggtcatctattaaacggatcatgccgatataattagcacggattctgggtaggtcctgttccagattaggacaagacgcatcttccagttctgctaaaatgcgatatttctctcctttcttttccaagtctttacgtgacgtcttcaatacgggaagcttatccggcgaaaacatagaataatagggttcgcaaacctgataaggattatgaggttccgggaaagatacccacacaaagaaaggattctctttttgactctctatccatgacaatgtctcattaacgattttagcagggtgttgctcctctacaggaattggcgaaggttccagccattgtcccctggctttctggtttaagaaacgagccgtctctttttcttcgggagtcgttttcttatttttaccccaatgcccgtattctgaccaaaagtccaagtcagcaggtttcagataagcatggtttttacctacaagtgctgttttatatccgttttcttttaatacgcccaccaagtcctgttcaaaaaagatatccggaatgttgtggttggtacgtacatgggttgccgaaggaaaacgtccggtgaacatggagcagcgggcaggagaactggccggtgctacagtatatgctttgttaaaccatacattttcctgagctaattgatctacataaggagtaactgccagaggaaaaccttctctgccacataggtcagcacgctgctgatcggtcataatgattacaatattcggcttgtcggtttgtgccatcaatgacatagacaaaccctgtaatgccaatcccgtaatacaaaacgctgcatttctcatatttatcttatttaaaacggtatacaatcattgaagaagcctcaagctgcaaatctttatttaagtccagtgttacggtcgactgaactggctttactgcatccggcatttccggagtgttattcttgccgggttccagactcaatgttattttttgtgcctgtatctttttcccaaatcctttcactgctgtttgaagtaccacctcctgttttctcaaattgatcagtttcaggatatattctttactttcactatcatatcccatcgtaacaaagacattctgcaaacccttcatcccctgaatcccagcatccaggcatacatcgaaagtgtggtctctgaacatttttgataaataatagaaagatgtcctgatgctgcaatctaccccattgattagcatagagtgcaactgacgatgctctgaaaaatcccaatggcgcatcaccggacgttctgccaataatggattcaagtctccattacgttcaagagacattcgcaccgctccgctggctaacagattatagggatacttcccgtcaatgcccaattctccaacaaacaaatccgctattccccgttcatagttgtcaaaacggtaatgctgcttgcaagcccattcgacaggttgataatggtgttcatcgaataccttcacattcttcgggttcacaaacttcgcaatatcaatccgtttgtcgtcattttctttgcctatgatactgttggctatgtatatcaagtcggggtactgtctgtgtaacgcttgataaatcttctcgtaacgttcccaataaacaggtccgaagtcttcgtttccaatttcaatgtactttagagggaaaggcttcggatgtccgttctttacacgtaaagccccccatttgctggtttccggaccgattgcgtattctatggcatccagtgcatcctgaatataagcatccagatcaacgtccggttgaatgaaattccagggagaactttgctttacccaacctgtacagatcatccctgtagggattacgtacatagcatctgctcccaaatattcgcacaattcgtaaaactcatgataaccaattccatctgtacggtagtaaggcgcccatttactccattgtcccggtcgattttcaatgggacctattgtctttttccagtggtacatggtagcttcattcaccccatgcacaatacatccgccgggaaaacgaatgaaatccggtgcatattctttcaagttctgcataatatccgcccgaaaaactgattttccattgtcccatgtatcagaagggaataaagagacgacatccagttggaattgccctttacctaacggctgaatggcaagcatcccccgtttgacatctttatcaggttttaatgttccggtaagtttcgtccactctttaccctttacatccaaaacaagctgagtactgaccggtttaccttgttcgtctaccagcataacttgaagaagagctgtataatttttgctttttatatacatggaaagatgataagatacctcctttcgtagattcataccgtaatatccccgatttagaatcattgcctccggattgtttgcaatatcttcagtcacgttgaccagcattgaatacttattctccttattcagaggattttcttctgtacggctaatgaaaatgggagtataagacagaggataagtgttccatccgatcagagggtctacatgaaatacatctttgttttttccacgcggattcggtacattctgataaagcccatttttgaccgccagatctgcgggtggagttgcttcttcgaatgaacggttgcgtaccagttcggcatgcaaggcaccttctcctatcataccaatctcttcataatggaacccatattggacacggcttactttgcgtgttttctgtttgtcgatatgcaaaacaccctcatgagtatcatttacctggcttcctgttatcggctggataaacataaaacagcacaggcaatacactgccgttctgcaaaattttgttttcatggtcttttcatttggtttacgatacaaatgtagagaattcaaagaataaacattcgtaacatcatgttcaatataaggaagcatgtattgtttgagcccataaagcttcgattgtgcacataatttctaatggaatatacatttgtactagaaaaaccgatagaaaaaagactatctttgagcgttaaacaaggagtagaatcagatatgaaaaggagtacactcaaaaatcttatatcggtagcagtttgtttattattcctgcttcatccgacatttgcggaaggaaaaatccaatataataatgtccgcttcaaacagctaagcattacagaagggctttctcataatactgtcaatgccatatctcaggacagtaagggatttatgtggtttggcaccaggaatggattatgcagatatgatgggtataatattacccggtactttcacgaagaaggggattccactacaatcagccatgattttatcaccaaactatataatgacccctgccggaatgtcctctggatttctacggagcaaggaatctgcaaatacaatccccagaatgaacaattcacacgctatcacatagagggaaacaataagaacagtgtcttatttctgaacacgtctgacagcagattgctgaccggatgcagtaacggcatctatcaatacgataatgaaaaaaacagcttcactccttttatattaaatgaagaaaaaggagaaaatattcgtggactggtagaagactcaaacaatgttctatggataaacagtaacaaaggggtgaaacgctataatctaaagaaggaacaatttgaaccactgcctctgaacatccgtccatttttggaaacgtgcattcaattagttatgttgcctggcaatcagttgttattcaatacacctcaagaggtatttgtgtacaatatcaataatgattcgctgtatcctctggccgcgatcaaggatatcagacaattcagatgtgcaacaactgatactatgaacaacatctggctgggaaccgaaaatggaattttcatttatgaccagacctttcggttagtgactcactatcagcagtcggaaagtgacttgagtaatctgaacgattctcctatttatagcctttttgaagattacaatcataacatgtgggttggaacctatttcggtggtgtgaattattttatatatgcttcggatcagttccggatttatccttatggaaactctcccaatcatctgagtggtaaagctgtacgccagatcatcaatactccggacaacgggctctatattgctaccgaagacggagggcttaactacctgaacagcaatcgggaaataacgcgttccgaacgactccatgaacggatgaatataaaagcccggaatatacattccttgctgattgacagtaaacagaacctatggatcggtctgtttcttcggggaatgaactattatatgcccaaagagaacaaaacgctttcttttaatgacggaatggggaaaaactcatccgggttctgcatcatagaagacgaaaccggcaaaatctggtatggagggccgtcgggactatttaccttgaagaaacagaacggcagtttccagttgaaaaaagtttctgcacttcctgtcttttgcatgcttaacctcaatgacagcattatctggactggaaaccgtcaaaatggaatataccagataaacaaacgaacagaagaacagacacctcttccacaattctcatccagtaagttgtatatgacttatttatatatggactcgcaggggaatatttgggcaggaacgaacaatgacgggctttttgttctgaataaaaaaggcgaaaaattgaaaagttattcgaagaaagaattgggatcgaacgctataaaaggtataatagaagatgatcagaacactatatggataggaacagacaacggattatgtaatattcagccgaaatccggattaatcagccggtataccatagccgacggactgccgaccaatcagttcaattattcctctgtctgcaagaaacccgacggcgaactgttcttcggaacaattaatggcatgatttctttctatcctgaacaggtgcgccctgtagaacctcattttaatatcgctttgacaggagtatggagcaataacgatgtcgtatcttccagcaatccggatgcgctactgcccgcctctatctctgaaagtgatgtgatgacgcttacccacgaacaggcacaatccatacgtatcgaatactcagggcttaattatcaatacaaagataaaacgcaatatgccatgaagctggaaggcatcgataaagaatggcagtttgtaggcaatcagcatcaggtacgtttctctaatctcccgaccggagattatacattgaagattaaagcaagcaatgacggagtaaactgggatgaaaaaggacagaaagagttgactatccatgtactacctccgtggtggctttctatatgggcctatctgacctacgtatgtatggttctctgcatcatctatttggcatataaatataccaaagccaggttgattcttcttatgagactgaaaacggaacatgagcaacgggttaatatggagaagatgaatcaatcgaaaataaacttctttacgtacgtatctcatgatctgaaaacaccgttgactttgatcctgtcaccacttcagcggctcatcaaacagaaacaaatcgataataatgatcgcgagaaactggaagtcatctaccgcaatgccaacagaatgcattatcttattgacgaactgctcactttcagtaaaatcgaaatgcagcaaatggaaattaacgtcagaaaaggaaacatcatgcatttcctggaagagatttctcatatcttcgatattgtatctaaggaaaaggagattgatttcattgtcagtctggaagaaacggatgaagaagtctggttctctccatccaagctggaacgcatcatgtataatctgctgtcgaatgctttcaaatacacccagccgggagattatgtgaaactcagtgccaagcttctcaaaaaagattcggaaaatttcatcgaaatatcagtaaaagacagcggcagagggattcctaaagagatgaaagataaaatctttgacagctacttccaagtagaaaaaaaggatcatagagaaggcttcggattggggttatctctcacgaagtcactgattcatatgcataagggggagattaaggttgaaagcgaagtcggaaagggatcggaatttatcgtcagcctgaatgtttcagaatctgcctatagctcttcggagaaatctttggaaagtatcacgtccgaagaaatacagaaatataatctgcggatgaaagaaacgatcgaactgattcccgaccagttgatttctaccgagcaagataacaccgacgtcaaagaaagtatccttattgtagaagataataaagagatgaatgattatctggcagagatatttagcaaagattatcaggtatttcgtgcttacaatggtgctgaggcttgtaagttactgaagaagcaactgcccgatctgatagtcagcgatgtaatgatgcccgtgatggatggtctggaattaacggcatacgtcaaacaggatttgaatagcagtcatatcccggtaattctgctaactgctaaaacggatgaattggatcatactcaagggtacttgaaaggggcggatgcgtatataaccaagccttttaatgcacagaatctggaactattggttcagaatatgcgtactaacagaaagcagaacattgagtatttcaagcggatcgagaagctgaacattacacaaataacgaacaatccacgtgatgaagtatttatgaaagagttagttgacctgattatggccaatatcaaagacgaagagttcggagttactgaaattattactcatatgaaagtgagccgaagcctgttgcataccaagcttaaatcattgaccggatgttctatcacccagttcatgcggactataaagatgaaagaagcaaagattcatttacagaatggcatgaatgtctcggaagcttcgtacgccgtaggaatgtccgaccctaactattttacaaaatgttttaagaaagagtttaatatcactcctactgaatttatcaaacaactgaatctgtaaattaaaaaacaaacttatatctaatgcttattaatatttaatacatgaaagtacatgtaaaatgaaaacatttagaattattgtattgctattagttctaggaattaatgctacagcacaagaaaatcaaaattttgctaagatactagatacttatgtaggtacttgggtttatcagaaaaatgataccgtatttaaaattaaatttcaaaaaggtcaacagctatggacaaaaaaaaccgcaaatggactttatggaggatattatctatcagtcaatggaagagtattggaagattatatgggagaacttcctacgtgttgggatgtattaaaagagtgtcagcctaataatttgtttatatgggcttacagtccttatactgatgaattaggaagtttaggtataatattttatgaccaacgtaaaagacactttggtggtaaggggattacaggtggatacatacagttattgtcgcctactaagattcgctggaaactggatgaggaaaaaggaatttggaatgagacagaaggtgatgaatctattagtgacgcaggaaggagaccaattggcttttctgtcccagatgacgttattatgacgaaagaataagtattgcgtggaatgtgtattgcaggaattatatgcccgacaataatttttcactaatagtcataggttataattagatgtaactaaaaatgcaagtacatataaaatgaaaacattcaaatttatcttattagcattagttgttagtaatactattacagcacagaagaatgtacgtcctactaagaatttggattcttatgaaggtacttggatttatcaaaagaacgatattattttcaaaataaagctacaaaaagggcaagaggcatggagaaacgatctaattaacggactttatggaggatattatctttctgttagaggagaggtattagagaactatatgagtggattccctgtatattgggatttttcaaaagaccctcgtcctaataacatgtatatttgggtttctaatcactcacttcgtttagatgatatcaatcccaattatgttagcgtttggttttatgaccaacgtaaaagacattttggtggtaagggaattacaggtggatacatacagttattgtcacctactaagattcgctggaaactggatgaattaacaggtatttggaatgagacagaaggtgatgaatctattagtgatgcagaaaggagaccaattggcttttctgtcccggatgacgttattatgacgaaagaatagatgctattcacatatgcagttgggcataagtaatgctggagaaagggtgtttcattatgaagtaatgtcatcatatactttggtattactacttccattattattaggctatatacagcagcaaacgtatatgtttgctgtccctttccattgcttccatatggtgtctttatcgtcttattattttctgcagcataggcttttcatcaaggattttttttagaaggaagcttcccgacaattatccaggttatcttgggagaagaatacttctactttgaaatttattgattctcattttctgacctaactataaatgatacagagagataaatgatagtataaatgccaccaaaatagctcgacaacttttttctcaaaagttgaaagtagataatttattggataaagagttcctatgctaaatttagctccggcttgtgcaataaataatcctttgcagtgcataaattaattcgtccgcctatagccggacgcaagtttgcctatagccgacgttgcgtttgcctatagccggacgaaacgttgtctataggcggacgaattaatttatgcacctgcggatattattttttataaagaaaatgtttattgtattcgacagcaatgattgtagtggttgggaagcagattcagaagcgaatcagaaatgaaccataataaagaggaaatatccaaattctaagtgttttttaatatgcaaacagcttaaatggaaaaatccccgataaaaaacgactggcaaatcaaaagcctctatttaatatatcctaaagatttcaagaagaccacagtagctgacatcgttttttcaaaaaattcttcaaacttagcattaaagaaaccgtgcttttgtcccggatatagcaataaatcgcaacgtgaccctacatgttccattttcttcttaaactttagagccgtttcaagcaaaacaatattatcctcactccctaaaaaaaatatagcaggaggagcatctttttttatattatgtataggagaaaaatctctataataatcttttactctgtcgaatccgtacccatgaggtccattatctataaccggattaaaaaggatcaaagctttaggaattgatgacacattaagatcatcctccggattattaatttgatgacaaaaagctgttgcagcagccaaatgtccacctgcagagccaccgcctgccaatattttatcaggatcaacatgtatggacattgcatgctgctttaaataacgcatagctgattttgcatccattaaagcttctttaggagtagtacctgcattcttttgggttcgataatcagctaatacaactgttactccatacttattcaaataactggcttgtgattcaaattgtttaggagaaccggaattccaacctccaccaaaaaagaaaataacagccggagaactctgattcgtttggtccttggaataataaacatagagtttacctgtaggatagtgattatatctcaaaatcgtatctgcacttaaatcattgttatctctaataaacaggttgctacctattaataggtttccactattaataagaactaaagataatgttacaatagcctttaattctatacaccgtattagtttaattcgcattattatactttttatcatttcattcaaattaacaggtttatttatatctgtcattggatagcgagataactgacctcatcaatatcaaagataaaacatttatcctcctgaatccattgtcccataggatgaagaccattagaagtatctacttcaatctgcacactgtttacacatcacttttgtttggaaggcatatgatcaaacgcccgcatttcggtagcttgcccttcgtctccacacgctttcatccatttctttagttctgcatccagccgaataataatattggagtatttcgtatctcctgccaaattgttcatgcaaaatggatcattccgtacatcgtacaattcaatggcaggacgatgctgatacttgaatgtcatcgcctttgcatgggaatctgtctctgcaagctgttcccattctttaaataaaggcgtagcagtcatcgcattctggaaggttgcctccggagtaaggttaacaatatatcgatatcttccatcataggctgagcgtatcccgtagtactccggacctttatttattcccctgctagtctgaagagagaaagaatatttcttatgctccttcttcttccctgtcaaaacagatttaaagctttcaccatctactctcgcctgcggttttcctcctgctatatctacaaaagtaggaactatatccacatattctactaatgcatcactgacactccccgatttgactactcccggccagcggacaatgcatgccgaatgtacgcctgcatcataacaagtccatttggcaaaaggcagactgtttccttgttcactcaaatatactacaacagattgatcagcgaccttttcctgttccagaatagagagtacgttaccaaactcctgatccataaagttgacttctgcaagatacttagtaaactcctgacgtgtttgtggaacatctacatacataggtgccaaagttaatttatccggatcgaactgtgagacatcacctttattccaaggggtatgtggctgattggaagcaacaaacaggcaaaacggctggcctttccttttgcaatcagcgataaattcctgaatagcttcaaaatgtaattcccccttttcactaggcacgtagagatcaaagggaaatactgactttggagcaacatgcttctttccaatcaaagctactttataccccaatggatgcaaatgatgcacaacgcttaaagtaccctgatcagcacaagtatggtttggataagctccgctacccacaggccataaacctgtatacagattatggcgggtaggcgatgacataggagcagcttgataggcttgggtgaaacgcactccctgtgtggcaaaattatctatattgggtgttttcgaatccacacttccatagcaacctaaatcgtaatatgaacaatcatcggctatgaacaacaccaaattaggctgcgtgatttgctgcgcaaaagagcaagttgtcgcacttaatgcaacagaaacactcaaaaatagtctattcataatttatttctcctttcatgggagtgcttaatttaaacatatatctttagtacccgggattttgctgtactccatcattgcgagaaacctctgcaaatggtatcggaaaatatttctttcttgcagccataactccttgcttttgtacatccgcagccggtcgtgatggaatgaatgtatcctttatgtagtcatacatctgcgtgttttcatcatacttcatacgaataaggtcgaaccagcgtttctgttcaccggcaaattccaatccccgttccatgaataccagccagcggaattcttgtttggtcaaggtacgtccgatattatcgggtctgtccgaacctatatacttcggataagcacgttcggttccgttcgctttgcgcgcacgttcacgcaccatatcgatagcctggcaggcttctgtgtactttccaagttcgttcaatgcttctgctcttataagatacatatcggacagacgcagacgtggcatatcgttttcattggtacggttattgataccttgcggatcaataaatttgcggatatatccccagttctcctgtgagttgcctccggcagcaggatatacggttacgatattgcccaatactcctgtattattgttcttttgttgaaaacgtctccagaatgtaacctcaatccggtaatctttagaaatgagtttggattcatcaatggatgcatcaacagaggggtcactgtatcctagattaccctgatcgtcctgaaaatatttgataaaccatttttgtaccctatgagctcctgctccttttccatagggatttccagaaaccaatttaccaccaacctgcacacctgccggattaaataaatgagcaatattagaacccaatgactgatctgctaaagcatctttgtcacgaaagaaaggtactgagaagatatgttcggtttgagctaatgactcttgctcaatgtcccataaattctgataatcattgacaaacgtatattgttcggaagaaatcacctcttgggcttctctggctgcatcctcccatcttccgagagtcaagtagacttccgccaaaaatgcatgagcagctccgttagttacacgtccgcttgtgtacgccggatctaaacgtttcggcaaacggggagtatcatcatcgttcagtccggctgcatattcaaaatcacttattatctgttcgtaaactttagatgcgggagattgtggtacatatgcgttttcaattccggtcacaggctcaataacaataggaataccattaacaccaccatacaagcgcattaagtcataatgataaagtgctctcagaaagtaggcttctgcaatgattcgattcttatcattttcacttttgaaggaaatagaaggaacacgtgctattacttcattagcgtttttaatgccattatatagctctccccaaaaattaacaactggagcggaaccagcactgtgtgtattgttggaaacagtggcaggtacagcatttccggtagagaacatagcgtcttcataggtcggaagtatgatagcccagtttgttttatgataagcgaaagcgtaaagagtggaatataccccgttaatagccgccaaggcatgatcttccgttttgaagaatccgtcctctttttctacacggtctacaatatctacatccaaacagcttgaaagcagcgctgttcctatcagtaaggataatatatatttcttcatattttcagtattttgatgttaaaaagctagatttatacccatagaatacgtacggctagaaggataagcagcatagtcaacattaggtgacatagcgcccgaagttatgctgacttccggatcataaccgctataattagtgattgtaaagacattggtaacggtaccgaatacacgtatactacgtagccatcgtagttttttcaagctaaactggtaggcgagtgtcagattcttcagacggaaaaatgaaccatcttcaagcaagaaggtagagaaacgcttgttaaagtaagaactgccttgcgaaccgtttactgccggataaaagttactggttccttcgccctgccatcttccttcccaagcctcagcacgaatattgtcgttggtatctgtaaaagaatccaagaaataacggttcaaattggcgatatcacctcctacacggcccgtgaaaatcatggataatgtcaggcccttccaagatagctcagaattaataccataattgaatttcggttctgccgtaccgatgatagtcatatcgtcagaagttatttttccatccggcaacccgtcgggtccactaatatctttgaatctcaaagaacccggagtagcttgtggagtatcaaatggagccagttttgcttctgcttcattctgataaacaccatccactacgtagccataaaagctgcctaccggataaccggctttagtgatatgtatgctttggctgaatacaccgccacctgccagataggaggttcccagtaactcattgccgctgatatcgtctactttattacggttcaggtatatgtttcctccaagagtccattttacgcgacctgtcagaatatccgcactggcttccagctcaaatcctttattggtcatttttcccatattgtaaggtatagaaccgtatccggatgataaaggcagtccaaaattcatcagcatatctttggtagtacgttgatatacattcatggttactctaaaacggttgtctataaaacctaaatccagtccggcattgtaggtagcagtactttcccaacctaaattaggattagccagcttcccgttgaccataccgtgagtcactgcacctccggaataagagcggacatggttcataatggcgagcggagcagcataagcaatgctttggttacctgtaacaccatagctcaaacgtagcttaatattagagatagcaggtatgtctttcatgaacttctcttgattaatgcgccaggctactgcaaatgatggaaagaaactccacctgtttccacttgccaacaaagaagaaccgtcgtagcgtccggttgccgtgaaaatataacggtcatacagggtgtagttcatacgtcctaagaaagaggaaagtttagtttgaatgactgaactggatttgtccatcgtattcgttccttctccgatagcgtagtacaacaagtcattgcctgcaaaatcacctacctgaattgccagtgtctttctctgacggtcttcatgcgtatatcccaagacagcattgatgtgatgatgcttcttaaatttacgatcataattaaccgtcgtttccaatacaatattctggcgattgtcttctccacgaaatgccataccatgggcactgtttccagcattggtacctattggataataagtagaacgcgaaccgtctgtgcggttgaagctaccggcacctttccaggaaagccctttaccaaagttatatgtcaaagatgcattcagtatgaagaaccgttgttgaagaatgtcttttagttcggtcgccataatataaggattgtctgccggaacatattccacattttcatcttcataaatttgatctccaggcattaatgtcggtttggtagtcaaaatacgccgtaccatttggttcatacttgaagattgagagtgcgacgtttgcttctgctcagtctgtgaataacttgtgttcagttgcaaaactaaacgcttggcaagctcagatttaagattcagacggaaagaataacgttcgagtccagtattcataataataccttcttgatcggtgtagccggcagtaatattatattgagtcatcttgttaccaccattgacagccaactggtggtcctgagatactgccgtctggtacattaagtcctgccagtcagttgaataaatcttatatctttccaaggcatcatctgtatgtctggggacttttgtacttggaatgacgtttccttgcatatcgtaaccgttagaggttcgatccaattcattctcaaaaagcgcatagtcatgagcattcagtaaattatagcgtttggcaatgttggaaatatctacacgggcattgtagttcacattgacttttccttcttttccctgtttggttgtgatcagaataactccgttcgtagcacgtgaaccataaatagccgttgcggaagcatctttcagaacctggatagattcaatatcattgggattgatggaagctagcggattcatcgccggctgttggcttaactcactggtgccaccatttacacttgctgttgcagcctctatcggaaaaccgtcaactacataaagcgggtctgtattgcctgacagtgtagagacaccacgtatttgaatattcatgcccgctccgggtgcaccactgttagctgcgatactgacgcccgctatacgtccctgcaagaattggtcggcacttgtgataggcataatctcagcttcattcttcatactgacagcacttaccgaaccggaaaggtctgatttgcgaacgcttccatagccgatgaccactacctcgtccaaattgcgtgatgcttcctgcattgtaatcgtcatcttcccttttaactgtaccggaacagttatagtagtaaatccgatatacgatatctgcaactgggccttgggattttttacttccagcgagaagttaccgtcaatgtctgtaatggttccgttgttagcacccttcacttggattgtagctccaatgataggagactttccttcatcaactaccacaccggaaattttatgagactgtgctgatacggttgatatatatcctaaaaagcatattagtaggactaagtatctatccgtcaacttaaatcgaatcttctgtttcataatattatattcgttattcattgattgttaaaccttattttaataagccctgtaatgtcgggtattcacttcccatttcccaaaccgtactgaaattccagtttgtgaatgaagatgtgttcttcatttcacttgcagacaggttcttataactggaagaaccacctgatatgtatgagtcacttccgctactctgtgactttccgtcttcgttcaaagagaaacagcttttcattgttatttgagaaatcttgccatcagtacgatggaacagtccgtttccgaaagaagccccgttcgcagttgtcatgtctcctacgttatgacagttttcgattgtcatgccacctcctgctgctatagtacatgtcgctacaattcctgcggcattgctgttgccattggtagctgtacctgtgctctttatcgcacctgtattgtagcaatctctgactatagcattggttccacccatacgtgcgatgataccacttgccgagcccatcgcagtgatagaaccagtattgtaagactgggatatttcggtatcaatagttgcacgaccgacaattcctcctacttgattgttagcctgagttccagaaatttctcctgaatttgcacaaccagtcactttgatcaggtcatttcctgctgctcccgctattgaaccgaccacacctccaaccggtgatttgctgctgcaaactacattcgctttattggtacaatatgcaacggcaggagcattgttagcatcacgcattatgattcctacaaccccaccgacacaaccggctgtcccttcaatagccgctgtattagagcaataggaaacttcgcctttctcggtgagataaccgacaattcctccgagatagatttcagcatccgtagttgcagccgtactgatgcttccctcattacctgttgtgtggcaagagataattttaccagaacagttaccggcaatcgcaccaactttggctttggccttgataacaacattctcgatacatacattacgtacgataccttctgcaccgatagaagcgaacaaaccgcaattagtattggaacttttattcagcgtccagttctttatcttatattgttcggaagaacgtcctgtaccggtatcgataatatctcccttagttgcttcgtatactccggtgaaattaccgttataagtgttattgaccagttctgtactgataggtgccatatctatgcctgtaaggtcaatatctacagtctgtttgtagttcttatcaagatacttgctgacgttcctcaaatgacggggcttcgtgataatatattcagatcctttttctccgtctccactggtctcgtcaaacagattgtgtgcctctataatttcacttcccatctgagctacagttcctccgccaatgtttgcgtaagagaataactgaatagaaaccattcctacatatcctttccagtcaataacatccagattgtaagatgccgttcccgaaggaatatcgattgtgttttcgttctggtctgcaatgactttcagcttatagccgtccacaccggtaatttcattccatgaaagcaggaaatcgttgtgatcatccaaagtaatgacaggagcttccagtttgtcggcctgaatgacaggaatactcagactcttgtcggcagctgtaaaaaccaaactggctttacgtaccacttctgtcgtattactctcggtagtgactttcaaagtggctgttccttttcctgtaacaggagttactgtacaccatttaaccggagtatgggtcggttcatccactacttcgacattccattctaccgcattggtttgtagagtaatatccttttcacctcctccaatgttatattgcagttctttagagtccgcagccaaagaagtttcgctggcttcttgctccacagttactatctttatctcctgcgattcattgataagaaaagtcagttctgccgtacgaggttcattccatggattctcagaatacgaaacaggcacttgggaatatttgaacccttctgtttctgatacgctgcaccatgcttgtgaactacttaacgtccatttatcatcagatatcactttcaatatataggttccctctggtcccggtacttgtagaggggactgagtgagctcgtttaaggtcaaataagtttcagcgacctttgcatccggttcgggatatacaatatcttcttgttgacaccccgcgaaacatacagcagtcagcatgatgacggctagtttacgatacttatttttcatatgttataaattaaagattataattccgatacttcttatttgagatattcttctacaggagtataccatttgccaaccttgaattcgatctcactttctactccgatatgatctgccattttttggtaatcatgaatcattcggttcagtatttcaggctccctatctgcgagattccgcatttcagtaggatcattcttcaagttgtatagcctccatttcggctctttatattcctgcactattttccattctccgtcacgcagcattttgttgccttcgtgttccacaatggtcggtttggtttgctttaccggttctccctttaataaaggcagtaaggatataccttccattggaggtactttatggccgccacgcgaagagggataagtagcgcctgtaagtttcaccaaagtaggcatgatatctactatatgtccgtaattgtctttttgaatagtgccgttcagacttttatcaattccattcggataggaaacaataaacggtgtgttgcaacctccttcatgaccgtgatgtttgtacaagaagaatggtgcattagcaacgtctgcccaggcagcacccagaaaaactgtactccccgctgaaccgggattctttccagcaaagcgtccttctatgcccggttctccatttccaccattgtccgaaaggaggataatcagggtattatccagcacacctttttcttttaaatgttctaccacacgcccgatactccgatctacttcctcaataacagctgcataaatagccatctgcatgtcatagcgctccttttcttcctgagtcagtgaatcccattccggaaccttgggattacgaggtgttaactggtcaggacgctcgaataaccctaattctaattgctttttgaatcgtgcattacgcacatcttcccatcccttcatatattttcccttatatttattgatggtttctacaggagcctgcaagggaaaatgtgcagcattatgtgccagataccaaaagaagggctgtttttcttcaatagcttcatcaataaactttaatccaaaatctgtccacaaatgagtagaataccaattttcaggtaaacgatcatcatcgaatccaatttcttcatcattcaaataaagatttcgttggttggttctttcttttttattcttcttcaatgatttgtcagaagaaaaataatagccgccaaacggagcgttcagtgaacggtcaaatcctctgcttattggagtaacaccttgaaaatatcctaaatgccatttacctgtcatgacattaaaatatccagctgttttcaatgcttcaggcaagaaaacattattctcatttggatatccctgatatgccggataacccggaactttccctaaagcaccattcccaacttgatgaggatataaaccagtaatcaacgaagccctggttggcgcactccgagcctggttataaaaatgacgtagtctaataccattttcagcaagccgatctatattaggagtatttatttccgaaccataacatccgaaatcggaatatccgacatcatccaataatataaggacaatattaggttttgatacattctgctgggccaatacaggacaagcacctattgacgcaccaagggtcaacataaaagtataatctattcttttcatggctatatattattttttattattaggaaatggaattaaaacttttgtctcagctgcccatacggcccatttgtccgataactgtttaaggatatccggatgaacggctgacaaatcacaagcctccacgcggtctttcccgatatcatataattcccaaacttttccttcctgatcccataccgctttccagtttttccaacggacagctctattaccctgatgttcccaatacatatattcatgaatggaagaaacttttccttttatagccggcataagatcagtgcccactaaaggatgtatcttattaccattgtgaaaggtagaaggatatgtggcaccagtcacattcagtatggtcggcatgatatccggaagatatccgggaacgtggcaccatgtattttcaaaacctttcaaacgatttttccatgtaattatcaacggagtagatattcccccttcgtatgcacgttgtttgtactttctgaatggagtatttgaggtctgagcccaagctttgccatacgaaggatggccgcttaccgccggattattgatatctttttgcttgccaccaccaagttcattatgcggttcggcacatgccccgttatcagacatgaaaaagatcaaagtattatccaactttccactctttttcaggctctcaatcagttttcctatgttataatccatacaatgcacttgtgcagcataaacagccattctataagctgtatgatctttttctgcttcagagagctcttcccactgacgattctcccattcagcaaaaccgatctctgagtcgattattcctaaatcggccatacgtttatggcgttctttacgaatctggtcccagcctttcgtacgatacagttcataatatttctctatatctgcttctttagcttgtaaaggccaatgcggagcattatatgctaaatataagaaaaagggagtattatctttttgttcatttataaaattaacggcatagtctgtaaacgcatcggtagtataataaggtgcctcgggtgcaggtaacttttcgttgtctaggaccaatcctctttcaccttctggcctcagataactgcaagcccctgccaatataccataaaaacgttcaaaaccacgctgcaaaggccatttttccatgccatgcatccctaaatgccatttgcccgtcatataggtatggtaacctgaacttttaagaacttcggcaatagtcacacaattacggttcaaagcccccctatattcagcaacaccccagtctttcggatctttatcgacatttttaaaaggatcttctgacatccatcctatcccagcttgatgttgatacaaaccagtcataagacttgcccgggttgggcaggaacgagaagtattataaaattgagtcagccggattccctgtaacgccaaactatcaatatgcggggtttctatctcgctaccataacatccgatatcggaataacccatatcatctgccaatatcataactatgttctgacgctcttgtcccgagagatttccaaactgtaaaaaggataaagcaactatgcctcctattctttttcgagatataaaattaccatccatcataatacatattgttttatatacttctattatttccacattggcttgataacattttctttatcaatcgttatactatatacgtcattttccttttttaatattaacggaacaatgcgtgtcttacgcggctgcacaattgaatctgaatgatgaacatgatatacatagtaatatcttccgtccaaacctttaaacaaatccccatgtccggagccgttttcgtggacgatgcttcggtgaatgataggattgtttgcatgcttcttccacggaccgtaaggagacgtagacgtagcatatccaacggcataatctatattcttgaaatgattggcagaatagaacaaataatataaatcatcgagtttgacaacagtaggaccttccattactggtgccgatttataattaggcgttctttcccatgcctccgtattatcgaaacactttttcagagtttcgggcttaatacagcctttctgcaagtcaaattcagctacccacagataatttcctttgttgaaacgtacatgatacaagtagtactttccatctgaatctttgaataaaaatgaatcgatatttttggccgtctcgtcaataggacgtatggagtcttgtctaaatggaccatatacagagttggaggatgccagtgcagtatgttcattagccgtatatgtcagataatacctatttccttccttaaataattgcggagcccagaatcctctttcaccataagcggaatctcccttgcgtagtatcaactgaagagtatctccattagcagtcttccattccttcaaatctgtagattcgaatatagcaaatccattaggttctctattgcgcgtacctgtgagataatacttgccattttctacaaatatagtcggatctgcaaaggtaatttcattcaatttatcgtctgttttttcttcttttgcagtcttgcaacatacacaagctaaaatggtgaatgtcgccaataaaaattggatgagtgttttcatatgattctaaaaagttaaacgttatttatgtatgattgtgatgcagcaaaagtaaaagaaaaaaggtgtagacgatagaaaatatgttttattatgagcacacatgttcagaaactatccttctacaccaattcctgcaaaacaatctaatacctaaccaatcaaatgctttccagaaagggttatcgggcttattttaatggttcttcttccacctcactacgataaaatccatctgtttgcacaaaaaattcctgctttaaccgctcaagcagttccggatgtctgccagctacattagatttctgtcccttgtctgattttacatcaaacagactgaattcatccaagttccccaattcatttccggtcaggtttctttgcgaacctttataaggtggcatcataatccagtcaccactgcggtaacccagtctgccttgagcttcgataaccaaattttcacgagctttcagttctgttcccatgaatgcatttaaatagttgcgactatccagtccatccggcagagtggctcccaccatgcttcctaaagacgccaacaagtccatttggcagactagtgcatccgattttacaggctgaatctttcctttccaataaatgaataaaggaatatgtgtacctccatcgaacaaactatatttaccaccacgtaatcctccggcaggagcgtgcttgccagccagttcgggagcaccatctttatatccatcattcaaaaccggaccattgtcacttgaaaaaataatcagagtcttttccagaagtccttctttcttcaaataagttagtaattcacccacacaccagtctgcttccacaattgcatctccacgaggtcccatagtcgttttcccaacaaaacgttgatgaggcgcgcgtggcacatgaggttcatgcaaaccataataaagaaagaatgaagagtctctgtgttcagtaataaagttctttaccttgtctacaaaataatcagccatatcttcgtctttccaacgggctttcttcccacctttcatataaccgatacggggtattccatttacaatcgaattattatgtccgtgcgcccattgcattttcagcatttcgggattggatatagcagtcggctccccctcaaagttctgttcataactcacctcaataggatctgacggatcacgacctaccacatctccattttctacataaacagtcggaacgcggtcatttgttgccgcaatcagacaagagtaatcaaagccaatctcttttgctcccggcttgactgtctcattccaattgacatttccatttcccatgcccaaatgccattttccgatagctccggtcacataaccacactctcgcatcatctttggtaaagtgtattggctctcgttgataataagaggagcatcacccggaaggatttttgcatctttattcttccatggatacattccggtcattagggcataacgactgggggtagaagtagccgaagtagcatatccatttgtgaaacaaactcccccacgggcaagactgtcaatattcggtgtatgaatagtagttgaaccataagcactgacatcaccgaaccccagatcatcagcaagaatgacaatcacattcggcttttcttctacctgctgtgaagtgcaacctgctaaagataacgcaggaacaagatagattatttttttcataat

SEQ ID NO: 50 - DNA, 55828 bp, Bacteroides thetaiotaomicron
gtttttcttttagttgtatttagtgtataaaggaagaaattaatgatgaaaaactatattcaacagatcatagagttattcgggcataatgagtattcattggctacgcgtagaaaagtgcagcgatggttggctgacgacaatcatgcggaagaaaaaaaagaagcacttcacacgttgtggcaacaagcgggagaacagaaagtacctcgcggaatgcaacagtccatattacggatgcaacaaaatctgggaatgcagtctgtcggttccggtaaaaagtatcagttacttatatggagagcagcagctattttcctgttggcagtatcgtctgtttctatctatctgatgttggagaaagacaaactgcaaaaagacttggtagaatgtttcataccaacggcggaaatacgtgaacttacattgcccgatggtacccgggtgatgctaaattcgagaagcaccttactgtacccggagcagtttgccggtaagaccagaagtgtatatttgattggcgaagcaaatttccaggtaaagccggatgaaaaacatccttttatagtgaaagccaatgattttcaaataacagctttaggtacagagtttaacgtgaatgcctatccggagaacaatgaactgattgcaactctgctggaaggtagtgtgaaggtagaatttaataatctgatatctaatgtaatacttaaacccaatgagcagataacgtataataaacagacccggaaacgtagcctccaatcgcctcggatagaggatgtgactgcctggcagcgtggagaactggttttcagtgatatgcatctcgatgagatttttacgagtctcgaacgcaaatttccctatacctttgtttatagccttcacagcctgaacaataaatcgtatagtttccgtttccaacagcaagccactttggaagaggtgatgaagataataacgcaggtggcaggggatgtgaaatatataattaaggggaataaatgctatataactgataaaatatagaaaaacgattgttgaaccttttttaacttaatgtactatgcaaaaaagtatccggaagaaatggccgtttctcccggatgtgaaatcattgtccttctaatattagcgtatctcgacgctatttcaattgatcatagaataataaccaattaactaatactaaaaagatgctacaaatttacgaaaaaagagcagataatgttgttcaaaagcgagtctttctcatttttttaggtctattattgatgcagacccttgcttttgctcaaagtgatagtaaaattactatccagcagaaagatatcactgtagtagatgcattgaaaactgtggaaagacagtcgaagatgtctataaattatagtgattccgaattgaagggaaagaaaattgccgatcttaacttggaagacgtatcggtgactactgcactcgacgcaatcttgaaaggaacaggtttctcttatcagattcaaggtaattatattatagttacggagaagaaaccggcagctgcacaatctgtcaaagatatcaaagggaaagtaaccgatgagaatggtgaacccctgatcggagtaaatatctctgtggacggcagttctacagggacgattacagactttgacggaaacttttcgattaaaagtcccggtaatgcccgtttgaaaatatcttatataggatatgcaactcaactgattgctgtttccaataaggacttttacccgattacaatgaaacaagatacggaagtgctggacgaagtagtcgtgacggcattgggtatcaagcgggcagaaaaggcactgtcttacaatgtgcagcagataaaaagcgaggatataaccggcattaaagatgccaacttcatcaattcactgaatggtaagatagccggtgtaagtatcaacaagagtggtagtggtgtcggtggtgcgacgcgtgtcgttatgcgtggcgctaaatctatcgaaggcgacaacaatgcactgtatgtagtagacggtatccctttgtttaatactaatatgggaaacacagatagtggtatcatgggtgaaggcaaagccggaacggaaggtattgctgatttcaatccggaagatatcgagagtatctctattctgagcggaccttcggctgctgctttgtatggtagtagtgcggcaaatggtgtcgttctgattactactaagaaaggacaggaaggcaaattacagatatcattttcttcttcatccgaattcagcaaagcgtacatggtgcccgaattccagaacacgtatggaaataaagaaggtatgttcgaaagctggggtgacaaactggcccgtccgaattcgtatgatcccaagagtgatttcttcaacaccggaaccaactttatcaactcgttgaccttgtctaccggtacaaagcagaatcaaacttttgcttcggtttcatccaccaattcaaaaggtattgttcccaacaattcttatgaccgtctgaacttcaccattcgcaatacagccacttttctggacgataaattgcagttggatttaggagcgtcctatgtgaaacaggaagataaaaacatggtatcgcagggacaatactggaatccggtgatttctgcctaccttttcccccgtggagaagacttcgaagatatcaagactttcgagcgttatgaccagagccgcaatattccgatacagtattggccgattgccgatgcaacctatggttcgcagaatccgtactggactgcttatcgcaacatcgcaacgaacgagaagagccgttatatgtttaatgtcggtctgagctataagatcaccgactggatgaatcttgccggacgttatcgtatggacgatactcatgttcagtttgaacgtaaggtttatgctacttccgatcagaaatttgccgaaggaaagaaaggtctgtatgattacagcaattacaaagaccgtcaggagtatgccgactttatgttaaatatcaacaagcagttcaacgattttaatatttctgccaacttgggttatagctactctaactactggtcgctggcaagaggctacaaaggaaccttgctcggagtaacaaacctgtttgccgccagcaacatcgacccttccaacggtcgtatctcggaagacggaggtgacagtcgcgtacgtaatcacgctatctttgccaacgtcgaactgggctggagaagtatgctttatcttacattgacaggtcgtaatgactggaactcccggttggtaaacaccagcgaagaatcctttttctatccctcggtaggtctgtccggtattatctctgaaatggtgaaactgcccgagttcatttcctatttaaaggtacgcgggtcttatacggaagtcggttctccggtatcacagtcgggacttactccgggaactgtgaccactccgattatcggtggtgcactggctcccacaggcatctatccttttactgatttcaaggcagaacgtacccgttcttatgaattgggattgagtgtacgtttatggaataaactgagtgccgaagttacttactataaatcgaatacatacaatcagacctttattggcgatttaccggaattttcgggttacaaacaaatctatttgcaggctggtaatgtgcaaaatcacggttgggaagcatcgttgggatacagagacagtttcggagactttagcttctcctccaatctgaccttctcgcgcaatgtcaatgaaatcaaagaaatggtggaaaactatcgtactgacatgagccccgagcccatcaacgtacccgaagtaaggaaagacaacggacgcgttatattaaaagtaggcggcagcatcaacgatatatatgccaatactttcctgaagaaagacagtcaggggtatgttgaaatcaagcaagacggttcgtacggactcgaacaaggtgaacccgttttcttgggcaagacgtcaccggactttaatctaggatggagcaactcgctgtcatacaaaggattcggactcagcttcctgattaacggacgttttggtggtgtggtaacttcctctacccaagctattctcgatcgcttcggagtatccaaagcatctgccgaagcacgcgatgcaggcggtgtcttactgcccggacaagggagagtggatgcgcaatcgtattatcagctgataggtacgggtgactataccacttccggatattatgtgtatagtgcaaccaatatccgtctgcaagagctgactttgagttacaggttccccgacctttggtttaagaatgtgctgaaagatgttactttgtcattcattgccaataacccctggatgctctatagcaaagctccgcacgatccggaactgactccgtccgtaggaacttacggtcaaggtaatgactattttatgcagccgagtgtgagaagtttcggtttcggtattaaatttaaattataactgacccatgaaaaagataaatcaatataaactattagcaggaatttgcgctttgtcgctctttactgcttgtgacttcgaagagttaaacaccaatccgttcgagatgaccgacgaaatgggtataagagatggtgttgctgtcggaggtgctgttatggcgatgcaaagagctgtaatcaccgtaggaactcaggctgacgatacggaggccatcaaccagtatcaggttgcatacaatctgtcagccgattcgtggagcggatttttcggacagaataataactggtatagtggtagcaacaatactacctattacttacaggacaattgggtggcggctacctataccaactcatatacgacactgctgtcttcctggaaaaagataaaacaagaatccgaaaagaacgaaacaccggaaatctttgctttggctcagattctgaaaatatctgcttggcacaaaacgcttgagtctttcggtcccattccttacacccatgcaggagaacctgcactggtgatacctttcgacagcgagcaagttgcattcaatgccatgtttgccgatctgacggccgctatcgaagccttgacagtgagagcggaacaaggggcaactattgttgccgattatgatgccgtatatgccggtgatacgagaaaatgggtgaaatacgccaattcgctgatgttgcgtctggcaatgcgtatcagttatgcggacgaaacgactgcacagaaatatgcccgtcaggctttgaatcatccgtttggagtgatgacttccaaatcggacgaggcacagatgagcaccggagccggaatggtatttcgtaacaacatcgattggctggccaatcaatacaatgagtgccgcatgggctcttccatgttttcttatttgttgggctatcaggacccgcgtttgagtgcttattttgaagcttctcccagtgcgtatgcggtagcggcttttgatggaaaaaactatcaggcggtgcctcccggcaatgccaatcagcagaatacgatttataccgatttctccaagcccaatattacctcgaatactccgacttactggatgcgtgcttccgaagtttatttcctgagagctgaggctgcgttgagatggggaagcgaatttggtgatgcggaagcactgtacgaacaaggagttgccacgtcatttgatgaaaatggtatcagttcgtctgtagacgactatctggctttcggattgactccgattgcccataatatgagagcctcctattacagttacaatgctgcggctcctactactgcaacacccgcattcagcggtggaacggaacaaaaactggagaagatcatgatccaaaagtggattgcattgtatccgaacggtcacgaagcatggactgagtggagaagaaccggttatccgaaactgaatcaggtgcagaccaaccgcggacagggcgttactcgtgaaggtggtattcgtcgtatggtgtatcctgtaagtttctatcagtcggcagaggatagagccaattatgaagaagcattgaagctcttgggcggtcttgataaagacaaagcaactactcagttgtggtgggattgtaaaaataaaatctattaaactatgattcatatgaaaatgttaagacgattattatatatacttcctgttatagggataatgattgcgtcgtgtgtcgatatagagagcaaggactttgaacatatcggcggttacaacacgatggacaatgaagaaagtgcacagtattatgccgatcttcgtgcatggaaggcaaccagtcagggttacggacgtcctattttcttcggatggttcagcaactggtctcccgagggacctattcgtaaaggatatttggcttctttgccggacagcatcgacatggtatcgatgtggagtggtccattcggcttgaatgaagcgaaactggctgataaggagattttccaaaagaagaaaggcggtaagatcacggtttgttacattctgcataatattggaactggtattacgcctgcttccgtttcagaaaaagtacaggcggaaaacccgaatgcttccagtgaggaaatcacggaactggtcaataaggcaacagaagcttattggggatttaccagtggagagaaaggtgctgaagaccatatcgcagccattcaacgttatgccaaagcattggtagacacgattgttgcgactgattatgatggtctggacattgactgggaacccgataacggtggtgacggcggaagatatgtaggcagtctgaaagaccgcagaggtggtccgcgtggtgagtttctgcattatctggtagaagagataggaaaatactttggtccgatggcaaccgagcgtccgaatggtaagtactactattttatgattgacggtgaaatatggaactctaacaaagaatctgctccttattttgactatttcatcactcaggcatatggtgactccaatctcgatcgaagagtgagtaccttgcaaagctggtgtggagaatattacgactatcgtaagcacatctttacagagaactttgagtcatcctggactaccggtggtgtacttttgactcaggctgcttataaccatgccaatggtccgaaaggtggcgtcggtgctttccgacttgataatgactatgataatgcccgtgattacaattttgtgcgtcatgctatacagatcaatctgcaggcttatcaggaatatatggacaatcaatctaataaaaatacagaacagcaatgaaacgtatcaaaatcttatatgcaggtgcactagttgcattgtctttctctagtgtgggttgcaacgacagcgaaagcgatctgttggaaccgaaactttactttgaaagtaatgtgataagagtggaagttgaagcggatacctacgagtgcgaattggtgtcgcggctttcaacgatggtgaagagtaatgtaaatgtgaactatcaggtaggagggcaggaccttgtggatgactacaatcataaacacgggacgaccggacagcttctggcgactgataactatgaaatgacaggaacttcttcgaccattaaagcaggcgaactgtatgctgatccctgcggattgtcggtaaagaacattaccaagggggaagacggggtaacgtatattctgcctgtaatagtgaacagtacggacattgaaaagataagcagttcgagcgttacttatattgtagtaaggaaaccaattattattgataaggtataccgtatcaatccgggctggcttgatgtacgtctgccgactgcttataaaacaatgggttctgtcacctacgaagcattggtttatgccgaacgttggaagaatctgggcaccattatgggcaatgaaggtactttgattatgcgtaccggtgacttgaatcatcctgataacgagcttcaaatggccggaagtgttgcacttcagatgcccgatgtatctatattcctgttgaatcagtggtatcatgtagcgttcacttacgatgcttctgcgggaatggctactctttatctcaatggagagaaaatagcagaaaagacggtaggctcactgacattcgacttgaacgaacgtttctgcatcggttatgcttatgactatgaccggaatcgtaaatggaacggatttatgagtgaggttcgtttatggtcggtagcccgtactgcgaatcagattcgtgaaaatatgatgtttgtcgattcaggttcagatggtctggtcggttattggaaactgaatggagaagatatcgaacaacgggacggagtgtggtatgtgctcgaccagtcaccgaatcataatgacgcaacttccaataatggtttgcgtggtgaaaccggtggtagtcagtcttttgtagagccgacggtagtagatatgagggttcggcttgaataaatataggtttgttttctaggtagattaaatagcgggggctgaattctcaatgcagaattcagcccctattttttatttatatgaaatcctgattatttcttttatgtttctgtgaattactcggtaatatttttgttatattctacttccgtttatcttaatgtcggtattgggaaataaagttttgatacgttgcatctcttctttagtaattctgccggatagcttcaacctttcgattttcacttttgacagttcgtccggtatatcaatttcattaataaaggtaagctccaactgttttatttcttcaagtttcagcaggacggaagggaactctttcactctaaggttgatacccctgcctttggcatcggctttcaatctgtttatgagtccggtgttgtctgtgtttttctttttgaccatccagccaatttgtggtctcagtgcaaaattctcattgttttgtttgagtccgatgaaaccggaccacaactccagtggtgtttcaattacggtgtcattgtatgcttcaatatactttaaatcaacttttactatctcgctcggaagctttttacgacccacaatctgttttagattatttcttttcccctcattgtcgtaaggaaagaatttaatgatccatccatcaaaagtctcgggagctccgcatgactttggcgaatgacatttaaacatattgcgccaaaactcttggtttattgttccttttgatgccttcacaaactcctccaaaagaggttcaagttgtgaaatccaccattcgagtttatattcttttagtcctctggctttatttaaaactttttcccagtcttgtggtgtcccttcaagcgtgatttccggaataccgcaaacaatcattatggtgataaactcgaagtatgattttaccgtttccattattgttatttcagaaacagtcttttccaaagaggtcgttgtagagaaattacaagtgagtgtttcaaccaaatggcctcctacctcttttcttatctgttccgtaaactgcgggaaaatttcttcccataaaagactcgggtctttcagtttcttatgggattgtacaattaaagattcctttccggagaaatttacaaaatattttctcaaagactcatggttggcattcacatgttgggcaaaaccttgattaatcagtagccaaatcatatccggagataaaacgaacggcctatgatctgcataagcctgatacataccgcagaaaaaagaattatacccgaagtataataaactgtcaggagattcactcttggctattacattaaatggaggtttccagatgtctttttctgtaattcgaatggttgattcattgtcaaatagcatcagatatctgtagatttcatcaggggaagtcacgggatataatttttcgggcttggagagttgttcaacttcaaaagtaattccattttgagcaactatggaagtgctgcatagaatgaataaatagaatagtagttttttcataatactaaatttactttatggtttgtatttcaaatattttcctgttgatagattatagataacaatatacaaatatagtattattagaaatggaatcgctatgatatcgaatcttttttatgtcctgtgcttctaaaaaaataggcgcgtattattttagaggctgtttattcggaaaattatagtaagtttgctatggaatttgaatacaagtgtttcagcgtaagataatacatatcgatatggacgccttctacgcttctgtagaacagcgtgatcatccggaacttcgtggcaaacccttggcagtgggacatgccgaggagcggggagttgtggcagcagccagttatgaagcccgtcgttacggggtccgttccgccatgtcttctcagaaggcgaaacgtttatgtccccagcttatttttgtatccggaagaatggatgtttataagtccgtctcccgtcagatacacgaaatctttcatgagtataccgatataattgagcctctgtctttggatgaggcctttttggatgttacggagaataagaaaggaatctctctggcagttgatattgcaaaggagataaaacttcgtatccgggaacagttgaacttggtcgcatctgccggagtctcctataataaatttcttgcaaagattgcatcggactatcggaaaccggacggactatgtaccatacatcctgaccaggcgctggacttcatcgccggacttccgatcgaatctttttggggagtaggacctgtgacagcaaagaagatgcatttgcttggtattcacaatggtcttcaattacgtaaatgctcgctcgaaatgctgacggcccactttggaaaggtgggggcgctctattatgaatgttcgcgggggattgacgagcgtccggttgaggcagttcgtattcggaagtctatcggttgtgaacgaacgctggaaagagatatatcggttcactcttccgttatcatcgaattgtatcatgtagcggtagaattaatagaacgtcttcaacgtaaagagtttaaaggaaatacattgactctgaagattaagtttcatgattttagtcagataacccgaagtattacgcagtcgcaggagctgtatacattagatcgcatacttccactcgctaaagagttattgaaaagtgtggagtacgaacagcatcctatccgcttgatcgggctttctgtttccaatccgaaagaggaggcggatgaacaacatggagtttgggagcagctcagttttgagtttagcgattgggaataaagttcaggttttaccatcggtggaaattttatagaagctcaaatgaagtttctgtttataatcaacaggatgtttttcaaacggaacctctgtttactctgaatgaaggctctgtttgccctaaatagaaggtctgtttgctttgaacagagcgtctgtttcacgagagggctgagagcttctggatgtactttttttgaagtctgtacttttttgtcatgaggttcgtatgatttgctcaccttactttttgagagatgcgttatctttgccatacttaaacgaacaaaataccatgaatcgaatgaagcatttaatttgtgtttttctgttagctacctttggaagtttctctttcaaagccaatgcctatacagaacgcgatatgctgcaaaaagcggcagatgaaactacgttgaagaatgtgctggtaatgaaacaggcatgggtaccttatccggcctatactgaccgtgccgcttgggactcattgatggggtccaacaagcagcgtcttatcgcggcaggcgagaagctcctcgactacaaatggcaactgattcctgccaccgcctatcttgaatatgagcggaccggtaatcgtaaaatcatggaagttccctatgacgccaatcgtcaggcattgaatacgctgatgctggcagaactggcggaaggcaaaggacgcttcatcgatcagctactcaacggggcttacatgagttgcgaaatgaattcatgggtactgtctgctcacctgccccggcaaagcagcaaacgttctcttcctgatttccgcgaacagatcattgatcttggttccggcggatatggtgcattgatggcttgggtgcactatttcttccgtaagcctttcgacaaaatcaatccggtggtttctctgcaaatgcgcaaagctattaaggaacgtatcctcgacccttatatgaacgatgacgatatgtggtggatggcgttcaactggcaaccgggtgagattatcaataactggaatccttggtgcaactccaatgctttgcagtgtttccttttgatggagaacaataaagaccgtttggcaaaagctgtataccgttcgatgaaatcggtagataagtttatcaactttgtgaagtctgacggcgcttgcgaagaagggacttcttattggggacacgcggcaggtaaactttatgattatttgcaaatactttctgatggtacaggtggtaaaatatccctgttgaatgaaccgatgatccggcgtatgggagagtatatgtcccgttcttatgtcggtaatggttgggtggtgaactttgccgatgcttccgcgcaaggtggtggcgatcctctactgatctatcgttttggtaaagcggtaaacagcaatgaaatgatgcattttgccgcttatctgctgaatggtagaaaaccgtacgcgaccatgggaaacgatgcattccgctcgctccagtctctgctttgctgcaatgatcttgccaaagagactccaaagcatgatatgccggacgtgacttggtatcccgagacggagttctgttacatgaagaataagaatggaatgttcgtggctgccaaaggcggattcaataacgaaagtcataatcataatgatgtgggaacgttttccttatatgtgaataccattcccgtaatccttgatgcaggggtaggtacatatactaagcagactttcggtaaagaccgttacaccatctggacaatgcagagtaattatcataatctgccgatgattaatggtataccgcagaaatacggacaggaatataaagcgacaaataccacttgcaatgaaaagaaacgtgtcttttccactgatattgctgccgcctatccgtcggaagcaaaagtgaaaaactggatccggtcgtatacactggatgaccggaaactgacgatcaccgacagctacacgctggaagaggccgtagctcccaatcaggtgaatttcatgacttggggcaatgtcactttcccttcacagggcaaaattcagattgaagtaaaggggcagaaagtggaactggactatccgaccctgttcaaagccgaactggaaacaatccaattggacgatccgcgcctctctaatgtatggggtaaggagatttatcgcatcacactaaaaacaaacgaaaagaaagaaactggaaattataagtttgttattcaacaaattaaataggattcagcaagcagagtgaaaataagaaataacgtataaacaattaaatcgcagtaagatgaaaaaagtattattagttagtcttttggctatcgcaggagtaagcatcagtgcgcagaatctgatcaaaaatgaaaagtttgctacggaagtaacgaacaaggtaaccaatcctagcaaggctacggctggtgagtggttcattatgaataatgaggcggacggagtaacaacaatcgcttgggagcagactggagatgccaagtatccgaacgcgatgaaaatagataattcgggtgctgagaagaatacatcctggtataaagcatttcttggtcaacgtattacagatggcttggagaaaggtatctacgtgctgactttctatgcaaaagcaaaggaggcaggaactccggtcagtgtatatatcaagcagacgaatgaggaaaaaaatgataacggtaaactgaacaccacttttttcatgcgcagggattatgatgctgacgcccagcctaacgcttctggggcacagtacaacttcaagattaaagatgccgacaaatggacaaaggtcgttgtttactatgatatgggacaggtagtaaatgcaatcagcagcaaaaaatcaaatcctgctctggaagtgtccgatacggatgatgacgctgctatcctgaaagactgttacgtggctattcttggacagaataagggtggtgtagtagaaatcagtgatgtgactttgaagaagaaataaaaagaaagagcggagaaccagtgtggttgctccgctcttttcatgatatatattagtgtgtttaattacatggcaggctgcttcgtcagcagtttttgaagtttaccattcaaggtttggcacattgcaccgtttcccattgcttgataacgtttgatacggtactgtaacatcatgattttttcatttgcattctttttcataatttgtttcctctttttttgccctccacgttttgaagagcggttttacatcttgttttctttattaacactgcaaagatacaaaatgtttttgaattatatgctgtaaaacataaaaatcttctttttcttatgaattttctttttatgagaggttcggacacggagatgttacaaacctgttacaattttcccgtcctctttccccgatgacaatattattcttatctgtcacatttttatatacttatctaggcattcagaaaatattcttgtacttttgtgagtcagcaatcttattatctaaaataaaccaaacacttttatgaagacattcattcatcttttatccgttcttatcctgtctgttgtgctgtatgcctgcaacaatgctcattttctgaaagaagagaattatcggaatcaagtgaccgaagactttgaacagaaaaagcaggcacttcctcatggagacctgtttactgttttttcgaatcctgacttgtctgtatatgagcaggaagctctgatgtttctctatgcttatatgccgataggggatgtgacggattattcaggagattattatttggagaatgttcgtttgtccgggcagacgcgtactgagatgccttggggagatctgattccggatgaattgttccggcattttgtgttgcctatccgggtgaataatgagaatttggatgactcgcgtcgggtgttttatggagaattaaaggatagggtgaagcatctgtccatgaaggacgctattctggaagtaaatcattggtgccatgaaaaggtggtctatcgtccgagtgatgcacgtaccagttcgccgctggcatcggtgaagacagcgtatgggcgttgcggagaagaatccacatttactgtggctgcgttgcgttcggtggggattccggcaaggcaggtatatactccccgttgggcacatacggatgataatcatgcctgggtagaagcgtgggcggatggccagtggtatttcttcggagcttgcgagcctgaaccggttttgaatctcggatggttcaatgctcctgccagtcgcgggatgctgatgcatacaaaggtgttcggtcgctataccggtccggaagagattatgcttgaaacgccgaattacacggagatcaatgtgatagacaattatgcgcctactgccaaagctacagtgacggtgacggatacggaaggacatccggtatcaggtgcaaaagtggaatttaagatatacaattatgctgagttctatacggtagccacgaaatataccgatgccgaaggtaaagccttcctcactgccggcaagggagatatgttggtatgggcatctagggatggaaaattcggatatgctaaactgtcatttggaaaagaagatgctttgaagttatctttagataagaaagtaggtgaaagctatacacttccgatggatattgttcctccggtagaaggggctaaccttcccgaagtaactcctgaacaacgggcggaaaatgaccaccggatgacacaggaagattcgatccgcaatgcatatgtggcaacgatgatgacagatgaacaggcaaaagaatgggtgaacggactgtacggaaatatattgcaacctgaaactatgaaagataagttggcagcttttctggttgcttcgcgcggaaaccaccagacattgaaggattttctttcagctatcagaaaggagaaaaaacatatttcatgggaggaaatgcggggtatgtggttattagagaatatctcggcaaaagatcttcgtgacgtgacactcgatgtactgaacgatcatctgaaaaacacatcggatggagaaaagacggacactgatctggtgaaaagggcgttgctcaatcctcgcatagcgaatgagatgctgactccttataaaaagatactttatgatgcaatttctgaagcagtcttgaaatcggcacctgttgatgctgctcatgatgccaaagcattaatagaatggtgcagaaaagagattaagatcgataacgaactgaattctcagcagattcctgtttctccgatgggagtatggaagtcgcgtgtagctgatgagaagtcccgtgatatcttcttcgtagcagctgcccggagcatagggataccagcctggattgatgaagtgaccgggaaggttcaatatgtaagcgatgggctttctccgcaggatgtcaactttgagacttcgcagtccacacaatcttgtaccggcatgttgaaagccagctatactccgatacgttctttatccgatcctaaatactattctcatttcactatctccaagtttaagaacggcacgttccaactgctcaattatgacgaaggcgatgtagatatgggtggtggtgctacgtggtcgaatctcctgaaaaacggagtaaagctggacgaaggttattatatgatggtgaccggaacccgcctggctagtggtgcggtactctccaataccacattcttcactatcgaaccggataagacgactactgttgaccttgtgatgcgtgaaagtaaagatcaggtgcaagtgatcggtaatttcaattccgaagctacttatcgtccggtaggaggtactgacctgcaaagtatcctgcaaacctgcggacgcggctattttgtggttgctgttctcggagtggggcaggagcctaccaatcatgctttaagagatattgcagctttgcgcagcgagtttgaacagtggggacgtaaaatggtctttcttttcccttcggaagagcaatataaaaagttcaacacgcatgaatttaaagatcttccctctaccattgtttatggcattgatgtggataacagcattcaaaaacagattgttgatgcgatgaagttgaatcaatcaaccctgcctgtctttatcattgccgataccttcaaccgtgtggtctttgtttctcaaggatatacgatcggtctgggagagcaattgatgaaagtagtacatggattataaagaggagccagagtgcaataatcgttaattcttaccattaatacattgttattggaaaagaatgattacgtttgcagcaaattatggcaaagtacattttttgcatattagcatgcgcatttctggctttgggatttactcatatttccaataaagaattgcagggatttcagaaagaaactgaggtcccggcaattgatatgcaatacaatgcgggagcaaattgcagtgtctcttctgccggtttcgataaatcatgtaaagatactcattcattgctgactgacggaacttacggcagtaaggtcagtgactgcatttttgataacctctcttttccgagaagcattgttcctttcaagaatctgagatttaatacaaatactgcaataatacagatattgagctcactgaatacgttgcttccggaggaacgtctgagccatacctgctttgatgtcaattacactaaatattcgtgtaaatactacgtctatacattagcccatattcttatttaggctgcattatttttcattggcagggtgaggttttctctctgtccctccttttatttattgttcctataaacgtgtgatatatttcccggatacccaatcaagtatagggatcaggatattgtgttttcgttgtgaaacgggagttacgtcgtatagaagcaaagatgtataccgaagtgattcaagcaaataacatctgccaattgtttctatatgggtgatgaggagtgcccaatgggattttaactttcatgtgtgtctaaaatttaataatgatttgccattgggcgcctcttctttttttgaatactatattatcaaacctatattttttattgctatgattgatttattaatatctactttcgctatgatggggctcacctttctcatcggtttttttgttgcggcagtcatcaaactgattgcttatgcggcagattcttttgatttttatagttctcaccgtttggagctgctgcggttacatcgctggcgacaacaccggcagaaagtagaaaggcttgtcaggcagatgcctcttccggacgaagggactttaggagattatcgtgaagatttcagtcgtggaatcaaccggaatgtttccggctattccggttattatcatggagtaagtccgggtgcgtcggaagagaacctgatggattattattatccgcgggatacacgtgagttctttctcaaagaagaagaactggcgcatgtcaacaagaaaaatacaaagaaatctactatcaacaaacaataaaatgacatttatttatggaaaatattgattttgccaccctctttcagggtatcggcacaatgatggaaagcggctggttactggcttctgccagagtctttctggtacttctcggtttgttacttatctatctgggttggaagggagtgctcgaacctatggttatgattccgatgggattgggcatggtagccatcaactgcggaacattgatgatgccggacggtacattaggtaacctcttcctcgatccgatgctttcggatacggatgacctgatgaatacgatgcagatagactttctgcaacctgtctacacgctgactttcagtaacgggcttatagcctgctttgtctttatgggcatcggaactttgctggatgtgggcttcctgctccagaaaccgtttgcgagtatattccttgctttatgtgccgaactcggtacgttccttaccgtgcccatcgcttccgcactcggactgactttaaaggaaagcgcatctgttgctatggtaggtggtgcggacggtccgatggtgctctttacttcgctggctctggcaaaacatttgtttgttcctatcacggtagtcgcttacctgtatttgggactgacgtacggagggtatccatatctggtcaagctattagtgcccaaacgtttccgtgccattaagatggtgactaagaaggcgccgaagaactacgatgccaaagtgaaactggctttctctgctgttctttgcgcagtactttgtttcttgtttccggttgcctctccattgttcttctccctgtttctgggtgttgctgttcgtgaatccggtatgaagcatatttatgattttgtcagtggtccgttgctctatggctcgacctttatgttgggagtgttgctgggcgtactttgcgatgcacatctgttgctcgatccgaagattctgaaattgctggtattaggtatcgtcgcacttttactttccggtatcggagggattatcggaggatacatcatgtacattgtcaaacggggaaattacaatccggtggtcggtatcgcagccgttagttgcgtacctaccaccgcaaaggtcgcccaaaagatagtaagcaaagacaatcccgattcattcgtattgggagatgccttgggagccaatatctcaggagtaatcacctcggctattattaccggtatttatattacgattatcccttatttataaacaggtatgctattgcaggactataaatcgctgtttatcgcagttttcagctttttatagcctgaatggtatttatcactctttgggcggtggttacatttcgttcgtattcgtcgatatgtacagtgccgcccatcgatactgattcgtttttatacttcatatcgctcttgatgctttcccgtgcggagaaatgaaactcctgtattccggtttccgaagcaatgcgggcgatatttttttcgttcacgccacatccggcaagcaggataattcttccggaagcctgtgtctgcaatgcttttagcaaggggattccgagttcggcagtagcttgctgaccggaagtaaggatacggttacaccccagttcgataatctgctccaaagccttttcaggatcacggcatatatcaaaagcacggtgaaaagtcactgataacccttgtgaggctttcattaactcttgcattacaggaaggtcgatttccccgtttgccgtcagacaaccgaataccactccgtcagctcccaactgccgtgccatttctatatctttcagcatcgttctcacttcgatgggagaataaagaaaatccccaccccgcggacggataatgacatgcagacgagtcgttgtcagcatgtcgcgtgctgtcgatatctctccgtaagaaggagtcgtcccgccttccggaatacctgcacataactctacccggtcggctccgcctgcctgtgctgccagacagctttctacggaattggcacagacttcaaattggtactttttcataagctgatacttttagactgtatgctgctgcgtgatgctgcaaacatgagaagtgaatgatgataaattgaaaaagggcgaattgcttcgcccttgtattgaatcttcttttgaatatttacttatttagcgaagctgaccgcacgtgtttcacggataacggtaatcttcacctgtcccggataagtcatctcgtcctgaatcttcttggcgatttcaccggacaagctttcagtttgcttgtcatcgatcttatcggcacctacgatcacgcggagttcgcgtcctgcctgaatagcgtatgtcttggtcacacccggataagccatagccaattgttcaagatcgttcaggcgtttgatgtaagcctctacgatttcacggcgtgcgcccggacgtgcaccggagatagcatcacaaacctgtacgataggagccagcagactggtcatttccgtttcgtcgtggtgagcaccgatagcgttgcagatatccggtttttctttgtatttctcggcaagtttcatacccagcaatgcgtgcggcaattccggttcttcatcgggcactttaccgatatcatgcagcaaacctgcacgttttgccttcttcgggttcagtcccagttccgatgccatcacagcacagagattggctgtttcacgggcgtgttgcaacaagttctgaccataagaagagcgatatttcatcttaccgatgatacggatcagttccggatgcagaccgtggataccaaggtcgattgttgtccgtttaccggtttcgataatttcttcctctacctgtttgcgtactttggacaccacttcctcgatacgtgccggatggatacgtccgtctgtcaccagttggtgaagagccagacgggcaatttcacggcgaaccgggtcaaaagcggaaagaacgattgcttccggagtgtcgtctacaacgatttcaacgccggtagcggcttccagtgcacggatattgcgtccttcacgtccgatgatacgtcctttgatttcgtccgattcgatatggaataccgttacggagttttcgatggcagtttcggtagctacccgttggatagactggataacgatccgtttagcttctttgctggcagtcagtttggcatcatccatgatgtcgttgataaacgactgtgcctgcgttttagcttcttctttcagtgattcgaccagacgttcttttgcttcgtcggcagacagaccggagattgcttccagtttttctatttcctgatgttgcagtttgtccagttcttccttctttttgtcaacgataacaagttgcgcctccaggttttcctttacggcttcggcttccagctttttgcgttggatttcttcctgacgctggctgagcaccatttcacgttgtttcagtttattttccgcctgctgaatcttttgattacgcagtgccacttccttctccaaatcagctttcttgttcaggaatttttcctttacttccagcaatttgtttttcttaattacttcagcttctgtctccgcatctttcaggacactgtcgtacttggacttcaacacgtaccggaacagtacgtatgaaaggattcctcctacgacgaagcaagcaattgctgttgctattattgctatcattcttacattaatttagttatataaataaaaacgcaccgccaaatatcagagcatacatttgctcggatattgtgcagtgcgtggtgttttctttatcagtgaatggctcggtggcattattctttcttaaaataatcctccagcaattccgttagttcttttaccttttccgtatacggagtggtatcgttacgttgcattaattgcagtttctccaacgagaactgataggctaccatggcaataatcttttccggttcaaggtttttatagtattcccggtacgcattaagcctgatgtttacctgcttggctgcttcccgtaccatttcttcttcctctcggttaatggttaacgggtagtttgaatctgctatttgcaggtttatctttatcttatcgttcatacatctttcttctttactcgttcaataaagcgatgcatttatcgacttcacgcactaattttgacaatcgcagcttcgtctcttttacgtcgctgccgttaaggctgattgccgtagctgtttttaggtttgtatagttgacttccaattcatcatactgagcttgcaccttctcgttcttcaacttttcgttttcaagaagttttctcaacccggcattttcacgctttaattcatcgtgcaaatacattaaatgccgtagctgcgtttcaaaggtactcaataactttttttcttcttctgtcatcactacaccaaaattgtacacaaaaatacgattaactctgatattacaaaaacttttcgggagaaaatgtgctttttagccttaaaatagcggaatacgtgggcaaaggggatgaattatggaagagtatgcgtataaatcttttctttatgaacagcttgtcggaggtgaaaaatgcaaaaatgcagaaaatgcactccacaatttttccacacacaggcgcgcgtatataatatagtttacgcgtatttagttatgttcgtgtgtgtatgtgtatgcgcgtgcgcttacgtgtgtgcgtgtgttagggaggcccccgaaaaagtgcatttttgcatcggttaataacatagcgctttggggaggctaaagcttagctttacgactcctaaagctaagctttagctcacacaaagcgccgctttgtattttcagccggattgtttcattaatcgcatgacttcatattctcttttttcggcagattctagccggtaaatctttccatccacaccggaggcaccttctaaataaactcttctttttagtggttccgttcatctgattcgttcataaaataatgtgatttctattattattgagttctctgtcggtggataatcaagagatgaaatgaatcattctgttgaaggattatatccttttttaatgaaaaaaggggcgtttttgcgtcataatgaacaaattttgtcctttattgatttgtcgttttccttctttgctgagattttccagtaagtttgcgtaccgaactaacggactcaaattataaacataaacatttgtatcagctaaccatgaaaaagtattatttactatctctgatttctgcttctttgattggagcaacttgtattcaatgtacttctcccaaacaaaagagtggagagaatactcttccgcaaaagagtgaactgtttgtatcattgccggactattgtccgacaccggatggcatggccattgctcccaatggagatttgattctggcatgtcccaattttgcagatatcacacagcctgcttgcctgatgcgtattactaaggatggagccgtttcaaaatggctggatgtgcctgtattggaagaaaccggatgggcttctccgatgggacttgccttcaatgaagagggcgacctgtttatcagtgacaatcagggctggagcggtgcagagaaagcaaagaacaaaggacgtgtacttcgtctgaagtttgaaaatgaccagttgaaggaaactattacagtagcatccggcatggagcatcccaatggtatccgtatccgtaacggaaaattatatgtgactcaaagctctttgtcacagatcaaagacccttccggtctgcttgtcagcggtgtatattgctttgatatgaacgaccgtgacattgcagtaaccaatacttcggcagatcagaatctgttgactacggtaatcaccaagaacccggaagtacaatacggactggatggaatcgtgtttaacgaagcgggcgacctttttgtaggtaacttcggtgatggcgcaatccatcgtatcaagatggacgcggaaggaaaagttgtcagcaacgatgtctgggcacaggatacgactcagcttcgtaccacagacggtatgtgcatcgatgataaaggaaatatttgggtagcagatttctctgcaaatgccgttgcccgtgtagataaggacggaaagattcagcgtatcgcccaaagccccgattgtgatggaagcgatggcggactggaccaaccgggcgaacccatcgtatggaacggtcaggtgatcgtatcctgtttcgacctggtgaccggaccggacaaggtaaataccaagcacgacaagcctttcacactagctaaactgtcactggaataagccttgattaccaatctgaaaacacattatcaacccaagaacacattatctataatatgaaatactatctatcgacctttgccggctccgccatctgtggtggtttcgctttcggcatctggccggaactctggaagacttacggtctgatgggcggctggctggcggcaacgctgattatcggcatcatgtggtatatgaatcattataacggagcgatcttgaatcctccgggaaaaatatggctcgatcagggctggtgtatcggttctgccggtatagcctggggaatcgtccgctttcagggagacattaccaatttcttttatgcagtgcctacactggtctgttgtctgataggcggtgcactggcgggaattgtagtttggaaaatccgttcgtgcgactgtgcccgaaagataaaataaggaggagaacacaatgagcgaatggttacaaacctataatgagatgttcggtatgtatcatgccggaatcattaccactattttcggagcttttgccgtgacatttaccgtattgatgagctggcccaagctggtgaaggacttcggtccgataggcggattcatggcagccgcccttatcatcggaacattctggctggtcaatcataaactgcccggattcggcttctctaccggattgctgaatgatgccgacggcttgccgatgcaattcagcctgatccatcaggggaatcgcggcagtgccccctgggtagacatgggatgggcgattgcgatgggattcatctttgcagacgtgctctgcacaccgaaaggcacacgcggcggattgctgaaagaagcgtttccccgttgggtagttattatactgggcggcatcgtcggaggaatcttcgtcggccttaccggatacacgaatgcggcactctaattcaattaactgaaaaggaaaatataaaatgtatatattagcacatgacttgggtaccagcgggaacaaagccactttgttcgatgaatcggggctgttgatagcttcgcgtaccgctgcttatcctaccgactatgcttccggcaaccgggcggaacagaatccgcaccattggtggaaagccatcgttgacacaacacaggcacttctcgaactggtatcacccaatgatattgccggagtagctcttagcggacaaatgatgggatgtctttgcatagataaagacggtaatccgcttcgtccgcacatgctctattgcgaccagcgttcgcaggaagaagaagcaaagttgaccgaaaagatagacccgctccatttctacgaaatcacgggacatcggatcagcgcctcttactctgtggagaaactgatgtgggtaaagaagcacgaaccggaaatctttgcgcagactgccaaaatgctgaatgcgaaagattacatcaactaccgtttgtgcggtactatcgccacagacccttcggatgcatcgggaaccaatgcctacgatttgaaccgttggcaatggagtgaagagatcatagaagccgcagagctcgatctttctttattccccgaagtccgttcgtcgattgacgtgatcggagaaatcaccaacgaagctgcccgtgagacaggactgcttgccggaacacccgtcatctgtggcggcggcgacggtagctgtgccggagtaggtgtcggctgtgtggctccgggcactgcgtacaattatctgggctcttcttcctgggtagcactgacggtcgaaaagccgattgtagacgaacaacgccgtaccatgaactgggcgcatgtagtgcccggtatgctgcatccgtcgggaacgatgcaggcggcaggatcatcctacaactggatgatcaaccagctttgccagaatgaacaggcactggcagctcaatcgggacgcagcgtgttcgaactgatcgacgagcagatcattgcttctccgataggtgcgaataaactcctgttccttccctatatgctgggtgaacgtactccccgttggaacgttgatgccaaaggggctttcatcggtctgacgctgggacacaaacatggtgatatgttgcgtgccgtaatggaaggagtaaccttgaatctcggatttatcatcaatatattccgcaagcatgttcctatcgaccgcatgacggtgatcggcggctgtgctcagaatcctgtctggcgtcagatgatggcggacatctatcaggcggaaatccgtgtgcctaactatctcgaagaggcaacttcgatgggagcggccatccttgcgggtatcggtgcgggtgttttccctgatttctctgtaatcgaccgttttgtccgtatcgagcagacggtgcagcctattcccgaaaacgtgaagaagtacgaagcgtggatgcctgttttcgatcaggcttatcacgccttgtgtgagatgtacacagagatagcaaaaactgaactataacctataaaaatgaataagaatacgatgaaatctgtaattgtgccggctcccggcaaaatagaaatacgagaggtcgaaactcctgtcatcaatgcttatcaggcgttggtgaaaacagaaatggtggcactgtgcaatgcgaccgacagcaaactgattgcgggacattttcccggagtagatacttatcctctggctttgggacacgagaatgcaggaattgtagtggctgtaggcgagaaggtacgcaactttaaagtaggcgaccgtgctatcggcggtctgatctccgactttggcgcgcagggtattaacagcggctggggcggtttcagcgaatatgtagtggtgaacgatttcgaggtactgaaagaagaaggactggctacccccgaacagggatgctgggacagctttgaaattcagaactcggttcctgctcatgtgcagccggaagaagcggtgatctcttgcacctggcgtgaagtgctgggcgctttcaaggatttcaacctgactccgggaaagaaagtgatagtggtaggctccggtcctgtaggactgagcttcgtcaagttgggcaagctgttcggcttgggtcagattgatatcgtcgatatgcttcctgccaaactggaagtagcccgccggatgggagcagacaacggatatacacctgctgaaatcagcacgccggagtttatagctgctgccggtcgttcatacgatgccgtgattgatgccgtagggctcgatgtagtagtcaattccgtattgccgttggtaaaaatgggcggtgatgtctgtgtatatggtgtcatgacgaagaatccgacattcgatttgtcgaaagcgccttacaacttcgacctgcatatgcaccagtggcctacccgttcggaagagaaagcggctatgaccacgctggcacaatggattgaagaaggcacactttccgcttccgacttcatcacacaccgtttcaaaatcgaagaaatagaagaagccttcgctgccgtgaagcggggtgaagtattgaaatgtgtattgactttttaagaactaacaattaactaacatattaaacgactcaaaacaatggaaaagaaaaatataaacgaagtgattgcaaatttatcagtagaacaactggcaggaatgattgaccatacctttctgaaacctttcggaacggcggagaacatcgaaaaactctgtgcagaagcccgtcagtatcagtttgcgatggtagccatcaaccctgcggaagtggaaacctgtgtcaaactgctggaaggttcgggtgtacgtgtaggagcggccatcggtttccctctggggcagaataccgtagagtgcaaggcattcgaaacccgtgatgccattgccaagggagctaccgaaattgatacggtcatcaatgtccgtgctttgcagaagggacagacagacattgtaaagaaagaaatcgaagatatggtttctatctgcaaacctgccggtgtgatctgtaaagtgattcttgaaacttgctacctgactgacgaagagaaagaaaccgtatgccgcattgcaaaggaagcaggtgtggacttcgtaaaaacgtctaccggattcggtacggcaggcgccaacgtgcatgatgttgcattgatgcgtcgtgtggtaggtccggtgatcggtgtgaaagctgcgggcggtattcgcgacctcgatacggcactggcattgattcaggtgggtgctacccgcatcggtacttcaagcggtattcagattgtagaagcttacaaagagttgaagaaaggtctgtaatatccggttcagaaaggtaaatttaaggtaaacaggaatttgaaatgataagatcgaaattaataaagtggttgaagtgggggatggtatgttgcatgctcgtcccgttccttgcctggcaggcgaaggacacttctttccagccaaccgacacaaaaggttttatcgccgaaatgcagaagcagtttgcagaggttcagacgataaagaagaaagagaatcacagggaagagctggaacgtaaagtgagagatacacaccggatgttgatgcatgattatccggtttattatgactggtggctacaggatggaaatgatgcgaaagacataaaggacggaaaagatgtaaactggttcagaggttctttcagccggcagctttcccttcgtatgcagaaactgaatattactactgctgtcaatgatactccggaaagtattgaagcggctttccagtcttatctgaaagcgtgcgagagaagacgtgccgaacgtctggaaactttcactgccaatcagccggagattgtttttacgaagttcagaacgttgcgtccttctttctttgcttataccgaaggcgtttccgatgcccgtgccgagtgcaactactttgcaggcggttcgctgtcgaagattaagatgaacggtatctgggcggaggaagaaacactgctgacggacgaagacggtgtatatcgtgaccctaatcttcattttgacggtcagcacctgcttttctcctggaagaagtctgcaaaagacgatgatttccatttgtatgagatggatttaaagacacgtgcggtcaagcaactgactttcggaaaaggacatgccgatatcgaaggcatctacctgccggatgagaatatacttttcaactctacccgtagcgggagtgcggtggattgctggtttaccgaagtcagcaatatgtacctctgcgaccgtgaaggccgttatatgcgtcaggtaggtttcgaccaggtgcatactactacgccgactttgcttgacgatggtcgggtagtttacactcgttgggactataatgaccgtggtcaagtatgggcgcaacctctgttccagatgaatcctgacggaacgggacaggccgaatattacggaatgaacagctggttcccgacaacggtagcgcatacccgtcagattcccggtacacgtaaagtgatgactgtcttcatgggacatcataatccccagcacggtaaattgggtattattgatcccgaagccggaagagatgagaatgaaggtgtcatgtttgttgctccggtgcgcaagcccgaggcagagcgtatagatagctacggacagtttactgaccagttccagcatcctttcccgctgaacgagacggaatttctgatttcctatactccgctgggataccatatcggacatccgatggagtttggcatttattggatgaatgcaaacggagaacgcgaattactggttgctgattcgaagatatcctgcaatcagcctatcttgcttgctccccgtaaacgtccgttccaccgctcgacttctgtagactatacgaagaatgaaggagtatattatatgcagaatatctatgaagggaatggcttgaaaggagtggctcccggaacgatcaaacagcttcgtatcgtagaaattcaattccgtgcagccggtgtgggcgaggtgaatggtaatgatgagggaggtggcgcattggcaagttctccggtaggagtcggcaatgccgcttgggacgtgaagagagtgatcggagtgacggatgtatatcccgacggttccgctttctttaaagtacctgcccgcagaccgctttacttccaggcgttggacgataagggaagggtagtgcagacgatgcgcagctggtctaccttgcagccgaacgaagttcagagttgtgtaggatgccatgaacacaagaatacggttccggtggcaggtcatcgggtatccatggcaatggacaaaggaatcaaggcattggctccggaagatgaaatgggagaacgtaacttcagctatctgaaagagattcagcctatctgggaccgaaattgtatctcttgtcatgacggagtgaaacacccgatgagcttgaaaggagaactgaaggtagtggacaaacagagtaaaagaaaatatacggactcatatctcagtctgacgcatgcccgtccggatggtcccgacagagcatggagaggcgatgcccatcatcctgaagtaaactggatcagtgctttgtcccagcctactttgttgcctccttattttgcagggtccaacaagagtaatctgatcaagcgtctggaagagggtcatggaggtacgaagctgacaccgcaggagatacgtaaagtttctctctggatcgacttgctcgttcctcagatcggtgactaccgggaagcgaacaactggtcggatcatgatcgggagttttacgaccgctacgataagaagcggaaacaagcccgcatggaggaacaggagaatattcgccagtacattcaatctcttcaaactaaacaacagaaataatgaaaaagatattgatacctgttagtatcgtagctatacttctttgcgctagttggaaagaagatgcaaagacggtttcgccggatcgtttgtttctggcggacagtggaaagtccttgtttgtaacgaacagggcaggcaatgaattaatcaaaatgtcgtccgacggacagaaggcggaacagaaagtgaccctttcctcgcccgtcaacgccatgacacaagacccgtccggcaacctttgggtggtatgcgacggaaacaccggcatgatgtacgaactggatggaaagaaactttcggtgcagtcaaaaacaaagagcggtgctacgccttcggatatcttgtacagtccggtgtccaaatcgctttgggtgacacaacgcttcaacaatgagttgtgggaaattgatccggcaacccgtaaggtaaagacaaagattgcggtcggtcgtgaaccggtggctatggctccgtttgcgggcgactcttgcctgctgattgccaataatctgccggaaatgtcctctacggcttatcctattgcagtgcagctcgatatcgtagatgtcccttcaaagaaggtgacgggacgcatcatgttgccgaacggcgctaccgatgcgaagtctgtagcggtagataaaaatcagacgtatgcgtatgtcactcacttgattgcccgttatcagttgcctaccaatcagctggaccgcggatggatggctacgaacacgctgtccattatcgacctgaaagctggaaaactgctgacttccgtattgttggacactccccagaagggagccgccaacccgtggtcggtgattgtcactccggatgataaacagattatcgtagctgctgccggaagtcaggagctggttcgtattgaccgcattgctttgcacgaacgtttggcgaaggcaaagcagggggagatggtgactccttccgtgaagtcatggaataatattccgaatgatgcgggattcttatatggtatccgcgactttatcccgacacaggggaaaggcccccgttcggtggttgctaccggagataagatttacacagccaactattatacttcggaactggtgtctatggatttgaacggcaagaatctgaagaagcaggttttgggtgcaccgctggctttcacgaaagtcggaaagggtgatatgtatttccatgacgctactatttgtttccagaactggcagagctgtgctacctgtcatccgaatgacgcccgcatggacggacttaactgggacttgctgaatgacggcatgggaaatccgaagaataccaagacactcttgctttcgcatcagactccgccctgtatggcgaccggtatccgtaagaatgccgaagtagcggtacgttcgggtgtgaagtatattctgtttatggaaggtgaagacgaaatatacgaatccatcgacgaatatctgaaatccctgaaaccgttgccaagcccataccttgtgaacggtaaactttccggtaaggcaaagaagggaaagaagatttttgaagaaaactgtgcgagctgccattccggagagtactatacagatcagaaacagtataaggtagactggacaacgggtccggacaagggactgtctatggatgttccggcactgaatgaatgctggcgtacagctccctatctttatgacgggcgcagctattcaatgaaggatatgctgaaagttcacggacctcataagcctgtcactgagaaggaattggaagaactggaagagtatgtgttgtctttgtaaagaagatatctgtttatattaatacttagaataataatgataaagatatgtagtgttgcgtttttgtcgcttctgctctctgcctcttctctgtttgcacagaccaagacgtttgccggagccgattattcgcagggaatcgtatttgtgatggaaaacaaccaaatggtgtggaagcacaaagcgcccgattccaatgatttgtggatattgcctaacggcaatatcctcttcaccaccggacacggagtgctcgaaatgacccgtcagaacgataccattttccattatgaatcaaaaagtccggtctttgcctgccaacgcctgaaaaatggtaatactttcgttggcgaatgtgttacaggacggatgctggagatatcccccaaagggaagattgtgaaagaaacctgcatcctgccgaaaggtgtgaaggatggcggattcgcattcatgcgtaatgcacggcggctggataacggtcatttcctcgtagctcattatggagaccagtgtgtgaaggagtatgatgcaaacggcaaggtggtgtggaagctggatgttcccggcggtcctcattctctgactcgtctgcctaacggacatacgctgatagctgttgccgataaagatcagaaccccagattgatagaagtgactccagaaggaaaaacgatctgggaaatatcgaatgcggatattcccggaaagcctttgaagtttctcggaggttttcagtacttctccgacggacgtttcctgattacgaactggacgggacacgtgaacccgaaggagaaagtacatctgctgctggtagaccgccagaagaatgtgctctactctctggagaatactccggaactacagacgatgtcttccgtatatagtacagacaaaccggcgggggtagcttcgtatcattaattgatgtctgtggcataaaaaaaacattgaagtttgcaatatgaaatattatcggataaaatgtgaaatctataaagcggcaggaaagagctgggaacgaatggcggaagaattacttctgtcagccgttcgcggggaaggaaaggaacatgggggaaaagtggtccgtcttgtattctttacattctgtgaggataatcgggaatatcagctccaacggtcttttctggaacaatgggtggacgatcatttcgtttctccccgtccggttctttcgctcgtagcccaaaagcctttggtgggagaactggtcatggaagtccattcgttgccggcaactgccggtgaggaagtgacggtagaagaacagatgacttcttccgtccgctaccttcgggttacttccggtcattatcgggaaataatagcgggaggactttatgccgacgatttgactcttcctgtccgcgaacagtcggagcaggtgttcgggaaagcggaagaaattctgaaagcggagcagatgagcttcggtgatattgtccgccagtggaattatctggaacgcatcacggatattgtgtacggcaatcagtgttatcaggattttaatgatatacgttcgcagttttatgcttcttcggaatgggcttccggatatccggcagccacaggaatcgggacgcagcatggtggaatactagtcgatttcaatgccgtcaaaggaggaatagagattatcccgttggataatgactggcagagagctgcccatgtctattcggatgaagtcctgatcagccaccggacggatgcggagaagggaactcccaagtttgaaagaggcaaatcgttgtccgatcatcaacaggagatgatttatatatccggcacagccgccattcgtggtgaagaaagtatcgtgacgggcgacgtgcttgtgcagacggaaatcacactggagaatatccagcatctgattggtctggaagaagggagagagaaacttccggaacattccggcaagctggaacttctccgtgtgtatctgaagcatgaagaggatgcgaagattgtaaaagaagatatggacaaactttgtcccgatgttcctattgtctatctttatgccgatgtatgcagggaagaactgcttgtagaaatagaaggtattgcttatttgtaaaaacagaaaactgatgaaactgattcgattgatcgcttctccgattttgatgtacgtattagcgggagtttatgcgttggtactggcaatcgccacttttgtggaaaattcgtccggtccggccgttgcgcgcgaatacttttattatgctccgtggtttattttgttgcaactcttgcaggctgtcaatctgttggccatgtttcttcagggaggttatttcaaaagaatcagtaaaggaagtctgatctttcatggggctttggtttttatttggttgggggcggctgttactcactatgcaggagtaacaggaatcatgcacatccgtgagggggaaacggtggaccgcatgatgcgcgatgaaggggcagggatgggaaatgcctccctgcctttttctgtcactctcgatgatttccggttaaagcgttatccgggctctcacagtccgatgtcttatgaaagcgatctggtgataaagaaggagaatgaagctcctttgcaggctacggtccggatgaataaggtgattgaagtggatggttatcgcttgtttcagtcttcgttcgatccggatgagcagggaacggtgttgtccgtaagttatgaccgtcccggtatgcagattacctatatcggctatttcctgctgtttgccggctttgtgctgactctgttcagtaagaagtcccgtttcgggcgtttgcgcagggaactgggggagatgaaaaagaatgctcctttctgtctgcttctctttttaggtttatccggtgctttgggtacacaggcgtcatatgcgcaggaaacgctttcttcttcgcagctaccttgcattcctgccccgcacgcccggaaattcggcagtctggtactgctcaatcctaatggtcgccttgaacctgtcaacagttacacttccgccattctgcgcaaactttacggagcggacaagctgaacagcatcaattcagaccagttctttctgaatcttctcgcttttccggatgagtggggtggctatccttttatcaaggtcgataataaagatattcttcaacggttcggaagagacggcaaatacatcgcatggcaggatgtctttgatgccgacggcaattatgtgctgaccgatgaagtgaatgccatctatgcaaaatccgcttcagaacggaaacgaatggattcggatttgttaaaactggatgaatcggtgaatattgtctaccgtattatgcaacatcaacttctgcctctcttcccggacgaaaacgacgttcagggaaaatggtactcggcaggtgacgaacaaaccgtctttcatgataaggattccctgtttgtttctaaaatcatggattggtatatctacgaattgggtaatggtgtccgcactaataactggaaagaagcggacaagattgtcgatatgatgcatatcttccagcaagctaaaagtaaaactcccgctattgacaatcagagagtaaaagcggagcttctctataatcagttaaacctgttcttctggtgtcgtctggcttacctgattttgggcggaatcttacttttcatagcctgcggagagattatcgcggatttcaaatgggggagcagactgagcagcatactgattgttcttctgatcgctgctttccttgcacacacgaccggtgtcttactgcgctggtatatctccgaacgtgcaccgtgggcgaatgcttacgaatcaatgatctgcacttcctggctgctcgttggcggaggcctcttgtttgcccggcgtttccgtattctccctgcgcttgccggactgttaggcggaatcatgcttttcgtggcaggactgaaccatctgaatccggaaataactcctttggttccggtgcttcagtcgtattggctgatgtctcatgtcgccattatcatgatcggctatgtattcttcgcactttgtgcgctgacgggactgtttaatcttatcttgatgaatctgctttctgccaccaatcgggtgaagcttctcttccgtatccgtgagtttaccttactgaatgaaatggcaatgattctcggcttattctttatgacggcaggaaccttcctcggtgccatctgggcaaatgtctcatggggcagatactggggatgggacccgaaagaaacatgggctttaatctctattgttgtctatgcactggtacttcatatccgttttatcccgctgctgaaaggtaaaacaacttggtgttacaatttgctgtccgtagtctccattctctccattatcatgacttggtttggagtaaactactacctgagcggcttgcactcttatggaaagaccgaagggggagatttactgttatggatatggggagcgggtttgtgtgttgtgcttgctttggccctctttgcacgcaggcgtttgaaaaagtattcatgattcggtaaataatagaattagccgcttgtgacatttttgtctttattctaagtattatacggggataaacaaaaatgtcacagcgtttgtaatcagtggtttacccctgaaaatgacttgtttttaaaataagtttgcaaaaaactataggatgtttttgtctttttccggatcaaaactgcatttttctttcatttatttgtgtttcagtattttaatcattctggcttcgcgattcctgctgttttctatttccgcatattgttccagttctttcgtcgttatgccccgtcccgtgtttaatcccatctttttatatacctgtctgagcatacttttcgcttcctgcacggatatttcagcacccacaggaaaagcacgttggatatatgtccgcatttgtccggacttcttaatcgtatgctcgctactcacatttagtgctgtccgcaatttattctcattataatcggcttcccttacaaattccgctccgaagcggcagaaacagtcgtatatatacctgtcggcggtagaagtaatcagattcatcaacatacgctgataccttttctgtattttcttgtcggtagctttgctcatcttttccatctcttccagtttccggacgatcagttctgcccgttttttctttgccagacgatgctggatagccatgcgttcattatccgaaaccggcatcaggcgttcttcgtgcgagaagacaaaatatccggtctgctcgtaagcaaggtgcagcagatcggcagaggtgtacaagcgtttcacttgttccttttcatagaagttggctatcagaaacgaatccggctttccgttttcgtccagataagggaggtaagagttttctccgatggcttcctgtagtaaggtgcgttcgcctatgttggtagttcgtgccagttgcgctttccagccgttgaaaatggtggaagctccctgaatccagtgatcgatttcagaagaagacatacattccagttccggtcggatagaagcgatgtgtgtcacactgttgactccgccccggaaacgtccgataatctggattgcctcggtggcagggtcaataacggattgcgcggcaccatacaagtcactgacgaaaatcacatgaggcggatttttgcagagtatgtctaccgccgagtagaagcgggaggtgaagaaattgtagcgttccagttcggtgatcatcattgactttttgcggcggtttcctttccagagcttgtattgtccgtcttcgctacagaatgtgcaggcattgcttagttcgggtatcaaccggtagaagctgtctatcgaatctatactgttacagaaaatacagacagttcctctcttggcttcaatcacttcctgcagggtttccagcacattgttggtagtaatcagtttcagtttctgccgatagacataatccggctgaatcaatacccgcatgaaaccgtcaaaacgactgtccttttcgggtacgataggtgtagcggaaatcagtgccttgttctggaaacgaaagaaatcattcatcggttcgcggatagagtcacggtagtgcacgtcctgtaccagcttctcgcattcatcaaacaagatgaagcattcggtatacatatctatatccaccgtttgcatggcttcctttatcttgttgaagccttcgggggtagtcagtagtttataatccttctcccggtttgcttccagaaagtcggcgatctgccggatgcttacacctttatagacagcaagtgcattcttatgtacctttgctttcgactcgatgacgggtacattcggttcgatgataatggatttgcgtggtgctgtgagttcacagtgcgtggcacccagtcccggcagcagtttgttgatgatgcaattggtaggaataaaatcttttcctgcacgttttagcgcatccgcaaagtattctcctttccggatggagtaaattcgatcgtattccatgcaattaatatttccgtttattgtgtttctttggattgtacttctcaaatccggcagctgaaatacgtttttttagattcttgtccgctttaaaaactacgtttttcacttggatggattctgccctgtggttttcgtcaggctctttgtcttcacagaaatttccgtttagagagaaactgccgaagtcgtccagattgagtatgtttccgtctttcagtacggcttccattccttccagtactatgctgaggcttttgtatgcttctcctttggataggttgtatttggttgccagatattctacgaatgctttggtgtccagtgtatcccatgatagcagttgtacccggacatttgtctccttatctcctgtgaatgtatccgcgaagcgggttgttttgtaaagtatgctcataataactcctttcaatagccattgtttgcggtgcagttgagtaatagccgggatagacaagtgtaacaggaatattgcacaagtataacaggacggttgctcaagtgcaacagattaattcatacagatgaagttgctaaaagataagggattatttttagtttgtgtgggaaaaacaattaactcttccttatgaattggtaaaaacatcttgtcggttaagacgatgcaaaggtaagaataagtaccggactaacaagagaataaatctattttgtgactttgtctttgatgtcatggtttggtatagtaaattttattcaaacattaataatgatagtatttttatcggattatcaacaaacaatgcatacaatagatgaaaagatggcacgaccttaaaatataatatgctaattgactgctaattaatattctcaacatctagtttgtattattgaattgaacaaccaaaatgaatgtctttatggatataaaaaagaatttgcggaccgttgcgaggaatgcagcgtttagggtagagtttctcacgagtgggagagagattcttttgtacacgaatgctatttactctgctatgatgtgggggtggactaagcgcatcgaagagaaagaaaaagaaactcacataagagaagagttaataaagtaataatcttaaaaacgacaggctatgttacaggaatttttagaaattgaagaactgaaatcaatacatgaagagaagctcagattgatggagagggaaatggcattatcaactcctttactaacagaattggagtatatacccatgctgtataaatggtattgtgaattgtccggttgctgtgaggaagcaggagtacagaataccgatcagaaaggacaatttcttttcgttatcttatttttttattctcctattgcattagttggcggaagaatagtaagtggtgttcgggataagctggcacaattattcggatttacttccccgtctgctgtttccaatctttgcaaattaataaaatcgttttataccacttacaaagggtatagaaagattgtaaatcagctatgtgacgaatttatgagtcgtctgaaagagaacggaatcatacctcaaaatcctattttatgacttcgggtaagatgtcacggctgggggaactgaaaatttaccagtcattgatattggcagtacttttaccagcgaattagaaaacaggacctgtgattcaaaagaaagaacagtttaaagctagcttttttatatattatttattaattaaaaatttaaacaatttaaattatggcacaattatcttggggaaaacccacaattgagtttggaaaatgtgtgaacggagctacaccgtcagaatggacaaaactaggttgcgacccggtggaaagttcaacgaaactgactcctaccaaaggtgaaaagaaagaagcaaaggtagagggaggcgaaaatgaagcagtgaagtatgccagaaatacttatgcgttcgagtttgaaatccgtgcggctaaaggtcgtgaaaaaccgatcaaggactctgacggagtagttgaaggcgagtatgctttccgtcttactccggaagatgaaacatgcgaaggtatcctgatcgaacgttctgtggtttctgtagaagaatcatacgacaccgccgaaggtaagaagtggaaatacacggtagatgtattgaaacctgccaccggtgatcaggtgaaaccttatactcctgctactccggcagaataagattctttttacgtcaatggagagcgctagtcatggcgctcttcttttataaattccgctatgaacataaataaagaaatcgaaatcaacatatccgatgctatcgtggaaaaagcgatcagttttagtatcggtaagaataaactatgtctctatccttctactttgggtaagatgcaaatactgaagaacttgtatctctcgatggatgtcaatatggagcttctggccattaatccgcttgttgagacgctgagaatctgccaagagaaaacggaatctgtctgtcaggtcattgcttactctacattcaacgatagaaagagtattctggatatggagaaagtacttcggcgtgccaggctttttcaggatgaagcgtcggtggaagatttggctaccattttgactattatcctttcgagtgataagatagaagagttcatccgatattttggtatcgatgcagaccgggaaatgaaaacacgaatcagcaggataaagggagaggggagcagcatcactttcgggggaaagagtatctatggactgctgatagactttgcctgccagcgctatggatggacaatggactacgtactttggggaattagctatgtcaatctgaatatgttgtttgccgatgctgttactactgtgtatcttagcgaagaagaacgtaaaaagttaggtcggggagatggcgaggtgatcaatgcggatgatccggggaatagagatttgataaggagaatgattagtgagtaatttatagaaataattattacggattagtgttgttatgttgttgttatttgtatctttgccaaatgtttatcacgttttacataaaggattcataggtgggatatgaattggtaaaatgaatgcacaaacgaaataagctggctaaatattaacaagtaatgaaaaagattttatttttaatgacggctgttttagtgattgccggatgtagtaaaagtgaagatgggaaactaactctgagtgctaatcaagtttctttgtattcgggcgacacaaaacaagtaacggtaaacgacaatgctacttggagttcaaagagtgaatttgtagctgaagtaagtgaggatggaataatcaaaggaaatcatgttggaaaaacaattatcactgcaacttcagataatggagaggcgctgtgtgaagttgtggtaaatgctaaatatagcacttacacagaacctgtattggaatttggtgtggataaggcaactgttaaggctaaagagaaacgtactattctggaggataaaacaagtacattgggatacagaggcgagaatagtgctgtaaagagcgttgcttatctgtttgagaatggaaaattaacttcttcagctatagctctttcctattcgtatactgaagaaatagctaaatttctgtcagagagatatcaggtaatagggaaggatagtgatggtgcatattacttcatcaataatgattcggataaatataatatgggggttagattatccgttgaaagtggtttcattatggtggtgtatgttcctcagtctcctaaatcaaggagtattcaagctgcagatctgcaggaacttaagtctatattgggaatttaatatataaatctataagcttggtagtgtaaaataaactgtgtcacgcattatttatctctagaaaactcatcggtcggggaacggcccgcgccaaggggcgggaccacccgtcccgacgagcgtaaaattacaataatttaaaccggtttccaaactttatagccagttgttgcgagatggtagcccaattggccagtggcatggtccatttcttacgtatattgcggtatgcaagataaacaagtttctcaagggctgtatccgatgggaacacgcccttgttttttgttaccttgcggatctgacggtgatacccctcaacggtatttgtggtatagataagcttacggatgaccggagtatactggaagtattcggacagcttatcccagttgtcctgccaggatctgataacgacaggatactgttcaccccatttttcatccagcttgaggagctcattttctgcggattccttattgactgcctgatagacacatttcaaatcccttaagaactccttctgattcttggatcctacatacttgatggagttacgtatctgatgtactacacaaagctgtacggctgtattaggataaacgctttgaatggcttcaggaaaccccttcagaccgtctatacaggcaatgagaatatcctcaactccacggttctgaaggtctgtcaacacgctgagccagaagtttgctccctcattccttgatatatacattccaagtaactccttgtgtccctccctgtcaatgctcagtacattatagattgcacgggttaccgcgcagccacgttcatccgttactttgtaatgaatggcatccatccagactataggataaacagaatcaagcatccgtgatttccatgcttttatctccggaagtacacggtctgtgatggaactgattgtgtcggccgaaacacgattcccaagattttcttccatccagtcactgatttcccttgtgctgtttcccattgcatacaagccaattatacggtcagcaacaccttctgccagaatagtctcacgcttcttgataaactggggatcaaaactcgaattacggtcacggggagtggaaacggttacttcgcccaagggagtctgaacctgcttttgcatctttccgttacgacggttacccatctggcgttcttcttctgtcaaatgtgcatccatctctccttccagggctgcattcaatatactttccaatagtggggcaaaggcgccgtccttacccaacaaaggcttgccggctttcagctgttcaatggccttgttcttgatactctcgaaatcaaattcttctttcataaaaaaaactgtgttagcaaagttaatactttattccttgctgacacagtttaatttacatcctctggctgacacggcagtcgatgcgggtacacctagcatattagaagccaacagtcctgttatcagccgggttcttgcttttcttgatgcgggcatcaataccggagaaacgatcaaaacgaatcttcgtactgcaattaatgctctgaaaacaaagtattcgaatcttaagatgggattattctctacgacctatacccttgaaggtagttcggctgcttatcctttactttcttccgattcattacaaaggatctccttgctagacgctgacaaacagatatatcctttattcaaggagtatgtaacagcacgcaacgagcttgctaacctgggagtagaagcctcccgtgaatggattgtcaagaatcagacgactattgaccagactagcacgtccattggtctgttggtgaagaagacagaaggtggggaagtcgttaatgcagcttcgatcattgctgctatcaatgaaagtggtgatggtgaaattaaactggtagctgataagataactctagaaggttttgctactgataataaggggtttagtattgaaaatggatatatgactgctaagggaggaaaaattggagggtttgagatagatggatacggattgtcaaattatagtaatgcagatgcgtttattagtattgaaacacaaaaaacacggacatcaggaaatcaaactttaaccgccataaggaaagcgatactcggtaatggcataccttctattgcaggatttgaaacagcgtctatgtttcaggcatcaggtgacgatgaaaatatagctgtcaagattaatgcttatggcagttctacatatgattataagtatggaggaaaggctaattatgctcttgttgcttctggaggatgccaatggaaattatcagaagctggagatacttggtgtatgcccggtgtacttgggtgtgtcgagatttatactaccaatagtggcattaaccttaataggaaatggggaaatggtatttctattaaccgtattgcattaaacgcagaacgggagtatgaattttaccataaccttggacatacagattattatttcttggcaatgccatcagtaaattgggtggatggataccatgaagcaattccatcttatactagcattgaaaataatgtttttcggatattgtttagatctgggaataatgataaggcaaaacccgcttattttatggttataattttcgggagacctgcttaataaatgatttattaataagaaaaattatgaaagtagattttacaaaagcaaaagtagaagtgacatttggtgaatacaaggaaatggatatcgccaaagcagtaggtaatgcaattcatcagaatacttctgatatcggtgttgatgaaacagcacgcaacatttatcattccgaaggagagcttgaaatccctgatgaacaaatcagtgctattatatatgccctctctaatgcaagtaccattctggtatctgcaaagaaggctgctttaaatttattaaaactaacacaggaataatatggaactgacacaagagcaaattaatgatatagtaacggctgtattttcgttgatggaatctcaaggaatgctgcctgagtcgcaactggacgtactagctcaaaacgtgaagcgacgcctgcaactcgactctgtaggagttgatgaagttcctcttgttgattcgatagagggaattaactctctcccgtgtgtacgccaatccggatcggtatttgatgttgtccgtactccgttggaactacttaaaggtaaattggcagctttacctgtctttcgaatttcgtcaggctattggcaagtatcggaagataacgggaatacatggaaagatataactgattctttagggaatcgggtgtctgctcagggagaaaagggagaacagggaaatcaaggagatccgggtcagacaggagagaagggagatccgggagataaaggtgataatggagaaaatgtctatcttcagtctaacggaacagaattgcaatggaagatgggagaggatggagaatggcagaccctgattttactttctgaaataaaaggtgctgcttcaatgggagaattgaccaatgtgtctcaagaagctgatatagcagaagatggttccgttttgatgtatagggacaatgaatggaaaccggctgcggaatgctttattcctaccggaacggctgaggacggttctatcattaccactttttctgacttaatgaattatatctccactcatggagaaggtggtggcggtactggtgtgcaacggaatattcgtatcacaaataacctggaatcgaaaaatatttctgctagtaagggagagccttgtttattggattttacctttatcagccaggaaagatatagctctaatgaaccatatgaagacacaggagaacgtggtatgtgccagatttcggtcaagaataacattaactctgaatatgttatagtgaaacaattgtatatcaattctagtgttccgttcaaaacggatattgccgagtttctgacatccggagctaataatgtcatgatcaaagttaccggagaagtgactgaggtaacaactcccgcatttgtatatgctgtgcagcttacgtctctgtccattagcgcagtaaactttaaatggtggacggcatttaataatgacattacagttccgttcaatatatcagggaatgtttctaaaagtctgtatgtgaacatttccggaacagattattctgaagggtatgaagtagcgttgggcacgggagtttatgtcgaaactgcttacaattactctattccacatccacaaaagagcggaatttttaagatatcggcttatgtttccaatgcggacggtagtattcgtactaagaccctatcatttaatgtgatatgtgcagtcgccggtgagcaggctaaactgatcgctatcaataatgtggcggaaagaataaccaactggagtgaaaacatcttgtttgattatacgatgtatgatggtgataatgttagtacttctgccttgtttgagattacgaaggggaatgaagtagtattcagttctactgaagaaagcatttctacctctactaagtattcattctcattgcctcttgaaatagacacaatagataatcaggatttctctattattgctaatgtcaaagatagcggcgttctgcttaccgatccattagagtttcccgtgaataactcgttgggatattctgccgtagcaggagctgtgatgtatatcaaccctaaaacacgtaccaacagacaaggaaatagggaatgtatgattaatgaagtcgacggaacgcagatcgaagctatatggaatggaataaactggggaaacgacggatggacaaacgataatctagggtataaaacgctccgtctgcttgccggatcaagcgttgatatcaattacagtccgtttggaaaagagagtgcccggaccggcaagacatttgaaatagactatcaaatctctaacgttactgatttctcaaaaccggttatcacagtctctactcctgcaggagatttatttgtcggattgaatatttatccagacaacgtgattatgtactcacagtctctaaaagataaggatgtacaaagtcttcacacctttgaagagaagcggacccggctgacacttacaatcatgccggatgcttatggaaatagtggatttaatctctgcattctctatataaacggaattaagaaccgtgagtttacttatgagaataatgattattttgctcataacggaacgattgtcataggctctgataatgcggatgtagatgtatacggtattcgtgaatatgattcggcattaacctcgcaaggtgtacaaacgaactatgtcaattggctttctacagcagaagaaaaaaatagtttcaaaacagagaatgacatccttgatacaaacggttctgaaatagacttcgataatacggttgaccaatataatgtcatagtgtttgacaatacgattccaagtatggctgaccagacgcaacgtattggtacccttgacgtttacttctacgaccatccggagtggaatgtatctatcagtgatgtcactgcaaaaggacaaggtacttcatctatgaaatactggatatggaatacccgttatcaactagacaagaatttgtctgtcattactcatgctgatggaagtaccagtaaaaaagtatggcagatggtaccttggattccggcaggacagaaatttacagcaaaaaagaattttgcctcttccatgcaatctcataaaatcggcgcagtcaattcttacactgatttatataaacaagtaggtttgtcgaacgaagcaatgcagagggaggggtattcggatgtacgtgtatcagtatacgagcttcctttcttttgttttgaaaagtcaattaatgacgacggagaacctgtatatgttttcaagggtttatatactttcggaccggataaaggggataaatatacgttcggctatgatacggactattttcctgatcttttgtctatcgaaggttctgataactcgcctcttctgactttgtttcgtgttccgtggaatactgatagcgggagagtcgtatacgatgaggacaaagaagcatggcagtataatggtgccaactctttcggttttggagctggagatatagcaaatatagtcaactggattccaacctacaatcacgtttatcaatgttccccccgtttgcttccattcgatggtactcccgatgaactgaatgatgacctggatatatatcgtacgcagccttatgagttttggattgcaaaagttggtgattcgcatcggtttgatgtctattattatgaggcgtcggtaggtttgtttataccatcggacattggagaaggaccaattaatctggtatctcaactggtagacaaagattatggacttgcttctgctgatattgagaataaaacaaatgatagtctgaataccctttttatcaatgcccgtgtggctaagttcagaaaggaagccgctttgtactgggatatcgatgattgtttgtactttatgaacaatgtagagtttaatgctggaacagacgaacgagcaaagaacacctatccgtatagctttggaatcgaaacttcaaaatggagatggcgtgttgatgatgctgatactcgttttgatacaaccaatcgtggtttaccggataaagagtacagtgttgaaactcatgatttggatgagaccggggcggctgtatggaacggagaaacaaataatttttttaacttgatggaacttgctttcccggaggagaagataataagtatgcgcaaatctatggcagccatgcaatcgctcggaggtttaaagagtggaaatgaccttgaaaagatatacgcgttttacaaaaagtatttctttgaccaagcgcaggaatatttcccgtcggacggttataatgctgatgctaagtattgttatgaaaatggtaaattagcttataatgcaggtatttattcaaatgatactgatccgattactcaaagtttaggcgatcattatctggcggagcagaggtggattactaagcgtattttgtatatgatgtcgaagtataacttcggactattctcggcttctggaaccgatacaattactgtacgtgctgcaggtaacacgattaaatatcagttgacacccgcaatggatatgtatccggcaattgcgaacggtacaagtatcatacaaggaaagagaacgaaagctggagaagtgtgtgaaatggaaattgaactttcgggctccggtgatcagcagaatgcaatacagggagcatcatatctgcaggatataggtgattggtacaataagaatgtaactggatctatgattattcaaggaagaatgctaagggatatacgacttggaagcaaaaataatccggttatcatttcaatatcctctttgacattatcgaattgtgtgagccttcagagattgctattatcgaatattaccactttgtccggtacattgaacttaaccgcatgcgagcacttgcaagaaatttatgcagacggtacttctttggcgcagattgtgctgccgtcgggtggaggacttcgtgtagttgaatacagcagatttaatcaatacttgtcattgtctaattatcctcttcttacagatgatggaatcgggattgacttgtgcaagacagtgatcagtgactttttcattgttgattgcgcactggttcgacctatgaaaattcttgttgatataatgaatgcacaaatggaacaaggagataaccatgcattgaagaggattagagccgttggctttgaagagtcatacaataactcgttcatattagacaaattggttgacctgacaaacggtacttatagtggattaagtagtgaagggctttccggagaagatgaattacctgtgttagatggaactctcaacatcaatgcgagtgtttatggagatactgtagaagcgctcagagcaatgttcacaagactaaccttaaatatcaatggggaattttatgttcgttttgcagatgatattgtaacaatgttatgcgcagaaaattggggtgacggtataggaacaagcaaaagacaaatgggaaatattactgaactaggaattatttttgcaggaacaggtatcaaatcgtttaaagagttatctttaagtaagattgaatcattaacaaatgaatttacaggttgttcgcaacttagttctattgcatttcctgagacactgcggatattgaacacaacggcatttgctggtagtatggttgcattagacttgtctgattgcacacatataactgatttactgattgattcagacgatactattgatttcatgccatccgcaaacgataatctcgttaatattacttataataacggatctagctgtatacatatggtgggttattcaaatgctattcttaccattaataacgagtctgagattgtagatttttgggtagaaaattgtaatactaataataatattctttcgaaaatacaatccatatattcagtcaaggaacatttacttaaatatattagggctgtaggatttgatgaagaattctatacgaacgaaatattaaaaactctgttatcattagctgagaatggatatcgtggaataaatgaaagtggagaaagagatgataacattatacctgtattatcagggaaagtactatgtacagataagtattcgccagatatgttgtatgatttaaaaagttacttccctaatattttgtttaatatgacgggagaagcttgtgttgatttcaaagatcaagtcgtaaaagatatatgtgtgaggaattggggtagtgatggagaattgaccgttgaacaggctgcagggataacaactattaatactaagttcaaagagaacttggaaattacatcttttaatgagttgaaatatttcactaatgcaaacgcacgtacagagtatcctggtgagcctggggtgccatacggagctttcgaccgatgtaccaatctggaatcagtaacaataatgcctacagccaaaagaattgaaacaagtgcttttggtggttgctccagtcttaaaaaagttctatttcctgattctgtatatttcttaggtacgaatattttttatggctgtacttcgctggaaagtgtaaatataccaaagggttttgctgacagtaaatttccaagtaatgtatttagagattgtatttcattaacttcgcttatagaagtacctgaaactgtcactataataggtatggcaacatttaatggatgtacttctttagcaggggtgaaattgaagggaaatgtccctccatctcttgaatacagtgtgtttggtaattctacattccctatttatgtcccagaagcagcagttaatgcttacaagtctgcttccggatggacttcattggcttctaggattatgggatactaattttctactctgattgttagtgtacattattggggttaagatcaaagtcatactctgtaatagttctaaaacttccccaattggtcgcagaagcataaacttccttgcatccaataggaacgtatagatcacaggtatcaggattatctccccatccgtgttccaatattggtggaattgttgattttacatataatgtatttagattagagcctcttctccaatatcctctaattctgtatgttttaaatggaagtactaatattgtaacttgagtgttttctagccacagatcaccgccgacgtataatggtacatcccctccatcctcaaacacaatagaagtgaggtttacacaattcttaaacgttgcaacatcacaaagaccaactgacttgggaattaaaattttagaaattttagtattagccaaaaaactgagagcgatattaaaaatgttgggtggaagaacaatagatttcaaatttatacaattctggaatggactcgaatcaatacgattgttattagcagaatccaaataacggccattactattggtataattgacaaaatattgaaattcatcaaagtttgtaatttccaagttctctttgaacttagtataataatataaataaaaaataagaatgaaaaaagtgaaaattatgattggagataatactcctagcttccatctgatagcttcagaaggtaaagttctacaaagaatatctgacaaacagatttttgggtatgaaatatacttagggtatacctactatattggttctcaaaagctacccgaaccattgttagagttgccggagcattattgtgagatcgatgctcctgaagaatataaagatatgctttattagatttgattttgatggaatatgtttgagtacagtatactataggatatatccattaacatcattaataacagaataaaattggataaatatgggattaaatgaatggctagctctgattggcgctctaggcggattagaagcaatcaaatgggtaataaacttctatgtgaacaggaaaactaatgcacgtaaggaaggtgcggctgctgacagcatggagaatgaaaatgagcgtaagcaaatagcttggttggaggaacgtatcgctcaaagagatgcaaagattgatactatctatgttgaactccgtcaggagcaagctgcccatttagatgaaatttacaaaagacatggaattgaattaaaacagaaggaggctgaaatgaggcgttgtgatattcgtaaatgtgacaggcggcaacctccaagtggttattaataaaaaagaatattgtaacatgaaaatattgatagataacgggcatggtgaaaatactcctggcaaatgttcaccggatgggagattaaaagaatgggcatatacaagagaaatagctgatagagtggtagccggattacgtcataggggagaggaggcagaacgtattgtgaaggaggatgtagatataccactctctatacgatgtaggcgagtgaacaaaatttatcaggaatctggaggaaatgcgatcttaatttctatccattgcaatgcagcagctcttggtattgattggttatctgcgcatggatggagtgtatttgtttcgaataatgcttctgccaatagtaaatgtttggctacaagtttagctgaatctgctattatgcaatctgtttttgtccgtcagccaatgccaggacaactgttttggacacaaaatctcgccatatgccgggatacaatttgtccgtcagtattaaccgagaatttttttcaggataataaggaagatgtcgaattccttttatctcctgagggaaagcaacaagttatacaaatacatattgatgggattcttaattatttgaaaactatcgaattatgaggcatttagtatgtatattgatgctatcttttgtattgggaggatgtttctgttcatgtcggactcaatatatcccgattgaatctgtaaagacagaatataatgttcgtgatagtataaggtatgatagtatatatcagcatgatagtgtatatctaacggtaaaaggagatacggtatatcagtataaata

SEQ ID NO: 51 - DNA, 55642 bp, Bacteroides thetaiotaomicron
ctaaaagaaagaagggcgttctgatagacgtgcgctgtagaatagcggccctcctctcgcaaacggccgatatagatatcggcacatcgactaaatccatttttattcattatttacatcactagttagattacacgatacaaattaagatgaataaacgagaagtcttagttttatgttgtttgacattattaaaataactaaaaaaggcttctaacatacatttatgtcagaagcctctatcaatataactttgaagaaaacttagtttctcaaatccgattatccatttacctttttataatcttccaaaaatttcttcaatcccgaatcagtcagcggatgattcaacaaccctttgatagcactcaacggacaggtagccacatctgctcccacctccacacactcgatgatgtgcttcgtattgcggatagaagccgccaatacctgagtcttgtaatcataggtgcgatacatacgtacaatatcaccaacaagtcctaccccgtcttcgcaaatatcatccagacgtccgacaaaaggcgaaacgtaagtcgctccggcttttgcagccagcaatgcctgtccgacggaaaataccaatgtacaattggtccggattcctttttctgtaaagtacttgatagctttgataccatcggcaatgcaaggcaccttgacaacgatatgcggattgagtgcggcaagctcttccccttcgcggatcatcccttcataatccgttgctattacttccgcacttacgtcagcattgacaatcttacatattttaatgtaatgttcacgttgattctccgtacctttaatgccttctttcgccatcagcgaaggattggtagtcactccgtcaagtactccgaggtcatacgcctcctgaatctgctccaaattggctgtgtcaataaaaaacttcataattctattttttaatggttaactatctggtagtcaaagataagaattatttctcatctttcctagatcaggcaatggttattgccggatcgaggtagacatcctgaatagcgtttaataattcgacacccttattcatcggcttctggaaggctttacgtccactgatcaatcccatgccaccggcacgcttattgacaactgctgtaatgaccgcatcacgcaaatcggaagccccatgagattctccaccggaattgatcaatccgacacgtcccatataaccatttgccacctgataacgacagagatcaatcgggtgttccgatgtgagttccgtgtacatgcgttcatctgtctttccgaaaccaatcgctttgaaaccaccattattggtaggaagtttctgcttcacaatgtccgctttgatggtaactcccaaacggtcagcctgtccggtaaggtcggcagcagcatgataatcaatagctcctttcttgaaatcgctattgcgcaaataacaccacagaatggtagccataccgagttcatgggcatattcgaaagcctcagcaatctctaccaattggcggcgactctgttccgaaccgaaataaatggttgcgcctactgctacggctcccatattccaagcctctttcaccgtaccaaataatacctgatcgtatgtattcggataggtcagcagctcattgtgattcaactttaccacgaaaggtattttgtgcgcatatttacgtgcgactgatcccaaaataccaaatgtagaagctactgcattacagcctccttcgatagccagcttcacaatattctccggatcgaaataaatgggattcggtgcaaaggatgcgccggctgtatgctcgatatcctgatcgacaggaagaatggacacataacccgtatttgccagacgtccatgccctaaaagggtttgcaggctgttcaatactttaatgtttcggtccgaatcaatccagactttatcaatggtatccggtgagggtatataaatcaacgacttatcaatggtcttacaggtatgatccagataataactggtcttatctcctaataaatcaactactttactcataactttatttttttaatgtataacaatttatatacaggcgatgaagcctgctattttttcttcccctgattggctaccgcttccatcagcttacgaatttcttccggattgcccaggaagtaatcattggcaacattcaggttctcgtcgaactcgaatacataaggaacggcagtaggaagattcagtttgatgatatcttcatcagaaatatgtttcaaatgcttaatgatacctcgcagactattgccatgcgcgacaaccagcaaggtatgcgcatcttttaaagccgggaatatatccgactcccagtacggcataatacggtcgatggtatcttttaatgattcggtacgcggcagttccgcatcggatacttcgtgatagcgataatcgaaacgcggatttctcaaatcgctttcggaaagcggattgggagctatatcataactgcgacgccagatcagcacttgttcttctccgtatttctcggctgtttccgccttattgagtccttgcaaatcgccgtaatgcttctcattcagacgccagctcttctcgacgggaatccagtccagattcattttatcaagcacgcagttcaaggttttgactgcccttttcagataagaagtataggctttatcaaagttgaagccatattccctcaacgtgacgcctgccttttccgcttcggcaactcccttttccgtcaggtctacatccgtccaacctgtgaaacggttttctttgttccaagcactctctccatgacgaagtaatactatctttttcattcttaatggtctcctttcttctttttatatatacaacattttgtttctctacaaagttcacgaaagaatcagcaggtatcaatacctaaaagtgatggtttattgaaaagaattcaatagaaatgactatttttacggactaaatgaatattcaaccgccaacttaaaacaagtcagacattggaaacaagcaaacagaaagaatacacattcctgcaaaaactgctgaataaagcgaatatgggatggtgggaagcggacttaaaaacagaaagttatgtatgttccgagtttatctcccgattactcgggatagacgaagacggagtgatcagttttgaagatttcaataaacgtatcctaagggaggatcagcaccatactaccagctactctttcgataaattgcaacagagcattgaggaggtgtacctgctcgatactccccacggggaagtatggattcgcagtaaaatatgctttcaggaaactgatggggaaggaaacaccaaaatatacggaatagcagaaactcaagatggtccacgcatggcttccgcctatcaggcactgcaaaacagtgaacgtatcctgcacaatatctataaaaaccttcccgtcggcattgaactgtataataaagacggttatctgcttgacttgaataaaaaggaactggaaatgttccatatcacccataaagaaaaagttattggtatcaatatctttgagaatccggcactacccgaagaaataaagctaaagatcagagataatgaagaggttgaattcaccttccaatatgatttttcaaaaatcaaaggatattatgaatcggaaaaaacatccggtttcattaatctgacaacaagaataacaacactttatgatcatgaccggcagcccatcaattatctgttgataaacgtagataagacggaaaacaccatcgcctacaacaaaattcaggaatttaaaaatttctttgaactggtaggagattatgccaaggttggatacgctcattttgatgcgttaagccgcaatggttatgccttaagcagctggtataaaaatgtaggagaagaggaaggcacgcccctaccggaaattatcggtatccattctcactttcatccggaggaccgggctgttatgctcgactttctggcgaaagtggtcaaaggcgaaagtacgaaattatgcagggatgtacgtatccgcagagccgacggaagttatacgtggacacgggtgaatgtgttggtccgcaactaccgaccgcaggataatgtcatcgaaatgctgtgtatcaactttgatattacccaactaaaagaaaccgaacaaatgcttatcaaagccaaagagaaagccgaagaagcggatcgtttaaaatcggccttccttgccaacatgagtcacgagatacgtactccgctcaatgcgatcgtcggtttctcaagtatgctggaagaggcggaggatcaggaagaaaagcatcagtatatcacgatcatagaagataataacaagttgttgcttcagctcatttccgatatcctcgacttatcgaaaatcgaagcgggaactttcgacattattcctgaaagagtaaatgcgaaacagctttgtaacgatctgtttcaggctatgcaaatgaaaactagtccacaagtagaactccgcctgaaagataatttacccgaactgacgttcaccagtgacaagaacagactttatcaggtattactgaactttgtgactaacgcactaaaattcacttccgaaggaaatatcaccatcgactaccaaatagacggaaacgaagtgaaattctccgttcaggacacgggaatggggatagagccggaaaaacaggaagctatcttcacccgatttgtaaaactcaacagttttattcccggtacgggactcggactgcctatctgccaaagtatcgtcacgcaactgggagggaaaatcggtgtggaatcggaaccgggaagaggggcttgcttttggttcacccatccaattaattaaagaaaaatctcttttaaattgctctgtcatccctcactaagttcggaatggcagagctaaacattatttttcagacaacagtccattttcatcggtttctcttcaggaaaatacggtctgtaatagtgcccggcaactctgattcgtagtgagtcaccataatcatcgtcttgtctttgcgatggcagaaagcctcaataatcttctttacccgacgacggttgtaagtatccagaccgtgaagcggttcatccagaatcagcagctccgggtccttcacaaaagcacgtgccagcaatgccagccgttgttctccactggaaagttgcaaaaaagggttgtctttcaattccgcaataccaaatatatccatccaccattcgcagatggccatttgttccggctggggacgtttgtaaagcccgatgctgtcatgaagcccactggccacgatttcaatagccggcagatttttgagataagcacgatgcatctccggacttacatagccaatatgctttttaatttcccaaatactctcccctgtaccccgcttccgcccgaaaaggctgatgtcacaagcatatgattgcggattatccgcacagacaaggcttaacaaagtagattttccggccccgttttcaccgctcaatgcccatttctcaccacgccgcaccgtccagtcgagatctttcagaatagtgcggtcatcatagcgaatgctgactttattcagtttgaccacttcatcagaatcgtaattattgccatcatagggcaaattgacgatacgctgctgtaactcatcaaaagaaacggctgcatctctggaacgaaaagcttccagataggcctcacgttccattttggggtacaccgtcattttatccacaggaattacatgggtaataaatgaaggaatatcatccagcattgacaataccagaataatctgtacggacgacatttttgtcaagcgatcgagtaaagaaaacagcaactcgcgggtaggtgcatccagaccaataaacggattgtccataatcaatacacggggagctgtcagcagagttttgaccagctggaatttacgcagttcgccactggagagaagaattattttcttatcgagcatcggctcaatgcgaaaaagctcaaacagttcttgtttcagttgttcgtccttaatttctcccagcatttcacgaacatcgggtgcttcgtcctgatcgtgggcgttccagcgttgctgatagtaataattagcatcggcagccccgtaagtgtcacggaaagcgatgtacttcacattatcatagacggtctgggtggcagcaggagaaaagtcatattgcagcgtcccttcacgcaatgggtatttaccgatcagcgtatcgacaaaaagactttttcctcctccgttgggacctacaatcgcaatgtgttctccggctgaaatcgttgccgtgatgggagcagctaaacgcacaagcgggttgcgtgctacgccccccgctatgttgaatgtattttgaatcatattcttctattctgtttgattatcaaaagactgaatttacttatataaaatcaaagccgactgactgggaataataacttccggcccgttttgtatgcctaatccacgtacatctatcactccgtctttacataccactgtatatttaccaaccggaatagtaagcctggcaggagtaggacgagaattaaatgcgacgatgatatcttcccaatgatctccatttgcatggtctttcagacggaaagcaatcaggttgcttccttccacaggaagaaattccagatgttttcgaacctgtcctgcatctcccatgcggaaggccggatgagatttacgcagatcgatcaatcgtttataatacatgaaaacatctgcgctggtggttttgcgccgccagtcgatggcattcactgcatccgggctcttataactattgtccacgccttgcttatcacgcatgatttcttctccggcgtaaataaacggaataccttgtgaagtaaagaccacagtctgtgccagtttatcgagacgtataagttgttcgggagtgatgtccggcatgcttgccttcagtcggtctaccaaacacagcccgtcgtgacaggaaacataactgatcatttgcacaggctgtttcgcccacggcttttgagtataattaaccgaatcgcactgtacttgcggatgctcgatagcgcctgctatgccgaactttacgctcatctcccctcccggaattccggcaagaaaagctcctttgcgcttatcgcctacaggtccgcaaagcccgtcacgcagctcgtcagaaaagacagcaactccgggtatctgtgctatatttcccttcattgccaaggagtcagccggatactgaggcgcctcggcagcccacccctctccgtaaatgcaaatggtaggatcgaccgcatttacagccttccgtatctcgttcatcgtttctatgtcatgaattcccatcaagtcgaaccggaagccgtcaacatgatattcttttatccaataaaggacggattctaccataaacttacgcatcataaggcgttcgctggcagtctcgttaccacagcctgagccatttgccaaggttttatcttctttctggcgatagaaataaccgggaacggtgcgctcgaagttactctcatcggtattgaatgtatgattgtacaccacatccattatcacacggataccagctttgtgcagtgcctgtaccatctgcttgaattctttcacacgagtggcgggctgatagggatcagtggcataggaaccatcgggtacattatagttttgcggatcatatccccagttgtacgaattttcattcagtctggtttcatctaccgaagcgtaatcaaaagaaggaagcagatgcacgtgtgtcacgcccagttcgatcagatggtcgatacctgtcagtaacttgtcggagttcatcgttccatgttcggtcagtgccagatattttcctttattcttcactcctgaagtagaatcgaccgaaaagtcacggtggtgcatctcataaataatcatatcggcgggagacttcaaaggaggtcgggtgtcactctcccaaccgtccggattggtggattgccagtcgataatagcggcccgcttcccgtttactccgacagcacgggcgtttattccgggagtatctccctgccacttgtcatcgatcttcacattgaaagtatagaacttgccaataaggtccttacttaccacagctgtccaggttccttcttcccccgactgcatctttaccgtttcataggcatgtccgccctcgcctgcctcataaagcatcagacgtacttcatctgccgtaggcgaccaaagagtaaacttcgttgcctccggtgtatactccatttcaatcagacttcctgtacggaccggatataattcataagacatatattcctttttcgcagtagtacaactcattactgtcgtcaccgtagtcacccctaatatcgctaaataattggttcccattttcatactaaacctcccctgcggtactcacactaccttcgcacttacttgtttattacttttctcactcccagcctctttcattgcgggtttattttactttatcgggatttttcgcaataaaatctttccaactgctatatcctttttccattgccggacgtcccatttgcagaaaatgacaataggctgccgccaaaccgtccgtcgcatccataaaggtaggcatctcttctttgggaaaatgcagcatacgctgcagcatatccgctacttgttcctttgatgcctgtccgtttccggttatagccatcttgatcttcaaaggagcatattctgtgatcggaatatcacggctcaatgccactgccatcgccactccctgagcacgtcccaacttcaacatggactgtacgttcttgccgaaaaaaggagcttcgatagccagttcgtcaggcagatagctttcgatgatacttaatacccgttcgtgaatatgccgcagcttcagataatgattggcaaatttacgtaaatcgataattcccatcgcgatcatctcaggcttagtccctttcacgcgcaagactccatatcccatgatggtcgtaccggggtctatacccaaaataatcttttcttttaccggttgaatcactctactatctccatcaatgtcggaaaaccgactactttatccttgaatattttcgtaagttcgtcattcagccgcactccctgttccatgtgccagcgatgcagcaatccactactctctacttcccattgcagagaataagaacttccgtcgtcccgatggctcagtatccgacagatacgcggtgctttcaacgtcccgtgtttctgtacttcaggtatatagctttcctttatccaaatcaaaaaattatcgtgaacagcatcgtccacctgaaaagttgtattataaatcagcatatcatctgtcctttcaataaattattttccgcaaacatagcaattatttcagaatattccattatatttgcgccaacaaaagcaaaacgttgacaaacgttatatcagtggcataaaaatggggcgttagctcatctggctagagcgcgacactggcagtgtcgaggtgatcggttcgagtccgatacgctccacaaaatgaaaagagtaacttatgataagttactcttttttttattttaaacctgtgattggctttgtagccaagcttcattaagacatttatattaccccgaaatgtttcaaagccttgtaaagtccactattgtccaccgtatcagtgacaaagtcggcaactgactgaactttttcggacgcatttcccatcgccactcctattccggcggccttcagcatggggatatcattaccgccatcaccgcacgccattatttcagaaactttaaccctgtagtaatcggcaaataacgagaggccggttgccttacttgtccctgcaacattaacatcagcaaataaaggatgccagcgtgttgcggaaagaccagacagaagcggcattactttttgttctgcttcctcatcaaaataaaaacaaagttgacagcattcttttctttcaaacatctcttcgatgtcgacaaccggcggaaccggatgctcaacaattccggcaatctgttcgacagtcggggtaaggcgattgacaaatacaccttcatttaattcgagagcgactgcaaaatcaaattcccgtgcaagctccattgattttctaaaatcctgtgcaggtattgctacttttcttatcacacttccgtcacgcaatacacactctgctccattaagtgcaataactccatcatacggcacagcatcaatctcatgaagatcacttgccgctctaccggtagcaatcacaatcttaattccactatcatgtacttttttaagagcatctatagaggattgcgacaccttatgagtttcaaaactcaacaaagttccatctacatcaagcaataatacctttatcatactatctatatttttgggctacaaagttactgaaaagtttctcatggcctacaacgataagcacgagatcgtgttaaaaaagatatcatatatacaataaaaaaggacctttattcaaggtccttttttatcacttcatccatttcttttattcgtttctcacgatccttgatgggaccgtctttcgtatcacctttgaatacattatctgcacgatcggtaacttcagtgctccattcttcaaactcattcttagccggacggccattcggttcgatattttcctcagcaatcgaatcgtgtctgttaatcatatcatccatatcttctctttttttattggttacaatgataatacaatataaaaagagaaaagttccgggcgttaatgttttttggacaactcgcgttcgcgtatctgcaactgttctttatacaactggggacggaaagggacataaagggtataatcactttcaaccgccttgcctcccaccagtgccggtgtccaatttggcatttccttcacaatgcgaagagcttcttctgcaaactccggatgagtcgattttaatatatgaggacgaagaatcactccctccttatctatagtaaactcacacaaagcatatcccgagacattgtctttaagcaattccgcaggataaatcatttgtccggctacatattcccgtacacaaacatcagccaagcagggtaattcttcaatttgctttcccgaatgcgttttgagcttcggaccaacagaataaatccccacatacatcggctttttgtgagcgtccggctgttctttggtacggtgctccagctctttcaataaagcggttgcttcctccgccaatgcttgttccgaaatattttctccctgagaaaacatgtaagtcgactgacaaaccaacacaagccgctccatcaaagtacctttcatgggtgaccacttccgtcccatcatctcttttcctttcgcatctgtcgatgagaagtaataaacaactccatccagtccggctgtcgaaccgtccaaatcctgtatctggctggttaccagacgggcgatagctcccaaagactggtataaggactgactgatctccactgatttagtttccactttcaccgttcctttctctgcctgccaataggtacgcgacaaagtattcgcaatcaacagacaacgtccgttcttcttctctaccgacattgcatattccggtgaaaaagaaggaatggctacaaaacgcgcgtaaggacgctgttgaaaacctgtattaagcaaagaaaagacatttcgataatactcacccaactcacccgtataggtagtaaaaggcttcaccggctccagatagtcgatctgagctgacaggcgaaacgataaagtcaatagcagaagagaaataacaatctttttcataagtgttccccgattttcggtacattcggcaacaaagatacaaattatttcgatggttcgtgataaaattatatctttgcacggtttttactaagaaactgaataacaatacatcaaaaatatgatagctaagattgaacaacttctgaaagaggtggaagctttgcacgcctccaatgccgaagaactcgaagctctccgcatcaaatacctgagtaagaagggagccattaacgatttgatggcggatttccgtaacgtagctgccgaacagaaaaaagaagtcggcatgagactgaatgaactgaaaactaaagcgcaggacaaaatcaatgcgttgaaggaacagttcgagagccaggataatagttgcgacggtcttgacctgacccgctcggcttatccgattgaactcggtacacgtcatccgattacaattgtaaagaacgaagtcattgatatcttcgcacgtctgggattcagcatcgccgaaggtccggaaatcgaagacgactggcatgtattctcggcactgaactttgccgaagatcatccggcacgcgatatgcaggacacatttttcatcgaagctcatccggatgtagtactccgtactcatacttcttccgtacagacccgtgtgatggaaacttccaaacctcctatccgcatcatctgtccgggacgtgtataccgtaacgaagctatcagctaccgtgcacactgtttcttccatcaggtagaagcgttgtatgtagacaaaaacgtatcattcaccgacttgaaacaggtattgctgctcttcgccaaagaaatgttcggcacagacaccaaaatccgtctgcgtccgtcttatttcccatttacagaaccaagtgctgaaatggatatcagctgtaacatttgcggtggtaaaggttgtccgttctgcaagcataccggttgggtggaaatcctcggttgcggtatggtagacccgaacgtactcgaatcaaacggcatcgacagcaaagtatacagcggttatgctctcggaatgggtatcgaacgcatcacgaacctgaaatatcaggtgaaagacctccgtatgttctccgaaaatgatacacgcttcttaaaagaattcgaagcggcatattaaatagagcacagaatttaccagtatgccaatgtgccaataaaaccatctgatggtaattgggacattggcatttaatcaatataccgattacactgaaacgggatggcttatcaccgttccgatcagcaaattgaacgttcacttattatggcaaaggatagactcattactcccggttattgtttcatcttggcagccaacttcctgctctacttcggtttctggttgctgattcctgttttgccgttctatttatccgagttctttcaggcaggaaattccactatcggcatcgtgctttcctgttatacggtagctgcactctgcatccgtccgttttccggctatctgctggatacgtttgcccgtaagccgctttatcttttcgcttatttcatctttatgctgatgtttgcgggatatcttatcgccggctcgcttaccctatttattatattccgaattattcatggagtctctttcggcatggtcacagtaggtggaaatacagtagtcattgacattatgccctcttcccgcagaggtgaagggctgggctattatggactgaccaataatatcgccatgtccatcggaccgatgttcggactgtttttacatgacggaggggtttctttcgctacaatattctgctatgcgctcggttcctgtatgctgggattcctgtccgcaagcctggtgaaaacaccttataaaccaccggtaaagcgtgaaccgatttcactcgaccgtttcattttattaaaaggaatgcctgcgggactcagcctgttgctactctccatcccctacggaatgaccaccaattatgtagccatgtatgcccgcgaaataggaatccatacacaaacaggtttcttttttacctttatggcgatcggtatggccatttcccgtatattctcaggaaagctggtggaccggggaaagataacccaagtaattgccgccggactcaatctggttataataagtttcttcctgctcgcatcctgtgtatatctgattcaatggaatgatgctgcctgcaccattctctttttcggaattgccctgctgatgggaatcggattcggaattatgtttccggcattcaatactctgttcgtaaaccttgcccccaacaaccaacggggaacagctacttccacctacctgacctcatgggatgtaggaattggtatcggtatgctgaccggaggatatatagccgaaatctgttcgtttgacaaagcatatcttttcggtgcctgcctgacagtagtttccgctgtctatttcaaattaaaagtaacgcctcactaccataaaaacaagttaagatgagaaagaaagaacgttatgaaaaagtaatcgcatggtttcaggcaaatgttcctgtagccgaaacagaattacattacaataatccgtatgaattactgatcgctgtaatcctttctgcacaatgtacggataaacgagtaaatatgatcactccgcctctctacaaggacttcccgactccggaagctcttgctgccagtacgcctgaagttattttcgaatacatccggagcgtatcttatccgaataacaaagccaaacatctggtaggaatggctaaaatgctggttaatgacttcaacagcaaagtgcccgacaacatggatgacctgatcaaacttcccggtgtaggaagaaagaccgccaatgtgattcagtccgtcgttttcaacaaagcagcgatggcggttgatacccacgttttccgtgtcagtcaccgcatcggactggtgccggacagttgtacgactccattcagcgtagagaaagaactggtgaagaacattccggaaaaattaatacccatagcccatcactggcttattctgcatggtcgttatgtttgtcaggcacgtacgccgaaatgtgacacctgcggtttgcaaatgatgtgcaaatatttctgtaacacttataaagttacaaaagaggcaccaaaagccaagaataaataacgatttaatagcaaggaaccgaaataaatagtaactttgcggtcgatcaaaaaagagaatattaaaaacacttttaaataaaaatagagtattatgcagacaattgacaaattcaattttgccggtaaaaaggcatttgttcgcgtggacttcaatgtacccctggacgaaaacttcaacattacagatgacactcgtatgcgtgcagctcttcctactttgaagaagattttggctgacggcggtagcatcatcatcggttctcacctgggccgtccgaaaggcgttgccgacaaattctctttgaaacatatcatcaaacatctgtctgaactgctgggcgttgaagttcagtttgctaacgactgcatgggcgaagaagccgctgtaaaagctgctgctctgcaaccgggagaagttctgttgctcgaaaaccttcgcttctatgctgaggaagaaggcaaaccaagaggtttggctgaagatgccacagacgaagaaaaggctgctgcaaagaaggctgtcaaagaaagccagaaagaattcaccaagaaattggcttcttacgctgactgctacgtaaacgacgcattcggtacagctcaccgtgcacacgcttctacagctctgatcgctaaatacttcgacactgacaacaagatgttcggttacctgatggagaaagaagtaaaagctgttgataaagtattgaacgacatccaacgtccgttcactgctatcatgggtggttctaaagtttcttctaaaatcgaaatcatcgaaaacctgttgaataaggtagacaacctgatcatcgcaggtggtatgacttatacattcaccaaagcaatgggtggtaaaatcggtatctctatctgtgaggacgacaaacttgacctggctttggatctgatcaagaaagcaaaagaaaagggtgtaaaccttgtactggctgttgacgctaagatcgctgacgctttctctaacgacgctaacactcagttctgcgctgttgatgaaattcctgacggatgggaaggtcttgacatcggtcctaagactgaagaaatcttcgctaacgtaatcaaagaatccaaaactattctttggaacggtcctacaggtgtattcgaatttgaaaacttcactcacggttcacgtacagtaggtgaagctatcgttgaagcaactaagaacggtgcattctcacttgtggggggtggtgactctgtagcttgtgttaacaagttcggtctggctagcggcgtatcttatgtttctacaggtggtggcgcattgctcgaagcaatcgaaggaaaagttcttccgggtatcgctgccattaatgaataatgaatttataacaatgtaattttagatacgagggcagttctttgtgaaaagagttgcccttatttatatctgacccatcaactaaggcatgaagagagcagcactcatattctgtatcctccttttcttcctttattcttgccaaagaaaaaaaggagaaagcgtctttataccttcaacagaattacaaccactcacactgggaatgctcccgactctggacggactgccttttcacatagctaaagcacaaggaatctacgattcgctgggattggatttgaccatcctttctttcaattccgcctatgaccgcgacgcagcgttccagttcaaatcaatggatggcatgatcaccgactatcccagtgcagtaactctacaggctatccaccataccgacttaggaatcattttgaaacatgacggttatttctgttttatagtctccaaagaaagcggtatcaaccaacttcaggaactcaaagaaaaaaatatagctgtttcacataatacgattatcgagtatgcaaccggacagctactgaacaaagcgggaatcagtcaggcagaagtgaacaaaccggaaatcgcccagctccctcttcgcctgcaaatgctgcaatacgatcagattgacgcatccttcctccccgaccctgccgcatccatcgcaatgaatgcccgtcaccggtctctgatcagcacacaggaattgggaattgatttcactgtcaccgctttctcccgagaagccatcaacgaaaaaagaagagaaatcgaactattaatcaccggatataatctgggaatagactatataaaaatgcacccgcaaaaagaatggaaacaggtattgatagagatcggcgttccggaaaacctgaccggcctcattgcactccctgtttacagaaaagcggagcgcccctcagccgatgccctggataaagctgtaacatggctgaaaacaaacaaccggatacctcagacatattccggatacaaaagtctgatagatacaacttttataaaaacaaattcaactactatcaaataacaactaatcatatgcgaaaaacactctttcgactctcaatgatcgcgttcgccctgcttggtatgcagagtacgctcaccgcacaggagaaaacaccgttgaatcaagtagtcaatacactgaaagaaagaatcagtctggccggttatgcacaactgggctatacatacgacgatgccgccgatcccgacaatacattcgacatcaaacggatcatctttatggcacatggtaaaatcaccgacagatggacatgcgatttcatgtatgatttctacaacggtggtatgctgctcgaagtatatacagactaccggatcctttccggacttacagcacgtatcggagaattcaaagttccttataccattgaaaacgaactgtctcccactacggtggagctgatcaactgctattctcagtcagtctgttatctggcgggagtcagcggcagtgacaaatgttatggaatgacttccggacgagacatcggtatgatgattcacggaaaattatttcatgatttcctccaatacaaatttgctgtcatgaacggacagggcttaaacaccaaagacaaaaacagtcagaaagatgtagtcggcaatctgatggtgtatcctaacaaatggctgtccgtagggggatctttcattcggggaaccggacacgccataggtgactcccaatattcgggaatcaaagcaggagaaaattacgccaagaaacgcttgagcctgggaggggttgttactacttccgcattcaacttccgtacggaatatcttgcaggaaaagacagaaacgtaaaaagcgaaggattctatgcgacaggcagcgtacgtttattacaaaatttcgactttatcgcctctttcgattatttcaatccgaacaaagcggcagatttcaaacaaaataattacattgccggactgcaatactggttttatcccagatgccgtgtgcaggcacaatacactttttgtgataaaaaaggagacggacaaaaggattctaatctgatacaagcacaggtgcaagtcagattctaactttttggcatcctttttgttctattacctataaataattgaaccattatgaacgaaaaaacgattaatgaacaatacgcctatatacgcactctgcttgaagaaaaaagacttaaagaagctctgatgcagttggaatccctgctctggcaatgtccggactgggatttacgtacccgcttggagcaactgcaaacctcctacaagtatatgctggagtatatgcgccaaggtgcaaacgacccagaacgctggaatgtatacagaaaactcatagctgatacctgggaaatagccgaccgttcgcgcctgcttatgctggacaatgcttcatcaagatattatcatgaggtacgccgcactccccgaccggaaagtctgtcagcatatacactcaaaaaattactgcacatgctggagtcattcaatgacgacttggcagtcagcggactgttgtctgacgaaaagatggacgaggtactgaaacggcatgaagaaacacttaaatatatgtttctgcaaacatggaccaacagtgcatggactcccgaagaggaagaggatgcacaatccatgcttacctccgaacttcttccggtgaacgacctgtgcctgtttatcagtgccgtcacattaagtctgatggaatgctttgacctgcgtaaaatcatgtggctgctggacgcttaccgccatccggatgtcaatgccggtcaacgtgcactggtaggtgtcattttcattttccatatctacaagaaccgtctttcactctacaatgatctggtcaagagagtcgacctcatggatgagatttctccattcaaagaggatgtggcacgtatctatcaccaaatgttactatgccaggaaacggaaaagatagacaagaaaatgagagaggaaatcattcccgaaatgttgaagaatgtttcgtccatgcggaacatgagattcggctttgaggagaatgaggatgagaacgatgacaagaatccggattgggcggacgctttcgaacaatcaggactgggagacaagttgcgcgaaatgaatgaactgcaactggaaggagccgacgtatacatgagtacatttgcggcactgaaaagttatccgttcttccgggaagtacagaattggttttacccgttcagcaagcagcaatccgatgtcatcaagcaactgaaacaggaaggtaacgagaaaaacacattgctggatttaattcttcaatcgggatttttcagtaacagtgacaagtactcactcttctttacgatccggcagttgccaaaggcgcagcaagacatgatgctaagccagctcggtgaacaacaagtggcagaactgaccgagaagtcgagtgcggaaacaatgaagaaattcaatgagcgaccgggaaccgtcagcaatcaatatctgcatgacctgtaccgtttcttcaagctcagtgtacgccgccatgagtttagggacatctttaaggaaaaactcgatttacaccacattcctgcacttagtaacgtattatatagtgaagatatcctattcccgatcgcagatttctatttaaagaaagaacgctggaatgaggcaatagaagtgtacgaggaaatggaaacgatcggagcacttcaggaaagaggtgcggaatattatcagaaactgggatatgccctgcaaaaaagcaagaagtatgcagaagcgatcggtgcttatctgaaagcggatacactgaaaccggataacatctggaacaaccgccatctggctatctgttaccggttaaaccgaaattatcaggctgcattgagctattataaaaaggtggaagaagctacaccggaagataccaatgttattttccatatcggcagttgcctggccgaactcggacaatacgaagaagctgccaactactttttcaaactggatttcatcgaaagtaattgcataaaagcatggcgtggcatcgggtggtgttcattcatcagccggaaatacgaacaagccatgaaatattacgaaaagatcatcgaacagaagccactggctatcgactatatgaatgccggacacgtcgcatggacaatgggagacattcagaaagcggccgccctgtacggcaagtcaatcacagccaacggaaaccgcgaacgctttctggagatgttccggaaagacgaggaagctcttctcaaacaaggtattcaagaagaggacatcccgttaatgctggatttattataacttcttcagctccccgtacagtttctgtatggggagtcccattatattataaaagctgcccgaaatagactttacccctatatatccgatccattcctgcactccatacgctcccgctttatccataggctgatatttgtccacataataccggatttcctcttcggacaaaacatcaaattccacatcggatgcagcagtaaagctcttttgccattcagtggtcgtaagacaaacaccggtgaacacctgatgtgacttaccggacaaagaacggagcatttcgaccgctccttcgcgaccttccggctttccaagcactttaccatcgagccagacaatcgtatctgccgtaatcaacagttcccccggttgcataatactccggtaagcatccgccttttcgcgggagatatattccggaatctcagcaccagccagatcggctggatatgattcatccacatccggcaatgtcctgaccacataatccactcccaaacctgacatcagttctttccggcggggagaattggaggctaatataatctgatatttatctaaatttccaagcataattttatttattattaagtgatttacaactcaccagccgaaagcatcttccgccatccacttgccatgagctttcaatacttgttccaccacatcacgtccacagccacgaccgccatcggcataagatatatacttcgcgaccgacttaacttccggaacagcatctttgggacaacaaggcaacccgcactcacgcatcacttctatatcaggcacatcatcgcccatatacagaatttcgtcatcagacagaccgtatttatcgcggaaattacggtaatcatgaattttcactgcagaccccatatacagatccttcacacccaatgctgcaaaccggatacgtaccgcttctgtccgtccaccggtaatgatagcaatatggagtcctttctttactgccaactgaatggcataaccgtctttaatattcaccgtacgcatcggttctccggaaggatgcaacgggactgttgtcgaactcaatactccgtcaacatcaaaagccagtgctttgatgcgggatagatcataattgatggtgctcatggatacttttactcattaatttataaatttcctgcaatgcctgactgtctgccagcatagaaagatgcttattcatcacattctcgtcatagcgtacagccggtccggtctgcgcatcacgaggagcaagttcatgcactttgcgtgccgtttcgtcaatcaggggaagcataacatcaaatggcaaatgatatttttccagcaattcggcggcaagagcatacatatggttggtaaagttacaggtaaagacagctgccagatgaagactcctgcgttgctccgaatcggcttcgtacaccttatcagagagtgtaccggcaaccgctttcagcagctcggtatcttccggtctttttgcttcaataaagaaaggtacttcccgaaaatcaacttcacgttgtttgctgaacgtctgcatcggataaaatactccgtagcgttccgcatgaccttcccaaatattcatcgggatgctgcctgccgtatgcaccaacagcgcatgctgcttcccatcagtgatctgaggcaacagttcgacgaaagcggcatctttcaatgaaataatatataatctcgcttcattcgatacgtcttttaaatcagtgatatattccgcttccacttcattggctaacgtacgagccgattcttccgttcggctgtacacctgcatgatacggaatcctttccggtaaagcgctttcgccagattagttgccagatttccggcaccgagaaacacaacgggcgtatcttcaatacttcttttcattgtttctttaacgttttgaaacccaaaataaaataattccgatgatcaacagtgccaatggcaacagataaccggacaaggaaccgagcaatgacattaccagaccgatattcattaccagccacagtcccaacagcacaaagccgaccgacttgtcacgcttgaaaataagaaaactgatagaggcatacaacaacaaattgtccttattcatcacccaaggcaaacctatagaagcaaaggggagcagtttatttatcaggaaaagagttccgataacaataaaagcgacggcagtagccttataagtatctttattattatttgctttgacagctcccatcgttattttcctccgaacttattaatatgaattttctcccactggaggtgttcttcgttgaaaggcttacgttccattcccttatgtccgatggcaatcacggaaagaatctgcagttgcaaaggaatatccaaaattccatgaacaaactcgtcagacggcattccggttgcagtgaaacgttcgcgaacctgtacccaacagcttcccagccccaaatcttccgcctgcaactgtatcatgatggaagcaatagaagcatcttcaatccacacatcgcttgccaacggatcagccatcacaacaatcgccaaagcagcatccgcaatgaacgaggaagcctgctctttgcagtgagacagttctttcaacttttctttatcatcgactaccacaaactgccagctattactacgtttggaactgggagacatcaaggcagctttcatcagtgccacaacctcatcctgtgttaactcctcatccgtaaatttgcgcatactgcggcgattctttatcagttcactgaaattttccatattatttccgttttcatttgatttatgtatgcaaagatagcgcaaaccgatcgtaataagaaatgaaattgtatctttgcactgagaaatatattcattatgaaaaaacgaattacacaagacgattacatcaaagcgaatcgtaaagccagccgtgaggcagaaatcaaagagcacggacaccccgtttgttacaaacgagtgcatgagtcaaagaaagtatataaccgcagaaagataaaggcagccgataaaaagctgccttatttttttcatttgggatagtgtcggtatcccaatgacatagtgacaccatgagacagtgatagtgacactatcctgttgcgatagtgacaccatgttttatgcagttcctgataggcagaaagggcgatttcctatacaattcgcgtcagttctccagtagtggagtctatgataaacccgtgcactttcacgtccgacggaatcaaaggatgatgaactataaaatcgaccgttccccttaccgacttctccgtatcttcaaagccatctagccaagaatgaaaatcgactccacaaaaactcatcatatgaatataatcggcattaataccccgtgccttcatcttctcaagcatttcttcactgtgcatatggcaggctccacaatcagaatgggcaatcaccattatttcctccacacctaactcgaagatagcgacaagcagactgcgaatcacactaccgaaaggatgggaaatgacgcctcctgcattcttgatcattttaacgtctccgttcttaatgcctagtgcggccgggagtaaagctgtcagacgtgtatccatacaggataagatagcaatctttttatcgggatacttattcgttatatattctttatatccctcgttcttaacgaactctctgttataagcaagcatttcttctatcatagcgctattttgtttggacacacaaaaataaagaaaataataaaaagctgtatcaggaaacaatgaaaatataccggaaatcctttttaaacttttacgcaggatacaggtatggaaacaaagagccggacaagagaaatctcctgcccggctcctattaattatgcttgattattaattaactgattaataaccggcgttttgtccgaattctgccggattattgatcgcatccagatatttcgtaggaataggacgcaaatagaattctttcttaaagtgctcagcagcacgcttattataagcagccaaacgagtctcaaaagcagcattacgtttcagcaaataccagcgggcacattcgccacaaagttcacgggcatattcatcgaaaatataattcagatccacttgcgactcactgaccgtaccggcaccggcacgcgtacggagtacattaatatatttggcagcatctcccttgttcaagcgtaccgatgcttcagcagcaatcaggtaaacttccgccatacgcatgatcatcacatccacagtttttctctgaacgtctctgccgacaaacttattacccggcatattgaatttagaaagagccggataaatagataaccacaaagcactggcagcactaggcttgtcataggtagccctggctgttccattctcatcgtaaagatcgaaaacattaagaaccaaccccggatattgagctttttcctcttctgtcagcgtcttcaaagaacaataaacggcatattgatgagcttctgccggatctaaaggcatagcaggatgaagaatattaccatctgttttatcctgagtagtcttcgctgttccatctgcattccagatagccagctggcagtaattagcatcggctgtactattggattccaagttaaaatgaggataaactttcttacctatattagatgcgggaataccaaatttagtagcaagtgtgcttgtgatttctttggcacacgctgaacctccatattcataagtcgccccccatgccggtatagaataagacgagtaagctgaaataaatgaataacgaaaacgagagtcgttcatatcagcagcaaaacagtccatcagatatttggatggcaggaagatattactgttcggacgaccgtaaacgaagtttgaagtcttgtctaccaaacccagatccgtatatgttcccaacgaaggtaagaagtgacggaacatttcactttgtgagtagttaccattggtgtaagcgtccgaatttctttcggcacccgcagcaatgaacagagcttcttcattgttacgattattattttcgttgaatacatcggcaaaagcaggatgcatataccactcataaatcgctttattattaatcatggttgtcgccgtatcataggctttttccagaaagctgacaccatcggtatctttcagatcataaccggcaccattaatatatgcacgtgccaataatcccatcgccgatttctttgtaacgcggctatagtaatcactgaaacttacaggcagattctctacggcaaacttcaggtcttcgataatggcagcataaatttcgggaacggtagaacggtgagcatcaaaagaaatattctcgctatcggcagccttcaactgcaaatcgacatttccaaactgctccaccagattcatataatagtaagcacgcagacatctggcctgtgccacacattcattaatttcagtctcatcccctgtcacattctcagctccgtcaatcacaatattacagctgttgatacacagataagaatattgccacactttataataatagctatcatcggttttcataccgttataactatgataacgctgatagctggagcccgatttaggttcttcccaaatatcagtacccgcttccgtacaaaccagatagtcactactctgatagatgttgttgatcaaggctgtatagcacgagttggtgaatgccttataagtttccaatgtataagaaccatcggagaactgacccgagttgttggggttcacttcatcaagactgcaagagccccaagaaaaaacaccggcaacaagtagaactaaactatatatctttttcatattgctattttttagaaagttaaattaagaccaaatatgcaatcacgagacaatgggaagttgatgcttccgttcatttccggatcgtaattcttcacatatttgtttggcgaataagtaaacaggttggtcattgtcgcataaactctcagattactgataccaaaacgttttgtaagtttaccgggtaacgtataacccaatgttacgtttttaagtttaaagaatgatccatccacataatacatcgaatcatatccttcataagcacttctatccttggatttatcgatagcatagaacaagacatcctgatctgcttcgatcgtcttgtcatagtaagtaaaataagtaggaatattgtaatccggattaggcgaatatttacctatcacactaccatagttcatcatttgcccccaacgtgcataaaggaagacagacaaatcaaaatctttgtatctgaaattattcttaaagcccaatgtccagtccggagtattacgacctattacctgacgatcataatccgcacgtacaccataaggattttctgccgtaatatcaacgcgctctccttcaggattcatataataataaccatttccgtccttcttcacactaggtaaatccagcttaatatcgcccggttcgcatccgaacaaagcagcagtttccttttcgctatattgccagatacccaacactttatatctatagaaagaaccgactccttcgccgactttgaacaccatatcacccttttttgcattgaacatcatatcctgcccttcgatcaaagatttaattttttctttgttggcggtaaatgtcactgttgagctccaagtaaaatctttcttcacaatattacgagtattaagagcaagttcaataccgcgattttctgtttcagcagcattcttgttcattttataagtagtgctacctgtgtaattacccataatagatgtcggcaatgcctgagaaagaattacatccgttgtttttgtccgatacaaatccaccgtcagatcaatacgattattgaggaagctggcgtcaataccaatattcaagtcatgagtcttttcccatgtcagattacggttagtgatatactccgtaaacttggctgacggaacagtcattcctcccaaagaggttgtcacattttccaaagatgccatagaactgtattcagcaataccggcagtagttccggcaacaccatagcctacacgcagtttcaagttatccaaccagctttttgtaccagccataaatgcttcatccgagattctccagcctacagaaactgccgggaataaattccatctattgtctttcgacaaacgggaatccgcttcataacgactggaagcagaaaacaggtatttacctttgtatgagtagttgacacgaccgataaagcccatccctttcgacatcagatatttgctgttcagtttcttattatcagcattctgcaatgcataccacaacatatcattggtcgccgggttttcaccatagacataatattcttcactctgattgtaattccaggaagtaacccctgtaaccgtcaggtcatgatccttattaaatgtattgtgataagttactatgttttcccatttgtaattatatcccgtcttattggtagcttcgccatatgccaccgtactgcctttcaacacattataggagccttctcccataaatttaccggcacgagattgagaataactgcctccaagctgtgacttgacagacaatccttttaccggtttccattcaagataagcgtcaacataagcccttcctgctttagtattattcttatatactccatcctgttcgtctgctaacggattcgggtctgatgatgaacctggaatcgggaattccgtgatagagccgtcttcattataaggagtacctaacggggtggcaaacaatgctctttccaaaacggcattacgtgaattcttgttggagaaagatgcctgaacattaataccggcattcatccatttattgatttcctgatctatacggacacgggtagagtacactttatagtcatcattctcatacatactcttctcatcagtatagttcaacgagaaataggctttcgtcttctcagtacctccggcaacggaaatactataattctgcttcaaacctgagtgtaatacttcatctccccagtttacccattggttgtttttgatggcatcgtatctttcaccgaaaatttcctcctcattagtagtaccgacaggcttataagaatcttttatataattaatgtatgagtcacccgtacgcatcttaggaactcgggcacccatagtcgttccggcataagcattaaaattgatgaccggttttccactcttggatcctttcgtagtcacgataataacaccattcgcaccacttgaaccgtagatagctgtagaagatgcatctttcagtacttcgatagattcaatatcattgggattcaaggtagcaatatcacccggcataccatcgataatataagtcggcttaaatgcatctgaagagatattaccatcctcatccaactgtaaagagcgggtaccacgcaactgaactgtcggtgacgaacctgcctgacctgaagaattagtgatatccagacctgcaattttaccttgcagcgcatccatcggattcacgcccggattcatggtgatatcctctgatttcacagaagcaaccgcacctgtcaaatcacgtttctttaccgtaccgtaaccgatgaccactacctcatccaaagcctgtgtatccggaaccatctttatattcagcggggcatttccgctcacaatgatagcctgttctttatatccgatataagaaacaaccagttctttacttccggccggaagattaatggagaacttaccgtcaaaatcagttatcgtacctgtacttgtacctttcaccacaatagaaacaccgatcaacggttctccattttcatctaaaacagttcctttcactgtctttgtctgcatgacggcttgcacagtaatatcattcacaccattttctgcataaacagatatggcagaaggggcacacaataaagtcagccctaaaatcatggaaacgcgtctatgctgtgtcttccacgcttcaacaaatgcattctctctcattcgttttaatttaaagttaatattaattttcctttgtttagtaaaatacaattagcataatcttttatatagacgtttccattttacttctgtactcacaaaggacgacaataatacaaaaattcgcttttccaagcctttttttcctcaaatatatgcaaaggataaaaagacaaattttaggctaagccaacaaattctcttttttattgttgaatgaagaataaaaagtgtaaatttgtatttggatgccacttaaactaacaacatattatcgcggaaaagacattcctgatttaccgggaaccaatacttttcattccaaggagttgtttcagatctatgaatcgactccgggatataccccgctactgatagtggcaacagaagaaggcagacctgtagcacgcctgcttgccgccatacgcaagaccaaaaagtggcttccctcctctcttgtcaaacaatgtgtggtatatggtgcaggtgaatttctggacacttctctaccggcaagtaaagagaaggaggaagaaattttcggtgaaatgctggagcatctcacacaagaagcatcacgcacctgcattcttattgaattccgcaatctggataattccatgttcggttaccgtttcttccgaaagaacgacttttttccggtcaactggctgcgtgtccgtaactctctgcatagtacgcagaaagcggaagaccgtttcagcccatcacgtatccgtcagatccggaaagggctcaaaaacggagccaaagtagtagaagcccatacggtggaagagattaaggaattctcgcggatgctgcacaaagtttattcttcacgaatacggagatatttccctgccaatgactttttccgccacatgaacagcatgcttatcagaggaaaacaggcaaaaatattcatcgtaaaatacaaggaaaagattatcggcggctccgtctgcatctattccggcgaaaatgcttttatctggttttcaggaggaatgcgaaagacctatgcactgcagtcacccggcatactggcagtatggaaagcacttgaagatgcccatgaacggggattccgtcacatggagttcatggatgtaggacttcccttccgcaagcatggttatcgtgatttcgtactccgtttcggaggcaaacaaagcagtacccgccgctggttccgtatcagctggtcatggctgaataatcttctggtcaagttttatgtctaaatgtaatctcaagattacaaaacccgtctttgtcacccatccggagcattttttatgctttattccccaataattaaatgcagaaatatttctttattagacaagaaatgtctttctttgtgctgttttatgccatataagcacataattaaaccatataaaaaaatatagttatgaagatttcacacattgagcatctgggcattgctgtaaaaagcatcgaagaagcccttccttactacgaaaacgtattgggtctgaaatgttacaacatcgaaacagtagaagatcaaaaagtaagaaccgcttttttaaaggtaggtgaaacaaaaatcgaattgttggagccgacttgccccgaaagcaccattgctaaatttattgaaaacaaaggtgcaggtgttcatcacgtagcatttgccgtagaagatggcgtagctaatgctttggcagaagcagaaagcaaagaaatccgtctgattgacaaggctccccgcaaaggtgccgaaggtctgaacatcgctttccttcacccgaaatcaacactgggtgtgctgacagaactctgcgaacactaatcataaactctaaaaaaacaacaagaactcatgagtaatcaacttgaaaaaattaaagagcttattgaacgccgtgccgttgcacgcatcggaggcggcgaaaaagcaattgcgaagcaacatgaaaaagggaaatacacagcgcgtgagcgtatagccatgctgttggatgaaggtagcttcgaagaaatggacatgttcgttgagcacagatgcacgaacttcggcatggagaaaaagcactatccgggtgatggtgtagtaaccggttgcggtactatcgaaggtcgtctcgtatatctttttgcacaggactttaccgttactgcaggttcactgtcggaaacaatgtcactgaagatctgtaagattatggatcaggcaatgaagatgggtgctccttgtatcggtatcaatgactcgggcggtgcacgtatccaggaaggtattaacgctttggcaggttacgcagaaatcttccagcgcaatatcctcgcttcgggtgtcattccgcagatttccggtatcttcggtccttgtgccggcggtgctgtttattctccggcactgacagacttcacactgatgatggaaggtacttcttatatgttccttacaggtccgaaagttgtgaaaactgtaaccggtgaagacgtaagccaggaaaacctcggcggagcaagcgttcactctaccaaatcgggtgttactcatttcactgccaaaacagaagaagaaggtctggcattgatccgcacacttctgagctatattcctcaaaacaacctcgaagaagctccatatgtggattgcacagatccgatcgaccgtctggaagattcactgaacgatattatccccgacagccccaacaaaccgtatgatatgtacgaggttatcagcgctatcgtagacaacggcgaattcctggaaatccagaaagactatgccaagaatatcattatcggttttgcccgtttcaacggtcagtctgtaggtattgtagccaatcagcctaaattccttgccggtgtactcgacagcaacgcatctcgcaaaggcgcacgtttcgttcgtttctgcgatgctttcaatatccctatcgtgtcgttggtagacgtaccgggattccttccgggaacaggccaggaatacaatggcgttatccttcatggtgccaaactgctgtatgcttacggtgaagctactgtacctaaagtaacaatcacattgcgtaaatcttacggtggttctcacatcgtgatgagttgtaaacaacttcgtggtgacatgaactatgcttggccaacagctgaaatcgctgtaatgggtggtgcaggtgcagtagaagtattgtacgcgcgtgaagccaaagaccaggaaaatccggctcagttccttgccgaaaaagaagcagaatatacaaaactgtttgccaacccttataatgcagctaagtatggttacatcgatgatgtcatcgaaccccgtaacacacgtttccgcgtgatccgtgctttgcagcagttgcagactaagaaactgtctaatccggcgaagaaacatggtaatattccgttgtaatccaacttttcacattaaaacaagaacgattatgaacaaaaccaaaatcggaatattcctttctctgctgttgctgattggattgacttcctgcggagagcaaaagtcgaacaataagctattgctgaatgaagtcctgatagacaatcaaaacaactttcaggatgactacggcttgcacagtgcatggattgaaatattcaacaaatcatacggtagcgcagacttagcagcttgtttattgaaagtaagcagccagccgggcgatacagtaacctattttatcccgaaaggtgacatacttacattagtaaagccacgccaacatgcgttattttgggcagacggcgaacctaatcgtggtaccttccataccagcttcaaactgaaccctgaaacagccaattgggtcggtctttttgattcaggcagaaagctacttgatcaagttgtcataccagcaggaactttaggtcccaaccagtcttatgcacgcataagcgacggagcagcagactgggaagtaaaaggcggaagcaaagacaaatacgtaaccccgagcacgaacaacaaaacccttgacagtaatgccaagatggaaaagttcgaagaacatgactcagtcggtatcggtatgtctatttcagccatgagcgtagtattctgcggattgattcttctcttcattgccttcaaggtggtaggtaaagttgctgtcaacctgagcaaacgcaatgcgatgaaggctaaaggcatcgataaagtcgaagcgaaagagctttcacaggctccgggtgaagtttatgctgctatttcaatggcattacacgaaatgcaggatgaggtacatgacgtagaagaaacggtgctgaccatcactcgtgtgaaacgcagctattcaccgtggagttcgaagatttacaccttgcgtgaaaatcctaacagaaagtaaatcattccctaaaaagataaaacgatgaaagaatataaatataaaatcaacggtaactcatacaaagtaaccatcggagatattgaagataatatcgctcatgtagaagtgaacggtacgcactacaaagtagaaatggagaaacaaccgaaaactgctcccaaaccggtagtagtacgtcctatgcctaactcaccggctgctcctaccacaccggtagtaaaaccggctgctccttctacaggcaaatcaggcgttaagtccccgctaccaggcgttatccttgacatcaaagtaaatgtaggtgatacagtgaaaagaggacagactatcattatattggaagccatgaagatggaaaacaatatcaatgcagacaaagacggtaaagtgactgccatcaatgtcaacaagggagattctgttcttgaaggtaatgacctcgtaattattgaataatatgggagattttattaactttttaggaaataaccttgccgatttctggacctacacgggatttgccaacgcgacaggtggacatattgctatgatcattatcggtttaggctttatttacttagctgtagccaaagagttcgagccgatgttgttaattcctatcggattcggtattctgatcggtaatatacctttcaatatggacgccggactaaaagtcggtatatatgaagaaggttctgtattgaacatattgtatcagggagtaacgtccggctggtatccaccgctcatcttcttaggtatcggtgccatgacagacttctcggcgctaatctccaatccgaagctgatgctgatcggtgcggctgcccagtttggtatcttcggtgcatacatgatcgcattggaaatgggatttgacccgatgcaggccggtgctatcggtatcatcggtggagcagatggtccgacggctatcttcctttcgtccaagctggcacctaacttaatgggagccattgcggtatccgcctactcctatatggcgttagttccggtgatacagccgcctatcatgcgtctgctcaccaccaaacacgaacgcgttatccgtatgaaaccgccacgtgccgtttctcatacagagaaagtgattttcccgattatcggtctgttgctgacctgcttcctagttccttccggtctgcctctgttgggtatgctgttcttcggtaacctgttgaaagaaagtggtgtaacccgccgtctggctaacacagccagcggtccgctgattgacgttatcactatcctgttaggtttgacagtaggtgcttctactcaggcttctgagttcctgacactcgactccatcaagatcttcgccctcggtgctttgtcatttattattgctactgcatcaggtgtgatcttcgttaagatcttcaacctcttcctcaagaagggcaataagatcaatccgttgatcggtaatgcaggtgtatctgccgttcccgactctgcacgtatctcacaagttgtcggtctggaatatgatcctaccaactacttgctgatgcacgctatgggtccgaacgtagcaggtgtaatcggttcggctgttgctgccggtatcctgttaggattcttaatgtagggacaaaatattaggtgcggatattgctgttttagatgcaatatccgcacttatcattatgttatcttctcttatcattccgttaatctattccaaaaaggctacgaataattcgtaaatacgatattttttagcatcttgcgtctttgttacgacacactaaaataaatatttatgaaacggattattctcctcgccttcctttgtaccaccaccctggtgatggcgcagcgcatcaatcatgttcaggaagcaatagcaaactacgattacgaggcagctctcactctcattgccaaagaaaagccgacaattcccctactcttgcaaaaaggtaaagcacaacggggacttgggatgaatacagaagcactttccacttatcaggaaatcatagccaatgatactgccaatacccgtgcatatatcgaagcagccgaatgctgccgttcattggccaaataccaacaggcactgaaatattatgaacaggcacttgatctgaatccggaaaacaaatatgtgcgtattcaatacatcggactactgctctctttacagaagtttcaggatgctttaggagaaagtagtctgatgacagagaaagacagttccgccatcgccttgcatctgcaggcccaaagtttcgaaggtatgggagagcttctccccgccacggggtgctactataatatacaggagaaataccccgacgactatcttgccgccgccaagctcgccgcactgaacatagccggttcttatttcaacgaagcaattgaagccacggagaaatatcggcagactgataccaccaatatcgctgtcaaccgtcagaatgcactggcatattgtctgaataaggattatcctaccgctatccagcgttatgaatacctggtgagccagggcgacagttcttttcatacctgttattatctgggtatcagctattatgcggaagagaaatattacgaagcacatgactttctggaagccgcccgaaaacatgatcctgaaaacgtaaacctgctttattatctcggccgtgcctgcgccaagacttcatggaagaagttaggcgtagagtatctcgaaaaagcgcttgatctgactattcccaaagacagtaatatggtacggctctatattggcatgaccgactgctacaaaatggcacagatgcctaaagagcagattgaatcgatcagagaacgctaccggaaatacgataaacaaaatcataagctgctctatgatatggctttcatttatttctattcgctgaaagacaagaaaaataccgaacgctgtctggaagcattcttaaaaacacgcccgaaagaagataaggaagaagaagcgaaactaaacgaacgaggcgaactcgttttaggcactaagaattattataatgctgcagccaactggctgaaagacattcaaagtaagcaaaagatagaagatttcttcttgggaggaaatgtgcccgctcagaaaccggaataagcagataaaggatattacgtaaaaaaggctgcaaccgtcaaacgattgcagcctttctatataataggataatctgtgattattcagccaatttgttgtctgaacccagcacattaaggattttgtgcttgtacagtttttccatgttgtcacgagccggaccaagatacttacgtgggtcgaattcagcaggtttttcagcgaaagtcttacggatagcagcagtcatagccagacgagagtctgagtcgatgttgattttgcaaacagcagacttggcagctttacgcaattcttcttcaggaataccgatagcagctttcagagcaccaccaaacttgttgattgtttcaacttcttcttcaggaactgaagatgatccgtgaagtacgatagggaatcccggaagtttttccattacagcatccaatacttcgaaagccaatggaggaggaaccatacgaccggtagccggatcgatgtggcactgttccggagtaaacttgtaagcaccgtgagaagtaccgatagagatagccaatgagtcacaacctgtacgagtagcgaaatcgattacttcttcagggtcagtgtatgtgtggtggtcagaagaaacttcatcttctacacctgccaatacaccaagttcaccttcaactgttacgtcgaactgatgagcgtattcaaccaccttcttagtcaaagcaacgttttcttcgtaaggaagatgagaaccatcgatcataactgaagagaaacctgaatcgatgcaagatttgcaagtttcaaaagtatctccgtggtcaaggtgaagaacgatttcaggatgtgcgcaacctaattcttttgcgtactctacagcaccctgagccatgtaacgcaacaaagtagcgttagcatactgacgagcacctttagaaacctgaagaatcaccggagattttgtttctactgcagccttgatgatagcctgcatctgttccatattgttgaagttgaatgctgggatagcgtatccacccttaatagccttagcaaacatgtctcttgtgtttaccaatcctaagtctttgtaattaaccattttgtttaaagtttattgttagtgaattaaaattctacgcaaaagtaagcattatccaccgaataacgagcatcggaaagaaaaatataatagaaaaaggtttaaatcgatcagcaaatattcatccgtaagcgggtctgacattagattgtaatgtccacctagcaaataaacggctgaaaggttctatcccaaaacaggtattataccataaaaagcacaagacattcttttcgtgccaatcatataattcatagaaatagcataattcacagaagttttttcagcaaagttttttctattccggagaaatgtgctatctttgcgctctgaaaatgaccattacactatttcttaccaaaatagtaacagaatataaattaaaaaaacagatactgaaatgaaaaaaggccttcatccagaatcataccgtccggtagtattcaaagatatgtcaaatggtgatatgtttttgtctaaatcaactgtagcaactaaagaaaccatcgaattcgaaggtgaaacttatccgttgctgaagattgaaatctctaacacttctcacccgttctatacaggtaaatctacattggtagatactgcaggtcgcgttgataagttcatgagccgttacggtgaccgtaagaagaaataattcaatctttcgttaagatgaaaaaagaggagatttccggttggaaatttcctctttttcgtttcatagataaactaaaggaccgcaccattcttcacagagtagtgcggtccgtatattaactggctaaggggaactattaccaggtaatataaaaatggtatagttaagggaatataccataccattatattgtctgatctcctgaaaaatgatggtttattaaatagtactattcaggagaaatacttcctattatatataataatattcagcaggcaaaaaagacggtcctgctgacccgttgcactacatattacagtccacgagggatgagatacagtgggcgcattaacgctccacacgggggacagaaccgtatatctaaggaagccacgagcatattcccacatgctcgtagcttaaattcgagaattaaattctcatatcgcattccgcgactgtaatactagtgcggtgcaaaagtgggaataatctctgataaaatcaacagaaaaggcattttttatctataaacaatcattttcctttaatgttgatactaatttcacatttctaatatacccgtctctactgaacatagtcaagtattaaattgtttacttcccaaacaatgaacgacttatgaaaaatatctatgtgattgcactcgcagccatcctatttcaaggctgcgggcaaaaaaaagagatgacggtacccgccacccgacctgttaagacaactattgtcgaatcaaggtcagtaatcagaaaagacttctccggcattgtagaagcagtggagtatgtcaaactggcattccgcgtcagcggacagatcatcagcctgcctgttatcgaaggagagaaagtgaaaaaagggcaactgattgcagctatcgatcccagagatatcgcattgcagtatgctgccaccaagtctgcctacgaaacagcttccgcacaagtggaacgcaacaagcgcctgctctcccggcaagcgatctccgtgcaggagtatgaaatcagcctttccaattatcagaaagcaaaatcggagtacgaactgtccagcaacaacatgcgtgacaccaaactgacggcccctttcgacggttctatcgagaagcggttggtggagaactaccagcgtgtcaattcaggagaagggatcgtacaactggtcaacacacagaacctgcgtatcaagttcaccataccggatgcatatctttatctcctccgtgccaaagatccccgtttccttgtagagtttgataccttcaagggccatgtgttcaaggcgagactggaggaatatctggacatatccaccgaaggaacgggtattccggtcagcatcactatcgacgacccttcattcgaccgggacttatatgccgtgaagcccggcttcacttgcagcatccgtttcacagccgatgtaggcccattggtgcaggatagctggacaatcatcccgctcagtgctgttttcggcgaaagtgacggaaacaacatgtatgtctgggtagtagaggacaacaaagtgcacaaacgcaaaatcgtcgtcaatgcccccacaggagaggcgcaagtactcgtgtccgaaggactgaaacccggagaacaaatcgtcatagcaggagtataccagttggtagaaggagaaagtattaaatcaatagacaaatgaatttagcaaaatattcactggataacacgaagatcatctatttcttccttgccgtactgctgattggaggtattacctccttcggaaagctgggtaagaaagaagatgcccccttcgttatcaaatcagcggtcatcatgacacgctatccgggagccgaaccggcagaagtagaacggctgatcacagagcctatctcccgtgagatacaaagtatgagcggcgtgtacaagataaaatcagagtccatgtacgggctctccaaaatcacgttcgaactgcaaccttcactttccgccagttccatccctcagaaatgggacgaactgcgacgcaaagtgctcaatattcaaccgcagctgcccagcggtgcttccaccccgaccgtctccgatgatttcggcgacgtattcggcatttattatggactgacggcagatgacggcttcacctatgaggaaatgcgcaactgggcggaacggatcaagacgcaggttgtcacagcagacggcgtgatgaaagtagcgctgtttggcgtacagacggaagtagtcaacatcttcgtttctaccaacaaactggtgggaatggggatcgatcccaaacagctggccaacctgctgcaatcgcagaaccagattatcaacaccggagaaatccgtgcaggcgtacagcagttacgggtgacagccaacggaatgtatgccaacatagacgatatccgcaaccaggtaatcaccaccaaagccggacaggtgaaactgggcgacatagccgtgatcgagaaaggttatctcgaccctccatccaacatcatgcatgtgaacgggaaacgggctatcggcatcggtgtttccaccgacccgcaaagagatgtagtgcagacgggtgagaacgtaaaagtaaaactgaacgagctcctccccctcatgcctgtgggactggaactgcaaagcctctacctcgaaaacgagatcgccaacgaagccaacaacggatttatcatcaacctgatcgaatccatcctgatcgtgattgtcattatcatgctggtgatggggctccgtgccggtctgctcatcggctcttcgctgattttctctatcggaggtacactgctcatcatgtctttcttcggcgtcggactcaacagaacgtctctggcaggatttatcatcgccatgggtatgctggtggacaacgccatcgtagtgacggacaacgcccaaatagccattgcccgaggtgtaaaccgacggaaagccctgatagacggagcaaccggaccacaatggggcttgctcggagcaactttcattgccatctgctccttcctgccgctttaccttgctccctctgctgtagcggaaatcgtaaaaccgctgtttgtggtacttgccatttcactaggactgagctgggtacttgccctgacgcagactaccgtattcggaaatttcattctgaaagccaaaacaggcgacagcacgaaagatccatacgacaagccgttctatcataagttcgcttccgttctcggagtattgatccgcaagaaagcagtgacactggtatccatggtgatcctcttcatcatctcgctcattattatgggaacgatgccgcagaacttcttcccgtcgctcgataagccttatttccgggcggatgtattctatccggacggatacagcatcaatgacgtagtgaaagagatgaaatcggtagaagagcacctggcgaagcagccggaagtaaaaaaggtatccatcacattcggcagcaccccgctaaggtattaccttgcctccacttccgtaggtccgaaaccgaattttgccaatgtactcgtcgaactgacagacagtaaatatacgaaagaatacgaagaagattttgacggatatatgaaagccaattatccgagtgcaatcacacggaccagcttgttcaaactgtcccccgcagtggatgcggctatcgaaatcggctttatcggtccgaatgtggatacgcttgtatcacttaccaatcaggcaatagccattatgcaccagaatccggatttaattaatatccgcaattcgtggggaaacaagatacccgtctggaaaccggtttacagcccggaacgggcacaaccgctgggtgtatcccgacagggaatggcacagagcattcagatcggtaccacaggaatgactttgggagaataccggcagggagatcaggtacttcctatcctattgaaaaataaccagctggattcattccggatcaatgatctgcgcacactgcccgtattcgggacaggcaacgagacgaccagcctggaacaggtagtatctgaatttgacttccagtaccggttctcgaacgtgaaagactataaccggcagatggtgatgatggcacaatgcgacccgcgtcgcggaaccaatgcgatttccgctttcaaccaggtatggtcgcaagtacagcaagagataaaaataccggaaggatataccatgaagtatttcggcgaacaggaaagtcaggtggaatcgaatgaagcgctggccaaaaacttaccgctgacattcttcctgatgtttgtgacgctgctcttcttgttcaagacgtatcgcaagccgaccgtcatcctgttaatgctgccgctgatcttcatcggtatcgtgttgggactgctcgtactcggcaagtcgttcgacttcttctccatattgggtctgctaggtctgattggtatgaacatcaagaacgctatcgtactggtagaccaaatcgatttggaaacagcagcaggcaaaaaaccgctggacgcagtcatcagtgccacaaccagtcgcatcattccggtagcgatggcctccggaacaacgattctgggtatgttgccgctactgttcgacgccatgttcggcggaatggccgccaccatcatgggcggactgttagtagcctcggcattgacactattcgtccttcctgtagcctattgcgccatccaccggatcaaaggagaacaataattatccattatcaactatccattatccattaaaagattatccatgaaagaaatgaaaacccaactcatactattttcactgttgctccttggctccacagcctgggcgcaacagccctgcctgagtcaggacgcctaccgcgaaaaagtggaggcttacagccagatattgaaacaacaaaaactaaagacattggccagttcggaggcgcgaaagatagcccatacaggtttcctgccgaaaatcgacgtaaatgcagacggtaccctgaacatgagcgaccttagcgcatggaacgaaccggtgggcgaataccgcaaccatacctaccagggagtatttgtcgtatcacagccactctacacaggcggtgcgctcaatgcccaacatcagatagcgaaggcagacgaaaagctgaaccagctgaacgaggaactcacgttagaccagattcactatcaaagtgatgctgtctactggaatgcctccgcttcaaaagccatgctacaagcagccgacaaataccagagcattgtcaaacagcaatatgacattattcaggaccgtttcgatgacggaatgatcagccgtacagatcttctgatgatttccacccggctgaaagaagcggaactgcagtatatcaaagcccgccagaattatacattagcgctgcaacagctgaatattctgatgggagaagcaccgaatactcctgtagacagcctgtacaacatcggaatgatctccgctcctgtccggatactgcctctggaagatgttttgcaacgacgtgccgattatgccagtacggaagtaaacatcatgaagagccaggcacaacgtaaagcggctctcagccagttcaatccccaattaaacatgtatttcagcggtggctgggcaacggccacacccaacttgggatacgacgtatcttttaatcccatcgtaggagtcaatctgaatattcccattttccgctggggagcccgtttcaagacgaaccgacagcagaaggcatatatcggaatacaaaagttgcaacagagttatatgacggacaatatcaacgaagaactgtcggcagctctcaccaaactgacggaaacagaatctcaggtgaaaacagcgaaagaaaacatgagtctggcaaatgagaatctggatctggccactttctcctacaatgaaggaaaagcgagcatggtagatgtactttccgcccagttgtcatggacgcaagcacacaccaatctgatcaatgcttatctggcagagaagatggctgtggctgaatacaagaaggtgaccagcgaatagataaaaacaaaattaggcacggatgacacggatttcacggttttaagagttgagtaactaaaaaccgtgtttatccgcgtaatccgtgcctaatttttattggttgttctttttattatgcaaggaaggagatcagtacacccgcagctactgccgagccgattacccctgagatgttacttgccatacaatactgcaatacatgattcttcggatcgtatttcaacgcaatctcattcgccacacggcttgccatcggaacagcgctcagtccggtcgctccgatcagcggattaatcttcttcttggagaatagattcactaacttcacaaagaagataccaccggtaatagaaagagcaaatgcaaggaaaccaccgatgacaataccgattgtcgtccagttcaagaaggcttcagccgtcatggttgcacctaccgaaagtccgaggaagatagtagcagcattcatgatactgttggaagcagcgtcgaacagacggaaagtattgcttccgatttctttcaccagattaccgaacatcagcataccgatcaaaggtactgcacttgggacgaagagagctacaatcgtagtcactacaatcgggaaaataatcttcagtacacgcagattcttgatttccgtcttcgaaggatatttcttttcctgttccttcatgttgatgctcagttctttcttagtacagaacagcttcactaccaacggaatgatcacaggcaccagtgccatataagaataagcggcaatagcgatcggacccagcaaatgcggagccagcttgatcgttgtaaagatggctgtcggtccgtccgcaccaccgataatacccagtgaagcagcttcttgcggagtgaatcccatcaggatggctaccagcagaacagtaaagatacctaactgtgcagcagctccaaagatggaaagatgcagattacgcaacatcggtccgaagtccgtcaacgcaccgacccccataaagatgatcggaggcaggaaaccggtcttgatcagcatataatagatgaagttcataattcccagttcatgcgcaatgtcatgcaaaggcatttcccagatattcttcatcacaccgtttatcatcaccataccattctcgtctgcctgtatcactcccatatctcctccggggaagttggcaagcaacacaccgaaagcaatcggaacaagcagcagcggttcgtactgtttcttaatccccagataaagcaggacgaacgcgatggcatacattatcagaaactgcggttcggcaatgatattgctgaacgcagtcatgtcatataagttctcaaatatctcgttcattatcctatcttcattaatacatcatcttctgaaacagtgtctcccggattagcgcagatagcagttatcgtaccgctaaattcggcacggatagcgttgtaagtcttcattgcttccacataacaaagcacatcgccctctttcaccgcatcgccaactttcaaggcagattcctgcgcattcttcaccaggaagaatttaccttccagcggagaaagaacatctttgccctctcctgccggagctgcagctacaggtgcagcaggcagttcggcatctccgtatgctaccgtcacacgataagcctgtccgtccacctgtacagtcagtgtttttggttttgcatcttcttccggcgatttatctttctcggcacgacgttttgccacgtctgccaggaagtcttccttcgcttttccactcttgtaagcctcatactgagccggatgcatggcatattcgaagagttcttcgtcgtcctctcccacttcccatttgttttccttcatcagcttgcgatacttgtcgagtgagtcagggtaattgtcctgcggattaccttcgaagaatttacgtccttcacgttcggctttctcgatgatttcgggagccagtgtacccggcaggcgtcctgctttacccagcagcatatcccagatatcgtcggcaatcattccccagcgttccttgcctttttccattgccatcacattcatcatggcaaggttcttcacgtactggctgaacggagttaccaatggaggataaccgacgcggggccatacatacgccacttcgttgaatagcttgatcagcagctgatcctgtgtcataaacggcaggttatgtttggctttatacttgttgatagattccagattcgattcgaggtcagccatcagactacccatcataccgccaggaagtcccggaccgatcagcagcgagttcatcagacggttcttcggactgatatacaagccgaggaagtcatccataaattcttgaatcagcgcacgcactttcatgtaggcttccatattgatttccggtacctgatatccggcatctttcagcatagcctgtacactgagaagatcggcgtgtcccgtaccccatgaaagcggttccatacctacgtcaatgtagtcgcaaccggcttcgcatacttcgaggatgcttgccatgttgaaaccgggaccggcatgactatgatactgaataggaatttcaggatgtgccgctttgatattggccacgatcttgcccaatgaaacggggcgaccgatacctgccatgtctttgatgcaaatctcgtccgcccccagcttgataagttctaacgccatattggtgtagtactctaccgtgtggatcggcgaatgggtgatgcagagtgaacactgtgagatcatgcctgcctctttggcatacgtgatggaaggagcgatattgcgtacgtcgttcaatccgcagaatgtacgggtgatatctgtgccttgtgctttcttaactttgtagaacaacttgcggacgtctgccggaacggggctcatacggagtccgttcaatgcacggtcgagcatgtgtgtctgtatgccggcttcgtggaacggcttcgtccattcgcgcacggctctattcgggttttcaccaaacaataaattcacttgttcaaaacctccgccatttgtttctacacgggcgaaacagcccatttcaatgatggcaggagctacctttacgagttggtctacacgaggtacatattttccggcagattgccacatatctcggaaaaccagactaaacttaacttctcttttcatgtttttctatgatatacttttgataggtttataacttttctacttttgtaatctttccttttcctaatgtcaccacattcacagctgctgtgatagccgccattatattacccggaataggcgcaggaccttgtggcgcttccttcttcgcaggaaccacttcttcgggagcatacttgttgacaagagtaatcagtaacttacctaaataaatcacaatcagcagaataacaaatacggtagccatgccgaccaccatcagcaggatcgctgtttcgatattttccatataataaactattagtaattcaagtcgtttgtccaaaaagcgtccgaaaataccaaatatttgtgataaaattaattaagagaggaataaaaaagtataaatcgtaaggttacaataagaaaaaacacattattctttgcatgtctattaaaaagacaaaggaaaagccccttgaggggctctttttattttagggagttattaaaatgttattaatctgataattaaagaaaatggccttcgtccttacactttttatattcacttatcaatctctatttttcaatcatccaatcccccagtgtgccactttcactatcaaaattaacagccaccttcaccactggcagtccacatagagcaaagcgttccggataattctttaaatttatctgttccatagcaactgtcgcattcttatccagtttcaattccatcacatataatgtggcctcagtacgcaacactacatccacacgaccacgggaagtacgtacttcgacatccacatagtatcccagcaagctgaatatgatatagaatacctgctggtaatgaccttcgtactttgtatgatcgcattgaggtatagtagacagaaaggtttgcaaacgccgtaatgccgcgtccatatcacctttccggatatcacgggaaataaaagccaccatgttcgtcgcctcacgtgtgtcattggttacataataaggcaacaagcttcgcatcaatcccaccctcacctctttattaggaatatccaacgtatatagttccaattccttatcgtaatccttgatagtgacatagccgctttgatacagcaatggagtaatgctactcatcgtttcagtgggagcatcaaattcttcgaccgccgccaatttatttcctatttcagaaggctctactccaaacttatccagcatctttatcagataggtaggagtgccgctaccaaaccaataagaattaaatttcccatctgcaaaagcattgagcagactgaatggattatagatgtcgggcgatggataagtgaaatgatagccgtcataattctctttcaacttagccagtacttcctccgcagtaatattcaatttgacagccatcctatccacatcttctttcatttgggtaagtatctcattctccgttatgccacaaatggcagcataaggttcatccatgctgatatttttgatgttattgagttcactgaaaatgctgagctgtgagaatttagtgatacctgtaagaaacacatagcgcaaataaggatcacaggctttcaacggactatagaagttacgcataacgtcacgcaatacccccaagttctcccgttcgtgtaccacatccagcaaaggagcgtcatattcatcaataaggaccacgaccttcctgccagtctgttcataagcacgttttatcagattagtcaggcgcaaattagggtctgtacctgctgcatcaatccctagtgtacgttcgtgttctgttagcatgaagtctaaaagattcatcagtttatctttgtccacgtgcttggccatactcatatcgaagtgcagaaccggatactgtatccattctttctccagcttctccatcgccaatccacgaaacagttcttcacgaccggagaaatagctatgcaacgtagaggttaacaatgatttaccaaaacgacgcggacggctcaggaacatataactggaagcagaatgcgtcatccggtaaacgtattctgtcttatctacatagaggaaatttccctcacgaatcttagaaaatgtctgtatccctataggatataatctctgcaaatcttccataacaactttctttttcacaaagctactaaaaaattccaatattcaaatgtcattcttctccttcttatatcgaatataaagttttgcccactcattcactttctccaaaaactcttcttcggtgcgagtcctataataatattcaagaatacgctcataatgaatcagagctttttcttccccttttttaccttttggtaagtagcaggtcccatatgtatctcttgacacatttttgaaagattcacatgtgctactttaagcaccttttcaataaactcaccgagtttaggatgcacgattttattttccatttttcttattattagttaaaaacacgtcttatatattaaacattttcacactacttcagacatatctgaactcgacttattttatttgtcttactttcgcaccatgctttgaaagtcaaagtcatttattaaacgtcctaatagaagtattctatgcaaaactttttcagaatgtcttatttcatgcccccgattgctcccatcaggaacgaacaaggacaaaccgttacacccgccactctcactcccttctgcgaagtctcagtagagcaagtatatcagatgatcacctgcaatgaaaatctcaaagcactgaccgaacaggtgcgcagcgccgaagatatacgaatggcgaaaacatccttgctgccatacgtgactccgtgcggcacattcatccgccggaacagtaaattcttcgcatctccttccggactcgtagtggtagatatagataacctcgactcctatcagaaagccgtagaaatgcgtcgtacactgttcgacgatccttttctccaccctgtactcgcatttatcagtcccagcaaccggggtgtgaaaacattcgtaccttacagcaacctgtacacagacgatcagagccgtaatgtaagagagagtatgagctgggcaatggaatacgtagaaatgacctacggatcagaaatgaacaactccatcgaaacagttcaaaaagccgtagacacctccggcaaagacatcgtaagagcctgcttcctcagccatgacccacaagcactattcagagaatattaaattataatcacgaatgatcaaacttcaattgtcaattatcatttgtcaattgtcaattatcaaaaaatgaccgatattgaatctttacgcctcctcaccgaagcagtcgaaacagcaggtgccgacattgcacccacttacgccgagtacgtacaattagcattcgccatcgcaacggactgtggtgaagcaggacgggagttttttcatcgcctgtgccggatttccgccaagtatcaatccgcccatgccgaacgaatgttttccaatgcactcacgaaacagcagggagcaatacatctcggaacggcatttcacctcgctgaatcgacaggagtaaaaatctgcagggaagaccggaaggaagttatgaacaaccggacgggtacagtaggtacagaaagttcaccgcacaatttttccacacacgcgcacgtatataataaagtagaagaagaaaagagtgaatcagaagaactgctggaaggcagcgacccgcatcacccattacctactttcaccttagaagactggccgaagctactgctacgtatcataagttatggcactaccgccactcaaaaagacgtactcttgctcggagcattgactgccctgggtgccaccatggaacgatacgtgagatgtcattatgccggcaaataccaatcgccctgcatgcaatccttcattgtagctccggcagcctcgggcaagggagtactatcactcatccgcctgctcgttatgcctatccacgatgatatccgccaacaagttgaaaaagagatgaatgtctacaaaaaggcaaaagtcgcctacgaaatgatgggcaaagagcgtgccaaagcggaaatccccgaaatacctttaaacagaatgttcctcatctccggcaacaataccggtaccggtatccttcaaaatattatggataacaacggaacaggcctcatctgcgaaaccgaggcggatacgatctctaccgccatcggttcggaatacggtcactggagtgagacgcttcgcagagcattcgaccatgactggttagcatacaaccgacgtaccaatcaggagtaccgggaaaacaagaaaagttacctctctctcttgctttcggggacacccgcacaggtgaaaccactcattccttcagtagagaacggacttttttcacgccagctgttctattatatgcacggtatctatcaatggatcaatcagtttgacgagaacgaaacggacctggaagccatcttcacctccattggtctggaatggaaaaagctcttgaacttactcaaggaacatggtctccacacactccggctcacggatgaacagaaacaggagttcaatgatctcttttccgaactgttcacccggtcaacgattgccaatggcagagaaatgaacagttccatcgcccgaatggctgtcaacatctgccgtatcatgtcagtagtggccatgcttcgtgctcttgaaaatcctcagccgtatcaataccaggcatcttctcatcccctgcttacaccggacaaggaaatcgccactgataatatcaaagacggtatcattacccggtgggatatgacgatcactcccaaagattttaaggctgtgttgaaccttgtgaaaccactctatcagcatgccacgcatatcttgtctttccttcctccttcagaagtcagccatagggccaatgccgaccgtgacgcattctttgaggcactgggtatccaatttacccgtgcacagttgttggagcaggctacgactatgggaatcaagcccaacactgccctcacctggctgaaacgactggtaaaacagggactgattgtcaatcttgacggtaaaggtacttacgcgcacgcacgcgtgtgcgtgtgttagggaagggccggaaaagtgtacctactgtacctgttgataacatcgtcttttatcgtttctttatgaaaatcagagtatagcgttttgtattggctaaagctatgctttacgacttctaaagcggtgctttatggcctctaaagcttagctttagctaatacaaaacgcccctcgcagtctacaacacttattacctgttacctaatacttattacctgctcatggttctcccaatgcatccacaatcacccttacctccagcggagtgtaagaacggtgctgcggctgataacctaaatcggacaggcgttcctgaagaccgggacagcggacaatccatttattcattttgcggtaagcggcaatgccagtaagttcgggagaataaagctgtgccagttccatacgaccataagcacgtattttgaattctatcatgacaaataagtttctgttttactgtcacaaaagtaacaaaatatattcacattacctacgttttatcagggaataacagactataactgacaacaattgcacattaccgactctcactgtacacaaccgattcttccgagttacagcatactatctttgtgtcatcgaaagggagaaatcctcacgaaagtatgtttaactctttaaaattattattttatgattcgttacaaaatttatcagaaccaacagaaaaaaggcttgaatgccggcaaatggttcgcccgggcggtaagcgacgagacattcgaccttgccaaacttgccgaacacatgtcgaaacacaattcaccgtattccagtggggtgatcaaaggcgtgctcactgatatggtggactgcatcaaggaactgctgctcgacggcaaaagtgtgaaaattgatgatctagccatcttcggtgtaggaatccgcagcaaggctgccgaaacgctggaagagttctcgctggagaagaacatcacaggtatgcggctcaaagcacgtgccactggaaacttatcaacgaccaatctgaagctcgacagccaattgaagcagcaggcggagtatcagaaaccgacaacgcccggaggaggaggttccggttcaggcaacactcccgatccaaaacctaatccggacgaaggagacgaagaagcaccggacccgactgtttaagtcataacctgaaccccgcaaagtctttagcttatcacggctaaagactcattaaaaatcaatatttttttcatttaaaatcaaaacctatgagtaattcatcatcacgatccgtatggagtttcattatcaaagtaatcatcactgtcgctactgctgtaggtggtttgataggagtacaaagctgtatgtaaacttatgcggaccatcacactgattatcattcattgcagtgccacgccagagggaaaatccctctcggcggaggcttgccgacaggatcatatccgacatcggggattccgtgacatcggttaccatttctacatcacacgtgatggggaaatacatccgggacgaccgttagaaaaggtcggagcacattgccggaatcataacgcacattctataggaatctgttacgaaggaggactggatgctgacggacggactaaggatacacgtacgctagagcaacggggatcgttgttagccttaattcgtgagttacgaaagaggtttccaaaagcgttgatagtagggcatcatgatttgaatccgatgaaagaatgtccgtgttttcggtgtgtagaggaatataaggagttgtaaaagaggaggtcaatcacacttatcaaactcatcaatgatttgttccagtatttctttcaattggggcaaatcatttttgatttgttttctacacatagatcccgtctttatttatacagtttctcaacaattcatccatgttattccgcaatctaactacatctacaggacatttaaacagtttttccaattcttccttaatatgaactaaagtaaatatagaaggcctatctatctccacgcatatatcaacatcactaccgtcatgttgctcaccacgagctactgagccaaatattcccatacgagatataccatatttaacagcattctcccgcatgtatttacgaagaagggatagatattctatagtacttaacataatag

SEQ ID NO: 52 - DNA, 51838 bp, Bacteroides thetaiotaomicron
cataaggtaatgacttaatacttaatataacacttaatacttaatctctaaataagctacggctaatacttaatacctattacttaatacttaaaagaattgtcgttatctctttttatagcccgtcgtatttatcgcgagagcgatggtggaaaacaggtttcacgtcctgcggtcctcattgctatggctggtattgccatagggttggctgttatgattattgcggtggcggtagtcatagggtttaaaagtgaggtaaggaataaagtcatcgggttcgggtcgcacattcagatagcgaatctggatgcggtcaattcttatgagactcatccgatagcggtgggggacagtatgatgactgctctttccggttatccccaagtaagccatgtgcaacgttattctaccaagccggggatgataaaaacggatgatgcttttcagggaatggtactgaaaggtgtcggaccggagtttgatccgagttttatgcaggagtatctggtggaaggggagattcctgcgttcagcgattcggcttcgagtaatcaggtacttatctccaaggcgctggctaccaaaatgaagctgaagctgggagataagatatatacctattatattcaggataatatccgtgcccggcgcttgacgattgcaggcatttatcagaccaatttctcggagtatgataatctgtttctgctgactgacctttatttggtgaaccgtctgaatggctgggaaccggagcaggtgagcggagtggagctgcaggtgcgcgactatgataaactggaagatatcacttacgagatagccgttgatacggatagccagcgtgataagtttggaggcgtgtattatgtacgcaatatagagcaactgaatccccagatatttgaatggctcaatctgcttgatctgaatgtatgggtaatccttttcctgatgataggagttgccggctttaccatgatttccggtttgctgattattatcatagaacgcaccaatatgatcggaatactgaaagcgctgggagccgataattttacgattcgcaagactttcctttggtttgccgtctttctcatcggcaaggggatgctttggggcaatgcgattggactggcattctgttttatccagtcccaattcggaatatttaagctcgatccggagaattattatgttgatacggtatcggtttctttcaatgtctggttcttccttttgatcaatgcaggtacgttgctggcatcggttctgatgctgatcggaccttcttacttgataacgaagatcaatcctgcaagctccatgcggtacgagtaatcttctctttttcttttctttttttgctgcaaaaataatttagaccgtagcgtgatgtagagtgaataatatgtctatatttgcgcccgatttacttaatatcctcttgtaggtttaatttttaaccattatgaataatgtgttaattctgttggataatccggatgactggaagccgtattgtgagacgaaaagtatcctgactgtttccgactatctgaagaacaagccggttgaaaaagaccggaagttagttattaatcttagcaatgattacagctataactccgaagggtattactgttcgttgcttgcccagacgagaggacaacgggtgattcccgatgttgacatcatcaacaaactggagacggggacaggaatccgcatggaccgaagtctgcaggcgttgtgttatcaatggattcagaagaacgggatcaaaagtgatatctggtatctgaatatctatttcgggaaatgccgtgagaaagggctggaaagagtggcccgcttcattttcgagaactatccctgccctttgttgagagtcgctctgaacactcatccgaagaatcagattgaaagtattcagttcttgcctttgaaccggttggatgatgaggaacaggacttctttgccaatacgctggataactttaataagaaaatatggcgtgcgcctaagtcggcaaaagctccgagatatagcttggcggtactgatcgatccgaaagagaaatttccgcccagcaacaaaggcgctttgcataaactctccgaggtggccaagaagatgaatatccacgtcgaaatgattacagaggatgatgccatgcgtctgttggaatttgatgcgctgtttatccggacaacgacatcgctgaatcattatacattccatttgtcacagttggccgcccagaatgggatggtcgtcattgatgatccgttgtctatcattcggtgtaccaataaggtttatctgaaagaactttttgagaaagaaaggattccggcaccgaagtctacgttgatttttcagtccaatgagaactcgttcgaacagatcagtgagcaggttggtgctccttttatcttgaagataccggacggttcctattccattggcatgaaaaaggtgtccaatgaagaagaactgaaaacaagtcttgaacttcttttcgagaagtcggctatcttgttggcgcaggcatttacgcctacggagtttgactggcgtgtcggtctgctgaacggagtacctttgtatgcctgcaagtattatatggcaaaaggtcattggcagatttactgccattatgattcgggcaggagccgctgcggactggtggatacgattcctatctatcaggtgccgcgtgtggtactggatacggcgataaaggctgccaatctcatcggaaaaggcttgtatggagtggatttgaagatggtcgatgataaggcttacgtgattgaaatcaacgataatccgagtatcgaccatgaactggaagatgcgattatcggtgacgaaatgtattaccgtctgttgaatcactttgagcaggcgctggaaatgaaacattattaatgatggaaccaacgatacacctccgtcaggcaaaagcgggagacattcctgccattctggagatagagcaggaatgttttcaggaagatagtttttcgagagaacagtttgtttatctgatctgccgttcaaagggcaccttttatgtggtggtggaacaggagcggataatcgcctatgtctcattattgtttcatgcgggaactcgttatctgcgaatatattcgatagccgtccatccggactgcagaggaaggaagctgggacagttgctcatggagcggacgattgagacagctcttgactgtagggcggtaaagattacgctcgaagtaaaagagtcgaatacgcctgccatcaagctatatatgaaaaatggctttattcccgtgggagtaaagccaaactattatcatgatggttcggatgcgatttatatgcagcggcacatgtaatcagcagttgcctatcttctcataaagtctcctttcctgcgtaaggagcggtaaagtttgaatttgagcgactggatgggctggaggatatcgaaaaccggcagggagaaataatatttcctgtctccgcccatttctttggctgtccgattaatgatgattgcctgtacggtatagcggaacagccagatcagtaatgcaattccggcagccagccaatggttgttgaggatgccgaatacaagacccgcgatgcaggcagcgtaaaacagcagatgggagaaagtctcgaatcctaacaaatagcgctgtacaccgtgataaaagcgtgcggttgccatatagcttatcttttcttctttccattctttgtagctgtataccggttgtatccgcatagttgcattgatatccgtttctacacgtgtgttggatggggtggctatctggttgatgaataaatcatcttccccgcgttgcaggttcagataagtggaatagccttttctctggaagaataattctttccggtaagccatattgcggccgatgcccatgtatggctttcctgccagtgcaaagcataaataacgcagagactggaataacgtgtcaaaggctacccgtttgtgcagccatcctttggtccggtcgtaaccgctgtatcccagtactatctgagtctgtgaagtgaagttacgtgccattagtctgagccagtctttgcttgcaggcatacagtttgtttctgtaaataccagccagtcgtgtttgctggccttgatgcccaatgtcagggcaagtttcttatgactgatgtagcgtgcgctgtcgggagtgaagctgtggtagaggtgaggatatttctcttccataaatcccagtacatcctctgtctcatccgtagaagcatcgttgataacaatcacttcgaactgcggatagtcttgttcgagaatggcaggtaagattttacgtaggttatcagcttcgttgcgtgcacaaagaatcacggaaagcggaggcatctcttgtgtgaagtgcactgcttctttgcgtacagccttattgtgggcatgtatccgattgtacaagccgaaataataaatgagctgaatgataaaaagaatacctgccgccgataaaagaatcagttcgacagtattgaatgtaaatgcttccattggatataagtgtcgtttttacgactgcaaaagtacgtatttttttggtagctccgtcatctcgcaggaaggttatttcgtaaatccagatattctttcttgaacatgtcgacgaatagaaagaataatgaaagcagcaacggaccgaagatgactcccataaatccgaacaacggcaaaccgataacgactccgaatatcgtaatcagcggatgggtatccgccattttcttctgcaggatgaatcggatcaggttatccgactgagatatgactattccaccgtatgcggcgagtccgatagcgttgaaccagtctccggttacggcaagataggcagctacgggaaaccatatcaaggcagttcctaccattggaatgatggtggcgaagcaggtcaggaatcccaataccaggacattgggtgctccgaagataagataccctatcatggcgacccctccttgaataatggctaacagaggtatgccgatggcattggaacgtacaatcatattgatttcgtgaattacttcctgtgtattcgcttcattgaacgggagaatgtcattcacataagcttccatcttttttcctcctatcagcataaagtatagtacgaataccatgacaaacagattgatggcaaggctgctgatgctttccattattatttgtccgatgcggggtaggatggagacaatgaatgacaaggtatcttttcccagcacatcataacccgttttttctttgataaactctgccacctgctgcatcggggcaatgaatgtttgcgggtccagattgatgtcctgaagttggtttaccagtagccagattgtcagtccaagcggaaccaaaaataccataaccgtctctgccgtaatcagcaatgcggcaacactgcgtttcagtttccacttttctgtcaggtgcgtcatttgtgtgcgtaccaaaatataaatagtgagtgctcccagcaatcctcccaaaaaaggagtgatctgacggaagatgatgattcccataaatagtatgatgacgatgagggaatatttccagtattgttctttgatgctcatattatgtatttagatattctgctttataaacaaaagaacagtggaaaaagtttgaatgtccggtatgaggtttacgtatgttgtttttaagggagctcaatatgaaaaaccgtttttccggctctgctttctttgatagccaaatgcccttcgtggcggcggataatttctttgcacaggctcagtccgatgcctgtaccttctgatttagtcgtaaaaaaggggatgaatactttgtccataatttcgggaggaataccgggaccattgtcggtgatgtctatgactatatattcgtcttgttctgcttgcagggaaagctctccatgcggatgcccctccaatgcctgcatggcgtttttcaacagattgagaaacacttgtgacagttgcttttcgtctccttcggtcatcatcggttcgggggagcaccggagtgtaaaggagatattgttttcttgaaaattggtttgaagcagttcctccagattgtgtaataagtcggatagggaaaagagacgcttttcgggctgcggaagataggacagatgccggaaagattcggtaaattccatcagccgttcgctttgcgcctgaataatgtgaagcccgcggattcctttctcgctgatttccggataggaagccagtgtctgagacagtgagataatgggagcgatcgtgttcatgatctcatgagtcaggacatgactgagtttgctccatgattcactttcgttttcgttgagccggtcgtcaatgtcttgtatggaaagcaaggtgattgtttcgtcttgtagtttcatctgactttgggagaggctgagtctttttctgttcttctcattctgcaggatattttccagttgggaatatagagtcagtgattcgatgtttagtaaggtcaacgctgtgttgttgacgaagattattttcttggagttgttccaggctatgattccgttgggtactttctccagcagagaccggtagaaatgttcctgtttctggtagtccattttggtttgtgccaatagggcgttgatccggttcagtgaacggttcagctgttgttgctcttcgtttattccttgctcggggtagctgaatgtattatctctgtcctcgatggcatcaaagaaaagccggagtttccggttgatgttattgagataagtgactattccgccgatttgaaacaaggagcagatgattagtaacataccgatgatgatgccacgttgggagatgatgagccacagccctgttcccgaagttgcgaggatgagcaggatacgaagcaatatggtccaatagatatgtcgactgaatatcatcttgttcagggtttgaatcgtttcagtttattatagagagtttgtcggctgatgcctaattgttcggcggcggctgtcagatttccattgttttggaggattgctgtttcgatggcttgccgttctacttcctccagattggggacgacacttgccgtctgaggtttccagctttgctttaccagaatatctttggggcgtatcacgttgccttcgcataagatcaccgctttttcgatggcgtgttgcagttcgcggatattgcccggccagtgataggagcgtagtttctcaatcgtttgctcgtgcatccgtatgtccggccgttgatatttggaagtaaaacgacggaggaaagtatctatgaataataggatatcgtctccccgttcccttaaaggagggatttccagatgaatggtgttgatacggtagaacaaatcttcccgaaacagtccttgctttaccatttccggaatatctttattggtagcagagatcagccggatatcaacgggaatcactttgttacttccgattcgggtgacattccggttctgtagtacagtcaatagtttggcttgcagtgcaatggaaaggtttccgatttcgtccataaagagggaactgccgttggccgcttcgaattttcccgggcgactttcgtatgcgtcggtaaacgctccgcgttcgtgtccgaacagttcactttcgaagagtgattcactgatagcgcccatatcaatgccaagcatttgacgggaatttcggggagataaacgatgtatctctttggctaacatctcttttcctgttccgttctctcctgtgatcaggatgttggcgtcggttttggctactttcgtgaccactttaatcaactggagcattgcgggagagtggccgatcaacatttccggtttgctcggtttctcggtatccccctgtttgccggttgcctttgaagcgcttttggctttgctgttgttacttttataagcctcctttatcttccgaatcagaatctgattatcccaaggtttgagtaaaaaatcagtagccccgttttttagtgcttttaccgccaattcaacgtctccgtaagcagtcagcataaccaccggcaaagatgggcggatttcgtggatttgttttaaccagtacagcccttcattgccattgtttatgccggcagagaaattcatgtcaaggataacgacgtcgatagaggtggtagtcagtaacgtggtgatttgattgggattggcggcggtgcgaactgtaccgaactcattctcgagcaataactccagtgaagctagcacgcttttattatcatctactattaaaatagttccgttttccatatctaagattgggggtagctatcaggttgaaccatgctttaagtttgggggtaaagatattcgtttttgctttcctctgcaagcgagtgtccaataattagacgttttcgggcatatttactgcaaggcttacttaaattcccgaaaattgctcccgaagaatatgaaataatggataacgtccaaaagttggacgttgcggtgtgtaataattggacggatgcaatgcaatcgtattggtcatttggttaataatcaattacttaaaaattgtggcttcctatttgccttctaatcatcgtaacacacaatcgcatatattataaagaatgaaaaactttttctttttgtccttattcttattgccgcattttgtgcaggcccagtccggcatgactttggatgagtgcattcgtctggcatggaagcagaatccttctgtgcggaacagtgtgatagatataaaggaggcacgggcagattatatggctgctgtcggtgcttttcttccccgtgcagcggttaatgcagaaacagggaaacgcttcgggcgttctatcgatccggatacgaacggatataccaacgaaacttttgaagaagggactgtggggcttgatatgactctttctctttttgaaggcttttcacgcattcatcaggtacgcttccggaagatgaataaggaacgtagcgaatgggcattgaaaaataggcagaatgaactggcatatcaagtgacggatgcttattataaactgattctggagagaaaactgctgaatcttgctttagaacaaagccggttgagtgagcggtatctgaaacaaaccgaagcctttgttgagttgggattgaaatccgcttccgatttgcaggaagtcaaggcccgcagagaaggggatatctatcgttataaatctcgtgagaatacttgccggttggccttattgcatctggaacagctaatgaatttccaacccggtgatacactcgttattcaggatactattgtggaagcgaatcagttgcccttgctttctgttccgtctacggaaacactttatgcccaatcactggaaatacttcccgtcatgcgtatgattgatttgaaacgaaaggctgcccgtaaagagtatgcgatggctggcggaactttttctccttctgtctatgcccgctttacggttggttccaatttttacaatacagttttttctgccagacagttgcgggacaatataggaaaatatgtcggcatcggtatttcgtttcctttgctgagcggattggaacgtctgactcatcaacggaagcagaaactaaacctgtatcgcttgaagaatgaagaagaactggaaaagcaacagctatataccgatatagagcaaacacttctttccctacatgccggatttagtgaacatcaacaggcattgcaacagcttgaagcagaagctctcgtactgaaagagtctgaacgtaaatgggaggaagggctcatttccgtctttcagctgatggaagcccgtaaccgttttatctccgccaaggcagaactggttcgtgtacgcctgcaagtggaaatgatgaggaaactggagaaatactatcgggaggggactttcctgtaaaacggagtctgtgccatcggaacaatcatttaataacaaccctattttgaatatacctttatggatacacctgttgaacgcaaacccggcataaatcgcaaacacctttatacgatcggtggtgtggcgctgggaatcgctgtcattttatattttatttttagagatacggcttcctccatgacagttgagaaagaccgtctcacgattgctaccgtcaagcaagcggagttcaatgattatatccgtgtgatcgggcaagtgatgcccagccggattatctatatggatgccatagaaggcggtcgtgtggaagaacgtttgaaagaagaaggagctatggtgaaagcgggcgatgtgattctgcgtctcagcaacccgttgctgaatatcggaatcatgcagagtgaggcagaccttgcctatcaggaaaatgaattgcgcaatacccgcatcagtatggagcaggagcgtctgcaactgaaacaggaacgcataggcttgaataaagaacttacattgaaaaaacgccgttatgaacaatacagacgtttggtggaggagcaactgattgcccgcgaggattttcgtcaggcagaggaggagtatgaagctgccaaagaacaactggcggtcattgacgaacgtatccgtcaggataatattttccgtgaaagccagatcagcagtctggacgagaacatacgcaacatgaaacgcagtcttacgttggtccgtgagcgcttggaaaacctgaagattaaagctccgattgacggacaggtaggaaacttgaatgcgcaggtcggacagtccatttccgcaggagaacatatcggccagattattactccggacctcaaagtacaggcacagatagacgagcattatgtggagcgtgtacttcccggacttcctgccgactttacccgtgacggaggaacctataaactggaagtaaccaaaccttatccggaagtgaaagaagggcagttccgtactgacctggctttcatttcggagcggccggagaatatacgtgccggacaaacttatcatatcaaccttcagttaggagacccggcacaagcgatccttgttccccgtggcggattctttcaaattaccggagggcggtggatgtatattgtcgatgaaagtggtaaatttgccacgcggcgtcctgtgaagatcgggcgccagaatccacagtattatgaggtgacggaaggtttgtcttcgggtgagaaagtaatcatatccggttatgagttgttcggagacaatgagaaactaatactaaaataaataaaaagaatcaccatgattaaaacagaaaaactgtctatgcttttcactacggaagaggtgcagacgaaagcattgaacgaagtcaccttacacgtagaacaaggagaatttgttgctataatgggaccttccggatgcggcaagtcaacgttgctgaatattctgggcacgttggattctcccacttccggctcttatttctttgaagggaaacaggtggataaaatgaacgagaaccagctgactgcccttcggaagaataatctgggctttatcttccagagtttcaacctgattgacgaactgacggtatacgaaaatgtggaactcccgcttgtctatatggggattaagactgcccaacgcaaagagaaagtgaacaaagtgctggagaaagtaaatctgctacatcgtgccaaccattatcctcaacagttgtcgggcggacaacagcaacgtgtggccattgcccgtgcggtagtgacggactgtaagttgttgctggctgacgaaccgaccggaaatctggattcggtgaatggcgtggaagtgatggagctgttgagcgaactgaaccgccaggggactacgattatcattgtcacccactctcaaagggatgcgacgtatgcgcatcggattatccggttgttggacggacagattgtatccgaaaacatcaaccgtccgttagaaaaaagtacgtcctctaaaaacgaagctgtatgataggaaattattggaatagtgcctatcggaatctgatgaagcggaagaagttcagcttcattaatgtgtttggactggcgatcggcatggcatcggcgttactgattctgacgtatgtaacttttgagttcagttttgacaagatgcacacgaaatatccccatatttaccgtgtgcaaagtacattccgcgaaggggaggtgctgaccgataactgggcaagcagctctttcggatacggctcggcaatgaaagagaatcttgcgggaattgaagattatacccgaatcggctctctgctccaacctgaacagattgtgaagtatggtgagttgacactgcgggaaaaccagatagcttatgccgatccgggctttttccgtcttttcgatttcgagcttttgaaaggtgataaaaagaccagcctttcgatgccgggacaagtcgtaatcaccgagcgcattgcccgcaaatatttcaaagaggaagaccctatcggaaagattcttatctttaccggtccctattataagatatcgtgtgaagtgaccggagtcatggaggaaatgccttccaattcccatatacattataacttcctgatttcgtatacatctctgcccaagtttatacatgaatactggtataagcatgaagcatatacgtatgttctgctcgattcgccggagagggaagcggaaatagaaagagagtttcccgtcatggcggaaaagtacaagacggaggaagcgttgaaaaacaaaacatggggagtcgatttggttcctctggcagatatacatctcactccgcaattgggttatgaaatggagacaaaaggaaatcgttctgccatgattgcacttgtctttgcagccattgccattctggctattgcctggataaactatatcaatctgacagtagcccgttcgatggagcgtgccagggaagtcggagtgcgtcgggtagtgggtgctttccgcaagcagttgattcatcagttcctgttcgaagcgctggttatgaatctgattgcttttatattggcggtaggactgatagagctgattcttccgtactttaatcaactggtgggacgtacggtcactttctccgtttggctgatggattattggtggatgctgctggttcttgtttttatcgcagggatattcctttccggatattatccggcattggctttgctgaaccgtaaaccgattaccctgttgaaaggaaagtttttgcatagcaagtccggagaacggactcgtcaggtgttggttatcattcaatatacggcctctatgatactgctttgtggaacattgatcgtgtttgcacagctgaattttatgcgcagccaatcattaggggtgaaaaccgaccagacattagtcattaaatttcccggacgtacagacgggctgaatgtgaagctggaagcgatgaagaaagcgataatgcggttgccactggtgcatagtgtcgcagcttccggtgctgtgccgggcgaggaggtggctactttcctttccaatcgccgtaccaatgacgctttgaagcagaatcggctttatgagatgctggcctgcgatccggattatatagaggcatatggtttgcaagtgatagccggacggggcttttcagaagagtacggagacgatgtagataaactggtgattaatgagacggccgtacgcaatctgggctttgcttccaatgatgaggcgataggagagttggtaacagtagaatgtaccgatgctccgatgcagattatcggagtggtcaaagattatcatcagcaggcgttgagtaagaattatactcctattatgctgattcataaagataagatagactggttgccacaacgctatatttctatcgtaatgacttccggcaatccccgcgaactggtatcgcaggtacaggaaatatggaatcggtactttgctgattccagtttcgattattttttcctcgatcagttcttcgaccatcagtatcgtcaggatgaagtattcggggtgatgataggttctttcaccggattagcgatattcatatcctgtctgggactttgggtattggtgatgttttcctgttccacccgtacgaaagagatgggtatacgtaaagtcttgggagcttcccgctggaatcttttctatcagttggtcaaaggatttttcctgctgattctgatagcggttgtgattgctcttccggtagcctggttcagtatgaacgcctggttgagtcattatgctttccggacggatttagaagcctggttctttattgtgcccgtattgttgatgttgttcatttcattcgtgacggtggcctttcagacaatgaaaataataatgagcaaacctgctcgttcgttaagatatgaatagtttttagatcactccttcgggtattcgttaatatccggaggaattatgttaaatgttaacgagtctgctacttctattaaaccatgttataagatgctccgctttgctccggaaatttggagatatgcagaaagtccgtatctttgtagtgtgtttttcatagtattagatttaaggttaacaaaaagattggctgtctgggatagatagcctttttttatgccctttttttcgtatatttgagggacataaaaccagaatgaatattagagaacaatcttattaattctgttactttctgttgcggcaatatcgtcatttgcccagacaaatacttatcgggaatgtacaagtcagaattttaaaataatctcatatacacgggagctttctccccaaggatgccagcaatctccgatatatgtgaagcccaagcgttcgtaatacgaagtatgactggtgcttaaatataatttcgagaatccgaatttcagtgtatccttcttggcttgttctattaaaagattggcgtaatgatttcccctatacttttcttcaatgaataaggcaaccagccaaggatataaatccgcgcgagagttaaaatcgttgctggtaagtcccgcacatcctattatttcatcaccattcattaaaaggtaccattgaggaatgggattttcggcattcagagaatgtctgaaacaattgtcatacaccattttcgtgttctcgttaccccacttgctttggaaataggcgatagctctttccagatactgaggtgagtctctgagtgaaactagattcatacgtttattgtattgtttatatttaatattgccaaagttataaaagtatttttgaaaaccaataggttgcctgttttatctgactaattctgtatatttgcaagtatgtcctgcttattaaataacatcataatatatatatggagaataaagaattgcgtgaaagaatgctttcgggaaaaatgtataatgacttgtctgtagaactggttcaaagaagagaacaggctgttttcctgaccaatgattataattccacttatggaaagcctaaagaagttcgggaggcattgttacgtaaactattgaggtgtattggcagtagtgttcattttgaaccgaatttccggtgtgagtttggattcaatatcagtattggcaataatttcttcgccaattttgattgcatcatgttggacggaaatctcattacgataggcgacaatgtattattagggccccgtgtcggtttatatacggccaatcatgcgctcgatccgcaggaacgtcttatgggcgggtgctatgcccatccgattgtcattgaagataatgtatgggtaggtgccggcgttcatataatgggtggtgtcactgtcgggagaaattcagtaatcggtgcgggcagtgtggtgacaaagagcattccggagaatgtaattgccgcaggtgttccctgtaaagttattcgggaaataaccgatgaagacaagaccggttttctgccttagtgttttacggatgaactagctcgctacttactgaaatttaaggatcgtttcacaatcctttgtcccgcaatatgcgaaagattattcgtctgacaactgttgaactttcgtctgacagttgttagacgaaaaagaaacagctgtcagacgaaagttcaacagttgtcagacgaatacttttatgtaatttcaatactagagtttagcaaagtcgtccataagtttccttgattttgtcctaactatattccttttgtttattgctgattaccataatttgcaatctatccattccagtttgtcgaatagccataattcaaaaaagaacaagataaatgggaggataatgatgaaggtcatagtcactccactacttttcgagtgtcggtaatgattgataatagctttttttctgtctttacggtaacgaaaaaatatgaaaatgtaaggcaataaaagaatcagtacttgataaaatatgaccgcattgtctccaaagtgatgggttacactcgtgaatccaaatgccggaaaagctacgatcattatccaatactccagtaaaatgaatgcaccggagcatctgaaggctttcttgctccattgttcacccttaaaatacagataatcgaagaaataatatctgtatttgggaggatgtaatctttgttttacgcgttcgaaataattatctgttttattcgtaccttttttcatttaattgattaataggaattacatattacaacttacttgacgtatttagtaagtctctctgtttaaaaaagaattgagccatttttgagagaatttttcttgctcacgagtattcggaaattcttgaatctctgcataatcaaatatcgttgcgatatctttttttaatgcaggttttccaagagtcaggatatataccttattggaggtactcatcattcccgattgatgaacatttattattatggggtgtataccttatttatatcatacttttccatacatttgtttgttttggatcactgataatggctaagcggggaacgctgtaagcgttatcctgcttcgttagtaatttttttctgttgtgaattattaagacgttgaactaacatcttcttgaactctgtactattacattcatttataagttctctatattcaagagattttatttctgaatacacagactctattaaatgtagtaatgtccattctatcccatataaagcagtcggcggaaagagcttgattaaaatatgtgcttcatccaaagtgacaggtttaactatcttgcctaataagtctgcatattcatcaactaatgcagccgttattcgttcatctgcttcatcgggcattgcacccattaaagctaattgttcaacttcttttctcataacaatgttgttactaatgaataaataatcacactcgacgagtagaggttatttcagtaaccgatactataaggcgaggttactgaattctattttctaattcgatatatgctactgacaaagttatgaaactattaatgaaaaacaatctagcgtccattttattttatttacatgacagacattgtgataatatgtatatattagccattcactgaaaaaatgaccttttcttaaaaagaggatatttacacaggcactaaagaccgtaattacatatcacttatcaaggagaatagaatatctccgtcatttgtaaatacgaaattctatctttatgtaattggaagtgttcttagagtaaaatggtaaccatttcctgttaatacttatcatttagatggattaattaaggaaggtactccgttctgtcattttctattttatcggtatttatgatgaactagagaaaaaacgagcaaaaccagcctttttataacttcctcactgatgaaaaacaagttcatcagtaaggaacggagcgttggttttaaaggaacaccccgttcctttaaaaccaaagagtactgaatgactaaaaaaagatgcatatttcacgcagtattatgcaggatgaacccgtattcttgcatattattgcactaatttatgcaggatatgctgtcgttcatgactttttgagcaaattcctattgatataatattaaatttggaatatttagactgaaaggacatttatcttaccaattccacatcttgtctacaaatgaggcgtgttcgtctcatttgaaaaaccggcaatgcagtatcccttatcttcgtgtcgaaataaaaaacagaataagtcatgaagatgaataaaactatgttgttaggggaagtagcaaaccgttcggggattccggcagatgaatgcggagtagtacttaaaacttttgaaagagtcctttgcgaagaactcacacggaaactgtatcgttatggaggatggatattgctgttgatcggtttgtttgtatcagcttttgctttcgggcaaacatcggagcggaaagggcgtccggtccagaccattcgtgggatggttgttgacggagattccaaatatcctataccgtatgcgacaattagattgtcagataaagaggggatggggacgacaaccgacagtttgggacgtttcaccattccgcaggttcccgtcgggagacatacggtagaggcagcgttcatgggatatgaacccggcattttcagagaaatactggtgacttccgccaaagaagtctatttggaaatacctttgaaagaaagcgtcaacgaactgagtgaagtagtggtccgtgcgcggacgaacaaagaagaagcgatgaataagatggcaactaccggagcacgtatgctgagcgtggaggaagcgagccgttatgcaggcggattcgacgaccctgcacgtctggtatccgcttttgccggagtggcgcccagcgtctcttcgaatggaatttcgattcatggcaatgcaccccatctgttgcaatggaggctggaggatgtagaaatcccgaatccgaatcactttgcggatattgccacattgggtggaggaatcctttcttcccttagctcacaggtactcggaaattccgatttcttcaccggagcttttccggctgaatatggaaatgcagtgtccggcgtgttcgacatgaagctgcgcaacggtaacaatcaaaagaacgaaaacacgattcaagtgggaatcatgggaattgacgttgcttccgaaggtcctttgagcaagaagcataaagcctcgtatatcttcaattatcgttactctaccacaggactactgaatcttgacggcggaacgatggactatcaggacctgaacttcaaactaaactttcccacaaagatggccgggactttctcggtatggggaaccagtctgatagacaaatttaagagtgacatggagaggaaccctgagaaatgggaatatctgggcgaccgcagcgaatcacgtgacaagcagtatatggccgccggaggtatcagtcaccgttactttttcaatagtgacgcatcgctgaaaacaaccgttgccgctacctactcgcagttggacggaggcgcttccatgttcaatcatgcgttggaatcgactccttatatggaccttgaatcaaggcataccaacctgatactgaccagcaccttcaaccgtaaattcagcaaccgctttaccaataagacaggattcacttatactgccatgttttatgacatgaaccttgccatagctccatacgaagctcagctgctggaaacggtatcgaagggagatggcaatacgagtctgatttctgcttacaatagctcttctgtcggactgagtgaccgttggactctcaacgccggtatctacggacaatacctgacgctgaataataaatggtctgtcgaaccccgtgccggactgaaatggcaggctaccccgaaagcgacctttgctttagcttacggcatatacagccggatggagaaaatggacgtctactttgtgaaaacgaagagtacgggaaatcaatccgtcaacaagaacctcgacttcaccaaggcgcagcacatcatgctgtctttcggctataagatttcggaccgcatgaatctgaaaatagaaccatatgtacagttcctgcacgatgtaccggtaatggcggatagttcctattccgtactcaaccgctccgacttttatgtagaagatgcgcttgtcaacaaaggaagaggccggaatatcgggattgacataaccctcgaacgcttcctggaaaaaggactttattacatgatctccggttcgttgttcgactcccgttaccgtggcggagacggtgtatggtacaacacgaagttcaaccgcaactatgtcatcaacggactgatcggcaaagaatggatgctgggacgcaacaaacagaatattcttagcatcaacctgaaactgaccttgcagggcggcgaccgctattccccgattgatatggaagcaaccatgaagcatccggacaaggaagtgcagtacgacgaaaggaaggcattctccaaacagtattcgcccatgtttatcggcaattataccgtcagctatcgcatcaacaagaaaaaagtatctcacgaatttgctgtgaagggcttgaactttatgggcacgaaagagcactacggacatgagtataacgtgaaaaccggaaagatagacgcaaccgacggctctaccgttctgactaatgtgagttataagcttgaattttagatatccggtatagagaccttaacggaaaatgttttatcttcgtacccgatgaagcatatggcaactgaaacaactgcagcaggcaacgaatcggcctttttatatagattgctcgtaagtccggcattccgatggatgcggtatctgatacttgtcatggtgttgggcactatctccttcaatcaggtattcatcatttttatggactatcgggatatattgggcggatggatttatgtgttcacatttatatatatgctcacatacattggcgttacctgcctgaaccttttctggttattcccgaaatatttgttgaaaaggcattatatgacttatctgtcagtgctgtctgtggcgatggtcattgcgctgctgatacagatggtcatagaataccttgcttactcccattggccgcagcttcatgcgcggggatcgtatttttcggttcccatgctgatggactacatttcttcttttatgctgtcaacgctttgcatgataggaggaacgatgactttgcttctgaaagaatggatgattgagaatcagcgtgtttcacagatggaaaaggcgcacgtactgtccgaagtggaacaactcaaagaacaggtcagccccgaacttcttttcaaaacgttgcatcattcgggtgaactaacattgaccgagccggaaaaggcctcgaagatgttgatgaagctgagtcagttactgcgctatcagttatatgattgcagccggcaaaaagtattgctcagtagtgaaatcgctttcctgaccaactatctgacattggagcaaagctcccttccgcaattccgctatcagtttacttcggaaggggaggtaaacaggatgctggttcctcctctgctcttcattccttttgtgcagcatatcatggagttgacgcacgaacagcaaatcttgcttcctgtctctctggacattcatctgaaagcggagaaggctacgattgtattcacttgtatgtgtccgcaacttaatctctccgtaaacagggggctggaacggatcagacaaaggctggacttattgtatggcgaccgttacggactatctttgactacggaatgtataagactggaactgaatggaggggaacaatgagaataagtacaaacgataaaaatacactcgacaggaatcccggtgacggaaccatgaacggcaaaagtgtcaccgcttttctgctgagtcctcattgcaggatatacagacatatcctcttgcaggtggctgttctgctgattacaatcaatgttttttggtacgagcctttgcaggtggtctctctcttgaaacgctttggaggctgtctggtctatttcttgtctatgaatgcggtgatatataccaatctgtacgtcctggttccttcttttctgctaaagaaccgtttgggtggttatgttctggctgcgatagttaccaacttagtggtcatccttttcctttcagttacgcagggaatgctttttgaagttattttgcctgtcaggaatcccgatggatttgccactttcatcaacaccttttcggggatactcactatgggttttgtcaccgcaggttcggcagctatttcattgttcactcattggctgcgtcataatctgcgcattgatcagctggaatctaccactttgcaatcggagttgaagttccttaagagccagattaacccgcactttctgttcaatatgctgaataacgccaatgtactgataaagcggaatccggaagaggcttccaaagttcttttcaaactggaagatttgctgcggtatcagattaatgacagttcgcgcgaaagggttgctttagcctcggatatccgttttctgaacgactatctgaatctggaaaagatacgccgggatcattttcagtttacaatggagcaggaaggggacattggctccatctggattcagccgttattgtttatcccgtttgtggagaacgcggtgaagcatagttttgatagcgagcatccttcgtatgtacatctttcttttaaggtagaagagaaccggttggagttccgttgtgaaaatacgatgccggcggttgctgtcagcaacaaggtaggaggaatcggacttgcgaatattcagcgtagattaggattgttatatcccgaccgttatgaattggagcagatagagaatgaaaatcggtatatggtaactttatgtataacgttatgaattgtattattgtagacgatgaaccattggcacgggaggctatgaaattgctgatagaggaggcggaatgtcttcagctagtgggaagttttaacagtgccgccacggcttccgactttatggagcagcacgtagtagaccttgtctttctggatattcaaatgcccggcattacgggaattgagtttgcccgtaccatttccaaacggacattggtaatctttaccactgcctatacggagtatgcactggatagctacgaggtggacgcaattgattatctgataaagccggtggaggcggagcgctttcagaaggcggttgagaaggcgcagtcttatcattctttattattacaggaagaaaaggaagccattgagacgattgtggctgccgagtatttctttgtaaaggcggaacgcagatacttcaaggtcaacttctctgatatcctttttgtagaaggcttgaaagattatgtaattctacagttgggcgaacaacgcatcatcacccgtatgagtctgaaagcggtctttgacttgttgccgaaggactcttttttacgggtcaataaatcgtatatagtcaatacagcccatatcgattcgttcgacaataatgatatatttatcaagtcgtatgagattgctatcgggaatagttatcgggatgacttctttgaaggattcgtgatgaaacaacaaagatggtgacaggtcttgcgatgttttttatgtcatatatatccgttagtctttaatctgatgcaatattggtagataaaggaaagtttataaaagaatctgccctctgtcagtcattagaatgctgatagagggtagttgcatatcaagaaaaaatcgaaattagtttatttagcttcgttattctgtttcaaaagaaattcgtcgattgctttcttcaactggtctttgggcaaagccccttgcgtgattctcggttcttctttcatcggaatcagtaacagggtggggatactgcggataccgaatgcggcagccagttccttttcctggtccacatcaatctgatagatgtccactttaccgctgtattctttgctcagttcttccagaacaggatgcagcgctttacacggtccgcaccatgttgcatagaaatcgacgattgccggacgtttgccttcaaatttccaatcattcggattggcttcaaaatcatatactttctttaaaaactctgctttatttaatgatactacttccattttattgtcctcctttgttggttcattactctttttattttctccgccatttcccgcacaagctgtggtggccagtacgatagcgaaagcgctcataatgcttttaatcagtttcataaatcttttcggtttatttgttttctatgttgcaaaggtaaggcgaaatagcttcccgtgaaatagcgatttgactggaacacttggcaaaatttcccatcactgctcctttaacgctaaaaaatgtctttttatctttggaagtaataaaaatatgcactacttttgtcgcgataaaatgagtattcaccctttaaaatgatggaaagggtattaattatgttggagctataatattttcaaattaggactaagttgtctcgtcgggaagacggggctttgcgacattttgttttttacgtttaccgcaactctgctgctggcggtaatagttgattagtcctgcaatcacatttttatttttcgaattattcacttcaatgttgtggatggatgttttgtatccgtatccgaagcattggcataccgtgtataaccttactttccgctgttgaggcggacggggtgtggtatgcgaacagaaaaaaagtatgggaatacgattaaaagatttaagtaaactgggatatcgggataatgtagcccgtagtctggtagtagacattgtaggcaaatattgcaaacatgacacgaaggaacagattgcaatgactttgagcaatatactcgaacatcccgaatcttataaaaacaatgaaatatggagtaagctggcggaacgcctgtcgcctactgttcttgcgaaagagttcgtagcttacgacttacgggaagatccgttgatgtataaaacctatggaggtaagtttatcgagactcttgccaaacaacagatgaatttggctatgcgcctgcctgtaacggtcggcggagcgttgatgcccgatgcgcacgccggttatggattgcctatcggtggggtactggctactgataatgccgtgataccgtatgctgtcggggttgatatcggttgccggatgagtctgacggtatttgatgcgaaagcagacttcctgaaacgatattcttatcagataaaggaggctttgaaagactttacacatttcggaatggatggcggcctgggctttgaacaggagcatgaagtgctggatcgggaagaatttcggttgactcctttattaaaggatttgcagggaaaggccgtgcggcaactcggaagctccggaggtgggaatcactttgtggagttcggcgaaattgctttgcaggcggataatgtgctgaatcttccggaggggagttatgttgctttgctgtctcattccggttcacgtggcttgggtgctgctattgccaaacattacagtctgttggcccgtgaagtctgcaaacttcctcgggaggcgcagcattttgcgtggctgagtctggactccgaagaagggcaggagtattggatgagtatgaatctggcaggagactatgcccgtgcctgtcacgagcgtattcacttgaatctatctaaagcattgggactgaaacctgttgcgaatgtcaacaaccatcacaactttgcgtggaaagaggagatagctccgggacgtatggcgattgtgcatcgcaaaggggcaactcctgcacaaaagggacaggcgggtctgattcccggaagtatggctacggcaggttatctggtttgtggcaaaggggtggaagaatccttgtgctctgcttctcatggagccggaagagcgatgtcccggcaaaaagcaaaggagagtttcactcagtcggctttgaaaaagatgctgtcgcaggcagacgtgacattgataggcggaagtatcgaggaaatacctctggcatataaagacatcgaccgcgtgatgtacacacaggagactttggtggaagtgcagggtagatttatgcctcgcatcgtacgaatgaataaagaataaggcgatgaaggagaaagtctatttacagataacttccggcaggggacctgcggaatgttgccgggtggtggcattggtactcgaaagaatagtaagacaggcgcaggcaagcggactgaaaatggaaatgatagaacgtgaagtgggaccggtcaaccggacactgctttcggctaccattgctcttcaaggcgcagcgagcggagaactggcggatgaatgggagggaacggtgcaatggattgcccaaagcccgtatcgcatttatcacaagcggaaaaactggtttgtcggtgtgcattcgtttgtgttgtcggagagtcaggaggctacagaaagagatttccgctatgaaaccttacgggcttccggtccgggcgggcagcatgtcaacaagacagagtccgcggtccgtgccgttcacatcccgtccgggatgagtgtggtagcttccgaccaacgttcacaatggcagaacaagaagctggcaacggaacgcctgttggtgaaactttcgtcatggacgatggaacaggcgatgattcaggcgcaggaaaactggagtaatcataatcatcttcaacgggggaatcccgtgaaggtgattcgggaaccgctgatttagctgtgagtaataaaaaatatataaagtgactaaaaagtcggttctatctcccattcccctcccttcgggaaggaagggtggctgaaagtcggggtggtaggtggatgcatagattgatgataatcaaagttatatgcttacctaccacctccccctgcggggactcctccttcccgaaggaggagagtttgaggttactaccgactttttagttcgcctttatgtatgcaggataatgtcactatatcaaggcgatagtgtcattatcctgttattattctttcgggtggttaactgaaaatataaacgataattcctgtaatcaccacatatgccagtgcatacgggatagcagctttcagtatttccccttcctttccctgctggtttccagcagaagtcgcaatggcgatactttgcggagaaataatcttaccgcctgtcgcacctaccgtatttgcagctgacagccagtccggactgacatgaatctgtcctgccacacttgcctgtaactttccgaaaaggatgttggaggaggtatcacttcctgtaataaatgtccccaggcagccgatgaccggagcaaacagcggatacaagcttccggtagcagtagccagtgccgtagcgatgacagcaatcattcccgaagtatccataatggtggataatcccacgagacagatcacggtaataaaggttttctttaattgcttcaccgtattccaaagaacgataaacagctctttgactttggcaccctgtatcaacccaccgataaaagtaccgaggaagagtagtacacctgcatgggtcaaccacgagattgtatagtttacggtagtagcattgacaggcagactgattcttgtaacccagttattctccaatgtacttctcaaactcgggaaaagcggactggtgaggatgatcaggaacaaaatcagtaaatagatgctccatgcattcagtatatctttggttttcagcgtacttttccgagccttttcttctttcgatgcggtcagttttccatagagaacgatgacaatgatagaaagaatacttccgataatggcaggcgattctgcccccatatatctggcagccagatattgtccgaccaaagaaacacctccgaccagcagggccagaaatatattcttcgggagtgctttcagtttaggattggtgaggaaaagcaagaccagcggaatcagaaacatgagtaccgataattgcaatacaacgttcgtactgagttgtagcacatccagattcgtttcctttgccaacaccaataccggagttccgatagcaccgaaagccgtagcgacactgttggctatcagactgacagtcgccgaaaatatcggcttgaatcctagactgataagaatcgccgccggaatagcaaccgccgttccgaatcctgccatcgcttccagtaatcctccgaatccccaagtcagcagcaatacctgaatacttttatccgtagagatggaagcgaactgttgtttgataatctccatcttttccgttttcagtaatacgttataactgaaaatagccatcagaatgatgattaaaataggagagaccgctttcagtgctccatataaaaaggaataaaacagattgtctacagaaaaggcaaaaccgaaaagagcgatcagcatggttacaatcaacgagataatactgctcttgtcgccggacatcttgaaaaacgccatcaatacaattaatagcaataccggaataatagcaaggattagtgtcataattctaaattttaaatagtcaacttttggtgaatacttaatataacaaaacaaaaggtcgttttgatggatatgtgactctaattttatccaacttctttttgtgaatgtgtcaaaaatatattcaggcacggatttcacagattaacacggttttaagagttaggtaaccccaaaccgtgaaatccgtgtaatccgtgcctgaaaaatcgttttaagtgacttccgtcccttctgctattacttgctcattttcatattcatgatctgttgcaactgtttcaagtttgcctgagcagcttcatttcctaatttggcagcttgttcaaaggctgctgtagcacgttgaatatctccgtttaagaagttatacacgcctgtattattcagaaattcggcagtggtatgatccgctttttccatatatttcaatgcggtattgatatccttctgtgacaaggcgacagccgctgcattcagattggctacagcatccgtcggatacatacgtacggcaatatcaaatacatctacaaagtccttgctgcctttcggataactattggctacctgatacatctcgttcagactcagatatttcggattctcacggatgatgatacgtccttgttccacatcgaagttgaccactgtgtagtcgattttgcagttcactttacgcagtcccggataaatctctttcagcatagtgcgataaggagcgccgccgccgactttcatgatttcctgtttacgtttcacgtcattcgttgtatttttgatgatattcaggaaggtttccttatccttcatcgaagaggattcgagagctttcaccagtccgtcccagttctctccaccgaaagtcactttatacagtttggcagatgccttttcgttcttgaccagataatctttcagagcttccgcacgttttttagagagttgctcgttgaaagccagcggcccttcgggagaagcgaatccttcgatgctgatgctttgtacggtcagattcttgtcattctgaattttatcaaacatagaatgaatattcaccagttcggagtgattgttcatgaagtcggtaaggatgacagacttgttgacggggaagtccagatgagcttcgtattgctcactgcggtttttcaccacttccactgtaggctggatgtaggctacgataggagacatggcactcagtcgtttggcttcggtagatacatcgttcgttatcagttcctgcgcgttcatttcctgatagttgccgcatccgcataggttctctaccagttgcagggatgcgtttgccatccatggctgataaggaatgacctgcgtataattaaacgtttctcttttattataaggtacgatgatagccgtggattcctgtttgctgatcgccagtccacgtagataggctttctcgcgtcttttgccgttgacgataatctcctgtagcgggacattatgttgtccgtccgtcagcagggggatcaggctgagactacgtgccgagccgatggttaggtttgccatgtcgaccgtcatgccgacataaagcgagtttccttgttgccataaggatacattcgaaagcgtgagcgcatcattcagaaatttctgtgcatgagccggaagtatggtggctgcaagagctataaatagatagataagttttcttttcatcattgtaagttttagaaagttcgattatttgatgacataaatgaagctgaggccgattttggtcggaccgaaatagttgcgagtgttgtgcccgagtttttcacctccgtcaccgcgggcatatttatcatatttcagacgggcgtaaccgactccgacggttgcttccatgctccagcgtttgctgataatccactggtatccgtaagagatgccggctccgtacagactgccgtcatagcggtcgtgccccattccgaatatattcaggttgctgacattcatttctccgtagtgtccgtgcaggccgaagaaacttccgttgaaacgttcgcagagccagtagcgcaattccggttgtacgagccagtgcttgatctggcggtcgttgccaaacttccacggattgtagttgccggatacatcgagggtgattttctttgccagtccgacttcgaatcccaggttgggagtgctcgtagcccagtagagggcattggtcttgatggcgaatttgggtaaataagtttcattccgttgtacttgcgcatacgcacttgtacccaatacgagcaggaaaccggctgctaataaaagtttaattgttctcatttttgttagggtctaggttttattaaaatgatatgcgataaacacatgattgtgtgactttgttgtgtaaacccgtagaaaagattccttgcccgtatccgccataaagatgtttaagggcataaatgctaacaaattcggcaaatgatacgtttactatataaaaatacctttgtgtaatcaatatgacaactaattaatttattactgactatttttacacataacattaatacaaacagcctatgaaagagcttatcaagaatctggaagaactgaacaggaaagcagaaaaaggtggcggggatgcccgtattgagaaacagcactctgtgggcaagctgaccgcccgtgaacgcattgacttacttctggaaaaagggtcgtttatcgaacttgataaactggtaacccaccggtgtactgactttggtatggaaaaacagaaattctccggtgacggggtagtgactggttacggaatgattggcaaacggctggtctatgtttttgcacaggacttcaccgtattcggaggggctctttcggagacacacgccaagaagatttgcaaagtgatggacatggcgatgcagatgggagcgcctattatcggactcaatgattccggtggtgcgcgcattcaggaaggtgtccgttctttggcaggatatgcggagattttccttcgcaattccatggcttcgggagtcattccgcagatcagtgctatcatgggtccgtgtgccggtggtgccgtttattctcctgcactgaccgattttattctgatggtcaagaactccggctatatgtttatcaccggaccggacgtagtcaagagtgtgacacaggaagaagtaagcaaggaagatctgggtggagtgggcatccacatgacaaagtccggcgtggcgcatctatcggccgaaaatgatattgaatgtatcaattatatccgcgaacttatttcttatctgccgggcaacaatatggaagagcctcctttcgttgtcaccaacgactcgccgacccgcctgacacccgaactgtccgacttggtgcctaccaatccgaatcagccctataatataaaggagatgatagaagcggtggccgacgataataacttctttgaacttcaggcagaatttgccgcgaacatcgttaccggatatatccgtctgaacggaaagacgataggggtggtagccaatcagccgctggtgctggcaggaacactggacatcaatgcctctataaaggctgcccgtttcgttcgcttctgcgatgctttcaatatacctttgctgactctggtcgatgttccgggattccttccgggagtagatcaggaatatggcggaatcatccgtaatggtgcgaaactgctttacgcttactgcgaagctaccgtgccgaaagtgaccgttatcacccgtaaggcttacggaggcgcttatgatgtgatgagttccaagcatatccgtggcgatgtcaatctggctttccccactgccgaaatcgctgtgatgggaccggacggggccgtaaatatcctattcaagaaagagatcgaaaagtcacagactcccgaagaaaggcgaaaggaacttcagagcgattatcgtgaaaagtttgccaatccttaccgcgcagcggaactgggctatgtggatgaagtgatcgatccggccgttacccgtttgcgcctgatacgcagtttcgaaatgctggccaataaacgtcagtccaatccgcctaagaaacactcgaacattccactttaataaatggaaaatggaaagttgaaaatggagagtgataaattaaaagaaacagattatgataaagaaaatattagttgctaatcgtggagagatagctatgcgcatcttccgtacttgtcgggtgatggatatttcgacggtggctgtttacacgcatgtagacaggggggctttgcatgttcgctatgcggaggaggcttattgcatctccaattcgccggaggatacttcttatttgaagccggagttgatactggccattgccaaaaagaccggagccgccattcatccgggatatgggttcttgtcggagaacgctgactttgcccgtcgttgcgaagaagaaggagtgatctttatcgggcccggtgccgatattattgctaagatggggatcaagactgaggcacgcaaaatcatgcgtgaagcggggctgcccatcgttcccggaacggaaactcccgtacaggggatcgaagaagtgaagaaggttgctaaggaagtaggttatcctattatgttgaaagcgcttgccggaggaggcggaaaggggatgcgtctggtccgttccgaagaagaagcggaaacggctcttcgtttgtctcagtccgaggcgggtacttcttttggtaatgatgcggtctatatagagaaatatatcgagaatccgcaccatatcgaggtgcagattatgggagataaatatggcaatgtggttcatctgggcgagcgtgaatgttccattcagcgacgtaatcagaaggtaatcgaggagtctccgtcaccgtttgtgaaagacgaaacccgtaagaagatgctgaaagtagccgtagaggcttgcaagcggatcggttattacagtgccggcacgctggagttcatgatggataaagaccagaacttctatttccttgaaatgaatacccgtttgcaggtagaacatccggtgacggaggaatgtaccggcgtcgatctggtgcgtgacatgatcacggtggctgcgggcaatccgttgccgtataagcaggaagatataaaattcagcggagctgccatcgaatgccgtatctacgccgaagatccggagaataactttatgccttctcccggagtgataactgttcgtgaagctcccgaaggccgtaacctccgtctggacagtgccgcctatgccggattcgaagtttcactgcattatgatccgatgattgccaagctctgctgctgggggcgtacccgtgaatccgccatctccaacatggcacgtgccttgcgtgagtataagattctgggcatcaagacgacgattcctttccatcagcgtgtgttgaagaatgccgctttcctcgaaggaaaatatgatacgacttttatcgatacccgttttgacaaggaggacttgaagcgtcgtcagaatactgatccgactgttgccgtgatcgctgccgccgtaaggcattacgagagggagaaagaagctgcatcccgtgccaccacgctccctgtagtgggcgaatctctctggaagtattatggcaagttgcagatgactgccaataattattgaataagtggagagttgagagttgaaaattgaaagttaagttggtcattcattaaaattagaaagatatgggtacatcgttagcgacttattatgccaagcttctggatatgccggacagtgaatataaggtggagattctggaagacggaccgatcaagaaaatagcggtcaacggtaaaatatatgaggtcgattacaatatgggaggcgactccattcattcgatcatcattgatcatcactcgcatggagtgcagatttccccttcttccaataattcttataccattatgaataagggtgagctttatcagatagagctacagggagagatggaaaagatacataatgcccgtgccggtacggaagccgtagggcgtcaggtggtacaggctccgatgccgggggtgatcctgaaaatatatgtgaagaagggagacgaagtcaagcgtggagacccgctttgcgtattggtggccatgaaaatggaaaacgagattcgttctgtcaccgatggagtagtgaaagaagtctttgtcgaagccggtatgaaggtcggtttgaacgaccggattatggtgattgaatgattctcaaaaaaaataaaggtgttttacgtacttatctcaaaagttttctttacttttggcagataagtacgtatttatatccggatgtcttatgaacaacgaacaaacaaaagaagcactgaaagaggaattggagttgcttagaaaagaaaatgagcaactgaagcgacaacttcgatctctggaacagaataaacaacccgaagaaagctccaccagctttcaggaaaggtatgccgttaaaatattaaattccttaccggatatgctgactgtgttcaaccacgacgaagtgggaattgaagtcgtatccaatgaagaaaccaatcatgtcgggatatccaacaaagattttgaaggaatgcacatgcgccagatggtgcctcccgaagcctatcagaacatccatgccaatatgcagaaagtgatcgccacgcggactgtttcggcagcgcatcacgacatggatttcaatggctctcaccattactacgagaaccggatttttccgttggatgaagaatacgttctgattatgtgtcgtgacatcacggagagagtggccacccagcaacagctggagatatttaaaagcgtactcgacaaagtcagtgacagcattcttgccgtttccagtgacggaacgctggtatatgccaacaagcaatttatggaagagtatggtgtcacccagcagatgggtacccagaaaatatacgacctgcccgtctctatgcgcacgccggagttatgggaagccaaactgaaagatatacgcgataatggcggcagcttttcataccgtgcagcgtatgtgcgcaaaggtgaggagaaaaacagagtacaccaagtctctacctaccttacacaggaggatgatacggagcttatctggttttttacgcaggacattaccgatgtaataaagaagcgggatgaacttcgtgaattgaatctcctgctggacggtattctgaataatatccctgtctatctgtatgtgaaagatcccgaggacgatttcagatatctgtattggaacaaggcatttgccgaacattccaagattcctgcctctcgggcaatcggccgaacagactttgagatctttccggagcgtgcagatgccgaaaggttccgcagggatgatttggaattgatccggacgcatgaacggatcgatatgcaggagacctacgtggcggccaccggcgagacccgtattgtgcagacactgaaagcgcttgtcccgatggaagggcgcgaaccgcttctgatcggtatctcctgggatatcactaactttcagaatatcgagcaggaactgattaaggcacgcatcaaggcagagcaatccgacagattaaaaaccgcctttcttgcaaatatgagccatgaaatccggacaccgctgaatgcgattgtcggtttctccaatttgttgccttctgccgaaacccttgaagaagaaaaactctattcgagcattatcaatcagaactcagagatcctgttgcagctgattaatgacatcttggatttgtctaagatagaagccggtacattggaatacgtcagacagccgatgaacctgggtgaaatatgtcggaatatctatcagattcataaggatcgtgtgcaggaaggggttacccttattctggataatcaagacgaagacctgattattgaagaagaccggaaccgcattgcgcaggttatcactaacttcctcaccaatgccggtaaattcacgctttccggtgaaatccgctttggctttaaagtcaataatcaatgtatccgtttttatgtgaaggatacaggtatcggaatagctcccgataaggtgggacatattttcgaccgttttgtcaaattgaactcatttgcgcaggggacaggtctcggacttgccatctgccggatgatcatagaaaagataggaggggagatcggagtcacttcggaaataggcaaaggatcgactttctactttacgataccttataaagaaagctcagatgaccgtattgcattttccgaggcttcggaaacgaaatacatcagccacaccatcaagaggatgcagaagatcaagaagattctggtagctgaagatgtggacagcaactttgtactgatcaagaatatgattggcaaagattacactctgctatgggcgaaagatggctttgaggcggtggaaatgtataaacagttccagccggatttgattctgatggatatcaagatgcctcgtatgggtggactggaggctacccgcatcattcgttcctattcgaaggagattcctgtcattgcgctgactgcctatgctttcgaagcggacaaggagcaggctttggaagccggctgcaatgactttgtcacgaagccggtttcaaaagcagcattggaagaggcgttggggaagtgttgcgggtagtaactacaagtgattatattatactcactttcctatttcgggaactaataagaactttgtttccggaaagtacttttcgagccaagctcgtataaactccatcgtatcatcttgaattgttttatcctctaccgtcggatagagattataaagtactgtatccagcacaatgtcccgtttctgtatggcttcaagactcagaagagtatgattgatgctgcctagctttccggaagtcacgaagataagcggatatttctcctgtgcgatatattcaattgtcaggagctccgtagtcagaggaaccatcagaccgcccgcgccttcaagcagaacacagtcataccgttcgcttaatacttcggtagcatgcttgatcttgtcgaaatcaatgggacgatgatccagtcgggaagccagatggggggaggcgggataagaaaagatctccggcatggtcagcccttcctgatcttcccgggtgaaagggatttccataatgcgccgatgcaggtctatatcttcggaatgccccacatttcctgtttggataaacttctgcgtaatggttcttttgccgtttttattccattcgcgtgccaggtagccggtcgcgtaacttttgccggcatcggtatcgataccgcttacaaaatatacattctgtttcatacttttttcttttttgctatgatataaatagggtgatatgtcagggacactgaagtgccctgtgtaaattcttgtgtgtaacgttcgcaaaaatgctgcaaatcacgacgggtccaagtctgtttctcatgcttcggatagagggatgattgcgctgacaaaccattcacccccgtctgcttcagatgatacagcactttcatcggatcttcgaaagaaagggggatcagctcttcttctgagtacagtatatcaaagtgaagagacagggctgcttcaagctcttcccttgaacgatagggtagtccctttccggtaagctcacgtatctctttcatattctttttcccaaaagtactgaaagcaaagtatccctgactgtgaagcaatgtattacaccttttgaagaactcctccggcgagtcgaaccattgcaaagcggaacaggaagtaatcaacgtacttttatccggaaaagaaatcgtctccgcatctccggaaagaaaagagacttgtttctctcttaataaatcttcgcagcaatacctcatctccggacataagtcattcagaagcaactcttccggacgaagggtgcggagcaacattcgggagtaaatgcccgttccgcatccgaactcaatcactttcggacagggagagggaatatgtttctggagcaggcggatcattttatttgctatctgccgttgtacatttgcttcacggggataggtggagatggcttttgagaaacgttctgcaataattgtcttattcattgatcaatgattatttaatgttcatgattacctcattaaaaagctcctgctgataatgggcagcttcgacgtgcaggagggagactgccttgtttctccatgcctgctcttgatggtccggaaggaaaatccgatcgttatctccgatgatggctgtttgccagacaaactccgaagggagggatgacaagtattgctgccggatggcggcaagctcttctttcagttcttcaaccggacgtttgggagctattgtctgaaaagccttgtaatcagcagcagaaccacacattcttcgctgaaatttcagtagggtttgtgcgttcagtccttgcagggtgccttcaaaaacggatggcgtaattcctttcgtttcgtgtatcggataaagtgttccgttgatggcggtactttgggaaacaggcagggagggatattgcttcattacctgcgaagccgcccagactcccattgaccatgcgatcagcgaaatcttggaatatgcctgtattaaagtcgtatcgaattccagcgaacgataatcgtaacaaatcatccagtcacattccgccggatggatatgtcggaaaggcgtttcgtccattccccatcctgcgaagaatagtagaaggtgctttccattgttcctgataataaaagtctgcttcatccgttaatgatttctataagtgtatcgatttctttttctgtgatgtccgctgtcaatgagaagcggatacgggaagtcccttcgggtactgtaggcgggcgtaccggcagggcatagaatcccttgcgttgcaattcttctgccttcctgatggtatcttcgcttgctccgaccaccatcggcacgatgtggctgacggaaggacagttatatcctttctcggtcagtgcttctttcagtttcctgctgatttgcagcagatgctcccttttgctccggaaatcagcgaagtgtttcagtacccatgcggtccactggatattgacaggaggaagggccgttgtgaagataaaggtacgcatcttattgatcagatattcccggatggtctgtcggcagatgatatatgcgccagcggatgctgccgccttcccgaaagttcctaccagaaagtcgatgtcgttgatgcagttttgttcttcggcacatcctaagcctttctcgccccgtgctccgaaagcgtgggcttcgtctacatagagaagaaggttagcgtaatcgtgtttcaatcgtaccagcgcttgcaggtcggcttcgtctccgtccatgctgaagatactctcggtaacgatgattatcttctcatacataccgtggttttcttcaagaagacgccggagctgggctaagtcattgtgccggtaccggatacatttggcagatgataatctgattccgtctatcaggctggcatgtacgagtttgtccgcaaggatcaatgtacgggcatcactgacggcaggaagtatccctgtgttggcgtggtatccgctattgaacagaagggcgctttctgctccgaacatagtggccagttgctgttccagttcctgataggcagtgaagttgcctgtcagcaggcgggaggaagaggaagtgggcagaaaggtttccggagtgatggtctttaagaacgcttctcttaaagacacctcattggctaaccccagataatcattggatgataagttcagcatccgtcgtccgtctactgtcacgtctcttccattatgaatcaactgtgggagagaacggtaattcttcttctcttttaaagtcagaagttcttgattgatagagtctaaaatcataatctattcattttttgagaagatagttaagttacatctctctgactattttaagtactccggaagtcagtttacttaattgctccggagagatgatgaacgggggcatcaggtagaccagttttccgaacggacgtacccagataccttcttctacgaagcggcgttgcatatatgccatgctcaccgaacgttctgtctggatgactcctatggctcctaatatccgtacatccgctacttgcggaaacttgcgggcgggagccagttcttcttttaactgagcttcgattcgtttcacattctctgcccagccggagtcgagcagcaaccggacagaagcacacgccaccgcacacgcgagcggattccccataaaggtaggaccgtgcataaaagcctttggggcatgattggagatagtatctgctatctgattgcttgccaatactgcagacagtgtcatgtatcctccggtcagtgcctttccgatgcacatgatgtccggttccactccggcatgttcccaggcaaagagtttgccggtgcgtccgaatcctgtggctatttcgtcgaagatcaggaggatatcgtgttctttgcagagtttttccgcttcacgcagatactgcgggtgataaaaccacataccgcctgctccctgaacaatgggttcgaggatgagcgccgccagttctttggagtgtttctctatcgtttcccgcagggggatgatctcgtccggattccattctccgtcaaatcgcgaagagggggccggaacgaaatatcggacaggaagcgatgaaccgaaaagactgtgcatcccggtaacgggatcgcatacggacatggcattccaagtgtcaccgtgataaccggaacggatggttacgaaattgtttttgtcgggctttccggctgcataccaatattgcacggccatcttcaaggcaacttctaccgccaccgaaccggaatccgcataaaatatcttttgcatggatgggggaaccaagggcaacagcagtttgcctaactcgatggccggatcatgagtcagtcctccgaacatgacatgggacatcttgtctaactggtcttttgccgcctgattcaatactggatgattgtatccgtgcacagcacaccaccaggacgacattccctcgatgagtgtccgcccgtcttcgagtgtgatcgttgctccgtccgcccgctttactttgtagacaggcaatggatcggtagtagaagtataaggatgccacaaatgctcgcggtcaaactgggagtcggcgaagtggtaaccttcttccagaatcatcttcttgtcgtcggaaaccttggaaccgagtgtggtcagcaaatcacccacgatggcggaattgatgccgacaaacaaggctttgcgcatggcttcgggagtgagctgcgaacgtcctcctgcgaaacgcaggaaagcggtaggattgatgaagcggaacagggcgatggttcgcaggatttcttcttcgctcaatgccttttcattttccagtggagttccggggatcggacttagcaggttgatggggatggactgtacattcaattccgccaaagtgaaagcaaattcaatacgttgttccattgtttctcccatgccgatgatgccaccgcagcagatatccatccctacccggcgggcggcgtcgagagtggccagcttctgctcttgtgtatgtgtggagcagagtgtggggaaataggaaggagctgtttcgaggttgcagtgatagcgggtgattccggctgtgtgcaaggcgcggagttcttcttcgttgagtaatccaagggatgcacaaagttggatggacgaatgtttccgcataaggcgggccgcatcgcaaagttgactgatctgtttgggagaaggttttcgtccgctggtgacaagggagaaacggttgacgtcttgactttcgttgtattttgcctgtcggagacattcttcagcgggcaggagatcgtaaatctcggcttgagtcttgtagtgagaggattgtgcgcaccatttgcagttctccggacaccggccggacttggcgttgatgatggaacacatatcgaactcgtgcgaagcacaggtgatggtaatctcatgcgcggcggcataaagcgcctcgctgtcggccatgttggccagccaagtggcttgggcggacgatatgtcgaagcctgccagtacttggtctttgatttcttgaagtgtcataaatgtatgataagggatagtaacttttgcattctgcttgcgaagagccacatctaccacattggtatgcagatgaccgatctgaaattcacgtcccatactcgcaaatgcggcatagttcttcctgccccagtagcggaagcgggaaagaagggaacgtgtggtctgtatgtggcgttgtttcttcatcaggttcttgttttttgaagttaagaacggggcaaatgtacaaagattctttggataagcaagcgatacaataatatactgcaaatatacacccttaccttgtatcgtttatacacatcctttatcttgtattttttcttctatactccttgcgtaaattgaaattgaatccgacgtatatctgaagcgttccgaacccgttgtccagtgaaaaattattccggtggtaattgtagttctttccgacaaatgaagtgccgacgaaatattttccgttattatagacaactcccgcacggatcaaaaaatccaggttaaaattgccgtaccatgtcttcccttcgtgggtttctgcatctacatcggaggctttgtaggctatggcgggagtgagagacaggcatgccagacagttgcgggcaaatacccagttataggcataaccgaaactgatattggcattggtgtattttatattgttgactttcatggcaggattcatcgcttccagtatgaaagccggaagttctgcatagtcgaactcaagattatgttttgaaatggaaaagcctgcgataaacgaacctgcattcctgcgctgattggttgactggctgaaagcggcagggtaggagaatttgcggttgttgaagatatagtataggttcaatcccttgatatctacttttattccattgaacttttcggagtaattggcggggacatcttccgggaaaccgttgatcttatgaatcttatagttgttacctgtgcgacggtagaagatgtccactcccagcttggaactgtatagacttaaatcgaactctgttcccttgttccttcggttggtcttccggtaaatgtcgtccacgtctacagaccatcccaggaagatccatcgccagccgaagtacaatcctatcttgttatgcggattgggagagaaactcagcttctgcggttggggcagattgctggtaacggaataatattcaaagttgctgaaatgggtagtcatcaatgcgtaattataccggttgggactgatgtaaagggtgtcgaagtcactgaaattcatgaacttcctgatcgctctcttaaaagcgcttggtttggccggtatcacagaatcagtttgcagactatcgctcataagggtatctctcctttcagcctgggcctgtaaggagagtgacagaaacagaaaaagagatagaacaatttgcttcatcctgtgatttttcgttgttatgattgatgctgttcgtttcacgaatgtactacctttcgttgatttatactaataatcgtctaaaaaaatgtttcgtttcctaaacaaatgagatatgtattctgttagttagaacaagcaaataaatcctaagccacaaaattatgagaatctatttacgtttattagtggcgtttctattgctttctgccggcaatgtagtgtatgcagaagcacaacaagagaaacgcgtaacgggtactgtgacttctgaaggagagcctttacccggtgtttccgtacaagtgaaaggggcctcttccggcaccattaccgatatcgatggaaactattcaattgaagcccctgccaatgggactatcgtgttccgctttgtaggattgcggacagtggaacaagcggtgaacaaccggaatgtgatcaatgtcacaatggaatcggagagcaaagaactggaagaagtgatggttgtagcttatgctactgccaagaaatatagttttaccggagctgcctcgactatgaaggcgggagagatcgagaagttacagacttccagcgtatctcgtgtacttgaaggtacggtatccggtgtgcaagccagtgcttccagcggtcagcccggtacggatgccgaaatccgtattcgtggtatcggttcgatcaatgcctccagtgccccgttgtatgtggttgatggcgtaccttttgatggcagcgtcaactcgatcaatcctgatgacatcgcttccatgactgtactgaaagatgctgcatctgctgctctgtacggttcgcgtggtgcaaacggtgtgattatcattactacgaaacaaggacagcaggactcgaaagctactgtcaaggtgaaagctacactgggtggttccagtcgtgcggtacgcgattatgaccgtgtcaataccaatcagtatttcgaactttactgggaagcgcttcgcaaccagtatgccaagagctctgattatacccctgccaccgcagctacgcaggcttctaaagacttggttacaaaattgatgggaggcggtccgaatccttacggcacacaatatccgcaacctgtggggacagacggaaagctggcagcaggtgctcgtccgttatggaactccgactggagtgacgcgatggagcagcaagcgcttcgtaccgaactgaatctgagtgtttccggtggtggaaaggctaatcaatacttcttttctgccggctacctgaacgataaaggtattgcactcgaatccggctaccaacgtttcaaccttcgttcgaacgtgaccagtgaaatgacttcctggctgaaaggaagcatcaacctgagttttgcccattccatgcagaattatccggtttcttcggattccaaaacaagcaacgtgattacggcaggacgtactatgcccggattttatcctatttgtgaaatgaatacggacggcagctacaagctggatgacaatggggatcgtatctacgatttcggttcataccgtccttccggttctatggctaactggaacttgccggctaccttgcctttggataaatcggaacggatgaaagatgaattttccggtcgtacttatctcgaagctacgatcatcgaagggctgaaattcaagacaagtttcaacttcgacctgatcaactataatacgctggattatacgaatccgaaaatcggtccggctctggaaaacggaggtggttccagccgcttgaactcacgtactttttcatggacatggaacaacatcgcgtcgtatgataaaaccatcggtgatcatcactttaatgtgcttgccggaatggaagcctattcgtaccgttatgatgaactgactgcttcacgtacgaagatggcacagcccgatatgcccgaactggtagtcggctcacagttgacaggcggttccggttatcgtatcgattatgctttggtgggatatctcacccaggcgctttatgactatcagaataaatactttttctccgcttcctttcgtcgtgacggttcttcccgttttgcaccggagactcgctgggggaacttctggtctttgggaacttcatggcgtatcgaccgtgaaagttttatggcttccactgccaactggctttctgctctgacattaaagatgagctacggtgcacagggaaatgataatctgggtacttattatgcaagcaagggactttataccatcgtttccaatctcggagagaatgccttggtttccgaccgtatggctactccgaacctgaaatgggagacgaacctgaactttaacgtcggcgttgatttctcactgtttaacaaccgtttttccggttcgttcgacttctttacgcgtcgttccaaagacttactttattcccgtccgatcgctccttccttaggatatggctctattgatgagaatgtaggcgcattgaagaatacaggtattgagatggtgctgaacggaaccattatcaatcagaatggatgggtatggaaactcggaatgaacctgacgcattataagaataaggtgacggaacttccgctgaaggatatgccgcaaagtggcgtaaataaattgcaggtaggacggtcagtctatgacttctatatgaaagaatgggcgggagtagaccctgacaacggtaatccgctgtggtatatggatgagaaagatgccaatgataatttgaccggaaaacgtgtcacaacaagcgactatgcttcggcaaattattattacgtcaataaatcttccctcccgaaagtttatggtggtttcaatacatcgctttcatggaaagggttcgatctgtccgccatctttgcttatagcatcggcggatatatctacaaccgtgatattactatgattctgcacaacggaagtttggaaggccgtgactggtctacggagatattgaagagatggacaccggaaaaccgttatacagacgtgcctgctttgagcactacttccaataactggaactcagcttccacccgtttcttgcagaacaattcatatatgagactgaaaaacctgacgctatcttacgatctgccgaaacagtggatcagcaaactggcattgagcagtgttcaggtgtttgtgcagggcgataacctgttcactattcaccggaatcagggacttgaccctgaacagggaatcacgggtatcacttattaccgttatccggctatgcgaactatttccggaggtatcaatctatctttctaaaattacacgatatatgaaaaagataaaaattcaatctatacttactgctgttgccggactgtttctggcgacaagttgtagcagtagctttctggatacggaacctacggatgcggtaagctccgatcaggtagcagtagccggaaatgcagaacgtctcttcaacggagcttggtataacctgtttgaatacggcacgacgtatgccaatattggttatcgggcacttcaatgtcaggatgatatgatggcaagcgatgttgtctcccgtccgaaatatgggttcaattcttcctatcagtttaatgatgtggcgattccttccgatggaagaacttcgtttgcctggtatctgatctataagacaattgataactgcaacactgccatttcgattaagggtgactccgaggaacttcggcaggcacagggacaggcattggctttgcgtgccttttgttatctgcatttggtacagcattatcagtttacatatttgaaagataaagatgctccctgtgtgcctatatatacggaaccgactacaagcggtaccaagccgaaaggcaaatcgacagtggcgcaagtttatcagcagatctttgatgatttgaatcttgcacaggattatctgacaaactacgtccgcaagggagacgggcagaaattcaaaccgaatacggatgttgtcaacggtcttatggcacgtgcttacttattgacaggacaatggggagaggccgccaaagctgccgaagctgcacgcaaaggatattcattaatgactaccactgccgagtacgaaggttttaataatatttccaataaggaatggatttggggatctcctcaaacactttcgcaatcggatgcaagttataatttctactatctggatgcaacgtatgtcggagcttacagtagctttatggccgacccgcacttgatggatacttttgttaaaggtgacatccgtctgcctcttttccaatggatgcgtgaaggatatctgggttataagaaattccatatgcgttcggatgatactgcagatctggtactgatgcgttcggcagaaatgtatctgatagaagcggaagccaaggtcagagatggagtagcactggatcaggctgttgccccattgaatacattacgtactgcccgtggcgtaggtaattatgatgtgacagggaaaacaaaagagcaggtgattgacgaaattctgatggagcgccgacgcgaactttggggagaaggattcggtataacggatgtactccgtaatcagaaggcggtagaacgcatggctttatctgaggatatgcagaaaacggaagtggattgctggcaggaaggcggcagttttgcgaaaagaaatccgttaggacattggttccttaattttccggatggtaaagcgttctcagcgaacagttcttattatctgtatgctatccctgaaaaagagattaatgcaaaccctaacttataaatagctctcttaattttttgactttgaccttaacttgtagaccggtatacgtcgtgacgatgcataccggtcgtttttttatacctgtatcttctgtttctttaaattgggcaaaaagaacgtgactaatcccaataacggcatataagcgcaaacgttataaaccgactcaattccaaatttatcagccatattgccaagtacagccgaagcgatacctgctactccaaaggcaaaaccaaagaaaagaccggaaatcaaccctaacttggtagggagcagctcttgcgcataaagcaggatagccggaaaagcagacgaaagcatcagccctacacaaaaacttaaaatgatggtccatgctaaagtggcatgcggcatcagtaagctaaaaggtgcagctcctaagatagaagcccaaatcacatatttacgtcctacacggtcgccgataggaccgccgagcaatgttccgatagcagtagctaccagaaaaataaataagtataattgagattcctgtacagttacattgaatttatgaatcaagtagaatgtataataactggtaaggcttgccatataaatatactttgagaagattaatatcagtaggatgccgatagataaagcagtcttatccatcggtaaaggcaaatgtacagcctttttcactgtagccttttgctctttcattcggttgagataagatttgtaccatttgcagatcgggtacatgacaccgatagcagccaaagcaaaaagcgcaaaaacggccagatgctctctgccataaggagccaccagcaaagctaccaataaaggacctagtgaacctcctaaattgcctcctacctgaaataacgattgtgccagtccccgtttcccacccgaagcaagaaaagtaatacgcgatgcctccggatgcaagacggaagaaccgattccgatcagaaaaacagagatcagcatccaataaagattgttggagaatgccagattgatcattcctatcattgtaaagctcattccgataggtagtgaccaggcaacgggatgtttatcgaagatgattccggtgattggctggaataccgaagccgagagttgataaaccagtgtgataaggccgatctgtgcaaagttgagtcccaaatcgtctttgaataatggataggctgccgatataacggactgcaaaagatcattgagacaatgcgaaaggcttaatgcgatgaggatagaaaacgtaattcttcctacgggttgttcctgattctgtaccataatacctattcttttgaaatgttcctgaaaaaatgactgcaaaggtacgtaaacttcccgtttctcaatatatttgtcactattaaatctataagtaatgaagaaagtagtagtagcgatggattttttcaaagggtgtctttcctcatcagaggtggaaaaggcggtggaagaaggcataaagctggtttgtccggattgtgaagtcattcgttttccgatagccgacggaggtgagggaatattgactgtcttggtagaagcaacacgaggcacttatcagaagatcatagcgaatgatcctttgatgcgcccgatagaaaccacttatggagtttcgggtgataaacgcgttgcttttattgagatggccaccgtgaatggtctgccgctattatcagaaactgaacgaaatccgatgctgaccactacttatggaaccggtgaattgatattgcacgctattgaacagggatatcgggaatttgtcattggtatcggaggaagtgctacgaatgatgccggagtaggtatgttacaagcattaggagcccgatttctcaataaggatggagcagtcttgggagaaggaggcgaaatcctgcatcgaattgccgctattgatttttcttccgttcaccctgcacttgaagatactcgtttcacgatagcctgtgatgtacgaaatcccttttgtggtccggaaggcgctgcgcatgtttttgcccggcagaagggggcggatgatgcaatgatagagaaattagatgcgggtatgcagtctttttcccgattgatccattcaactaccggaagagaaatcactcacgttcccggagcaggagctgccggaggcttgggaggtgcttttcttgcttttctgaatgctgaactaaagcccggcattgatttactgctccaaacattgaaatttagtgagaaaataaaaggtgctgatctgatcataaccggtgaggggagaacagaccgtcaatctttaatgggaaaagtaccttccggaatattagaagaggcgaaacgacaagggataccggtcattgttgtggcaggcagcatagaggatacggaaattctgaatcaggcaggttttcaaggtctcttttctatcattccttcgcccatgtctttagaaacagccatgaagccggaagtcgctaagaaaaatatttgccggactgttgctcaaattatctctttagtgaatttatagtggcgtttggagtgtaaattgtcgttaattcatttttgacttactgaactattcgtggtacctgatgttgttaaataaaaaaggaggataaaatgggctttatttggtatattattattggtattatagccggctttcttgcaggtaagataatgcgtggcggaggttttggccttattataaatttgttacttggtattctcggaggagtgctgggc

SEQ ID NO: 53 - DNA, 51568 bp, Bacteroides thetaiotaomicron
attatagaaagaaaacaaactaatatttatatatttgtttccataaactttaatatacccgcacacactatgataaaaatactactgctgatcgattattccagtgaatttgacagaaaattgctccgcggacttgtacaatattccaaagaaaacggaccttggcttttctatcggcttccatcctattacagcggcatgtatggagaaaaaggtattctcaaatgggcaaaagaatggaaagctgacgccatcatcggacaatggaacaatgacaccgtcaatctactgaaagaactgaatattccgattgtattgcagaattatcaccatagaagcactacttactccaatctgacgggcgactacaaaggaacgggcagaatggccgcccaattcttcgccaagcggatgttccacaactttgcttatttcggcataaacggagttgtctggtctgacgaacgttgcgaaggcttccgtcaggaagttaaacggataggcggcaacttttattgtttcgaatccgataagcatgaagacgaaatcagaatagaagtaagccaatggctgcaagagcttcctaaacccatagcgttgttctgctgcgacgactcacacgcactattcatttcggaaacctgcaagataagtaacatacacataccggaagaaatctccctgttaggagtcgacaatgatgacttgatctgcaatatttccgatcctcccatctcctccatagaactggaagtagaaagaggaggatattccataggcaggctcattcatcaacaaatcaaaaaggaacatgaagggaccttcaatatcgtcatcaaccctatccgcatagaattgcggcaatccacagaaaagcataatataaaggacccttacattctcgaagttgtaaaatacatagagagtcattacaattccgacctgaccatagagtctttgctggcacagattccgctctcacgcagaaattttgaagtgaaattcaaaaatgcgatgcatacttccatctatcagtatatcttaaactgccgggtcaaccatctggccgatttacttcttactacagatcgttcattggcagacattgcaacggaagccggattcaaagactataataatatctcccggattttcaaaaagttcaaaggatgttcccctttggaatatcgggagaaaaaaatcacgaacagataaaaaataaattattcgtttttcgaatatagcttttcgtttttagtaccggaggcattactaaagtggcatatctttgttcggtaaatgttaactctcaaagtcaatcaacaacttatggagcaaaagaaaatcgtgctattcatcctgatcactcatctggcagcatttctagcaggatgcagcggaaacaaaaatagcggaaataatgactcctctgatctatggaataagttatcgagctacttccgcccgcccgcagaatacgaaaatgtatatgggaattttcgctctcctttattatattataatggggatacagtcagaaccgttgaagactggcaaagacgacgaactgaaatcaaggacagatggatgagcctgttaggacaatggccgcctgtcattaccggacaaacatttgaaattctggatactctccaccgtgaaaacttcatgcaataccgtgtccgcttctactggactcccaacgaacagactgaaggttatttgctggttccggacaaagaaggcaaaaagcctgccgttatcactacattttatgaacccgaaacggctatcggattgggtggaaaaccttatagagactttgcatatcaattgacgaaaagaggatttgtcacattatcaataggaacaacgaagaccacagagaatcagacatattccatttattaccccaccattgaaaatgcaactctccaaccactttcagcattagcttatgcagccgcaaatgcatgggaagtattagccaaagtacaggacgtcgattctacaagaataggcatcacagggcattcttatggtgggaagtgggcaatgtttgcctcatgcctatacgaaaagttcgcttgtgcggcatggggagaccccggaattgtattcgacgaaacaaaagagggatatatcaattactgggaaccctggtatttgggatattatccgccaccatgggaaaatacatggagcaaaaatgggcatgattatgctaaaggcatttatccgaagctccgcaaagaaggatatgatttgcatgaattgcatacgctgatggcacctcgcccatttcttgtttccggaggatactctgacggaacagaccggtggatagcgctaaaccatacaatagcggtcaaccggctcttaggataccgtaataatgtcgcgatgagcaacagagtcaatcatgacccaacccctgaatcaaacgaaattatatatgatttttttaaatggtacttgcattcagcaaataaatctaccaaagagtagaaagatgcgttttttgaatacactttttcgtttttttgcgcaaaaaatcaactctggatgcctaactttgttctatcaattcatccaagtaacctaaattacttgactaaaatgattagcctatgaaaaatatacactagaaaacataaaatgccccatctgcgaatggggcaatattaatgccatattaataaaactaatcataaattatcgcccaattaataaataacacaataataaattcataattaataaattaaaagtgctagctcaaaggaattaataaagctagcagatgattccgagttagtaataaatattaaactattaaaaattcaataggttaaatatatactaaaaagagtagaaactaaaaaaagtaaactatggaagcgaataatcgcagagatttcttaaagaaagccgcattagcgggagcctccgccctaatggctcccacactactggccgctgaaggcaaagatggaagtgaattcgttctctctccgagcaaaaggacggacagcaaattaattgtaccgaagaataatggtctgaaaatcacaggcacttttctagatgaaatatctcacgatattccacaccagaactggggagaaaaagaatgggatctcgactttcagcacatgaaaaggattggtatcgataccgttattatgatccgttccggatatcgcaagttcatcacttatccgtccaaatatctattaggaaaaggatgctatatgccttccgtggatttagtagatatgtacttacgactggctgaaaaatataacatgaagttttattttgggctgtatgacaccggtcattattgggatacacgtgatatgtcgtgggaagtggaatataataaatatgtgattgacgaagtatggaatacttacggtgaaaagtataagagtttcggaggctggtatattagcacggaaatcagccgcaataccaaaggagctatcggtgcatttcataccatgggtaaacaatgcaaagatgtatcgaatggcctccctacttttatatccccttggattgatggtaaaaaggcagtcatgggaaccggaaaaatgacaagggaggatgctgtatccgtagaacaacatgagagagaatggaatgaaatttttgatggtatacacgatgtagtagacgcttgtgcttttcaagacggacacattgactacgacgaactggatgcttttttcactgtaaacaagaaactggcagacaaatacggaatgcaatgttggacaaacgcggaaacattcgaccgcgatatgcccatccggttcctgccgatcaaattcgacaaactccgcatgaaactggaagcggcaaaacgtgccggatatgataaagcaatcacttttgagttttctcactttttaagtccgcaatcagcttatctgcaggcaggacatttatatgacagatacagagaatactttgaaatcaaataaactatatgaaaacaacaattaatctgggttatatcatattcctttcagtcgttgctgctttaggaggctttctgttcggttatgacacagctgtcatatccggcacaatagctcaggtgacacatctgtttcagttggacaccttgcaacaaggatggtatgtaggatgcgcattgatcggatcgattgtcggtgttctcttttccggaatattgagcgacagcatcggacgtaaaagaacaatgatactttctgccattctgttttctacatcagcaatcggctgtgctttttgcattgactttaaccagttagttgtttatagaatcataggtggcatcggaattggtgttgtttctattgtatctcctctttacatttccgaagtttccgtcgcacaattcagaggcaggatggtctccctgtatcaactggccgtaactgtcggttttctaggagcttatcttgtcaactaccagttattggcatattcagagagtggaaaccacttacctatcgcctggttagaaaaaatagtagttacagaagtgtggagaggtatgttaggcatggagacattaccagccataatattctttattattatctttttcatacccgaaagccccagatggctgatagtaaaaggacaagaaaggaaagccacttatattctggaaaagatctacaattcatttaaagaggctgatttccagctaaacgagacaaaatccgtccttgtttccgagacccgttcagaatggtctatccttctgaaaccaggtattctgaaagcagtcattatcggtgtatgtattgctattctgggacagttcatgggggttaatgcagttctttactacgggccttccatttttgagaatgccggtctttcaggaggggattctctgttctatcaggttcttgtaggacttgtgaatacactgaccactatcctggcacttctcatcattgacaaagtaggacgcaagaaactgatatattatggggtatccggaatggtcgtttcattgatactcattggcagttatttcctcttcggaaatgcctggaatatttccagcctgtttctgttagccttctttctgtgttatgttttttgttgcgccatttccatttgcgctgtgatattcgtacttctctctgagatgtaccctaccaaaatacgcggattagcaatgtccattgccggattcgctctttggatcggtacctatctgatcggacagctaaccccctggatgctccagaatcttactccagccggaacattcttcctgttcgccatcatgtgtgtaccgtatatgctcattgtctggaaactcgtaccggaaactaccggaaagtctctggaggagattgaaagatactggacccgttcggaacggtaaaatagaccttattaaataaaaaactaacaattatggatttaaaaaaattagcaaaccaatacaaagacgaactactgaataatgttcttccattctggttagagcattctcaggatcacgaattcggtggctatttcacttgtctggatcgtgaaggcaacgtattcgatacagataaatttatttggctgcaaggacgcgaagtttggttattctcaatgctttacaataaagttgagaaaaaacaggaatggctggattgcgctattcaaggcagtgaatttctaaagaaatacggacatgatggaaactatcattggtatttttctttggatcgggcaggtaatcctctggtagaaccatacaacatcttttcctatacatttgctacaatggctttcgggcaactcagtctggctacaggcaatcaggaatatgctgacattgcaaagaaaacgttcgatattattctctcaaaggcagataatccgaaaggtaaatggaacaaaatccatccgggcacacgtaatctgaaaaatttcgccctcccgatgatcctttgtaatctggcacttgaaatagaacacttgttggacaaagagtatctggaaaaaacaatagagacttgtatccatgaagtgatggaagtattctatcgcccggagctaggaggaattattgttgaaaacataggagtggacggcaatctcgtagactgttttgaaggacggcaagtgactcccggacacgacatcgaagcgatgtggtttatcatggatttaggaaaacgcctgaatcgccctgatctaatcgaaaaggcaaaaaatgtaaccttgacgatgattaactacggatgggacaaagaatatggtggcatctactattttatggaccgcaaaggttgccctccccaacaactggaatgggaccaaaaactttggtgggtacacattgaaacacttatttccctactaaaaggttaccaattgacaggtgacaaacaatgtatggagtggttcgagaaaatacatgagtatgtatggacgcacttcaaagatgctcaatatcctgaatggttcggttacttaaaccgccagggagaagtacttctgccacttaaaggaggcaaatggaaaggctgtttccatgtccccaggggcttatatcaatgctggaaagtactagaagaattacaataaatctaatacccaaaaacttttttattaaccaattaaattttatcttatgatggaacaatgctttaagcaaaaaagtagtttccgaacaatcagaatcatactattctcattgtcgatgctttttgcgtatgccacaaatggctatgcccagaacatggttaggggagtcgtcacagacgtgaccggtgatccgttgccaggagtcagcgtcgttgtcaaaggtacgaccacaggtaccactaccgatattgacggtagatactctatcaatgcatccaacactgccactcttgaattctcatacatcggtatgaacaaacaagagataaaagtgaacggacgcagtacgatcaacatcatcttaaaagaagatgtcgctaatttggacgaagttgtagtagtaggttatggaacacaaaagaaagctcacttaaccggatctgtagccacggtatctcaaaaagatatgttgaaaacaactgccagtaatatgtcacaaacattagtcggtaagttgcccggccttattacccaacaatcactcggacaaccaggatcggatgatgtttccatattaatccgtggttattcttcattcagcggttcaggtacggtacttgttttagttgatggagtagaacgagctatgggacaagtagacccgaatgacgtggagtctgttaccatcctaaaagacgctgcatcttgtgccgtttatggtatgaaggcagccaacggagttgtgctggtaacaaccaaacatgggcaagaaggtaaaacagatatcacctacagaggcagtatgactctatcgcacgctaccactctgcctaaaatgatgaacggaacccaatatatgcaatggtataatctggctcgcaaactagacaataatggcgtagataatccatattttaccgacgaagaaattgcggcaacttataacggagaccctaccgatggatttgaaaatacagactggacctccgacttatataagactacccttatgcaccaacacaatctgtctataaacggaggcagcaataaggtcagatatttcatcagcggcggctatttacatcaagatggtattattaaaggcaacaaaaacgaacgcagcaatttccgttcaaatattgatgtacaagcgaccaaagacattaaagtgtcactaaataccgcagcattaatcaaagattattatcagccgggaggatactcttatggcaatcaacaagcctatagtattttccatcagttgctttactctataccttttgttccgaaagagtatgaaggttatcctacttcggcataccgaggcgcaaccagcgcagccaatccgatctatggatctgcaaattcaggattccaggaatctcgcagagtcagaatagaaagttccgcaaatgtcgaatatacagccccattcctgaaaggtttgaaagcaaatatgttcatcagttgggactggcaagacctggcaagtaaaacatttgcttatgcatattctgtcaatgcctatgattcttccaccaaaagctacagctatgtacaaagtgcaaatctgctggcagatggtaacctatatcagggtgaccaaaaatcacaacaagtaatattacgtccgactatttcatataacaacaaattcggacttcatgatgtaggagcccttttcctctacgaacaaactcaggtaaaaagctctgcactgaatgctagtcgtacggattacgacttattcgatttacccgaaatatctttgggagatgcccaaactgcaactaatagcggttcttctgggaaaagtgcttacgccgcttatgtaggtcgtctaaattatgcctacgccaataaatacctggccgaagcatctttccgttacgacggttcttataagtttgccaaaggacaccgttggggattcttcccttcagtttctttaggatgggtgatgtcggaagaagactttttcaaagacgcacttcctaaaatagactattttaaactcagaggttcgtttggtattctaggtagcgacaacgttagtgctttcttgtacagaaaatcctactcttatactaataatggagtagtatttggcagtacacctaacactcaaggaacacttagcaacacagtagcttatccaaatgaacgactgacttgggaaaaaacaaaatcatataacttaggtttcgatcttagtgcctggaacggtttgttgggagttgagtttgatgtattctacaaatatacatacgacattcttcaaagtgttagtaatatctatcctccttctttaggtggacactacccaagttctgaaaatacaggaacatttgataaccgcggatttgaaattgcactgaaacatcgcaatcgtataggagaattcagttatagtttgaatggcaacttatcttacgctcataaccgtatcttaagcagaacacaggcggataacacattaccctggcaaagtgttctcggatcatcagtcggtgaattatggggattaaaagcattagggttgtatcagagtgaagaagagattgccaattcacctcaagtatcatggaatacaccacgagtaggagacattaaatatgccgatattaacggcgatggaaagatcgattccaacgaccgaatcaaaatatcacgtggcatccgcccggaaatgatgtttgcactaatggctgacgctaattacaaaggcttcgatttatctgttcagtttcaaggagcggcactttgtgataaaatgcttcaatactcatggcaagacttaaatggcgcaacagatatgacccctatgacaagaccctggtatgcaaattgggacaacgctcctctttatctggtagaaaacagttggcgacccgatcatacaaatgcggaatatcctcgtctgactgtcagcagtgtatctcattcaaacaatgcccaacaatcggatttctggaaaagaaatggtgcgtatttacgtttgaagaacgtgactttaggatatacgcttcctaaagcctggaccaacaagatgggattgtcaaacatcagagtttatgctaacgggactaacctactgacatttaccgatttcaagtatatcgacccggaaagtacaaatgtagcaacaggatattatccacaacaacgtacattcagttttggtatagatgttagattttaaaacaaatagttaatatgaaaaatataaaaaaatacattataggcatagcagctagcatttgcttgacacaatgtgatgtactggacgtagatcctactggctggtacagcgagaatgtagcatattcctcactggaaaatgtagacctttacgtcaaagggctatatagcgtgctatatgataatgctactatcaatatagattcttactgcttaatggacgatggagctacagatctgttaaaatactcttggtatggagtgaacggaggtgccatgaataaattcttttatcagacgaattatgtcaccgaaacgagcaacttccgctccaactggagtggtatgtatacccgtatccgtcaactcaacgaatatttctatgaccgaagcaaaggttatggagataacttagatcaggatgaaatgaaaaagcgtacagcagaggttcgtttcttacgtgcatttgcttaccaggaactggtgctccgtcatggcggagttatcctgcgtactgatgaagattatgtagacggacctgacgaaagagctaaagcacgttcatctgaatcagattgctgggatttcattatcaacgaatacacccaggcagtacaagaccttccggaaaactggacaggtaccaatgtggggcgtattaccaaaggagccgcttacggaatgaaagcacgtgcggccctttatgctaaacgctggggggatgcgatagatgcctgcaatgaagtattaaaattgaattacagtttattgcaaggaacgactgccaatgattactacaaaatattcacctcagtcaataatagtgagctaatccttccggtttacttccaacagggaaagaacgccaagcaacattcttttgacatctacgtgtgtccaccatacgactggaaagcagccggtgttacagaaggaagtgtaggtgcggcagtcactccatctgatgaatacgcttcctctttcgatatcaaagtaaacggtagctaccaatcttttgactggagtaatctcagttcctacaacaatgctccatttaccaatcgcgaaccacgtttttacgcctccattctttataatggagcaacatggaaaggacgtactctccagttgtatgtagatggaaatgacggatatatggattttgctacaaccggacaagataatgtgcacaaatcaacaacaggttatctgattcgtaagttcgcttctgatgataccaatatcaactttagcagcattttgagtggacaatactggatagaaatgcgtttagctgaaatttacttgattcgttcggaagcatatgcacgacaaaacgagtttggaaaagcctatgctgatctgaaaacgatccgtgaccgcgtcggactgccggaactcgcccaacaaaataattggagtgattatctggaagatctgtctaaagaacgtatttgtgaacttggaatggaaggacaccgatatttcgacctgatccgttggggaatcgccgtaagaacacttgatcataaacgtctgcacggcgttaagataacacaggccggtggcagtttcagttacgcacgagtagaatgcgatacacaagaccgtttattccctgaaaaatatacaattttccctattccatacacagaacttcaagacaacacactctgtgaacaaaatgaactgtggaaataataattatttaataagagaaaaattatgaaaataaaatatctattcaccggggtactaatatcaatgctagccttcatgagctgcgaggacccggacgatctggcaaggacaggcagcgaaaatgttacaggactaaccataaccggatgcttagcttctgatgaaagtaccacatatagtgctatcgtagacgaggcaagtaatacaattaccatacaagttccttattatatttcagatacggaaaaaatacaaggtgacctgacacaaatgaaagtttcagccagcctgcctgtaggagcaaaattctcccccagcatttccggcattcgtgatctggtcagtggtttccaatcaacattagtcaaagaagatggaagcaaaattacttatacatttaaggctgcttatgtgaaatcaaaattagccagtattagtaaagtagaactgacagactattcacgtgcaacaatacgtatcgtcgaacctgagagtacgggtggtacaggaaaaatcatcatctataaaacctcttcagctattgatgcagccttgaagtctgcggcattaacagtctctccatgggctactatcgaatcatcatcattggatccggcaaccggcattatagatttaagtaaccaaccgactataaccgttattgcacaaaatgaaacagacaaaacagtctatcagactagtctggaactcccggatctattacctcagggagtgggctatacagcttcattatttggtttccaaatctatacagatgacacacatggatttgaggttggagcgaaccgtacaatggctgttattgacgactatctaattatcagtaatagcactgattacaataaaatgattgtaatggatcgttataacggcaaagtacttgatgtaaaagtcaacactacaggtattgatgcaggccgctccatccatgctattaccagtgatgatgctggacatttagtagctatggcatacactagtactttagacgccaatgttaccgacccaaacgtacgtgcctgggtttggcctaacggcatcgagaatgcacctaagagcatcgtttatgcaaatattaatgggagtacattcgccaatgctcctgtaggcattaatggagtcaaaaaactagagcttggacgcacaatctgcgtcaaaggtgatctgacttcaggggatgcaattattgccacatcaaccaaaaatgtaccacgtgcggttttccttatgttcaaagatggtgcaatgcaaggcaacgcttatgtagaatggggcggaggagcatcagtctccatgtggaacgcaactaaagtcattccattgacaaatacttctccactaggatatatttgggccagtgccaacttccggcaagcaattaattacactcctataggcacaggcgcacgcgccatagatttctcacttccaacatcacattggtggtccggtagcgctacatatgataagaatgtccggggaataggatatgttgaatttaacggtacatgtttgttaggcgttcaaaatggtctgtcaagcaatggggtttggtcccaccgcctatatgtatccaacatcacgaataatcccggaacttcagcaatggctaatggctttatcttcgattcacgtgaaggaagtacaacaggaacaggcagtatccccggaacggggtatgcggtaactggtatgacatcttcagcctcgttcgtttctggcaaacaggtacttggtaccaacgttgatgaaacaggagatgttgtattcggtcgaagtgctgatggcaatgccgttcaggtctatatgttgactacggatcagggactatttgcttatgaaattaccagattcaatttataaatgaaaatttaaatatcatttaagatcatctataaactactcagtaacagttggcaattacatatgaataattgcacaactgttgctaagtagttattaaagtcactagattataattaaaaaaatccgatggtacaatttttccaagaaatacaagagcaaccgcaagcacttctgcagacggcaaacttctacaaaagcgtagaaggaaaatccgttttgtcacaaatttcagaattatggtgttccggcaaatatagaaatattctgttaaccggtatgggcagttcttacttcatcgctaacgcaactgcttctctacttaattcatataaaatcccggcatatgctctgaacgcaggagaattattgcattatcaaatttcattaattagtccagaatcgttgattatatgtatttcgcaatcaggagaaagctatgaagtaatcaaactaatagaaaagttatcttcaaacatcacagttctttctatttgtaatgaaaaagatagcagtttagtcaaattctctcgctatagcctattgtgcaaagctggaaaggaagaaaaaacgtcaacaaaaacattcataacctgttatcaagtagcatatttactggcaatgaagttatgcaatcaagaaatcgacagcacccaatggcataaactcagtaaaattattgagaacatggtcaatggaaatactccatggatgtcgaaagctattgaactgatagacggctccacttttgtgcaattaataggacggggaccagtttttgcagctgccagccagagtgcattgatgttcatggaagcagcgcatacgcctgcatcagctttattaggtggtgaattcaggcatggcccgttagaaatggtaaagaaaggattcatagccattctatttgcacactcgcaatcagaaacctacgaacaatcactatctttagtaaaagatatccttaaatatgaaggaaaagttatctttatcaccgattcaaacttagtgtttgaaaatgataatttatgtgccattactatcccaagcactaatgctgagttatttacaatcccctgtatagttcctgtacaacttcttataaatacatgggcaaccaaatgcggaataataccaggagaatttacacatggtgccaaaataacatcaatcgaataaactatgagaattgtgtatccaaagaaaattgcaattggagtcgatattggcgggactaaaataaaagccggacttgtcgatattaacggacagataatcggtatccccgaatctatccggactttagcgcacgaacccggtgaaatgattattgagcaattgactctattaatccgaagaatgatacaacaagccgatggagcagaattaatcggcatcggcatcggttctaccggtccattagatatcaacaaaggcatcattctcgaatgcaataaccttccaacgttacacaattaccctttacacaaaaaaatagaatcaactttcggacttccggtcaaactggataatgatgcaaatgcaatgatgttaggagaagccctatggggagccggaagaaacctaaattcaatactaggaatcactcttggcacaggcttaggagcagctatagtggtaaacagaaaaattattcgtggagctaccggttgtgccggagaaatctggctgtctccatacaaagaaggaatgatagaagattatgtatcgggaactggaatatcaaatttatatcagagaattacaaaaagaaagatttcaggagaagaaatcagtaaattagcccgggaaggagacatcaacgcattaaaagcatggaaagagtttacccaggcattagcttatgccctttcctggactgttaatatcgttgatccggaagtcgtaattatcggaggctcagttatgcattcatcagatatattttgggattcaatggtatctttatttaaaaagtacatttgtccgcaaactgctgcaagcatccagttaaagccagcaggtttaaaagataatgccggatttatgggtgcagcagctttaatgtttgtagaataaattgttatgaaaaaattacttatactctatccgtttctattgttttgcttgataagcaaagcagataaccagttgaaattaaccaattgggaaataaaaagtacaaccgaaataagcgaaaatgcggaaaaagtatctatgccttcattccaagctaccgactggtatgaagccacagtaccgactactgttttgaatgcattagtgaaacagaacgtttatcctgatcccagaatcggcatgaacaactttctaattcctgatgtctctgatgagtttaataaaaaaatggacttagctaaatacagttacctgggcaatggaaaaaatccttggcaggaaccttattggtatcgcacgaccttcactttgcctaagcaatataaaaacaaaaaaatatggctgaacctcaatggaattaactatcgtgcagacgtatggattaatggacatcaaatagggaaaaaagaagatgtagtaggcatgttccgccgcttcaaattcgatataaccgattatatccagcccacacagaactgtattgctataaaaatatatcaagtggaccatcccggaactcctaaccccggaacacaatttatagcctttgggcctaaccgtggtacggcttccgatttgttcaaagatgaaacattaaaattcacaggtggttgggattgcgcccctgtagtgcgtgaccggaatatgggtatttatcagtccgtcaccctggaagcaaccagccaggtcactattgaagacccatatattatcactactctaccccaaaaagatacaacagttgctgacattacaatcaaagcgactgtacacaatcattcggataagatgataagcggtaaagttaaagcaacaattcgccttatcaacgaattagtttatccgagttacacacgtaaactggctggaagcatgaaaccgataagcgtaactctgcctgtcacaatgctccccaatgaaagtaaagaaataatattatctccccagaagttttccgtcttatctatacagaacccatacttatggtacccaaacggatatggagagcaatatatgcacagtctcgatttatcattcgacatgaataatgggaaatcgtccgatcgggagaaggtaaacttcggaattcgcgaagtaacttcggaattaatgaaaaacggggaagaatatggtcgtgtattctttatcaatggcaaacgcatcttctgtaaagggggatggatacaaccggatgtacttctcgacgactcacccaaacgaatttatgaccaggcacgattaatggcaaatgccaacattactttgatcggcagtgaagatatgccttccccttccgaagattggctagatagctgggataaatacggactgatgaactggcatgtattttatcaatgctaccgaatgttcccgggacgtgacaaccagcataatcctctcaacaatgacttagctatcgcttgcgtgaaagacatggtcaaaagataccgtaatcatccctgtatcattgcatggttcggagttaatgaagtgttggtagatgaagaattgtatcatccgaccaaagaagccgtattaagcctcgacacgacacgcccctacataccgactaccagtatcagttgggacgtagacaaactaactccttatttaaaaccggacttaccaaccggtactaccgatgatggcgctcccgactataactgggcaccctccgattactacttcgacaaagtagaagaggtttatctgcaaatgttcagaaacgaattaggcatgccttccgtacctgtatacgaaagtttgaaaaagtttatacctaccattgataagccactcgaccggagaaatccgatttatccattagacagtatatgggcggaacacggagcatgggacaccaataacttctgctatcgtgcatacgacaatgcaatccgaaccttctatagcgacccagtcagtagcgaggattatgcatataaaggccagctagtaagttcagaagggtatcgtgccatgtttgaggcagccaaccaccggatgtgggatatcacaacagggataatgatctggaaactaaactcttgttggcccgatgtctgctggcaaatttatgattggtatctgtcacccaatgcttcttactatttctctaagaaagcaatggaacccattcatattcaaatgaatgcaaatacgaaccggatttctgtgataaacgctactcatcaagaatttaaatctgttatagccaaagccagaatcatagactattcgatgaaagaatgctgggcatacacagataccatatccgtgggcgccgaccaatataaagaattagaaaccgtacctcaacgaggtgacctttctgccatatattatataaagctggaattagaagacttaaacagaaatcttatttctgaaaacttatattggcgttactcgcaacatcaaaatttctattggctggtaaatatgcctaaagttacattaaagcaagatttaaaacttcaaaaacaagaaaaagagtatcagatcacgcttactttaacgaatgactctgataaattatcctttttcaaccacttaatgatacaaagagaaaaaacaaaagaagtcgtaaatccggtattctggagtgataacttcatttcattgttccctaatgagacccgtaccatcactgcgacagtatccatagaggatttacatggagaaaatcctataattattattaaataactaataaaaccaagaaacatgaaactattacttacaaccttggcaatagtctatctaagtttgttcatgagcctgcaagcacaagaacaggtacgggttatcccctatcctgctgaagtcaccatgcaagcagaaacgtgtaaactcaaatcgggtcagaaaatccactatctggatgccagtttatataaagaagcagcattccttgaaaagaaactcgctgatttaaactataaaatgaaagtaatccccggcaaaaaagctgtgaaaggaatcaacttatcattaaacaatagactgcaaaacaaagagggctatcagctgattatcgcccccaaacaggtcctaatcaaaggaggaagtccagctggagttttctatggtattcaaacgctattacagcagttaaccaacggagatctaagatgtggaacgatagaagacgccccgcgttatgaatggagaggatatatgcttgatgaagcacgtcacttttccggcgaaaaaagggtaaaacaaatccttgacctgatggcatattataagatgaatcgcttccattggcatctgacagacgcacaaggatggagaatcgaaattaaacaataccctaaactggcaactataggaggagaaggttgccatagtgatccggatacaccggcacaatattatacacaagagcagatccgtgatatcatagcatatgccaaagaacgtcatattgaaattatacccgaaatagacatgcccggacatgccacagcagccaataaagcttacccggaatactcaggcggaggaacggaagaacatccggaattcacttttaacgtcggcaaagaagaaacttatacttatctgactaatatactaaaagaaatagctgccttattcccttctccatatttacatatcggaggcgacgaagtagcttacggaatcaaggcatgggaaacagacccacatgtacaagcactattgaaacgcgaagggttacaaactgtaaaggaagcagaacgctactttatgcatagaatgacagatgtagtaaactcactaggtaaaactttagtcggttgggatgaacttctcgacttgaatgtaaagcaagataatactatcattatgtggtggagacatgataaacccgattacctgcgcaaatcactgaccaaaggatattcgactatcatgtgtccgcgcaaaccgctttattttgacttcgtacaatataaagaccacaaatggggacgaatctgggacggattctgcccaatagaagatgtatatgctttccccgacaaatggtttgccgaatggggagtgtcagcctctgacctctcacatgtcaaaggcatacaggccaatacatggacggaactaatgcatactaaagatcgggtagatttcatgatctttccccgcctctgcgcactggcagaatcagcttggtccgcaccgacagtcaaagactacgacaagttcctgtcacgtatggaagatgcattcaccttatttgataagctgaatatttattactttgattatcgtaatcctcagcaccatccggaaccggctggtcctgtcatcaaaaagaaagaaaaaatacaaatggatttccgtgactaaaaaaagaaatgctacatgaagattcttatctactttttaataattgtactgtggagcatcaatatggaggcaaaagtcaaattgcctccactacttagtgacaatatggtcttacagcaaaaaagcaatgtacgaatctggggaaaagcgactccaaattctactgttgtagtaactccttcatgggcaaataaggaagtcaaaacccatgctgacgaaaaggggtgttgggaattacagatcacaacgcctgctgccagtttcgaagaatatacattaacactgacggatggagaacaatctgtcactttgcagcacctcctgatcggagaagtctggttatgtgccggacaatcaaatatggtaatgcctttgaacggatttgattattgtcccataagcgactccaataatgtcatagcagatgctcccaatcatccgggaatacgaatggtaaccataaagccgacagtaaaactatctccgcaggagtatgcagaaggaagctggcagcaaccaactacggaaaatgctccgaagtttagtgcagccgcctatcattatgcattaactttacaacggaccttacagattcctataggagttatcacctgtgcatggggaggctcaagagtagaaggttggctacctaaagaaatactacaaacctacaaagatgaagacctgactttaataggaagtgacaaaacaccagtctatttacaatcgatgttaatgtataatggaattttatacccctgtcacaaatatacaataaaaggttttatctggtatcaaggagaaagtaatgtaagaagtagcagaacatacgccgaacgcctagctacaatggtaaaacattggcgatcaatatggaaacaaggagacctgcctttctactatgttgagacagtcccatttgcctgtgaatataaagaagatggctacataggagcattattgcgggaagctcaacaaaaggcgctttcactcattcccaatagtggtatgatcggaacaaacgacttagtagagacatacgaagctcctcaagtgcatcctcacaataaaaaagggattggagaacgcctcgcatatatgtccttgaataagacatacggatatcagggaatagaatccgaatatccatcttataaaagcatgaaaatcaacggagagacaattgaaatctccttttcccatgcagaaaaaggattaagcccctggataaatatctccggatttgagattgcaggttcagataaagtcttttatccggcagaggcctctttaaatcagaaggatcatacagtaattgtcaaatccccaacagtcaaatctcccgttgccgttcgttactgttttcggaatttcctgaaaggaaatctgattaatacacgcaatctgccggtcagaccatttcgcacagataagtggtaataaaaacataaaataaatgatgaaaagaatatattatacatatccggttttattagtctggcttgtgtcgacattgttgccacaattttgtatagctatgcctaatgaacagaaagaaaacaatgatgtggtcatagagaacgcggaaatgcgtctaattattagcaatgacggaaaagcacgcagcctgatacacaaagctacgggagaggaatgtctgataacaaatgcagatgtacctttatgcgctattacccaataccgtccttacgataatgaaaacttcctaatgtttcctgcaaagccacgcaccttccctgccaataaaattgaacgtaacggaaatgaattacgtatagaatttcaggatacctatgacattgccatcatagagttaaatatcacagattattatataggtttcactctgaagcaaattgattatcgtatcgaagattttggggtaaaacgcaaaactgaaatagatgaaatctcattattacaattaccagtacgtaaacgtgagaactttggtgagtggctgaatgtatcatgggatgaacagacagccatatgcctgctaggcacccatccgaccacctatatcgatgcttttgcaaacaaggaatatactacgatgtatgcaggacttgattttcaagtgaaactattcaattccggtgcagcactgattactacttcaaaagaaaaactgctaacctgtattgataaagtagaacgtgactatcatatgcctttaggagtagaaagtcgccaacgtaaagaatatcagtactcctattatgagctacgtgatgtcacgactaaaaatatagatgaacatattgtatatgctcaaaaaggtggtttcaaatccattgtcgtctattatgttgatttcgccaaagcttgcggacattatgaatggagaaaagaatatccgaatggaatgaaagatttacaggaaatcactaataaaatcaaagcagcaggcatgatacccggcattcatattcattattccaaagtagcagtgaatgacccatatatcaacaacggcataccggactcccgcaccaaccatgtacgcgaatttattctctcggaaccattagatgattcaagtactatcatcactatagaaggtaatccggaaggcgtacgtatggagaaaggacgacgtctcctgcaaattgacaacgagcttgtcacttatgagaactataccaccgaaccaccatatcaatttacgggatgtgtacggggagtatttaactcaaaagcagcctcacatgacaaaggacaacatttcagactattggatgtagatgactggcccctgtttatccgtgtcaaccaaaatacaggaatccaaaaagagattgccgaacgtttaggaaaaatctaccacgaagcaggctttcgttttgtctattttgatggtgcggaagatgtaccgatgccttattggtataatgtctcccgctctcagatgatagtatacaacgaaatgaaaccaactccattatttgcagaaggagcattgaaatcacattatggatggcatattttaagtcgtgggaatgctttcgatatattccctccggaacgtatccgtccggcaatgaagaagtatacacttcgatgtgcagagcagatagccaaagattttacttctgtcaatttcggatgggtgaattacttggctcccaacgacaagacaataggcatgcaaccagacatgtatgaatatatttgcagcaaagctgtcgcatggaattctcccatatcattagttggcaatttaaaagagttacagaatcatcctcgtacggaagataacctgagagttatcaaaatgtgggaagaagcaaaacttcaaggtgtcctgacagacaaacagaaagaattactcaaaaatcccgaacaagaatatcttctgatgaaagataaaaaaggaaattatcagttatacccctatcgtcaaataaccaaggatgacgaaaagccaatccgggcattcattttccagaaagcaggaaggacttgtatcatttattggcatatgaacggtacagggcaactcactcttgatatagaaaaaaacaagctgtctttgatgaatgagagtggtaaaagaatacctatccggtcagcaggaagcaaaagtatcctccccgcagcagggcgtctcatattggaaaccgctcttccacaagaggaagtaataaaattattcagaaaaagcatcgaaattattaaatagaaattattcatcctaatcttttgtatatgagaaatatgataaccagtattattagcatattatgctatttacaatgttttggaactttatcagcctcagtgactgctaaaaatgaaaatggaaactttgtattaaaaaacaagaatgttgaattagtgtttgccaacggaaaagaattcttattcaaggaattccgcatggatggcatgaatatattgcctgtaaatggaagtacaacacatccgtggcaactaatctatcgggggcccaacggagagaacccgaccttaatgccccgatggggcgaatataaaggaggcgagatacaaaaaactcaagatgcctcaacattaatattcacctggcaaatggttatagatgcaggaccgacgtgtccggtacgcatattagtcacattaggtaaagatgccgaactaccggaatggcgcattgaagcagaaatgccggaaggatgggtgattacagaatctgaatttccccgtattgctgtaaacagaccggaaggagcaaaaggaattcttcctgtcggattcgggaccgaatacacaatcggtaatgaaggacaactgcaatcacgttatccttcgtgtacaggcacaatgcagttagtactgatgcatcataaaggaggcacagtctactttgccgcacaagacaaagggggatctggcaaagtattcagaatgaaaagtgaaggaaaaagtcttgtatttattcagaatgtgacaacatcctatgcctggactcaaaacaagaagttctgcattccttgggaaacagtgatgggatttacccaaaagggatggcaggacgctgcagtacaatggtatcgtccatttactttcgaaacactgtggggtgcaaaaactatttcagaacgtcctatagcagaatggatcaaaaacgctgatatgtggctacggccgggagaagtaaatgctgaaacaatggaagcagtacgtaaagcgatgaaatactatggaaaaggagtcggattgcattggtattattggcacaatcatcgtttcgatactaaatatccggaatactttcccgaaaaagcaggattcaaagaaatgattaaagaaacacaggaacttggaggatttattactccatatattaacggtcgtctatgggatccagcaacagacagctataaaacgcttaatggtaaagatgcctcttgtcgcaaagctgatggtacattatatacagaagtatatagctcaaaggtattaaatactgtaacctgcccagcttcttatatttggagagatgtgctgaaaggagtcaacaaacagatattaactgaactaaaaacgaacggtgtatatatggatcagataggttgcgccaacagcgaaccctgctatgcaaccaaccacggacatgcacctggcggtggtgactggtggccttttgcctaccgcagtttactcaccgaaatgcgcacaaatctatacaaagagaaccaagccatgacaacagaagaaaatgcagagtgctatattgacctgtttgacatgatgttagttgtcaattctccgcacaacagctatacaaaaatggttccgttgtttccgctcatttattctgaccgttgcatctatagcggatacacctacatcccttggcgtatcacagacggttctttgaatttcatgagtatgcgtagtctgttatggggttctcagttaggatgggtagagcccagtctgttgatgcgcccagatgcgaaaagggaagctaaatttctgaaaaatctgacagatttccgccgtcaacaacatgatttattcttgggaggccgttttatacaggaaataattccaactggtgataacccaacgcaagagatacccaactatgaaataactccggtagtattagcggcagaatgggctagtgtatcaggcgaacacgtataccttatagtaaacatgagtgaacaagaacacaaggttacactgcctaataaaaaacaaataaccgttaaagcacttgatgcgatcagaatcagcaaataaacagtctttgtaatcaaacaataaatagtacagtaaaatgaaacagattatatttatagcaatattattaacatgtgccttcggagcctgctcaagtgacaatgacggcgacgaacagtctgcaagcgtacaagcaccttcagacataaccatagaaagaatgggaaaaaccaaagtattactacgttggaaagacaatagtaataatgaaaccggattcagcatcttattaagaaaagcagataccagtgaaaatatagaaatagccaaggtatccgcaaatgtcacagaatatacaatcgaaaatggtctggaagaaggaaacatatactatttcggagtaagagcattctcggctacgaatacttcacgtgccatttacgagctctatcggttggtagccctcggtgacgagccaagcatcgcaatcataggaagtatcaaagcaaactcaacttgtatcagttcctcttatcaagtgacaaacatagctggacaaaccaacgtaaaatatggtttatgctggagtaccgaaaacacacccactatcaatgatcaaaagcaaaacggaccggaagttgctgaagacggaaaagtatttcaagtgattccgaataccttactcgactatggcaaatcctataaagtacgtgccttcctgacaacctctaccggtacttattacagtgcagagtcgactgtttccttggaaacagagccacaagcgatccaattgacatggaataaactgactaagtctacattgccagcagaaatcgaactgtacgaaaccaccagtaacttaaatggtagtaatttccatgcatggtacgccattggtgatctctctaccggtaaggtagaagtacgtgtccacataccatcttctcccgcaaccatcgacacgcaatctgcatcatttaatggagactgttatttattggtcaatggaggatacttctataatggaaaccatacaggaatagctgttatcaattccattaaatcgggctctgtttcagccgttcgggggtcactaaaaactggcgatacagaatacaacagtatgtataatgtgacaagaggaacattcggcgtagatgcttcaggcaagccgaatgttgtttggacaggaacggatgcctccagtaatgttttctatttcgaccgtcctttgccatctgtcaaaggagaaaataaatatggaattgtcactaatgaaaatccgactaccgcaattagctggagtcctaaatatgctttaagtgcaggtcctgtattactgaaagacaaaaaaatcccattcgattttacagagacatcaaagggcacagattactatctcagtaactatgaaatcattccgtatgacattttcggagcgaatgtaaccccggaccgtacagcaatcggttatcgtgaagatggaaaagtggtcatattcatatgtgacggacgtattaccgccagtggtggagctactttaacagaactggcacaaataatgaaaggattaggctgtgtaggagctattaatcttgatggcggaggttctaccggaatggttgtaggagacgaacacttgaatgacatgaccggaggaaaccgggcagtcgtttctacaattggattcttcaagaaaaattagcccaatccggatattcataaaagctatagcaatatacatagtaagtttctttttatgtatattgcattgcttttataaacaaccatttattatgaaaagacatatcatcattttgctcattacattcttgtgcttgccggaatatctggaagctcaattaaaatattatgatgctgccaagtttccattgtatggtaaagccacaaagaatacagaaaatcgctacgaacgattgccggattcattaaagcatgtctctcgtaaaccggtatggaatttaagcagaaactccgcaggattagcaatcagattttgctccaattcaacaacaatagccaccaaatgggagaatttgaataataacctgatgaatcatatgacacctaccggtactaaaggactcgatctatacacatgggtagacggagcatggagatttgtgaatagtgggcgccccaccggaaaagtgaatcaagctacaattatagcaaatatggaaccggtcgagcgagaatatatgctatatttacctctttatgatggagtaatttcattgtccatcggaatagacgcagaagcatctatatcagtacctcgaacggcaattccagtacggactaaaccaatcgttttttatggaacaagcattcttcaaggtggctgtgccaatcgtcctgggatggcacataccaatattatttcccgccgtctcaatcgagaaatcgtcaatttgggattcagtggaaatgcacttttagactacgaaatagccgaagtaatgtcctcagtagatgcaggagtgtatgtactagacttcgtccctaatgcttcctccgatcagatatatgagaagatggaaaccttctatcgcatacttcgggataagcatccacgcactccgattatatttattgaggaccccgtattcactcatgctctgttcgacaagaaaatagctatcgaaataaacaaaaagaataaagccgtcaacagtgtcttcaaatctctaaaaacaaaaggtgaaaagaatatatacataatttcttccgaaaagatgcttggagaagatggagaagcaacagtagacggtattcatttcacagacttaggaatgatgagatatgcagaccttgtttgtccggttataaagaaagtattaaaaaaataatttactatgcagtacattaagcagataatgttattggttatactaacgattagttggaaatgccaggcagaagaagtaaaagaaatttggccggacgagttaggcgaaagttcttattacatacaggattggggactcccccgaatcaacaaagcagtcactatgacgccattgactgtgaaaggcatcgtctatgaacgcggcataggaactcatgcaatcagccgtatgctctttgatatcggaaaaaaagccaagacgctttccggattagcaggtgcagatgacaataccccatttgcttgtaatcttcagttcaagatattaggagatcggaaagaactatggagaagcggaattatgagaaaaggagatcctgccaaacctttcaatatcgatttatcaggaatagacaaagttttattattggtagaggaatgcggagatggaatgatgtacgaccgcgctgattggctgaatgtcaaattcacaactctcggtgacgtacagcccattcctgtatggcccaagcccattgccaaagaaaaatacatattgactccacaaagtccggacgctccacaaatcaataacccactgacttatggcgctcgtcccggcaatccttttctcatgccaattatggttagcggcaaacgacctatgacctataaagccaaaggacttccgaaaggattaaagttaaaccggaaaacaggactcatcaccggaagcacgaatacaaatggtaactttaaggtccgcctacaagcgacaaatgagaaaggaacagatgaaaaggagatcacactgaaaataggtagcgagattatgcttactcctcctatgggctggaatagctggaactgctggcgatttgcagctgatgaccaaaaggtacgtgatgctgcccgaatcatgcacgaaaagcttcaggcctacggatggacttatgtgaacatagatgacggatgggaagccgatgaacgtacacccgaaggtgaactcccggctaacgaaaaatttccggactttaagacacttactgactacattcactcgttagggctgaaattcggaatctactcttcaccaggttggacgacctgcggcaggcatataggcagctgtcagcacgaattgacagatgcaaaaacttgggaaaagtggggagtagactatttgaaatacgattattgcggttatgctgccattgagaagaactcggaagagaaaacgattcaagaaccatttatcgtcatgcgcaacgctttagatcagataaaacgggatatcgtatattgtgtcggatacggagctcccaatgtatggaactggggagcggaagccggaggtaatttgtggcgaacaacccgtgatatcaacgaccaatggaatattgtaatggcaatcggatgtttccaggatgtttgcgcatacgtatcagcacctggaaaatataacgatccggatatgttggtagtaggcaaattaggaccgggatggggtgcaaaatcccacgattcggacttaaccgctgacgaacaatatgcacatatctccctatggtccatcctttccgccccattattgcttggttgtgacatgactgccatagacgatttcacgttaggtcttctgaccaatccggaagtgattgcagtcaatcaggacccactggtagcccctgctactaagctcacagttcccaacggacaaatatggtataaaaagttatacgatggttcctatgcactcggcttcttccagatggatccctacttcattttatgggatcaggataaagcagtaaatatccagcaacaaaaatataactttaactttgcccttaatcagttgggcatccaaggtaaagtcaaaatcagagacttatggagacaaaaaaacttaggaatattcagtggtagttatgaaacttccatcccctaccacggtgtctccctaattaaaataacacctataaaataaaagcaaatatgaaacgtattctatttattctctttctctgttgtataggtagtggtcttgctgcttgccaagacgaagaccacacggtccctaccctcccatccgggaatgatccggaaataaacgatccagtcgtagaattctatgattgggaaaagaaccgcaccgagttactgacatctacagatatggtgttactttatggcggaggacatcatcgcactccctatacatgggataaagaacgtgtaagttcttatatcagatatgtagataccgacaatcaatcccactggctattcgacagcttcctctttttggaaattatggacacaggtacaggaggcgctaataaaatgttcgccaaagggtacaatctggaatcagccaatcaagcagactggacgaaacttatagactattacttccaatctgaaacaggaatcggagcattagatgcatcagtcaaagaggcctctgccattttgggaaccccacggcagaaacgtcagattgtgatcagtataccagagcccattgtctaccaacacccggaacaagcatcctcatcaaccaagtattgggggaaaattgataaccagacgcttgacttttccaactctgccgaccgaattaaagcctgcaaatggtatatcgatcaggtacgtgccaagttcaatgaaaagaactatcaacatgtagaattagcgggattttattggcttgccgagaaagcgaccgacacccgtgacattttaaatgcggttgccatctacctgaataaactaaaatatagtttcaactggatcccctattatggagcagatggatataatcagtggaaatcactaggatttaattatgcttatttccagcctaattatttcttcaacgaatccgtccccgattctcgtctggaagatgcctgccagaaagcactcacgtatgatatgcacatggaactggaatttgatgacaatgctctgaatagcagaggaaaggcttatcgtttgaagaactatatgagtgcattcaagaaacatggcatatgggagaaaaaacgccttgcctattatcagggaagtgcatccctacttacactaaaaaaatcagggaacgcagccgatacccaactctatcatgagttctgtaattttgtcatcagccgccccatccggagttcacattagtataaacagtttaatcatcgccattctatgaatcataaatacctatacttactcctgctatttttgatagtcagttgccaacgcaatgtagaaacagaacctcctgtattaaaagaaatgtgccaaagattattttcccggcatgcccagtcgtttctattcgagttactgacagattctattgatacagaccgttttattctggaatcgagtcaagggaaaatacggataaaaggaaacaatcgtaactcattggctgccggtttgaatcattatctgaaaaactactgtcatacccatgtttcctggtatgcctcagagacagtggaaatgcctgatgtactaccggagatacctcagccagtatatatccgttccaaatgtgacaatcgtttttttctcaactattgtacattcggctataccatgccctattggaaatggcaggactgggaacgactgatagactggatggcattaaacggagtcaccatgcctcttgccattaccggacaagaatccatttggtacaaagtatggacagacatgggtttgagcgacgaacaggttcgctcatactttacagggccagcccatcttccctggcatcggatgtccaatgtcgattactggcaaagtccactacctcaatcctggctaaaggatcaggaggaattacaaaaacgtattctcgaaagagaacgtgagtttgatatgactcctgtattaccagcatttgccggtcatgtaccagccgaattaaaaacaatttatccgaatgcaaaaatctatcagatgagtcagtggggcggcttcgatgaaaaataccgcagtcattttatcgatccgatggactcattatactcaatcattcagcgccgtttcctggaggaacaaaccaaagtatatggtactgaccatatttatggaatcgatcctttcaatgaagtcgactctcctgactggagcgaggattttttagccaatgtctcaagcaagatttacgagtcgattcatcaggtagactcagcagcccaatggttacaaatgacctggatgttcttctatgacaaaaagaaatggactcaaccccgtatccgttcctttctaaaagcagtaccggataacaaactgatattactcgattactattgcgatcatacagaaatctggcgaaatactgaaaaatattacgggaatccctatatttggtgttatctgggtaattttggcggcaatacgatgatagcaggcaatctgaatgatattgatttcaagattaaacgactcttcaaggagggaggagacaatgtctatggcttgggagcaactcttgaaggctttgatgtaaaccctcttatgtacgaatttgtttttgaccaggcatgggattatcctgtcactaccgaccaatggataaccaactggtccatgtgcagaggaggaaatcaggatgccaatatcatcaaagcgtggagagccttgcatcagaaaatttataccgaacatgccacatgcggccaatcggtattaatgaacgcacgccccagactaacgggaactaaaagttggaatacaaaccccggcatacattacgcaaataacgacttatggcaaatatggaaagagctactaaaagcccggaacatcaacaatagtgattttcgctttgacgtaatcaatatcggaagacaagtattaggaaacttgttctccgaatatagagatcagtttaccgcttgctataaccggaaagatacaacaggcatgagagaatggagtacccgtatggacaacctcttgcttgacgtagaccacctcctttcctgtgacgcgactctatccatcgggaaatggttacaagacgccagaaactgtggtgcaaccgtgtcggaaaaggattactatgaagaaaatgcacgctgtatcctgaccgtatgggggcaacaggacacccaactgaatgactatgccaatcgaggctggggcggacttacccgaagcttctaccgggaacgttggaaacgtttcacagacggagtcatcgctgctgtttcggaagataaaccttttgacgaagacaaattccaccaggacattacgcaatttgaatacaactggacattacagaaagactctttccctattgtttcagaggaagacccgattcaaatagcagacagtcttatcttaaaatacgatacgtactttaccaaagcacaataatgaaggcggacattcgacaaacaggcgcttcaaaagatacgttttttgaatgtagcttttcgtttttcacagagaagaaagaaatcgaatgtactacctttgttttatcaattatataaatacatactataaaagaccaatttatgggaaacaatcaaccttcggcaagaaaaaaaacttattatatatctctggctattctagccggtatgttcttcatattcggattcgtatcatgggtcaattccatactgattccatacttccgtatttcttgcgagcttacccattttgaatcctattttgtagcctttgctttctatatagcatactttgtcatggccattccttcgggcattctattgaagaaagtaggatttaaaaaaggaatcatgtatggctttatgctgactgctttgggagcctttatctttgtcccggcagctctggcacggcaatttgaaatattcctcatcggcttgttttctattggcaccggcctggctattttgcagacagccgccaatccttatgtcaccattatcggcccgatagatagtgcagcacgacgtatcagcatcatgggaatctgcaataaagtggcaggaattatctccccgctcatattcgctgcccttattctgaaagcaaacgacagtgaactctttgcattaattgaatccggtgcactggacgaagcaacaaagaacgccatgctcaatgaattgatacaacgtgtcattatcccatacattattctgggcatcatcttactgctgacaggtatcggtatccgctactccgtattaccggaaataaatactgacgagcagaatgccactgatgaacaggacaataaacatactgacaaaaaaagcattctcgactttccatacctcatattaggtgcattggccattttctttcatgtaggtacacaggttatagccattgacactataatcaattacgccaactctatggggatggatttactggaagcaaaagtattcccttcttacacactgggatgcacaatgataggatatatacttggtatcatccttatccctaaatacatttcccagaaaaatgcactgatagggtgtacattactaggtttggctctctcattcggagtggtatgggcagacttcgatatgacattattcggtcatcaagccaatgcttccatcttctttctgaatgctttaggttttcccaacgctctgatctatgcaggaatatggcctctttccattcatgggttaggcaaattcaccaaaaccggttcctctctgctgattatgggattatgcggcaatgccatcttacctttggtatatggtcactttgccgaccagtacagtttgcgtatcggttactgggtacttattccttgctttatctatctggtattctttgccatcaaagggcataaaatcaactcctggagataaaactgaacgtaagacattaaaaattaaaaaaatggaaagactgattattatcaatggggaactaatactccctaccggcatcgaaaccaataaaataatggtttgccggaatggtaagatagaacagattgtatcatccgaagcatatattcctcaagctgacgaccggatcatagatgccaaccaacaatatgtctccccaggatttatcgatatacatgttcacggtggcggaggtcatgactttatggatggaaccgtagaggcctttctgggagtagccgaaactcatgccagatatggaacaacagccatggtacctacaacactgaccagcacaaacgaagagctaatgacgacctttgccgtttatcaaaaagccaaaagtcttaataaaaaaggtgcccaatttatcgggctgcatctggaagggccctacttctcgcctaagcagtgtggagcccaagaccccaatcatttgaaaacgcctcatccggacgaatataacacaatactggaagcttcacaagatattgtacgatggagtattgctccggaactggcaggagcaattgaactgggggaaaagctcaatagctgtcacattctcccatccatcgcacataccgatgccatttatgaagaagtggtaaaagcatacgaagcagggtatactcatatcactcatttatattcagcgatgtcaaccatcacccgtagaaatgcctatcgctatgcaggtgtggtagaggcagcttatctgattgatggtatgacagtagaaatcattgcggacggcattcatctgcccaaacctttactacaattcgtatataagttcaagggggccgataaaacagcactttgcacagatgccatgcgaggtgcgggaatgccggacggtgaatccatattaggcagcctgaccaacggtcagaaagttattattgaagacggagtagccaagcttcccgaccgttcggcatttgccggaagcgtagctaccgccgatcgtttggtaagaaccatgataagtatagccggcatacccctaatcgatgctatccgaatgataacccttacccccgcccgcattctgcatgtggattcccaaaagggttctttggaggaaggtaaagatgccgacatcgtcatcttcgacaatcaaattaacgtaacaacaactatatcaaaaggccatgttatctacaatcaatgaaacatacctgtttcaacaagatctattaacagtcaaaatgttcccttctatccaacagatggggaaatgtgctgcgacagaagttactaacaaaatatgcgaacttctcaaagagaaagctgaaatcaatatgatttttgccgcagctccttcacaaaatgaattcttaagtcatcttattcacagtaaacagattgactggagcagaatcaacgctttccacatggatgaatacatcggcattcatccggaagccccacaaagtttcggaaattttctccgtcagcgcatcttcgacaaagtcccgttcaagactgtaaactatctgaacggacaagcagaaaaccttgaagaagaatgcaaacgttattccgaattgctgcttcgtcatcctgtcgatattgtctgtctgggaattggagaaaacggtcatattgcattcaatgatccggatgtagccaatttcaacgactcccatttagttaaagtagtagaactcgacccgatatgtcgccagcaacaagtgaatgaaaaatgctttgaagcattcgaccttgttcctgctaaagcactgactcttaccattccagccttattaaaagcggactggatgttctgcattgtgccttttaaaaataaagccaatgcagtatacaacactctttatggagaaatttccgaaaaatgtccggccagtatattacgcaaaaaagaaaattcttgtttatatttggatcctgaaagtgcagaacgaataaacttataaatacatatgaaaaatatcttatttatcctccttgctttcttgtctgtcagcttcagactatatgcgcaggatgtaattaaaataggaattatcgggctcgatacttcccattctacagctttcaccgagctactgaacggagactctgacgataagtttgtcaaagagttcgaagtcgtagcagcttacccttatggttcaaagactatccagtccagttacgaacgaattcccggatatatagaagaggtcaagaaacacggtgtggagattacatcttccatagcggaattgcttgacaaggtagattgcgtcatgcttgaaacaaacgacggtagaatccacctcgaacaagcaatggaagtattcaaatccggaaaaatatgctatatcgacaagcctattggagcgacattgggacaagctattgccatttacgaaatggcggagaaatacaatgtgcctatcttttcttcttctgcactcagatattctccacagaatcaaaagctgagaaacggagagttcggcaaaattctgggagctgactgttattctcctcacaaggtagaaccgactcaccccgacttcggtttttatggcattcacggagtagaaacgctttatactcttatgggaaccggttgcgagtcagtcaaccgtatgtcttcccaagatgctgatgtagtggtaggccgttggaaagacgggcggataggtactttcaggggaatcaaagaaggtccggccatttatggcggtacagcttatacccccaaaggttcaatagcagcaggaggatatgaaggttacaaagttttgctcgatcaaatactcacttttttcaagaccggagtagctccgatttcgaaagaagaaacaattgagatattcacttttatgaaagcttccaatatgagcaaagaacagaacggcaaaatcgttaccatggaggaggcataccgaaaagggctgaaagatgcacagaagctaattaaaacctacaaataaaaatagcacatgaggtacacatacagacacatcgggatcctgaccatctcattaatagttgcttcctgctccttttccaaaaagcaggcaaacaacaatcatgacaaaaatatgaatccgaacgtaaaaatagtggtcctcgacccaggacattttcatgccagtctgttgcaaaagaatccgctggcctcagtgaacgacacaattcgggtatatgctcccgaaggagcggaagtcaaacaatatctgaacgacataaatagctataatcaacgggcggagaatcccacatcctggaaagaagaaatatatattgggggcgattatctttccaggatgctttccgaccgtcaaggagatgtagtcgtgcttgccggaaacaaccagaaaaaaacaaactatattctggaagctatcaaagcaggatacaatgtgctttccgacaagcctttggccattaacaagaaggatttcgacttactgattcaagcatatcaattggcaaaggaaaggaaattactcctttacgacttgatgactgaacgatatgacatcctgaatatcatcgaaaaagcattactgaacaatccggatctttttggtgaattgcaaaaagggtctttgaatgatccgtcagtttctatggaaagtgttcattatttctttaagaatgtatcaggcaagccactgattcgtccggtatggtattatgacacagagcaacaaggagaaggtattgcggatgtaaccactcatcttatcgatctggtcaactggcaatgtttccccaacgaaaccatccgttatcagtcggatgtagaagtattgaaagccagacattggcctacccgcattacattacctgaattttcgcaatcgacgcaggctgacaccttccccgccttcttgaacaaatatatcaataataatgtgctggaagttttagcgaatggtagcctaaattacacagtaaaggggattcatataggtatgaaggttatctggaattacactcctccaagtgatggtggcgacacttttacctcccttaagaaaggaagtaaggctacattgaaaacaattcaggacaaagaaagtggttttgtgaaacaactctacatccaaagagctgcagactctgatcactctgaatttgagagccagttgcaaaaggcaatcaaacaactgcaagcgacctatccgttcctatccgtcaaaaaaatgaatgaaggactttatctgattgatattccacaggcggacagactgggacatgaagctcacttcagtaaagtagcagaagcattccttggctatttgcatgataaaaatatgccggaatgggaaaacgagaatacaatatctaaatattatatcaccactacagctgtagagctggcaaagaaagagaaataagaaaggccgcagacacgtgttaagaagtgaaataaaatattatgcagatgaatccatgtttcatggattcattcctcatgttatggggacacgtcttgatatcctgatgattcactccaaccttcccctactaaacatgctttgggcacatattaccgacgagttagaaaggttggataagatgttgaatcgatttgatgccacaagtgaagtatcaaagctaaacagccatacacaacaagattcagtttctgtcagtgcggaattggaagatatcctacggtcatgccaatattattatgaaaagactcttcatcttttcgacatcacattaaacgatttctcacaaatacaaattcacggcaatcaccatatctcttttagcaacttttccgtaacacttgattttggaggtttcgcgaagggatacgccttaaaaaagattcaagaaatcctcttgcggggaaatatagagaatgctttcgtcgattttggcaacagttcgattatgggaataggacaccatccttatggagactgctggaaagtcagtttgcagaatccttacactcaacaaactcttgacgaattctgccttactgacaatacgttgtccacttccgggaatacggaacagtacaccggacatattataaatccgcttacaggaatctacaacgaacaaaaaaaagttacgagtatcttatcagacaatccgctggatgcagaaatactcagtacagtctggatgattgccgacgaccaacaacgggaacagatcaacgagaacttcaaacatataaaaggaactatatatactctataaaatatgagaaacaaaatagaaaaaggagtcgatttgaatctcagacaattcatcaaaagtctgggatatatcgcaggaggaactgcactgctggcaagcacaccctggctgtcttcctgcacacccgaaaaacttaaagaaatccgcaacgagaaagcccggatcgctttgatcggtactggttccaggggacagtatcatatccacaatctaaaagagattccccatgcccggattgttgccgtttgtgacaattatgctcctaacctccaacaagcagtagagttatgtccgggtgccaaagcatacactgactaccggaagcttttggaatcggcagatattgacggcgtaattatctctactccgttgaactggcatgctcccattgtactggatgccctggcagccggcaaacacgtattctgtgaaaaagccatggcacggactttagacgaatgcaaagctatttatgatgcctatcaaacgaccaaccaggttctctacttctgcatgcagcgtatgtatgacgagaagtatatcaaaggaatgcaaatgattcattccggactcatcggagatgtggtaggaatgcgctgccattggttcagaaatgcagactggcgccgtcccgtcccctcaccggaactggaacatcaaatcaactggcgattgtacaaagaaagctcaggcggattaatgaccgaactggcctgccaccaactggaagtatgcaactgggcagctaaaagaatgccggtaagcatcatcggtatgggtgacattgtctactggaaagacggtcgtgaagtatacgatagcgtaaatgtgacttaccgatactccgacggaacgaagattgcctacgaatcgttgatttccaataaattcaacggtatggaagaccagatcctcgggcacaaaggtactatggaaatggcaaaaggtatctattatctggaagaggaccattcaacatcgggcatccggcaacttatcggacaggttaaggataaagtattcgctgctatcccgacagccggacccagttggagaccggaaacaaaaatggaatacacgccacattttgttattgaaggagacattaacgtcaacaacgggctgagcatgatcggagccgacaaagatggttccgatatcattctctcttctttctgccaatcatgtatcactggagaaaaagcacaaaatgtggtagaagaagcctattgctccaccgtactttgcctgcttggcaatcaagcaatggaggaagagcgacatatccttttccccgacgaatataaaataccatatatgaaattttaaattatgaaagatatcatcatcacctcccaaaaaattaaaagggaaagaaacatttatctgatatgctttcttctctcttttgcaatcaatattattgcaatccttgtctatacacgtccgtggattgaaatattcactcaactggggtatgtgctcgttatcagttttttcatctatttcatactatggattccgcgtatactcattatcgggttacgccatctccttcgaaaaaagaagtaacagctttacgttttttgaagattgattgacggaaaagaagtctgatatcagttaataacggcttaactttgaggaaaaataaacactatgacaacaagaagagattttatcaaaaaaacagttgcaggcacggccgccctttccttgggaagcattattcccggcttcggttcaaatagttatcaggaaatcctgggtgcgaacgaaaaaatacgaatcggagtcattggtgtaaactccagaggtaatgccttggcacaaggatttgccaagatgaaaggttgtgaagttacttacctttgtgatgttgattcaagagcacttgaaagatgtcaggcagatattcataaaataagcggacgcactcccaaaggagaaaaagatatccgcaaaatgctggaatcggacgattttgaggcggtagtcattgccacgcctgaccactggcatgccaaagcagccattatggctatgcaagcaggaaagcatgtttatctggagaaaccgaccagccacaatccggcagagaatgaaatgttagtcagggcgacgcttaaatataaccggattgtccaagtcggcaaccagcgccgttcgtggccgaacgttatcaaagcaatagaagagattaagtctggaacaatcgggaaagtaagatatgccaagtcctggtatgtcaacaaccgtccttccatcggcacaggaaaagtggttcctgtacccgactatctggactgggatttatggcaaggccctgcaccacgggtgcccaattttaaagacaattatgtccattataactggcactggttctggaactggggtaccggtgaagcattgaataacggaactcatttcgttgatatcctccgttgggggctgggcgttgattatccgacaaaggtagattctgtcggaggacgttatcgctttcaagacgactggcaaactccggatacacaactcatcactttccagttcggcgacgaagcatcctgctcttgggaagggcgtagttgcaacagcacaccggtagacggatacggagtaggtaccgctttctacggagaaacaggcacccttttcatcagtggaggcaatgagtacaaaataacagacttacaagggaaagtaatcaaagatgtaaaaagtaacttgaagtttgaaactggtaatttgctaaatccatcggaaaagctggatgcttatcatttcgaaaactggtttgacgccatccgcaaaggtggtaagctgaattccggcattgtagatgcctgcatcagtactcagttagtacagttaggcaatatcgcacaacgtgtaggtcattctttaaatattgatccggggagcggacgtattctgaatgatctggaagctaacaagctctggggcagagaatacgaaaaaggttgggaaatacgggtataaccccgcccttctcttcctcgttttttcattaggttatagttttgttggagggtatgtcaaaagtaactaaactcccctccttcgggaaggaagggtgactgaaagccggggtggtaggtgtactgtacaattgaatatcaatagtttatgtattcacctaccacctccccctacggggactcctccttcctgaaggaggagaattttgttactattgactctgacacacgctccttctttgtatcataaagcgaacagagtttatgttatcatatttcaccatataagtgcatccgtggcagagatactgcaacaccccgaccaagctcccatgaaaaacttcaaccttttatttataaaccagacaaacgtttctaataaattcctgcatcgtttattataaacgtccccccagtttattataaactcaaattccccttttcaaagattaatctttaattttatgcaacaaaaaaggctgcaaacccgctaagagttcgcagcccatcaatgataaatgagtctcacagagtctgttttctcagacttccgttctttatattgtcagtatatcataccaaattaaaggcatatacttcctatcagatgcagcaaaaaacaattcttttttcattggttcaggttttaattaaagctggatagccgactacaaatatacaacataaaaagggctttgtcaagtcttcgggaagtttacacaagaaaacaaaggattactgaagctgtcagcatcataaaaaacgtgagttcttttcgtcctcatattgaatttatttcgtatttttgcgtgcacatcctcctttttttgatggatagaagaaaatttgttgttaaagcaaagcgaagattgatatatgagtgacgaaatcaacgagataacggaaggacattcagactacaaaccggcggacgcgcgggacgaaaacgtaaagcatcagttaacaggcatgtaccagaattggtttctggactatgcttcttatgtgattctggaacgtgccgttccccacatcaatgacggtttgaagcctgtacaacgacgtattctacattccatgaaacgtctggacgacgggcggtataacaaagtggcaaatattgtgggacacaccatgcagttccatccgcacggtgatgcttctatcggcgatgcactggtacagttggggcagaaagacctgctgatagactgtcagggtaactggggtaatatactcaccggtgacggtgcggcagctccccgttacatcgaggcacgcctttccaagtttgcactggacatcgtattcaatcccaagacgaccgaatggaagctgtcttacgacggcagaaacaaggaaccggtcaccctccccgtgaagttcccgctattgctggcacagggagtggaaggtatcgccgtcggactttcatccaagatattacctcacaacttcaacgaactttgcgacgcctccatcagctatctgcatggagaatcgttccagctatatcccgacttccagacaggcggttccatcgacgtagccaaatacaatgacggagaacgcggcggagcggtaaaagtacgcgccaagatcaacaagctggacaacaagacactcgccatcacggagattccgtatggcaagaccacctctaccgtcatcgactccatcctgaaagctgttgacaaaggaaaaatcaagatacgcaaagtagacgataatacagccgccaacgtagagatactggtacacctggcacccggaacttcatcggacaaaacgatcgacgcactgtacgcctttaccgactgcgaggtaagcatctcacccaactgctgtgtgattgatgacagcaagcctcacttcctcaccgtcagcaaggtactgaaaaagtcggcagacaacacactgggactgctgaaacaggaactggaaatcaagaaaggggaaatactggaatcactccatttcgcttccctcgaaaaaatatttatcgaagaacgaatctataaggacaaagagttcgagcaatccaaagacatggacgccgcctgcgcacatatcgacgaccgcctgactcctttctacccgagctttatccgtgaagtgaccaaagaggatattctcaaactgatggaaatcaagatggggcgcatcctgaagttcaacaccgacaaagccgatgaactgatcgcccgtatgaaagaagagatcgccgaaatcgacgatcacctcgctcacatcgtggactataccgtaaactggtatcagatgctgaaaagcaaatacggaaagaacttcccgcgccgcaccgaactgcgcaacttcgacaccatcgaagccgccaaagtggtagaggccaacgagaaactctacatcaaccgtgatgaaggatttatcggaacagcactgaagaaggatgaattcgtagccaactgttcggatatcgatgacgtgatcgtcttcttccgggatggtaaatatatcgtcactccggtagccgacaagaagtttgtgggcaaaaacattctttacgtcaatgtattcaagaagaatgacaaacgcaccatctacaatatcacttaccgggacggcaaagaaggaacgacgtatatcaaacgttttgccgtgacaggtgtggtccgcgaccgtgaatacgatgtcacgcaaggaacgccggactcacgcatcacttatttcagcgccaacccgaacggagaagccgaaatcatcaaagtgacattaaagccgaacccgcgtgtaagacgcatcatcttcgaacgtgatttcagtgaaatcagcatcaagggacgtcaggcacagggagtgatcctcacccgactgccggtgcataagattaccctgaaacagaaaggaggctctaccctcggaggacgaaaagtctggttcgaccgcgatatcctgcgcctcaactacgacggacggggtgaatatctgggagaattccaaagcgacgacaccattctggtagtgctcaacaatggcgagttctacaccactaatttcgatttgagcaaccactacgaagataatgtcagcatcgtcgagaagttcgacccgaacaagatatggactgccgcgctttatgacgccgaccaacagaactatccgtatctgaaacgtttctgttttgaaggttccaaccgcaagcagaactatctgggagataacaagaatacccgtctgatcctgctgactgatgagtactatcctcgtctggaagtcatattcggcggacacgacagtttccgtgaagcgatggtaattgacgcggaagaatttattgcagtcaaaggcttcaaggcaaaaggaaagcgtatcactacttatacggtggataccatcaacgaacttgaaccgacccgtttcccggaaccgactaacgaacaaccggaacaaccggaagaagaaccggaaaatctggacccggacagcgataagagcgaaggggacatcatcgatgagattacgggacagatgaagctgttttagctaatgtatacatgcggtaaaaaatacccaatgtgccaatgaagaaaaacttattatacttagggctgacaggatacctcctgttcgccctctgcacaagattacaggcgcagaccgacagtctgcaagcacatcgctacgtaacacgtgccaccatgtacggagtcggatttaccaatgtgttcgacacctatctttcgcctcaggaatataaaggaatagatttccgtatttcccgcgagacgatccggatgacaaagttgttcgacgggaatgtttctgtgcagaacttctttcaggcagacgtcggctatacacacaaccgcgcagacaacaacaatactttctccggactcgtcaactggaactatggcctccattaccagttccgcctcaccgagaacttcaagttactggcaggaggactgtttgacgtcaacggaggatttgtctacaatctccgcaattcgaacaatccggcttctgcccgggcatacgtcaatctggacgcttcgggaatggctatctggcatttgaaaatcaagcgctatccgatggtactccgctatcaagtcaacgtgccgatgatcggacttatgttctcaccgcactacggacagtcttattacgaaatcttctcactgggcaactccagcggagttatccaatttacctctctccacaatcaaccgtctctccgtcagatgctttctgtcgatctgccgataggatataccaagatgcgtttcagttatctggcagacttgcaacaatccaatgttaacggaatcaagacacatacctactctcatgtatttatggtaggatttgtgaaagacctgtatcgggtttccaacaaaaaaggagcgaatctgcctccgtcggtgagggcgtactaggagaagtggagagtggagaatttatggacaagaactgaaagattaagaatgagaaatagaattatacaactacttttactgctctgctgcctcccgatacagacggggtgcatcggagaagatgattacgctgatgatcccgtaggaaacttcgagcaactatggaagatcattgacgaacggtattgctttctggactcgaaaggtattgactgggatgcggttcatgagaaatacagcaaactgattgtaccgggtatgtccaatgacgaccttttcgataaactcagcgagatgctctatatcctgaaagacggtcatgtcaatctttcatctgccaagcgtgtctcttattacgacgcatggtatcaggggtatccgtggaattatcgggaagatattctttaccagtattacctgggcagtgccagcaaggactactatacatcggcggggatgaagtacaaaatattcgacaataatatcggatatatccgctacgaaagtttcagttccggggtcggcgatggcaatctggatgaaatccttgtctatctggcaacctgcaacggactgattatcgatgtacgcgacaacggaggaggtaatctgactaattcttcccgcattgccgcccgatttaccaatagtaaaatcctgaccggattcatacagcataaaacgggaacaggacatagtgacttttcccaaccggaaccgatctacctggaaccttccaacagcatccgctggcagaagaaagtcgttatactgaccaaccgccgttgctacagtgcaaccaatgatttcgtcaatctgatgcgcagcatagacaacggcaacatcatacaggtcggtgaccagactggtggcggttcgggacttcctttcacatcggaactgccgaacggatggagcatccgcttctccgccagtcctcatttcgacaaaaatatgcagccgctggaagaaggtattttgcctgatatagctatcgatatgactgaggatgaccaatctaaacatagggacacactgattgaaaaggcttttgaaatcttaagtgagtaactttgttgcctaattatttgtcaaatcagaaaatcttcctatctttgcaccgctaaacaaaaagcgacgcatgcggatgtggcgtaattggtagccgcgccagacttaggatctggtgccgtgaggcgtgtaggttcgagtcctatcatccgcacacatttatataaactagaaagccttcaagaaatatcttgggggctttttaattgattacatatatgaagaaacatcaactttgctgcatcggccatatcactttggataaggtagtcactcctcaaagcacagtctatatgcctggaggcacagctttctattgttcacacgctatccgccatttcaatgacatagattatgcattagtgacagcagtcggcgctacggaaatgaaagtagtagaccagctgcgcgggataggcatcagcgtaaccgcattacccagccagcactctgtatacttcgagaacatctatggagaaaatccggatgaccgtacacaacgtgtgttggctaaagccgatcctttcaccgcttcccagcttcaggagatagaggcggaaatttatcatcttggttcgctgttagcagatgatttttctttagaagtgattaaggagttatcccggaaaggattgatagctgtcgattcgcaaggatacctgcgtgaagtacgtgatacgcacgtatacccggtagactggactgacaagcgggaagctctgcaatatattcatttccttaaagtaaatgagcacgaaatggaagtgctcacaggactttccgatccgcatgaggccgcacgtaaactgcacgaatggggagtgaaagaagtattagtcactttaggaagtatggggtctctcatttacgacggtacggatttttatcgcattccggcttataaacccggacaagtagtagatgcaaccggctgtggagatacttatactatcggatatttgtatcaacgggtatcgggtgcgagcatcgaagaagcaggtcggtttgctgccgccatgtctacgctgaagatcgagaaatccggtcctttctgtggaaataaggaagatgttattcgatgtatggagactgcggagcagatgtactaaaagagagccatacaggcgttaatatcaataagcagagcgctgttttatcttgaaaaaggatgaaacagcgctctgtttattaactacttttttctcctgttcttaataagttgccctagaaaaacaccactcattgtgaaaatcattgcaatggaagccgagaaccaacgactactttccgtacataaaagaatggtaaagagtcccaataatagaacaaagaataatgccaatttaatattacctttcatgtatcttcgaacgtttaaatttaacaatcaggaaatagacactttgaaagaagacgccaataaatatcattttcagaccatcaacatcaaacatacgttcacacagaactccgacaatctttaaagcacaaagtactgcaatgattaatgtgaaagcatattgtaaggcagcatttcttatctttaaatattcagcacttgtttctttacagcaccaaggaaaaagatacaccaaattaaagccaacaaaaatagataccaaagtatcatattcaaagggtactacgaatatctcatatattccccaaagaataagcagtataataatcatcacatctggcctattttttttcatgaatttcattgttctatttttatttattattcagactgttcgtatacctttcagctaaaccaagctttacctcaaaagtaataaatatctttcaaggttcactctatccagctaatcttttgacctaagatgttcaatagcagaaaactagtcctaactgaaaatcaagacgtctcatatagagtctatccaatttgtttggacgtagtgtttcctttttctcatcggctgtcatttcaatcttcttaaagtctccacttaaaacagaaaagcctccgtttaccgcaaggtggtctgtcaatttatattctaccagaaagtccatattcccggccaatgcaccggaagtacatttaaattcactattacttcgaccttcatcccgataatgtagatatccggctcccaatacgcaactaattaaagttctttcggttattggaattttgaatccaagttgcggtcctaaataccaaagttctacattgtcagctacattcgtttcatcatcaagtgtataattggcagaagtaccggagagattaaaccttaatccggcaacccaaaatttatcaattcgatagagtgtcttcacattacacgtcaagcctccattatattccccacgataattaacaccaaaaggtgacaagtttgacttaccgaacaatacaccttttccaccatctatcgaaataaacagtttatctccggaaaaactctgtgcaaatcctactgtaacagaaaacacaaataggaaaaataaaataagttttctcataatactatatttgaaaagtcgtatgaattgaaa

SEQ ID NO: 54 - DNA, 50560 bp, Bacteroides thetaiotaomicron
ctgaggaagatgatcagcctgttgtgggagcatccgtattagtgaaaggtacaacgatgggaacagtcaccgatatcgatggtaagtttaccataaacgatgtaccaagttctgctagaactttgaaaattagctacattggaatgaaaactcaggagattcctatcaaaacaggaacaataagaattctgatgaaaccagatgcagaagttctggaggaagtagtggtaaccggtatgcaaaaaatggacaagcgccttttcacgggagctgcaacaaaacttgatgcagaaggcgtaaaacttaatggtatggcagatatcagccgtggtcttgaaggccgtgctgcgggtgtgtcagtccagaatgtatccggtacatttggtacagctcccaaaatccgcgttcgcggtgctacctccatttatggtagctccaaaccattatgggtagtggatggagttattatggaagacgctgtagaagtcagcgctgatcaactatcttcaggcgatgctgaaactctaattagttcggctattgctggtctgaacgcagatgatattgaaagctttcagattttgaaagacggctcagcaacctcaatctatggcgcacgtgcaatggcaggtgtaatcgttgttactacaaagaaaggtaaagctggagtcagtagaataagctataccggtgaatttactacccgtttagtaccaagctacaatgactttaacatcatgaactcgcaagatcagatgggagtatacaaagaaatgcaacagaaaggctggttaaatttcgctgaaacctcccgaactgcagaaagtggtgtatacggaaagatgtatcagttaattaacacatacgatcctactaccggacaatatgcgttattaaatactgacgaagctaaaaatgcctatctacgtgaagctgaaatgagaaataccgattggtttgacacacttttctctcccagtctaagtcagaatcattctgtaagtcttagctctggtacagaaaagtcatcgttctatgcttctttaagtgctatgcacgatccgggatggtacaagcaaagtggagttgatcgctatacagccaacttaaatatgaatcataatatcttaaagaacctaagcataaacttgatatcaagtgcttcttatcgtaagcaaaaagcaccgggaactttaggacaagacattgacctagtaaacggtcaggtaaaacgtgaatttgacatcaacccctattcatatgcattgaatacttcacgtacattagacccaaacacttattacaccagcaactatgctgatttcaacattctgaacgaactggacaacaattacatggaactgaacattgcagatttaaagttccaaggcgagttgaaatggaaaccaattaccggattagagctaagcgctttgggagccgtgaagtatcaatcagcttcacaggagcacaacattaaagaccagtcaaaccaggcatcggcttatcgtgcaggtctagatgacaagacaattatggaccgcaatccatttctttataagaacccagataatccatatgcactaccgatctctatcttaccggaaggtggtatttatcaacgtagagactataagatgctaggttacgacttccgagctacagctagttggaaccacgtatttaatgatatacatatcactaacttctttgcaggaacagaaatcaactctacagaccgatcaaagaattactatcaagggtggggtatgcaatactcaatgggcgaaataccctactatgtatatgaattcttcaaaaaaggtatcgaagacggcaataattactactcattgagtcagacccgtagccgtagtgccgccttcttcgccaatgctacctactcttataaaggtcgttatactgtgaatggaacagcccgctacgaaggtaccaaccgtatgggtaagagccgctcggcacgttggttacctacatggaacgtatcaggagcatggaatgcccatgaagaaaaattcttcagcaatttaacttctgttctttcacactttacactgaaagcatcttattcgttaacagccgaccgcggtccggcagacgtaacgaactcacaggctattataaccagctatagtccttatcgaccatttacttctatccaggagtccggattgtatattaaggaactagaaaatagcgaattaacttatgaaaagaagcacgagttgaatattggtgccgacatgggcttcttgaataaccgcattaatttagctgtagactggtacaaacgtaacaactacgacttgattggtatcgttaatacacaaggcgcaggtggacagatcctgaagtatgcaaatatcgcttcaatgaaatcacatggtattgaattcactttatcaactaagaatattaaaacaaaagatttcaactggaacaccgactttatattctctaatgcaaaaaatgaagtcactgatttgaaacaaaatgcgaatgtgatggagcttatttccggtaatggattcgctaaacaaggctatccggttcgtgggctattctctatcccatttgtaggtctcgacaaagatggtattccagtcattataaatgaaaagggcgaagcgactagtaccaatataaatttccaggaacgccaaaatactggtttcctgaagtatgaaggtccgactgatcctaccattacaggtagtttgggtaatatgttctcatacaaaggtttccgtttgaatttatttatcacttattcatttggaaatgttatccgtttaaatcccgtattcaaagcatattattcggatctaacggcaatgactcgtgaatttaaaaatcgatggacactccccggagacgaagcaaagactaatgttcctgctattttgagcaaacgtatgtacgacagcaatgaagacttgaagtatgcctacaatgcttacaattattcaacagaacgcattgcaaagggggattttatccgtctgaaagaaatctcactggcttatgacttccccaaagcatggatcaacccattgaagttaacagacctctcgctgaaagtccaagccaccaaccttttcttaatctatgcggatgataagctaaatggtcaggacccggaattctttaatgcaggtggtgttgcctcaccggttccccgccaatttactattactttaagactggggttataatttaaaataagaacgaatatgaagaaatacataataatggccagtgtggccgcgctcgcaatagggctctcatcgtgttctaatttcttagatgagcttcccgacaatcgtaccgagctgaatgaaaacaatgttggcaaaatattactttccgcctatcctactacagcaatctgtgagatgggggaaatgtcatcagacaatactgatgcttatccgaatcgcttttcttctttcaaccgtttgcaagaagatctctataagtgggcagactctgcagaacaagatcaggactctccccatgcactttgggaatcttgctatatggcaatctctgcctgcaacgaggttttgaaagtgattgaagacgcaggaaatccagcttctcttagcgctgaaaagggagaagccctagtatgtcgcgcctatgctcattttttacttgccaatatattttgtaacgcttatagcagccaagcaagttcagacttgggtatcccctacatgaaaacgatagagacaaccgtaagccctgattatcaacgcggaactctagaggaggtataccaaaatattgagaaagatctattggaaggtctagatctggttactgatatttatgcagtccccaaatatcactttacaaagaaagcagctcaagcttttgctgcacgcttttacttgtactatgtaaaatcggataaatccaattacactaaggtgatcgattacgcaacaaaagtattaggaagcaatccagccacctctgtacgcgactggaaatctttgggtgcactagacataaatggcagtgttcagccaaatgcttatgtagatgcaacgaatggcgctaacttattattggtcagtgcaggttcttattggggatatgttcatgcaccttatggactaggcgaaagatacgcccatggaccgaaagtaggcaatgagacatgcaattccgtcggtccttggggaagtgactattatatgggtgtttggagtaactcaagtgcactgccgaccaaaatcgttgttatgaaaataactcaatataaagaagtggttgacgcagtagccggaacaatcaacggacacatgatcaatgcagcatttactacagatgaaacattactctgtcgtgcagaagcttatgcgatgaaagaaatgtatccacaggcaattgctgatttaaatatatggcgagaagcatacacacgttctactaccccgcttaccacagaatctataaacgatttctacggaagcatggaatattacactcctactgaatctacagttaagaaaaaattgaaccccgactttactataacaaatgaaacacaggaaaatgtaatccactgcatacttcatgcacgacgtttaacaactttacatgaagggttacgctggcaggatattaaacgctacggtattactatctatcgtcgtttaatgaatgataatggtactattaccgtcacagataagctggaacccaatgatcctcgtcgagcaatacagataccgagcgatgttatttcagccggattaaaaccaaaccctagaactaaataaaaatcgataagttatgaaaaaatatataatatatacattgatcgttactatagccgtttttttaggctcatgtaataaagatgatattgataccaaacgcagtatatttgatcctactgaagtttatgagcccaacgagtttgacaaatggctacttgacaactatgtttacacttataatatccaggtgaaatatcgtctggatgacaatgaaacggatgtagaatatcatctggttccagccaagtatgacaacgcaattacattggctaagattgtaaaatttgtatggatggaagcttatgacgaaatatggggaattgacatgacccgtacgtatgtccctaaactactccaattcattggaaatgttgcttataccgagtcaggtatgatcctcggacaagccgaaggaggaatgaaagtaaccctgtttcgtgtaaatgaaatagataaaaacaatctcagtgtagctcaattaaatgagtactatttcaagacaatgcatcatgaatttacacatattcttaatcagaaaaaagcctatgatacatcatacgatcgtatatcggaatccgactacgtaggttcaagctggtatagggtatctgagtcggttgctctgcaaaaaggatttatctctccttatgcaatggaccgtgctacggaagattttgcggagatggttgctatttatgtcaccaatgacgctagtacttgggaagatatgctagcaagtgccggcacaacaggaagaccgatcatagaaaagaaatttgagattgtatttgattacatgctcaattcctggggacttgatttagacaaattgcgcgaaattgttttgcgccggcaaagtgaaattaccgaattagatttaagtacgctttaataattgtaggatatgagaaagattaaaatatatggcttactgacttgcgtttgcctgatgatgcaatcgtgtctgtttaatgaagatgatatctttgatgaatcttctgcacaacgggctatagcctccgtcaacgaatgtcaggagattttaaagggcgcagccaatgggtggttactcgagtattatacaggagaagacggagaatatggtggcttcaatgttttggcacgatttgatggcaataatgtaattatggctgcagatttcgctacagataattacgaaattggagaagaatctacttccttgtataaagttgaatcataccagggaacagaattaagttttgattcatacaatgaattaattcacgaattctgtgaaccgagtggttataattcaccaggatatgccggagattatgagttcgtcttcagaagcgtttcaaaagaaaagatcgtactgactgggaaaaaacatggagtaacgttgatcatgacacctctgcctgctgaaacaaattggcaagagaaactgaccaatattgccaatgtcgtttcacaggcttcatatgtaacctataagttaattgtgaatggtcaggaaataactaaaatgggacaggaagagcatgccttctcagttaccaaagtagacgaaaccggtgaaacaaccgtaagtctatatccgttcatatatacagaggaaggcattaaaatgtatgaaccattagtagttaatggagtagaaataaacaacttcaaatgggataatgaaaaccttacatatatttgtacagatacaggtgtagatgcaaaaatagaattctattgtccggaaggatatctcaactatttaggcaactatatactacaattagcaaatgggcaacgtatacaacttgagctcaaacaaaaaatgataggaaaatcatttgcaatgaattttgctttgagtggtactcctattgaatttgtctataactataatatgacaacagactgtattgatgtaccttctcagacagttggcgtatatcaaggttacaacgtattattatatccaggaattcccggaggcaatttctatgcagatgactcagctgtattccaaggacgtattgcaaatacagatccgcttacaattaagttcacttatgtaaacaatcctatttgcacccttatgttgctggtatatcaaaaaacagacggttggtatggattctctacaatgttccaagatgtaacattgataaaagttgattaattaacaaatagcatattatgaagaaaataacaagcatatttgcattattattatgcgtattcgtcttctcatgtagtaacgacgacgataaagaaacatcttctttgcagattgttagctcaaatgtcacatttgaatctgctggaggaaccggtacaataaaagttaacgcaataagtgaaattactgctacctccaataaagattggtgtaccgtaagcgtgaatggagatattataaatgtttctgtcattgaaaataatgatatgtccggacgtacggcagctgtaaccataacagatggtgaagcatccactttggttcctgtttcacagggtggctgtgttattctgtataataaatcagaattggggcatgcttttacttatgcaggtggttctgctacagtatctttctcaaccacagcatcttattcaatagaagtacccgccgaagcccaaagttggttatcatacacacttgacgaagaaaacagaactataacatttaatgttgctgcgagtgctgataaaaccccacgaggagcggcagttaaagttaccgcaggtaaaaaaacgatttactatcatcttggagagtatgaattgaaagacatcgcaggcaaatggagagtatcctttgttgatggagatgatagtactctagctggagaaatagaagtagttcaggatgaagaggaacctaccatcttctacttgtcaggtatttccaatttctttgacctaccgttaatctataatggagaggccttactcacaatgggaggtcttaatttaggaacatatgctgggagatataacatctatacagtaacattgtctgaaggtggatatgtcagttgggatatgtcaacacaatatgttgcttatccgtcatccatcaatggcaaatttgcattggtatttggtgataatggttcctgggatggagacgtagtcaatggcattgcctactgggcattctccggtgctgcgggaacaggaagtgcaggatggttggagaaattcaacgctcttacactaagcaaataagacggcaagcgtgcttagctaagtctgtctctctaacatgtataagatttagctttacattaattattcatataaagggtgttcaacattggacaccctttacattatccttttccatataaaaagcaatacaaaagatgatgttattattaaattaattcgtatctttcggacacacaaaaaagttaaaccaacaatcacacatatgaaaatgattcttttccgactaatatgtttaaagacatgcctactattaatccctgtactttacgcacaaaacaactatcgtccgggatttatcatcactgttcagaaagacacaatatatggagaaatcgactaccgtacagataagatgaatgctaaacgctgcgtctttcaatcacaaggtaatgataccgaaccagtaacctatcatcctttcgaaatcttgggataccgttttacagacgacggtaaatactatgtctccaagaacatagaattgaaatacggtgtctctacccccgtctttctcgaatatttgctacaaggaatgaaaagcttgtactactatgagacagaagataacataccaatctattttgttgaagataataatacccttgtaaaaatagatgcgcccaaactgtccaagcaggctaccaatatacagtttaaaggccagactgaccgatatattccccttcttcattacgcattcaaagactgcccaagcctggctccccaaatagaccgggctcgtttcagccgaaaggagatgataaaaatcacaaaagaatatcattatgcaatgtgtaccagtaatgaagattgcattgaatttgaagcaaaagaagataaacgttcaatacagttagatataactccttatgtaggagttattcaatataatgtaccatcgggtagtccgatcgggctctatagctcacccgaactatcttacctggcaggagtcactttagctatcagcaatagacggtggatgagttcgctcagtggttgttttgatgtgtctttttcccgcataacatcctctgcaagatcattgaataatgaaaattcatccactatatttaaacatagcggaacaatgttttcgggtaagttaggaatacgctatacctatccgaaaggaatggcgcgaccatttgttgagcttggagcagacttcagtggaatgatcaatgccaagataaagataaatgataagagcgagagatggctggatggtgtctaccctggctattacgccaatgcgggagtaaacttcaaactttcgcggaaaaacaaacaaatgatatgcatacgcgctcaattcaaaggcttaagagacatgatggaaaaatcagccctcgttaatggatggtcaggagtgataggatatacattttaagtactgcattattcgtttatatagtactcacactaggaaatctcttataaaaccgtttttcttgttatacccatattctacccgacaataaaactccccttatttcagcctttcgaatgaaataaggagagccttatataactgggttatcagctattaatacttgacttctcaggtattaataactgacgcgacaagtattaatacctgagaagtcagatattaagacctgtcgtgacatattagaatgcttgtaccagagtttattaactaccgtcttagtaagtcaccgtcaacggtgtacgcaccttctgcgcatactcagccatatacgcattccacgcatcaaccgtcttgatagcagccttatcccaggcagaaccccagtaataagtatattccgagcccggttcatactcgctgattgccaatacatgaccgtcagctccaccgcgcagctccttcttctccttttccgggaaaagaacggtctttgcctcttttaccagtgaaggaaatgcagcgccgataaatatcttaccgttaccgccgcttctgtcggttgtagggtctacataggtgatatagccgtttgcagcgtctgctgtaaccacaccgtccggttcacgaagaacgattccggtagtcacaggcatcgcttctttcaggttagtatacgaaacaacggttttgttgagatacgaaccggcatccaatgtgatgacacgcgtctccaccacgttagaatcgccacggacagtcaacgggttaaattccagcttcactgtgaaacgcagcgggccattatcaaggatttcctgtgtccgatagcaataaggatagataatcgtatcacccgccatcagagcggctgtaccgcagcccagcgtaggacctacggcataacaatccattccgtagccgtggtcaatgtgataagagatggcattttgcagttcggcagccgctttagggtctgtctttttcagttcggcaattctggcacgcttttccttatccagttcttcagcgtaaagactttcaagaatcggttccgtagtgttatacttcgtaaagaggtcgtagccgaaaccacgttcaccacgcttctgcaaggcagggccataggcacggtatccgcccaggtcattctcccatgccacgtcgtccagacgttcgggataatagcggccgcaggcaattacattatacgggtcgggagtaccggattggatagtataagtggctgtgccatttgctttcaccgtagccgggaaaaccactttctcgtcatacgtcacttgataaggtacttgctggccatcttcaccaagcactacgatctgagccgtatcagccagctgcagcttggctgtaacgtcactcatcggaacttcaaccatttcacctgtgcgctccaacgccagaggattggtcactgtaaccgtcattgactgcttgctgtcagcacaagaggcaaaacccatcagggcaatagcagccaaaataaatatcttcttcatattatacacaacaaataaggggatagaatcaggtaaaaaaacgaaaggggataaatgtaaaccgtaaactattcaacagaaaaacgataaggtgacaggcggtaaagaatctccttaccaccctatcaccttataataatctcttgttatcgttatttcggctgttttccgatataagccaggataccaccgtctacgtaaagaacatgaccgtttacagcgttagaagcctcagaagccaggaatacggcaggacctgtcagttcttccggatccaaccaacggccggcaggagtcttggcgcagatgaatgaatcgaacgggtgacggcttccgtctgcttgtttctcacgaagaggagcagtttgcggagtagcgatataacccgggccgatgccgttacactgaatgttgtattcaccatattcagagcagatattgcgggtcagcatcttcagaccacctttggcagcagcgtaagccgatacagtttcacgacccagctcagacatcatagagcagatgttgatgattttaccggcacgcttcttcatcatggcaggcaacacagccttagaaacgatgaacggagcgttcaagtcgatatcaatcacacgacggaagtcagcagcttccatttcgtgcataggaacacggcggataataccggcgttattaacaaggatatcaatcgtacctacttctttctcgatagtagcaaccattgcctgaacagccggttcgtctgttacgtcgcatacataaccgtgagctttaattcccttttcagcataggcagccatgcctttgtctaccaactcctggttgatgtcgttaaaacatacagtagcgccttgttctgcgtaagcagaagcaattgcaaaaccgataccgtaagaagcacctgtaacgagagctactttacctttcaaagaaaaattcaaatactgattcataattttttgttattaaatgatgaaaactattgtagttgtttattttaaatctgtaattaatgagaagtcctgatcgccataatcgaggttttcaccgcccataccccagataaaggtatagttgtgggtagccgcagccgagtggatcgaccattcgggagacagaacagcctgatcgcccttcatccatacgtgacgagtttcgtccacctcacccataaagtggcagatagcgtgctcttcggggatttcgaagtagaagtaagcttccatacgacggctgtgcacgtgggcaggcatcgtgttccatacgcttcccggagcaagttccgtcatacccatctgcagctgacaggtaggcaatacctgattgaccagcatcttattgatgttacggtggttggaaccttccaacgagcccatttcagccactacggcatccgctttcgtcactttacggtcgggatagttgcggtgtgcggtcagtgagttgaaatagaatttggcaggattggaagcgtccttgctttcgaacgtcaccacacggtcgcccgaaccaaggtagagggcttctttatagtcaagttcgaaaaccgcatctccggccttcactacgcccggtccgcctacattgtaaatacccatttcacgacgggtcaggaagaacggagccttcagcgggtcgatcgcttcgagtgtcagcacctctcctaccggaagcgcgccgcctacaaccatacggtcgtacatggagtacaccatattcacttcgttgggaacaaatattttttcgattaagaaatcgcgacggattcttgcagtatcataactttttgcatcctcgggatgcgcagcatagcgaatttcatagttcgttttcataccttatttatttatagttattgaataagctctctttctcaaatgcacatcgtttacgtacacgatgcaaaaatagtaaaagaaaacgggttaaccttgcaattttgttccaattatccaccaaaaatgtccagaattgatgcaatgtacatctttttaacgaactataatacgttttgaaggagtttgacgactattttcaatgatacaaaacgatataaaaaaaggaagctccaataatcaatgattatcagagcttccttttggttgtcctaccaagattcgaacttagacaaacagaaccaaaaactgttgtgctaccattacaccataggacaaacatatgcgctttctgttaaaaagcggtgcaaagatagaggtttgcaagcaaacctccaaatatttcgattacttttttactttgccaccttgcaaatcgctgaattttacttcgcgatcagcagaaaatagttctttttaccacgctgaacaagcagatatttcccgtcaagcagatcggcagtcgtaataacctggtcaaaagcttccagtttttctttattcaatgatacgccaccgccttgaaccaacttacgcatttcgcctttcgaagcaaatacagccgcattatcgacaaacagatcaacagccttcactccttccgccaaggcgtcacgagagatttcaaactggggtacgccttcgaatacagccagcaacgtatcttcgtccaacttgcgcaacgactcggaagtagcgttaccgaacaggatattagacgcatctaccgctgcattgtaatcttcttcggagtgaaccatgatagtcacttccttggccagacgtttctgcaaagcacgcaagtgcggagcctgctggtgctcggccactaatgcttcgatttcttccttctcgatcgaagtgaaaatcttgatatagcgttctgcatcagagtcgcttacgttcagccagaactggtagaacttatagggagaagtataacgagggtccaaccagatatttccagattcagttttaccaaacttaccaccgtcagcttttgtgatcagcgggcaagtcagcgcgaacacctctcccccattggtacggcggatcagttctgctccggtagtgatatttccccactggtcggaaccgcccatctgaagtttacatcctttagtttcatacagatgaaggaaatcgtagccttgaagcagctgataagtaaattcggtgaatgacagtccgtcacgtgcttctccgttgaggcgacgctttacagaatcctttgccatcatatagtttacagtgatatgcttacctacttcgcgaacaaagtcaaggaaagaaaactctttcatccagtcataattgttcactaattcagcacggttaggcacatccgactcgaagtcgaggaacttggcaagctgttttttgatacacgcctgattgtgacgcaatgtttcctcgttcagcaggttacgttctgccgattttccggaagggtctccaatcatacctgtagcgccaccgatgagtgccagcggcttatggccgcagcgttgtaaatgacgaaggatcatcactccacaaaggtgaccaatgtgtagcgaatcggcagtcgggtcgatacccaaataggcagtcacctgctctttgtttaacaactcttccgttcccggcatgatgtcctgcagcatgccacgccatctcaattcttctacaaaattcatcgtattactctttttattaggtttttattgtctttcaattccatgtgcgacaaaagtacgactctttctcggaagatacaactcttaacgcctaaaaaagactttttgaatattttcccgaatcgcctgccgcagctcttccgcatccgtgcttcgtgctttcgccacctgcttcagcacttcttcaatgtcgaccggactgtcatccgtctccagaaacaggcgaccgacaggcactcccttcaccgtttcctccgaataatgcgcaccgaaagaaagataaatgccgttctttatcagttgccctgcctgctgcggtttcccgcgaaagccgtgccaaatccagggttgagccggattcagtttcttcctcaccgccagcaactcatccatcgccttcacacaatgaataatcagtggcaaccgatatttctccgacaattccacctgcttctcaaacatccttacctgaagctccatcggagcagctgtcagtttatcgaaacccgcctctcctaccgccacaaactgctctttcacaagcaactgctgcagaagttcaaattgctcttccgcattgcgttccgtcagtttccagggatgaatgccggccgaatagaaatatccctctttacctgccgtcctgacatccgaagccgacaggcacagcgaatcatccaccggtaatggaaaattgataatcgccctgccgtgggaagcatcctccgacttgtgagtatgaatatccagaatatgactcgcgttattctccatatctctcgttctttagggtaaatcgtttttaaggcacaggatcataaccggaaccaccccacggatgacacctgagaatgcgccggacagccagatagagtcctttgacgggaccgtgtttcttgattgcttcgaccgcataggccgaacaagtgggcgtaaaccgacaagacggaggggtaaggggcgaaatacacacccggtaaaaatagataggaatcagcagtaagaatgaaaacaccttcctcacaagacttttcagggacatccagcagacggacacccggtgagcacggggtttcataaggataacttttcagaaatgcgcgaaagcgctgtcttcattttctcttccagttcggcagtggctacaagttcgtccgacagatagataaaagcaattgccagacgctgccctttgttttgcaaaccgtccagcagtggctgtttgttcttccggtagacttcgcgtatctgccgcttcacccgattgcgctttacagcacgtttgaaacgccgcttcgatacgctgataagtatcgttgccggcacttcaccttgttctacgggcatatatacaacgcgtatcggaaagatggaaaacgacttggaatggccgccttcgaacatctttccgatcaatattttactattcagcctttcggctttacgcaaagtatatacgctcacgctgtttatttattgttttccttgatgaacatatcaagcgcagccgtcattgacggagcctgcacagtcggtgcttcaaggtccaaacggagtccggcgtcgcgtacagcctgcgcggtagtcgacccgaaggtaccgattctgatctctttctggtcaaagtccgggaagttcttcttcaaagaagtcactccggcagggctgaagaacacgagcatgtcataatcaaattcctcatccgatgtaaagtcattgctcacagtgcgatacattacagcttctgtatgctgtatgttattcttgtcgagcaggtttttcacatcatcattgtgcacgtccgacatagggacgagatatttctccgttttatgctttacgatagatggcaccaaatcttcaatctttccggtagcaccgaagaagattttacgtttgcgatattgcacatacttctgaatgtacaatgcaaccgcttctgtgacacagaaatacttcattgtttccggaatagtcacacgcagctccgtacacagattaaagaagtgatcgattgcgtggcgtgaagtgaatataacagcagtgtgatcaagaattgaaaccttctgttgccggaattctttcgccgaaagactctcgacctttataaacggccggaaatctatttttacgccatatttctctgctatgtcgtaatagggagatttctctgacgcaggcttaggctgcgaaactagtacttttttaattttcaacgtcctaaatttttattagcaatacattgtttacctggatcattccctgatagagtagcagacagggtatgatttcaagagcgcaaaagtacaaaattaataggaaagccgcacttaattgatgaaaaaaaagctttacccacttataaaacatcaatattttagtaaaaattagaataattagtccgattatcactaaattggtcaggttcagatcgaaataaacaaggaatagaacaaaaggaaaaagggcgaatccgacgtaatatatgagcgtagaataagattccaaccatatatttgtcttgtttttgtcaaaaaacacccatccgaggaacatataaagtaaccatttcagtaaaaaataggcaagacagaagccgacataaatccccaatagcaggagaggggagaccttggtcatcagcatcggacatgtatcatgaaaataattgaagaacacgatacctgtcaatacacaggtctgcactaccagtacgagtagatagcgcacatcggctgccgtagaactatcaaaaatgcttgtccgctcgcgatgcaatacaaagtctttcacctgttgggtgagaaacttctttccacgagccagagcgatggaggaaagaaagaagcaggcaagcaatgtcaaggcaatcacatcatccgtacggggagagtaggagatagggattccctcgaatccggagttcagaatatcggctatcatatggctgcaaatttacggatagaagcgtcccatacgggagttgtctgaagtaactccaccgcttcttccggtgtttgtgccactttccatatatcaccgtgttgctggcgcatgaagttttcctctattgcccgttcgagcatttggaacagcggatcaaaaaagccgtttatattcagaatgataatcggattcagatacagtccgagctgtttccatgtgatgatttcaagcaattcttccagagtgccgcatccgcccggcaaggcaatgatgccgtcgctcagattcgccatcttctgcttgcgttcgtgcatggaagtgacttcgatcaattccgtcaaccctgtgtgatgccagttctgttcgaccatgaagtgggggataacacctgtcacctcaccgccattcttcagaactgcgtcggctacggagcgcatcagtccgatgcttccggcaccgtttatcagacggatatgttgtttggcaagcaggcggccgagtttttcggctgcttcaaaatatacgggggctatcttagtgctggatgcgctgtatacgcatacggaatgtatctgattcattgtcttttgcaagtttactggatgaatgggtacaaaagtacaaagaaatcatatacatatcaaaatgaatgtgcaatttatgtcaaagtgaagatagaagaataaacacaaaggcaagactgcatattctatttctataaatagcacagtcaagcctatattctcctacttcaacactcattatttaaatattggcataaaaacagaaaattgaatatttcgtgaagttacttttccaacaccactagtattcatcagattgcaagtaccttgtttataagatagttgtagttcaagccatttcagcgtataactaactcttgccacaataggtatatcgatcgcattttttttgctattataagtagatgcacccaatcgatttacataccaagccacatctgctccgactccaagtctaaaattagaaaaacattcataactgaacacagtccctattgatagatattttccgtttacactatacttaggactatccgaattgaaggcttgataatcagtcccctgcgagccaaaaagagcaatgccatccattgcaaatttacgattaccccaatactgccgataagcatatccaatatgataatgaagtttatatccctcaaaattactggaaaccacactcactttttcatgcaatgttcctaaagagcctcctaaaacaggaccatgttcctgtgcagataatgatgctgtaacaaatagcaaagctataaatattaaattagtaattgttttcattagaagttcagtttttattatttaatatacaaatgatgaggacaaaagagtttatggttgttgctactttcgtcctcatttacacttttataatctcacagtggcaaatcctctttggtcatacggcacaccccgagaccagatttctattgtacccgtacactcttgtgctaacttacgtccaaaaactttggttacatttccacccatttctttggtatcaatagcaaaaggaataccatctttatttacatacactggaccataccccagtagttctccttgagcaaactcaaaaccacgaaggtttactttagcatggtatgtcgtagagtaacggctccatccaaagactcctttcttttgcgaagtaaaattagcatgtattattcctgatgaaacagataaatataatcctacttttctatctttttgacgactatatgcttcgtttatagaacttaaatctgaaacagacgaacgagtagaaaccgtaaattgttgttgacgctctttaaagtcagtatataccttatccacaaccaaagaatcgccaatcataaattcacctttcatattaacaaagtattcattggctacataaacaagccttgaataaggtgacagatcagtagcatcgatagtattaaacataaatacatcaccatatttatgtttatatttctcatatagaacatcaaactccgctttatcagcagcttgattacagattttatccaactcaccatccgcttcttgcatcagaatcatctgagacttaaaagataatgaattaagaaaactaacttgttctgaagtagacattgcactcactttcaaaagagcattctcgtacgattccacatctttaaatttaatcatagtaccgtcgtttattacttctatttcagaattagcattcgtcggtttaaccatattcacttcctgttcatcattggtacaagaaataaatgcacctaaacatactgttagtgtcagtgttgaaaatagttttttcattgttttttcttttttagttaatatcaattcgtagttgcaactatctttatgctattttttatgactcaattatttaatagctttttctatccttcaataatcctgtactcaaaatacccttaccaaaactttgaccagattatctgctacaaaagtagagataatggaggtatcgacctagatattcaattcagtaataattcagaaataaaaaatgccatttgatctaaaaactgaattatttctgaactcatccatactaaacaatcagacaattagcctttaatttgcaaaaaaaataaaagaacgatcatgatgaaaaaactactatttattgcaattattgcagtattaggatgcacagcactccaagctaaaaatcgcatcagaataaaaagagagtcttgggaagtaaaagcaagtactagagtgccaatatctaccccccttaatctttactacgaagggagtacactctttattcatgctaatatagatttagaaaacattataattgaagtaaaggattccttcaacaaaactatctacctagaccttacaagtattcaagctaacaatgaacatgtatttactctggaaaatatatcttccggagaatatattatcgaaataaaatccggcgaaaactatattatcggttgttttatattataagtcttgatatatgtgtatatttgcggcgagaagttacgaaaagagtgtaatttattgaaaatgagcgtaggttaattgctcttgatagtaataggttacgatttagttagttatctactgcattatccttctgcgcgtcgcgtaaccttcaaagaactctttgtatgcaaaagtagctattttatccgagattttgatataaactcccggattttttatcacctcattcattagtttttccgtaaaagcggtattgttcgtcggaacaccattgcccaaaacgagtttagaacaaacgtgtgccgactaccgcatagccagagaaaagggcattgcctcacgcctaaacgatgtttagactgatgaagcaatgcccctttcttttgcgtctatgccaagaggtgcttttacgggctaccagatgatttttcttttttagctgttttttgtgccggaagcggaaagtgaatgcagagagtgtcagcctgccccataaatgaaacaagcggccacacacagcgggcaatccgggaagaatgattgttgccacccggctggacaagtcccgtcggatcggaaaacaatcatactccctttgttgtggtttgcccttttcacgcttccggtgatgtctttttccttttggtgattccttttttacggattttcccctgaagttttttctacccaatctgcctctggtttcgtttacctccattttgcgcctttcagtgagccgcatcagtcagtcattttcgttcagggcgcaaaggtaattccgggattggacgggaaagcaaggtcaagcctcctgttttctgcggaaatctccagcccttcgggtagtatttccccgaaaaaccttgcattccctaatccctaccttttcaagcacccgaaacgaaaacgaccgatgcgacagaaagacgcataaaaaaaatgtcggataaacgagaggcagataagatagtttgaaactcaactccctcagctcttgaatccgcataaaaaacaaaaaaatcaaaaacagcgaagatatgacggcaacggcaaatttcagacaagtggcgcaatacatcgggttggcgatatgcggcttgatgatgcgcaccgccttcggggtgttcggcatcctttgggacatcatcagagagattataaacggagtgttccgagtggcgataggtgtaatcgtggctatcctttccaccattgcctacttcggcttcatcctttggttattcaccctttaacccttaccgacatggcaaagagaaacagcaagacggtagcgcagcagtgcagatattacgaggtggacaacatcttcgtgtatatggtggaaacgtacatcaacggtaattttgaaactttccgaagattgtaccacgaactgaacaaggacacacggagggacttcatggacttccttctcagcgaggtagagccgacctattggagagagagacttaaacagacaatctaaaaacgacagcgatatgaaaggaacagaccatttcaaaagaacgatacaaatgtatctggaacagcgggcggaggaagatacgctctttgcgaagaagtaccgcaaccctgccaaaaacatagacgagtgcgtgacccacattctgaactatgtgcagaaaagcggttgcagcggcttcacggacggagagatattcgggcaagccatccactactatgaggaaaacgagatagaggtgggcaaacctatgaactgccaagtggtggtgaaccatgttgtggaactcacggaagaggaaaaggcggaggcacgtcagaacgcagctcgcagataccaagaggaggaactccgcaagttgcaaaaccgcaacagaccgccagcgagaaaagtaacccaatcccaaccctcattatttgatttaggcttatgaaaccgaagaccaagatacagaaaaaggtggcaagactttcagccaaccttcgccccatatcagcgacacaaatagattgggcataccgccactgtattgaacatatcggctaccgcaccaagaaagggaacattacctgctccgactgcggtcacgagtggtacagcaacagcgtactgtgcgacacccttgaaggctgtacctgccccaaatgctatgccaaactcaaagtgcaggacacacgcaaacgtatctacaaggaaacgcagtatttcagcgtgataaccacctgcaaaggctatcaggtaatccgtgtggcgcaggtcagatgcgagagcaggaaaggcgagccgatgcacttctattgccacgaggttgtgcagcgttggatttcacccgacggtaaggttacggacatggcgttgctccgtggcttcacattctattactgcgatgtatgggcattgtgcagcgcgatggagataagaccgcacaacagcctatacgatgatgttgtggcaagaagctgtgcatatcctaagatgagggtattaccccaactcagacgcaacggcttcaagggcgatttccacggcatttcccccgtgcgtcttttcaaagccttgctttcagacccaagaattgaaacccttatgaaaggcgatgagattgaggtcatgaaacactttcttttcaatgcccgtactgccgatgaatgctgggcatcatatctgattgccaagcgtcacaagtatcggatagacaacttctccatgtggtgcgactatctgcgtatgctcaacaaactcggtcaagacctccgcaacccgaagaacatctgccccgaagatttcatggcggcacacgacaacgcaactcgaaagattgaagccatacacgagaaggaacgggccgaacaacgccgccgctgggagattgaaaggcgtgagcgtgaacaacagcggcaactgcaaagggaaaaagatgcggaggatttcattgccaacaaatccaaattcttcggattggtaatcactgacgaggaaataatcgtcaaggtacttgaaagcatagacgagtattacagcgagggcaaggcacagaacatctgcgtgttcggcagtgaatactacaagaaagccgacaccctcatactctcggcaaggattggcggtgagataattgaaaccgtagaggtggatttgcggacactcaaggtggtgcagtgccacggcaagtacaaccaagacaccgaataccacgagcgcatcatagaccttgtgaacaagaacgccaaccttatccgtgagcggatgaaagcggcatagcataaaccctaaaacaacattgatatggaagtaagaatcgaaagcatgatttgtgtgtgggacgataaaatccccaccttgttccttgaatttgtaaatctcctcactctctcaacaagtgaggagggattaagaaagagcgtaaaggagtttgccgagaagcacgaacttgacaagtttttcctttacggcttcggctctcaccatttctacctgcaccaacgctacacgagcaaccccgaaatagtgatgaagaacagagttctgtcagtacatttttaatcatctaaaaagcaacattatggcaacacgaatgaccatcaacggagtaagcacctgtacggaagcagggacggagaaatatgagcgtttccaatcgggtatcggcagacgcaagcggacacttgtgcagtacgactaccgccatacggacggagaactgttcacttgtgtcaaacccacattggacgagtgccgaaccgcaaggaacaagtggctgaacgcaaagcagggaaaggagggcaaccgatgaacacgacctatcaaacgctgatagtcaaattcagcgaacctatcgcggcattggacggtatctttgacgatgcccaagcgtggggaacggacaccctcaaagggtggatagatgattacgaaagcacacgtttcaccgccaccgacagccatacggcagtcatcacgagcgagtacaatatggagtgtgtgaaggagtggctgcaacggcagacacccattgccgagatgcgagaattttgaacaagttggcggtgtccgcaccgccagcacttaaaaccctaaaaacaacgaatatgatagcacagacgatattacagcagataggtggaaaacgctttaccgccatgacaggtagccgagattacatcaatatgggcaacggcttacggatgagccttgcaaggaacaagacaagtgccaaccgccttgacatcatctatgatgcgggggcagatctctacaatatgcgcttctaccgcaggacattcagcaaaaagacattcgagtgcaggacgaaggacattgccgtacacgagggtatctattttgatatgctggaggaaatgttcacgatggtgacgggactttacacacgcttttaagaagaggaacgggcggtaaaatcgccgcccgctacttttgtcagtgagcagtgggcggcacaaaagtagcaaaaagcccaagttccaatctgtgatacaatttacaaaaacaagttttaatcatggaagcaatcagacagaacggaaaaatcatcttgcacagcaacgacggcataagcataaagatgattttcagaaaccttacgggaaggaattttcaaggtcaggagtatgcggactatattagccacatcgcaattgggagcatggggtttacgcccggtagcattgagcattgcagggacggtggcgtgatagacacgggaacaatcccgaatgtatgaaaagcggaaaatccaatgaagttggcggcttcatcggatttttccgaaataatcattaagtattttaattttgaaatgttttttgtaagaatgttagtagtttagacatatcttcctttcgatatatcatttcacaaactttttgaacaaatacattttcttctattccttgttcttttaagtttttaatgaggtaattataaaacgccttgtcgtcattctttttgattaaactatccaccacttcttttagtgatttaactttgaaaaaacggtcacctatttccttgaaaaaatcagcatctttatttacaataattttttcatgtaggtatttttccaaactatgtattggcagaaaatttattgttaaattagtatataatcccttttgcttatatagttgttcaaaatccggttttacatcaccatcaagaacacttaatacttttgttccaacccctgctaaatttgacttacaaatatcatcttgcatttttaacacattctcccaaccaccacttggtagaatattaatcaatttacttttatacaaggcattttcatcaattatattctccaatatatatttagccaacacatcctctactaaaataagaaaatcgtatcccgaatgttgataaatatctcgtgttgcatatgatggataacatggatttacaatagcgatattatccaactccttttgtaaatgaaaaatatttgaaggctttattttcctaagtaattctattgaatgacttgaaaaatatatagcaagattatactctgtagccaatttttgcaaaaaatcaactaacctcatgattgcagatggatgcaatgctaattcaatttcatctatcaatataagccgtacatcttcagactttgcagggcgaacaatgacaacattcaacatatgcaataagctaatcaacatattttctcctgcactcatacaaaactgattaactattccattagttccttcaatgaaatatggaattcctttgaacgctttaagttgtgctaatgttctatttttaatgcgtttaagatttgtatagaaatcataatttccatgcaaaatataacttaaattgcgcgaaacaaacgaatctgcatcagttaaaattgtattattaactctttcagcttttagtaatgtatcataatttgcatctataaaacgcattccatgtattatgctaccttcataaaaaccttttagagatattatatcagttgaactacaactccatcctctactggcttttgtccaagaattttcttttccatcataggatattgtgattttactattagatgaataatcatgaggttgaaaaacattgaatgcagagttacgtacaaccttagaaatgactgtcatgatagtacttttgcctgttccattagctccagttatagcataaagtcctgtttctattggtagatttaactcaatattattgatgttctttaattgttctatttttatatttaatttattattcataattgttctgtctttggacgcaaaattaggcattttatactgaatgacaaaatgttatcataaaataatacaactaaagtaatattgaggtgatacataattacccctgctcttgaattataaaacagaggtaattattttttttacgaattttgcatcaatcacgggatatacagcagcgcaaactccacctttctccgtgtgagcagcatggcatggcgttttcccttgtaactgcaaaaagcaatatattcatggtagatgttcctgtcgccagcctccaacttctttatcaaggtgcttttggggattgtcttgctacccaaaagccggtatggacccacgttgtaggcaagcgtggcgagtaaaaggctgtctttcccgaactgccggaacatcgcgcagaacttccgcaagtctttccgcagaagcacgtccgcctgccgcttcgtcatggttcgtgccgaatatctttcgtccggcagaattttgtgaccccaacccacgtatgggtggtgtttttccgagtgccagccctcaaaatatttcgtgcagcacaccgccctctcgaaaagtggcaaacggtagattgccgcctgcccgtccattccctctcggcggctgatccgtgcggacacggaacagaccgccataagcgaacagagcattaccatgaatacacgcatcatttcagcaaggggctgaagttgccgatgggaacgatggtcaaaccgtcatcctttacattccggttgttgaagtcaaattccagctcgaaggagttgccgaagttgtcctccaccaccacaataaagttgtgcgcctcttcgccctccgccgtgtagtacaggcggaacttttcgttctccagcaggtagcggtcgttgggcaggaaggtgatgccgttatccattttcaactttccttctccctcaaactgaaaatagcggatggtataaagcgtgttagcgaagtcgccctcctttttcagttcacagcggatttccaccgtctgcccctttgtcaccttgttcggcacgggcatgacctccaccgtgaagggataggactgttggatgtccatgtcgtcatcgcacgacacgagggtgaatgacacagcggctatcaggcataacgccaccaccttaaagatgtttgtactcttgtttctgttgttcagtatgttcattgttcttcgatttttagatgattgtttttctgttttttcgttgtccgttgcaggtactcattcaagtccttgcaaccgtcatagagggaggaacggtcggcgacacgcgccccataccgtttggcaagagcgtcaagcgtccgccgtccggcttcgtcacggtcaaggaagcatccgatgcgcccgtagccgtccagcaattccgccgccttctccacgttggcgacagagttcagaacaaggcagtcagcgttaccggttacgccaagcgtcacagcggagagaaagtccatgaagccctcaaacacgaggcactcgtcagccgggatttccttcgtccttgccaaagacacatcttttggcgggatgcaccccttgaaaaatcggcttcggacttcatatccacctgccatattcaggaaaccgacagcaaaataccgttttccacgcacactgtagttcagacggcaacagtgacgggatgtgatggcgatgggtatgccacgttccgccagatagtccgtcaacggtgagcgaagtaacggagcgacctccacatcctcaaagacgggttcggtcggcttcgggagataggcgggcttttcccatccggcaaccgtcatattggcggcttccgctatgaacttcgcttgcttcatgaagtcatcgctttgcagaaactccccggcaagcgtgaagatgtcgccgcccttgcccaaaccgaagtcgtaccagagctgtttcgccacgttcacacggaaagagggtgtgcgctcgcccctgtacggggcaagataccacagctcgttactgctccttctaacaggctcatgccccagccgtgcgagaaaatccgtaagcggcatccttctgacagcatctatttccgtcctttccatgcccgtgtcagttgatgatgaacttgataccgaccccgaactgcgtgtgaaacttccgcgtgtcgccaccccaaaggcaacgctcccgcagattggcaagcagggctatacggtctgccacgtagcattccacatcgagcgtcagcgcgccgccgtagatgaaggcgtcccggtcgtgcagcgtagaaccgtcatgcagcaccttcgttccccagttcaccgactcatatccggcaagagccgaagccccggcatagacgaacacgatttttcgagcgtccgacagtatcttgaagtaatagccgccctccgccgtgaactgcgccacgggtatcttggtgttcttgtaaggattgtttttcaggaggtattcgccaccgaacacccacttgtttcccctcttcgtgtaggtggaaagagacgccccgaaactgtagccgccgtccttgccaccgggattgaaaccgtccgccatgtccgcccttacctcgatgccatgcatcttcggcagacaccgctgggcgtgcgcctgccccgtgaaaagggcaagcgacgcgatgattattgcgatgtattttctcatggtcagcgcacttgaagttcgttaatggtgctggctcgtaccaaatcctcgttctcaatcacgaaggactggtgacggccgccgttcttctcgttcagctccaccacgaggcacttgtcgtcggggatggtgaacttcgccatcgtgaagaccgtgcgctcactttttttgcccggcacgagagtggcgtagttctgcgcacggagcggcagaatgatctgctcctgcacggcggtacgtttcgccaccttcttgtccacgattttccaagtgatgtagtccacatcgaaaggcacgttgctctggttctttatctccgtgtggaagtagagtaagccgttgtgcgtgtagatgcctttcaacaggtattggatgccgaaacgcttgcagccgatatgcttcacctcgcgcttgttctgtttgtggatggacttcatgataaggcgcaccagcatcgggctttcgctgcccagctctttcagatagatttcctgcgcattgttcgggcggttcaccgtactgccgtcatggatgaaatcgcacatctccacgttgagtaacagcggttcggcggcgtacttcacgttgaaggtgtagaaactgccgtcctccgtgatgacggacatattcgtttcgttgggaaaatttctcacggtagccttcacgcggatgacgttctccgctccgtcggctttcccggcaatcaggtcgggcgagcctaaatcgacatagcgcacctccgccggaaaaatgacgtggacggtcttgtcataggtcacttccagtccgtgcggcggtatcatgcggtcgaaggtcagcttgcgcgacagaccgtgatacaggtcgccgtccgcctccttctgcggatagacctccttcgtcaaggtcggctgttcacttcctttggtcgtttcaacggttacattctcctgcgcgttggcagttgcgatgcccatagcgagggcaaacatgatgattacttttctcattacttttggattttagtggtaaatgtttttttgattgattgttgttttcagtccttttcctgatagagcatgaccctgtacccggctttcagatgcacctttacggttcgcatcttcttggcgatgtactggctcgtgccttgtatcagccccttgcccaaatcggaggcgagctgcgccccggcattggtggagatgttgatgctgctccctaacgagccgcccatgttggcggcgacctccctgacggcgttcatctccatcgagttcgggatgaagataccgggctgtccgtccgtgtcatagaccgcaagctccaccgggataatcgtgccatcgtattccagcgaggtgacctcgatgtcgagccgctcaccctgtatcttgcccgtgccgaccaccactgcattgcgtgggattgttctgcccgccaccgccataggctccagcaggcgcaaccttaccgtctgtccgtccgtcacgctctgcgcaccatgcacacatgccgggatggtattccggtccgatacctctgtagtgccgacagccgtgttgaacccccggttgcgctcctgcgagaaggtggcgacaaactccgcgttgctcatgggctgtgcaagggaggaaacgacttggcgggtcacttgccttacgggtgtcgccgtgttcttctttcccttctgcacggtggaaggctctgccgcctgttccggctttcctccgttctgaccgcccatgtactttgccgccagctcataggacttctccataagtgccacctgttcgtccatagatgaagtcctgcccttctcgctttccagttccgactccagcgaggcgatgcgctccaacagctcatccatctcggcattgtcgttcttcggctgttcgtagaagttgccgagggtggcgttcaggtcacggtaggcggctgcggaggattggatggtctgcggcgtggcgggctgtgccttttcctctttgccgcccggattggcgaggtcgaagtccgtcccgtcctccgttccagctatctcgcggtcgaacatgtcgcccagctgcccgatggcacggttgcggctctccagacgctcttccatctccccatgctcgtaggctttcaacttgtcgccgataatctgccggttcgccttgtccgcgtcgggcatctcggtgttgtatccgtctgttcccggctgttgctccttgccggaggacggggcgaatatcagccacatcgccccgatgaacaccagcaccatagcgggcaggactatcatcttctgccgtttcagccgctgcgcctcggtcagcggttcgcgcccctttttcggctttcccgtgtcgggagcggctttgttctctttcgtcggttcattcttcgtctgttccatataaataaggtgttaagtgattgtcagtttccaccggggtcggcagttccacccgtccggcgtgtcccgtttccatgcgtaagccgtcgttcctgccgatgtcatagacggctctgccgaaggtgtagagggcaagcaccgcgaaggcggcgagcatccccagtacgatgcggcggcgtgtttccggcggcaaaccgtccagataccctttgagccttgccaccagccgtttccgtttgtcgtggagcttccagtacacgccccacattgtttttctgatactttttactttccgtttcataatccgttaccgtttgatagtctgtaaatccttattctcgatgatggtgaaaccctcgatggtgaagccgttgggattgtcgtccgaccgtgatgcgttcagcaggcggcaggtggtcacgaggctgcgctcggtgacgttgctttgccggatgattttctgcgtggcgtaggtcacggctcggtagggataggcgttgaagtcacacaccacgctgtccaccttcaacacttggttgatgtttccggcgatgatgcggttgtagtaccccttctcggcgaagtccgaataatagtggtacacgctcttgtctgccagcagcaaggcacgttttacgttgtgttcaatcgcgcttttttcaggtgacagcgtgaagaaaagctcgtggaagcggcgcacatgctcccgtgcctccgctggacggttctgcgacagatcctgcgacagcgcaagcatcagcgacttgccgttgtccaacacatagattttctcccgttgcttctccgcgaaacggtaggagttccacacgctccacaccgtcaccacggtgcacagcgagaggaagacgataccgaacaggcgtatctgcctgaacgatgattcgatgtttttaagtgacttaaattccattgttgtttattcgtttttaattgtcagttgattatttcagcagtttcccggcacgtccgaccacgtttcctgcggctgcacccgccacgctgcccgccatgcttccggctcgtcccgccatctggttcacgttgcgaccgtaaccgcccatgcctccggcttggataatccagccggcaacggtgggaatggtgaagtatccgatgatgccgatgcagaggaacacgatatacaccccgtcgctcgaatccagcgagaagttcgggtctgcctgcatccgctcgatgtcgctttgcagcatcagcacctgtatcttcgccagtatggtgctgaacatgtccgacaccggaagccacagatagacctgtatgtagcggcatatccactgcgtgagcgtgctttggaaaccgtcccataccgacagggcgaaggctatcggaccgagtatcgccagcaccacgagaaagaaggtgcggacggtgtctatcacgagggcggcggcttggaacagcagttccagtatctcgcggaagaagtcgcggatactcttcttcatgttgtacattccccggtcgatatacattcccgccatcgtcaccatgtcggagggcgaccagccgagttcctccagttgcttgtcaaattcctcgttggacacgaggtaggcggtttcggggttgcgtaccatcgcctcgtattccagcttgtccttctgctcccggtatcggttcatgtccagcgtttccgcctccagcatctttgccgtgccctgtacgacgggtgagaggatgctgtttatcgtgcccagcaccacagtcgggaagaacatgatgcacagaccgatggcaaaaggacggagcatcgggaatacgtctatcggttcggctctcgccagcgactgccatacccggtaggcgacgtagaacagcgcacccagcccggcgatgcctttcgccacacccgccatgtccccacatagcggcatcatctgctcataaagtgagcgtaaaatctgatgaaggttatcgaactccataggcttaccagtatctttcgttcatgttcccgtacagccccatgatgcggtcgaggtcgttctttttcttcgcacgcagataactcacggagatgttcttgttggtgtaatagctcacaaggttgcggtaacgcttcattttggagtagcagcgttccaccacgtccatgcgctccttgtcggtcatggagagcgtggtgatgttcaccacattcttcagttccgtcaatacttcgttgctctcttccagcagtttcgtgtaaccgaaagcgattgccgacagctcttctggtctgaaatttccatcacggagcatcctttggaaactgtttacataaatgtcggtgatgtcgcctaccatcaggatggtctgctgcaccttgcgggcgtccttgacgagattgttcaccgatttgagggcatcgtaatactttttgccctgctgatagattttcaccgtttcctgaaagttgctcaccatgttcgtggcagtcttggaggtatggatgatgtttttggaggcattgatgataccctgcgccagattgcccggatcgcttacgacccactgtgcgcttgccctgcctgcgaaaagcaggcacaggcagataatcattgttattcttgttctcatgttactttggattttagtggttgttattcttctgtcgggtgtcccggctgcggtttcacccgcacatagtcgccgcccggcgagaaggtcagcacgtccgttgcctcgttgtaggacacgtcgatgcggaagccggtgttcatgaacaggttgtcgttttcctcctgcaagagataggtttccggtttcagcttgcggcgcagaccgctccggcggaacaccgtcaccttgtaggcttcgccctccttgtagataagcacatcgggcttcccctccacgctctcccagttcccgcacagcatatcacggcggttatcgaccacatcgcaggattgcagcatcatgaccgccaatccgatcaggcacttgctgacttgcagcattttaacttttgataaattcatacgcatttcttgtttttagctgatgattaaatgattaacttttggttctccgcttctcggcaagttgccggatggcggcttcgatgtcgccgcccaacttctccgccagacggtaaacctccactttctccgtttcctcggtggtgtacgccagatattcttctgcactgacctcggtggcatagaccgccgattgtgtgccacccaagcctatccacacctccttgtagagccgtgaagggttgttcgccatgttgatggagagtatctgccctttctccttttccgtcagtccgagcaacgcctgtatctggtcgaacttgttcatgtacttgcgctggtcgagaagtatcttgcagtcggagttgttgatgatgctctccttgaccacgggagaggaaatgatgtcgtccacctcctgcgtcaccacgattgcctcgccgtaatattttctgaccgtcttgtacatatagcgcagatattcagccatgttcgctgaagagagagccttccaagcctcttccacaataagctgtttccgtaccccttttagtcgccgcatcttgttgatgaaggcttccatgatgatgatggtcacgacggggaacagttcgcggttttccttaatcgaatctatctcgaagacaatgaaccgcttgccgagcaggtcgatgttctccgtggagttgagcaggaagtcgtagcgtccgccccggtaatactgccgcatggtggtgagcatgttgtcgatgttgaagtcggacttctccaccttgatgtcacgctgtgccagttccttgcggtagtcgtcacgcatatactcgtagaaggtgttgaacgacggcacgatgctacggtcggattggatgcgctcaatataggcactcacggcactgcccagctcgccgctctccgtctttgtcaccttgtcgtcctccgacttccagagcgtcagcagcagggtcttgatgctgtccttcttctccacgtcgaagatgtaatcgtcggtgtagaacgggttgaacgatatgggcttctcttccgtgtaggtgaaatacacgccgtccgctccgcctgtcttgcgtcggatcatgccgcacaagccctgataggagtttcccgtgtccaccaataccacatgtgcgccttgctcataatattggcgcacgaggtggttcatgaagaaagacttgccgctgcccgaaggacccagcacgaacttgttgcggttggtcgtgataccccgcttcatgggcaggtcggagatgtcaaggtgcagcggttttcccgtgagcctgtccaccatcttgatgccgaagggcgagagcgagttgcggtagttggtttcctctgtgaacaggcacaccgcctgttcgatgaaggtgtggaaactctcttccgccgggaagtccgccgcattgccgggtatcgccgcccagtagagtgtcgggcagtcgatggtgttgtggcgcggcacgcattccatgcttgccaactggctgcccacgtcgttcttgatatgcttcagttcctccgcatcgtcgctccacgccatgacgttgaagtgtgcccgtaccgaggtcagtccgtaggaatgggcttcgttcaggtattggtctatccactcgcggttgatgctgttgctccttgaatagcgagatagcgactgcatgttacgggcggacttctcgaacttatgcaaggtttcctcactgttgtctatcagcacatactggttgtagatatggttgcaggagagcagaagccccaccggggaggcgaatgacagtcggcagtcactccggtcggtggagagcttctcgtaacgggtgtcggtagccaccttgcccggcaggtcttccgcgtcggagagggtgtgcagacacaggcggttgtcgccgatgcgcatctcccttgccgaaagctcgatgtcctgcaaggtggtgtcaccttccgacatgagcgagaagtagcgttcaataagtcccgtatttccctcagtacccacaatctcatcggtggagaggcggcgcagcctgacaagcccgctgtcgttcatgatgcgctcgaactgttcgcaggcttccaagaacttggtcgtggtttccctgtccagctccttcgggatgatatgtccccggcacagcgtgctgaaattgctctgcatccggttacgctcctttgttgtcttggtcaggtagaggtagcaggtgtgtttcaggtacggacgctcgttgaagtgacgctcgaaagagcggcttaaaaagctcatgtcgtccttctgaagctccggtttgtagcgttccttgatgaaccagtcctgtttgtggacgacggagtagtccggcagcaccttgatagccttgcaccagcaactgtgtatcgcctcgtactccgcacccgtcacggtgtaaagttccggcagttccacctcgaaagccaccgtgatgtcggcgtcctttgagatgatgcagccatgctccaccgctaaaagtgggaacctgttttccagtgttgtcattttcgatgtattcctcattgtctttcttcctttcgttgtcgtttgaacagacggggtatccgccgccggttgataaggtatcggggatggctccgtgccgctcctaatttcatcagcccgtgttcgccgtaccgggcgttcagcgcgaaggtctgccatacaaggagggaggacgatgccgcgccgaagccgatacatatccactggtcgataccgaccatgtagaggatgacgaacaggacgaagagagccagcagacctccgcagaagatgaagaggtactgtgccttcaagcccttgaactctaccggacggccgatacccttgttgattgggtattcagccatacattatttattaaaggaagaatgagcgcaggatggtggcggcaacaatcaggaagatgcacgcgccgaaccacgaggcggctgtcttgctggtgtcggggtcgcccgatgaaaacttgccgtacacttttacgcccccgataagcccgacgactgcaccgatggcgtatatcagtttagttccggggtcgaaataagaactcaccatagaggtggcttcgttgatgcccgcgatgccgtttccctgcgcgaaagcggaggcggttgcggcgatgacaagtgccgcggagaggattgcttttctgtttttcaagatgttcttgttcataaactgttcttgttttttgccgtcaaaagggtggatggtcctttgtcgggcggttgatactttgtttctttactttggttttagtggatgcccgtttgtttccacggacgtgggcgtgtccgttgcggatagggatgcgccttgcgtttcctcgccgcgtgggttgatgtcattctttcatgttcatttcttttattgttgtcatacatagttgcgaatgtcgaactcctcgatgttgtccggcacgacgaactccttttcaggtttcttcagccgaatctcgataagccccttgatgcggatgcctatctccgaagagccttccatcattttctcgtacaactccgtgccctccatgtcggtgaacaccttcgccgccttttcacgttccgcctgtgtcgcgtccgggttcttggcggtcttgcaggcgtcgtcaatctcgtcaaagctgctgcccgaagcccgtggcgtgtccgaggcgtcctcttccggttcgtcgtccccgtatcccagttcctccggcggtatgctcgtgaaggtctcatcgagtttttcctccggaacttgtgccgggcgggatgcgtttcccgtttttccgtcgtcaaaagtagcctcttcctccgacagctcaatgcctttttccatagtggcggcttcttgcgtcggtatggcagcggttgtccgggtggatgccatcctgaaacggctcttgccgatgatgtccgccttttccgcagggacttcctcgtgtgccgctatgcgtttagcctcattcccgtccagtgaccgccataatccgacaatgcccttgaagaagcggacaatccgcgtgtccatgatgcgctcgtaaaggagcaggaacaggaaccagaggttgcagccgaccgataccgccagcagaatgtctgtcatgctgattgtgtaattcatatccttccgtttttggttagaatactgaattataatttcgggcataaaggctctttatcgcatcctcgcactggttgaagtgatgcgtcagcacatggtcgatgtaagcggacagcataagccggtcatgcccgattacacgggtgatacacatgatacgctcgtggtactccgggcgcacatacgccatcttcccctcacgtgcctttacttccgagtcacggatgaacagacgttcatagtccttctcgcagcatttgccgcttaccgggacaggcgacaggatttccacactcgcctgcacttgggcaaacatacctccgcagtcttgctgtggtcttttttcattcggtgtcatttctttttccattttcaaatcagatcttcacgttgtttcttgtacagttcgttgattctctccttgtgctgttccagatgttggcgcagcacggtatccacatagccgcccaccgagatttcacctccggcgatgtcgttcacgattctgaggattttgccgtggacatcgcggctgatatagacacactggcgggtctttatctcgttgcggcgcaggaacagctcgttatagtcctcatcctgccttttccggcggccactttccctctgcgctttttcccgtgttactggttgcacaggaggtggttccggtgcggcggtgtcctcttcggtcggtgcagctgcgggtacttcctgtgcggggcgcagtgtcccgtcctgtgtgcgccgcccgatggaagctaacagcagttcctcgtcgatgccttccgtgttcactttcctgctgcccatgctcactgcggtctgatgatgtcgcttatctcttcggaaaactcccggatgccactccctttcagcagtgccgtgtccatcgggaagatggtggagcggaaaacgctcttgcgctcttccgaaaggtcacggcggaacttcttgctgtcgggcaagcgggtggaaagtaccggaaagcccatttcggctatcacttcctcgtagatgccgtacaggtcgttcctctccctgccgtccaccatcgtccaaaacagataaagcccctttgttttcgcctgtccggtagtcatcagcctgtcgcggaacattgtgacgaatttcagggtactctccacaacaaagcggtcggcactcagcggagtgaagatgtagtccatctgcgagagcgtctttatcacgccgttactacggagtgtgccgggcatgtcgaagaacaccacgtcgggtttcacgtcctcagtggcaatcatcctctcggcatcgtcgagggcgttcaccgcattgctcttgacgatggtgtaggcgttctttttcatccggcggaaatggtcgcaagcgagagccttgaagtaggtgctgctgtcgataagccccatttcgtgttcgcgcagcccgtggatgctgtgctgcgggtcgtcgcagtccacgacggcgacattgtagcctttcacgttgtgcaggtagctggcggcaagtgccgtgacagtggatttgccgatgccacctttctgtgttgcgaatgcaacgaagatttccttactcatagttccatttattttaattgttgaagatttctttttctatttatatgcggatttggttgctacattatccgcttcagtgaacagacacatgggcgggtcatcgcgtatccggttctgtggtgaagcggtgcggcgaacaagtgatgaatgacgacactgcgtcatgaagtcattgaatctgtacttcaccagattgtcggataaccggggttccgacggttcgggtatccgcttcggcaagtatccgccgaagcgattgtccgggtatttgaatgttccttttctcatattttcaaatcgttcgtttcttgaatcatgctgcaaataaacaagtatattttggaacctgtatcacttctccggcaagtggcagcacgttgcgccggttggcagtcattgaccgggtcaagcatctgtccaatacagctttaagggcgtaactttgccccccggacagcagggttcgccgatggtgcgcggcccggagtcctgaaaggtatcttcccatccgtcccctgacggatttttatgttcacctgaacatagcaaggtatgttttcagccgctcaaaatattttgagcatcccggaaaacgccttgcccttgcagggggcgggctttccctccgaagtcggaaagcctttcagaactgcggtgctgtgatccgaagcggcggcttatgccgtcaatccgctaaatccaaagtaatatgaaagagaaaaggaaaagcaaagcagggagaaatcccaaacttgatccggcggtgtaccgttacaccgtccgtttcaacgaggaggaacacaatcgtttcctcgccatgttcggaaaatcgggtgtctatgcacggtcggttttcctcaaagcgcacttcttcggacagccgttcaaggtgctgaaggtggacaagacgctggtggactattacaccaagctatcggattttcatgcgcagttccgcgccgtgggtacgaattacaaccaagtcgtgaaggaactgaggctgcatttttcagagaaaaaggcgatggcgttgctctacaaattagagcaacacaccgtcgaactcgtgaaactgagccgccggattgtggaactttcaagggaaatggaggcgaaatggtcgcaaaaatcagtgtaggaaactcgttgtacggcgcgattgcctataacggggagaagattaacgaggcgcaggggcggttgcttacgaccaaccgcatctacaatgacggttcgggaaaggtggacatcaacaaggcgatggagggttttctcaccttcatgccgccacagatgaaggtggagaagccggtggtgcatatttcgctcaacccacatccggaggatgtgttgaccgatgcggaattgcaggatatagcccgcgagtatctggaaaaactcggtttcggcaaccagccttatcttgttttcaagcacgaggacatcgaccgccaccacctgcacatcgtgacggtgcgggtggacgataacgggaaatgtatcagcgacaagaacaactactatcgtagcaaacaaatcacccgtgagctggagaagaaatacgggctgcacggcgcggagcgcaggaaccgccggcttgacacgccgctaagcaaggtggacgcatcggcaggtgatgtgaagaagcaggtggctggcactgtgaaggctctgaacgggcagtaccgttttcagacgatgggcgaataccgtgcgctcctttccttatataatatgacggtggaggaagcgagaggcaacgtgcgcggacgggagtatcacgggctggtttattccgtcacggacgacaagggtaacaaggtgggcaacccgttcaagtcctcgcttttcgggaagtccgcaggttatgaagccgtacagagaaaatttatccgttccaaatcagagattaaggacaggaagctcgccgacatgacgaaacgcaccgttctttccgtgctgcaaggcacttatgacaaggacaaatttgtatcccaactcaaagagaagggcatcgacaccgtactgcgctacacggatgaagggcgtatctatggagcgacgtttatcgaccaccgcacaggatgtgtactgaacggctctcgcatgggcaaggagctttcggcgaatgccttgcaggaacacttcaccctgccatacgccggacaaccgccgataccgttatccatccctatggatgctgcggacaaggcatacggacagaccgcatacgaccgtgaagacgtatcgggcggaatgggcttgctcactcccgaaggtccggcggtagatgctgaggaaaaggctttcatccgggcgatgaagcgcaaaaagaagaaaaagcgcaagggcttgggtttgtaatcggagtatcaacaattaaaaaatcaatgtatgtcacaacaagaagacgatttgagggcattggcgaaaatcatggattttctgcgtgccgtgagtattattttagtggttatgaacgtgtactggttctgttacgaagtcatccggctgtggggcgtgaacatcggtgtggtggacagaatccttctgaacttcgaccgcacggcggggctgttccattccatactgtacacaaagctgtttgccgtcctgctgcttgccctgtcctgtctgggtacaaagggggtcaagggagagaaaatcacttggggaagaatatggacggcactcgccgccgggtccgtgctgtttttcctaaactggtggatactggctctgccgcttccgattgaggcggtgatggggctgtatgtccttaccatcggtacgggctatgtctgcctgttgatgggaggtctgtggatgagccgtctgttgaaacacaatttgatggaggatgttttcaacaacgagaacgagagtttcatgcaggaaacaagactcatcgaaagcgagtattcggtcaatttgccgacacgcttctattacaaaaagcgttggaacaacggttggatcaatgtggtgaatcccttccgtgcgtccatcgtgttgggtacgccgggcagcggcaagtcatacgccgtggtaaacaattttatcaagcaacagattgaaaagggcttcttgatgtacgtgtatgacttcaaattcagcgacttgtccaccattgcctacaatcatctgctgaaccaccctgacggctacaaggtgaagccgaagttctatgtgatcaacttcgacgacccgcgacgctctcatcggtgcaatcccattcacccggattttatggaagatattacggacgcctacgagagtgcctatacaataatgctcaacctcaataaaacgtgggtgcaaaagcagggtgacttctttgtggaatcacctatcattttgttcgccagtattatatggtatcttaaaatctatcagaacgggaaatattgcacgtttccccatgccatcgaatttttgaaccgccgctacgaggatatttttccgatactgacttcctatcccgaactggagaactacctttccccgttcatggatgcgtggctcggaggggctgcggagcagctcatggggcagatagcgtcggcaaaaattccgctttcgaggatgatttcaccgcagctctattgggtgatgtcggacagcgagtttacgctggacatcaacaatcccgaagagccgaaaatcctatgcgtgggcaacaatcccgaccgtcagaatatctacggggcggctctcggattgtataactcccgcatcgtgaagctcatcaataagaaggggatgctgaagtcgtcggtcatcatagacgagctgccgacgatatatttcaaagggttggacaatcttatagctaccgcccgaagcaacaaggttgccgtgtgtctgggatttcaggatttcagccagctggtgcgcgactacggtgataaggaggcgaaagtggtgatgaatacggtcggtaacattttctccgggcaggtggtaggtgaaacggcaaagacactatcggaacgattcggtaaggtgttgcagaaacggcagtctatctccatcaaccggcaggatgtttccacctccattaacacgcagatggacgcgcttatcccgcccagcaagatttccggtttgacgcagggaatgtttgtcggttcggtgtccgacaacttcaacgagcgtatcgaacagaagattttccactgcgagattgtggtggatgccgataaggtaaaacgggaggaaagtgcctacaagaaaatccccgttattaccgatttcactgacgcagacggcaacgaccgcatgaaggaaacggtgcaggcaaattaccggcgcatcaaggaggaggtgaagcagattgttcaggaggaattggagcgcatcgcgggcgatgacaacctgaagcatctgttgcagcagaagtaacctattaaaataagggaggatagctaaaatcctcccttattttaatattcctccaaaagtttattttgacgtaaatcttcaatgtaacatgctaagttacttgaaactttattaaatactttatcaagatatgggatgatattttccaaattcaattccaactctaacgggaaactatgatattgatgtaaaaaccttgtgatgtcatttctttctgaaacagataaaagcaaaaatggattactgtttttataatataccattgctgaaagatgaataaaagcgcatcctaatttataaacaaaaaaaggccagccataaaatttatcagctaaatccaccatttgtttatcggtcacgactttctttgtattgggataagaccattttattccctccaaagtttggtttataaaatgctctctaaggtttaagtcgctaattgacaacaaaaacataactcttaccatagaatctaattcttgacgcagaatagatattacctgcccatataattgttgttgcaacaaaatatttatagcgcaagaatgttctcctgacctttgagtaactatatcgcaaaataaattaatattatttgttttcattgttgagtgatttcgcttataagatataggatttactattggttgccacatatatctgatgcggcatttctttttcgttgtatattattgtatggttgtcgcacaaggtcattcccagcctttcaaccacacggatggatgccacgttttccggtcggatactgcaacagacagttttcagttccagctctccaaaggcgtattccaaacacgcgcgggcggcttccgtaccgtaaccgttatgccagtatgtgttatcgagtatatagccaagctcgacagtctcgttcccgtttagggtactattcatcagaccggcttgtcctatcaatgcgccgctttctttcagtatgacggcaaaatatccgaacccgtccttgcggtatcggatgagttgcctgtttatccatttgcgcacgtcctttttggtaaagccgtgttcccaagcgtacatgacttccggctttcccattatggcaaggagtgcgtccatatccttacgggttatcctgcggataagcagccgttccgtttccatgacgaccagcgatgcggaataggtctttatctcaaatccgtcctctttccattccttcacaagcctgttgatcgtttcttccaccagactgtcataagcggcatcgggaataacctttataaaaaaggtgtcacgggtttctttcatgacccattcgttgatgtctttcagttccttgccttcgggaatgtaattcttgtgtatcatgaactcgttgatgttgtccgccaacaattcttccaactgataacggatgtcatcctccagttcggcaaatggtatggtttcctcttcatagatgccttctattaaaacatcatcctcttccatatcctcgtccggtgtctgattgccccgtttcatgtccaacatatcctgcgcgaactgcccggattccttgtccttgtacttcttggcatatttttccagcagttcccagtcctgacggctcatcgggcatttgaaaacggctcgttccacctcgttacagcgcaccatgtccgccttcacatcatcgggaagcgaccggcattccttgcagatatgccgcgagtgtcctttgccgctgaattgctcgttggctttgtactcgctacaaatccgacagtaatgcccctgttgtttcttctttttcgccaccataccccgttattatatcaacagttcttttcctttatcggtaagacgatatttctgccggggatgtttcggattttccgggtaaataggctctaccaaattctgccttatggctggatacagatatagttctaaaaaattacttttgtcctttaatcctatcacacacataatctctttggttgaaagtgtctgtgtgccgattgcagacaacaccttttccacctgtggggtaactgtggggtgactgtggggtaactgtcgggtaattgtcgggtcgtgccccacagtttttcgggtatagcggaaaataacccatacactatttccatctgtatgaaactccggatcgggaatgccgacacgccggcattcgcttatcataagcccgatgcctcgtccccagctttccagaacctcgcttttatacagaacattcgcaataatcaggttttgaggttctgaattatgcccgctcaataacttttccattgttatatccggcggaaaagttccactgttctcaatctccacacggtcatcatagatggcaattcctaccgaactgccgggacggtggtatgagcggtggcaaagggcatttgtgcagcattccctcaatgccttgtaaggaatctcaagctcttcctcccgatacaagccttcaactttgcccgaaagggaaagatgcttgaaaaagaacgacattgcagtgtccagcagtgtgtagatattgccagtggtacgctgattgtctataaactcgtcttttgtagttcctttgaaacgcgccaaccgaagcaggcactggggatagaagtaaaaatcacgaccgaacaagactgcggaagcattattcagttttccgtcatgtaacaggttgaatttttcgagtatggtcggcaaatcctcccttatggtggcttcgggtaggcgaccgcaccggatgcctccacgtaccgctcccataatggcatgttcatcaaggtcagtaactttgatgtcgggattcgtcatcgcctcccaagcgtatttcccacctcgctgcataagcagttggttatatacgtcttgcggcatggaggatgtcacgctctccaatcgaagataagcccgtcccttataggagaacggacgcatataacgttggctgtccgcagacaaggctatcacactcttgtctgtattttggatactgatatacgaaacttcgagtgtggcaaatggttcaaaacgccggatggcttccgcaatatcacgcttcgtcttgtcgctcacttcctgcccgatgatctttcctttgtcggtcacaccgaacaacaccgtgccaccttcgctgttaaggaaagcgcagagcgtttccatgccgcgctccaactgcccggtggtttccttgaactccacctgcccgttttccttttcggctatcagttgttttactatatcgaggttgtctatgttcatattcaattcgtaacaattgtacaaagatagcgtttttcgctgaaattcggggcaatagcgcgccgaaaacgccctttttcgtatagattttactcaaacgggagaacagcatgataccattctcccgcttatacctgattttatcttctcatacgttccagctcttcatcgcgcagcattctctcgttcagtttctcctgcatcttgtcgaggaaataggtacggctttcgtttttccgacgtttgatgtcggtatagaagcggtagcaatccttcgactcaataccgaatatcttgtagagaatcggggcgagctgttttagcggcatattgccgttgttgatacagcccatctcgtctatgccgtagataagttccacgaggtcgatggcgttgcccgtccaaagaaggctggcggtggtttctgttgcgttgttggcggatattagtggtggcacttggggcgtggcaaggaatttctgcatctttcttacgaaagacagagccttgctgacgtaggcggcaatctctcttctttcttctgacagattacgcaccggatggtgctgcaactcgatttcgatgtaggcaagcgcgatgacggtaaggttcatgtccatgccgccgttgcacagttctattacttgggtggcgaaagccgtgtatgctttttccatattgcagtctccggcttcgtttatccggcggaagaactcggtttccgccaataaaaaataattcatgtcctgtcaattttgaaattttacactctgttttcggtatgcgcacatgaatataattggcaaaaaacgcggcagaaaacaaaaaatccaacgctcaattttacaaagtgttgtatttcagtggtataaaattcaatattttttcacagggacaaattatctccgacttaaattgtttgtaatcagaacatttattctattcttgaaaataaaaatgtatgcttgccgcacattttggctatcttgcttttttatcaaggatgtagataatgcggcatacaccgttgggaaaacttttcaaagaggaaagcgtccagtgttgctctggcagagccgacttaaaaaaatgtcgtccgcttccggatatgaaaggaacggtgtatagtatgatttcatccacagcgtgcatacgcagtagtccgtttatatagtctgccgtgtccggtgtggcttccgcgaggtaacggatgtttgtgccgtcttttctccattcgtgcagcattgaaatggaatagtctggtgtcacgcggtaaagggcgttcttcctgatttcatcaagaccgcaacggtcaaggcacaaatcctgatgtgctttataatataactctgaagaaagacatccgtccatcgtcagtacggcgagaatctgaactttacccataatcgttacctttcattaggcaagggcaaaaaagtagcgtgcaattcacactaccttcaagcgatggctctggtaaagcctttacggagagtacgtgaatgcacgctatgcgtaagcatagcataagcatcacgcaatcgtctccgtagttccaatttaccagattttcgcttgaaacgccttgcggtcttatcctatatgttggcggcgaaaagctcctgccaatcgccgtttttctcaaatgttatgcaaagatagccaaattcagtgaattacaggctatgattgcttgaatttatatttaagtccatactcttcaagtttgctgtatagtgttgtcctgcctattccgagcagttcggcggcgacactccggttgccgtttgcctgtttcaacgcacgcaatatccgctccttatcctccgcgtcattgcgcagggcgaagttgacagtagaggtcggtttcgtcacggcaagttccagatgctctttcatgacaacaccttcctgcgcctgcaatacagcacccataactttctgccgaagttcccgcacgttgcccggccatgcgtgtgtcagcaacgctttacgtgcttcggaactgaacccgctcacgctacactccagctctctgtttgccatatcacggaagaactctgccagcggcatgatgtcttcctgacagtcacgcaacggaggaacggttatcccgaagtcgtgcaggcggtacagaagatcctgccgaaaacgcttttcactcactgccgcttccagatcctcgttggtggcggcgatgatgcggacattgaaactcctgtctgccttgtctccgaccgggcgataccgcctctcctgtatggcctaccctttatacacaagtatatattattttttttatctttgcttgatgttattagagacagatcaaattcgtgatcctcggcttttgcggcgtttaaacttaatttgctctcagatggttgtccat

SEQ ID NO: 55 - DNA, 48011 bp, Bacteroides thetaiotaomicron
caatcatacttagttttattgttgattgtaataagtttctatctctactggcatttatttcattatctttccatacaaaaagaaagaaatttcctcaaagaagagaaccagtattttatagattctttccaaagtattcgaaatccaattaccttagtccatgttcctttacgaacgatctgtagtgacacctgtcccgagaatatgaagaatgatttattactagctattcggaatatagaatgcttaaatgagaatctggacagattgtccggattgaaatatttgcataatcatcccgaagccatggacattaccgaacatgaattaggaagctatgtaagaagcagaattcaatccctacaaggctatgcaacgaataaacacataaaactaatcatcaatacaaacttcacctatgccagtgtatggtttgacaaaagcaaagtctcaccaattatcgataaattcataactaatgcaatcgactgttccaaaccaaaaacaaacattacattactgatttctatcagtcaggaacattgggaaataagtgtacccgattcaggagatggtaaactgacaaagctttataatcaaaataaacatcggttgatgagacagacaacagaatttgaatgcgattttgcaaaaagcatattatataagaaactaacgaatttgtgtaatggaaaaatcatagtaaacagtacatatcatactgtcacattaaagtttccagtaaaatgctcttgtaaaaaccaattaaatcattcggcattgagtatcaccaatcatactgagattgaaaagatagatcgtttgctttcaaaggctccctgtaaaagaagttctcacaagccgacagtcgtacttgccgacagtaatgatgatttccgatcctatctgacaagttgtttaacggaagagtttactattaaaagttttagagatggcatcgaagcgatggcttacataaaaaatgaatatcctgatttagtgatttgtgatacagaacttcaaaacatggatggtgtcgaactctcatcaagattgaaaacatcttgcgaaacatcaatcatacctatcatactttatagttcgcatatagatattaaccagcacaatagaagaaagacttctttagccgatacattcttgcaacagccctttagtgtaacagatttaaagcttgaaatgtcaatccttatcaaaaacactcgttttcttcgaaaatcattcttacaacgattatttggagaagagtttttggagacaaaagcgtcagaaatattgcaggatggtaaacaccctttgataagtaaagttactaaaatcattctggaaaatctgaataatgaaaaactaaccatagactccattgccaaagagcttggaattagccggacaagtctttacaacaagtggacgcaattaacaggcgaagcacttaacaaattcattctcaaaatccgaatggaaaaagcgcatgaaatgttaaagagtggaaaatatcgcgtaaacgaagtcccagagaaaatcggaatgaaagatatggataacttccgcgaaaaatataagaagtatttcggaaagacaccagttgatactattaaaaacgtttgaagtatttatattgaaaagcagttttaaataaaacaacctgagaccgatagaagaattgttgacgcaatcaaccaaacttctttttatcgggctcaggtacctttccgacacgctattcctgaacgaatttgcctatatagaaattctcatcttcattgaccggtgtgtaataaggaacccaaaaattaaggaaaccataacgaacctcttcattagggaaagccaaacgataaagttgaaattctttgtcatagtccttgataatcagctaacctctctgataaatcaatggaagcggattgttggcatccacccgatattctataaataaaattacccaaagcctgcaacagaggtttatcgtattcatccaccaataccactactccgcaaccagactgctcattggcacaacgaataatatagctgaatcgttcctccggactacgatcttttttctcatctccatatataactttcgattttaatatagttcatcaatcaatgcttattgcatatctcttcatccacctatatccgccgcattaaccatagaaaaggaaatcgaagtggaaatgagagcggaactctatgaatttctgctggagaataaattcaaaaacggaatcatgttcaaacgctcaatagagctttttgtggaacattataatatggaaggtacagtgaaggaagatagcctgatgagggcttttaagaggtggaggaaggcgatgaaagataatagaaaatactaatacatctaaaaaaggggctgtccgattttggacagccccacacaaaaataagtcttatatttaggctgcactaataaagctacctaaatctttatatatttcctctattttaacaaacgactatcagggaactatctgtccgattcatcatctctccaatgttcaggtttgttcaactcatccgaacacctgatctttcctttatccacatcaaatcccttcggactgattgcctgaaccatccaataatccgagaactgttccagtatcgggtaaggagcaggataacccagcctggctgcatccggtataaaaccatattctggataatattctttatgccccaatacaaacacaaggcacgaacctttttcctgtaacctctctatgcctgcccgtatcagcattccgcctataccctgccgttgatattccggcttgacagctaaaggtgcaagaatgtgcatcatctgtagtgctccctgaccatcaaaataggctctggtgaagagaatgtgtccgacagcctcacctttgtagaaagcgagcaacgaaaccattggttctgcggttttgtcagccagcaggtcggctaccaactgtgcttctttgtcatagccaaacgcttgtttttcaacagtcattatgctgtcgaaatcatctgtattggtctctctaatttgtatattaattgaatttatcatttcattgtttttttgagcatgtatatcttgcagatagttattatccgccttatagacatgcgattatacttattatatagaatatgaaaataactctgacaagaatatgccagagtatgaattaagggataaccttgacagactgccaaaggttatttacttcacggactccttcttagctttacacatagaccgcaaaggtaatgctttctattgcattatgctatagtttgcagcgaaaactatccatcaattttacttttttattgatagaaactacttttatttcattctctcccggctgcaactccacatttttccattccaaaatagcatactgatccggcattgccttaccatagctttttccattgacaaacagttccgccccgggctgattagtgaatgcagtaatcgtttgcagacgtcgggaacgtacggtgttacgttttccggccagataaagcacaggttcttccttgttccagttagccttataaaagtagaacgcgtctttacgtactttccggtcaaaggtaaccagccccttatcattaattcccggacgatcaccttccgtacggtgagccgcaccgaaatcaaacatattccatacaaagctaccccatatataaggacgggcagaaatcgctttccagttctctatatgataataggtctgccagttctccggatgccaccaactgtttggcacggattttaccaacgaatcctgctgatgataaatgctggcaccggcaccatactcactaatggcaatacgaatttccggatgatctctatgcataccgtccagccagcgtcctaaatcggccggggtgcctccataccatccgtcgtaccgattccatgcaatggcatccgttatgaaattcaagtcacccatttgattacttgccgaagtggtagggcgggtagtatcttcctgatgcgccagctcatttaattccttgatatattccaccggattatcaccgaattcaagcagttcattgaacagcccccatacacagatggaaggatgattaaaatgttggcggatcagctccttcagctgttctttcccattagcacggaaagaaggcagattaacaaatcctttatcatcatatcctccgggaccgataaaaggtatttctgcccagacaataatcccattcttatccatcagatcatagaaataggtagcttgcggataatgtgccagccgaaccgcattcactcccatttccagcatcagggctgcatcttcttcatgatgctgaggacgtaaagcattacccacctcactcctgtcctgatgccggcaaacaccgtgaagaggcagatgcttaccattcaaaaagaatcccttatccggatcaatccgataataacgaaatcctaaaggctgcgtcacacaatctaccagctgccctcctctcgacagagaaacctccgcctgataaagaaacgggtcctgacggccattccacagatgaggattatttatctcaaatgtaagttcctgctgcaaagctgcattcccggcaagagtaagtgtctgtttctgttgcgccaccactttctgaccatccagcaaacggatacccagttctacttcctgaccggcattattgccatttgccaaatcaacgaccgcccttattttcgcatattgatgactgacactatcctgtatcagacgaactcccggagaagcataattcaaaggagaaatacatgcctcatcagtgatcagcagatgcacatccctgtaaataccgccataaaaattaaagtcacccaccaaaggcatcacgtccagttgttctccattattcacccgcactaatatagagttctcttttccataattcacctctccggttatttcaaagacaaaagctccgtatcctccacgatgttcaccgatatgacggcgattgataaatacatctgctatactgttcgccccttcgaaacgaaggaaaagacgcttgccttgccattcgggacgaatgaacagtttcttttcataattaccgattccccgtttatagtcgatctttccggacaaagcatcctgtgtattccaggtatggggcagatctactcttatttccgaccctttctgcacctgatgcgagaatcggaacttccagttgtcgtttaataaaatatcctgccgctgagcaaatagcggcatactgcaaaacagaaataaagcaactgccatcaaacggcagcatgacataattggtgttctcatattatttttttaatgatgatttcttcactttgataaaagaagagagtgattcaactttactcttatattttttctcattgactctatttttgttttcttctttatctatccgatgatcgaacagcatacttgctttcttcacgtcacctttcatccattcggcataactaaaacgttgatcaaccgcattgtctcccccttcccactgaatatagacttcatccttcgtcttagccttcagattgctgaaaacttttgcaaagctctgtccatccaactgttctgctggttgtggtatctggcataactcgcacaaagtaggatacaaatctacaaactcaaccatcgaccgggtctttccttttttcattccgggcacacggataatcaacggcacatgagtagaacggtccatcagattatgtttacccacaaaatcatgttcgcccagattccagccatgatctcctagcagtaccacaatcgtattctccgccagacctaactcatccagagcatccagcacttttccgatttgtgcatccacgtagctcaggcaagcataatatccatgcttcacttcccgctgaaaatcggcatcccccgtatcagtcacccgtgcataagcatatatctcactcgaattacggacttgttccggcaagccttccggtctgaaacggttggaagccaaaggtatctcttcccgcttatacaaatcccaatatttcttcggagcattaaacggcaaatgaggtttccaaaatccgcaagccaggaaaaacggcttgttcatttctttcatacgccgcaggtcacgaatggcacgttccgccaattttccgtcatcgtatgccgtatccggaacatccgctgactcgcaaaacggtccgcgcatagtcttgggattgatcgtcttgcccgattctgagttcatccaaagttcccatttattatattccgcccaatagacatcgtatccatccggatgattccggtagggaggttcgctccacgatgcggcatgatcgctcatgtggtgaaaaactttgccatccgaaactgtatgataaccattctttgtgaaccatccggaaagaggtatagcctccggacaatccttgctggcataagccgagaaattcacaaaacgatcgggatagtgaggatatacgcctgtcagaaggctggcacgggaagcgccactcaccggaacattgcaataagcgttctgaaacaagactccgctcgatgccagacgatccatattcggagtcttgaccgcctccactccgtaacaacccagttcgggacgcatatcgtcagccatcagaaaaagaacattcattctggaaacatcggagacattgtgctgcgcctgcacagcagaggccatacagcaagctgtcccgcaaagaagggtatattttaccgaaatagcgttcttcattttatagtttaaattttcaagacctgcaatatacaaaatattacaggtcttgcctctgtttttactcaaaaaattatttagtccataccggattctgttccagattcgtattcagtgccagttgcttcagaggcagcggatacaggtaataatgttcctgccatccgagcggagcgtcaaagaagtaaacatacccttcgtcattactcggtccgccggttactttcagatttttagccgaagctcccgtcacatatactcccaacgggcgtttattgacatagtctccttttttccatctgcgaaggtcatccagacggaatccttcccccatcagttccacacgtctctccctgcgtacctcccacagaagagcaggaacggaaggatcacgggtcgtatcaaaatcatctgtaatgtcttcgaccgtcattttcgctacatgtccgcgtgcacgaagtttattaatggatttatcggcagccgtctgatcaaacttacctaattcgcacatggcttcggcataattcaccattacctctcctacacggaacaaaggcgcatctgtcgtattcactccgttggcattggtagctacggtatgcgtattatagtacttccatacccagaatcccatttgagaagcattccagccctgtccccagttctgattcttgaagtgcggctgcccctgcaccgtgaatcctttgaagttggaagacggcaaacgatgataagtctcaccggagattgtagcaagaagatctataaactctctgtcctgcgcatgatccgtatatttccagtcggccgtgctcggaccattttctttctttaccatatagggaggacatatcgtcagatacaaccggtaatcacggtcgcggaactgtccataaatctccttatcaccgccataccgactggtggtagtacttaccggacgaccatccgtacacagataactgtctaccgcatcctttgtcgcctcaatataagattcaccggtacgcaccatacgtgtcagaccatgcatcaactgaccggtttcataggctttatacaagataatgcccgttaccccatccaaagattccgaattgaaaagctcgtcataccgtggatgcacattcggataaaccttcaagacttcttccgacgcacgtacacattctttcaagtaagtctcggcatcagacaatccatgatatttccgccaagtaccctcgaacaaagcaaaacgggaaataagtgcctgcaccacagatataccaatggtgtttttgccatcgtccgcaccgatatgtgtctccgcatatttcaggttggacaggatattcgaagccaccagatcgcgactatcccgtttgccgtacagttccggactgtcttctttcaacgcattctccacccaagggatatctccaaagcgggaaagcatctgaaagtatttatatgaacggaagaaatagccgacactgcgccagtgctccttctccgtatcattcatctgcgaaccatcgatattgtccagcatcagatttacccggcggatatagtcgtaatcccattccttgacttcatctgttgccttcgccttctggtatgcccactgcccttcatatccggacaaacctttgatcatattgtccgactcaaaatctccgcggaatatttcgtccgtctgccccgtatcatacgtatatccgaagaatacattatataatccccatgcatacgttttgaagttatcataggtagtaaagactgtcgcttccgtctgttgtcctttcggataaacttccagaaaagagtcattcaaacaagacgacatcagcaaacagagactaatgcccgtacccagtatatatttcttcataacaattactcttttaaatagtgaaacaatcagaatgaaaggttgataccaaacgaatactgccgcatatacggataggtaaaaccgcgttgtcccaagtcatccgttaccgaacgttccggatcgagtcctttcggcaaatgatcgaatgtataaagattctcaccgctaaagaagacagccagattattgacaccgatcttagtcatccacttggacgggaaattataagataaggtgatgttccggatactcaggtaggaaccatcctgcagataacgggtctgaatacgtgtattggcagctgtatttccggcagctttctcatacagacgggggaaatagctgtctgtgcgctccggcgtccagtaattcagttgtgtgtcatataccgtcgtccatgcgtcatagtgcggatagaacaagtcattcataatccacaaatcacgtttgcctactccctgcaacaggaaagataaagagacccccttccagtttgcaccaccgtggatgccatactgataacgacgggtactattaccgatgatcttacggtcgcccggatctttcgtcgtacttgtacctccgttgataatatcgttgtcatccagatctttatacaggatatcacccggattcggattgtagccttccacttttggaatgcctgctttcagcttgccatcggcatcaaaatcatcaacagtatacaggcggtcggtaacatacccccagatttcacccagttccatacctacacggtaagtatctttatcgttcttatccttgccgaagagacctgtctcgttattatacttggtaatcttggttttagcatcataaaggttgaagcccagattgtatttcacttttccgatctgatcattccagtctacagtgatctcccatcctttggaacgaagatcggcagtattctgcaaaggagcacttgcacccagcacagccggtaattccgctcccggagcgagcatacctttcgtatcacgacgataccagtcgaatacaagattcagcctgttgttcaataaacccagatcaaaaccgacatcgacagtcgtcactttttcccaggtaaaactgttactgaccaatgcagctggtttaagggtagttaccttgatacccgaaacggtccagtaagcctgctcggcatccatacccggaatataagcgtatggagtgatactctgattgccgatattaccccacgaagcacgcaattttaagttagacaatacggatgtcaacggtttcataaacgcttcttcgctcacacgccatccggcagagacagaaggaaagaaaccgaagcgactgtctttcggaaatttggaagagccgtcatagcgtccgttcgtttcaatcagatatttgccggcaaaggagtagttgatacgatagaataatcctcttactgtatagcgttcgaatttatctttagcgaaataatctcctgtagcctgcgatatagaaggaaggtcttcgttaatcatgttcatacgcgacatttccgcatagcgatagtcactgctctcctgattgaaacctcccatcacggtgacttcatgcttgccccatgtgttattgtagtttccgtagaagttcaaggcattataatcggtaatgccgttggagttttcatacttagagtttgccgtcgaagtctctttcacaaagttacctccgtgggcataatagaacttcttttcaaacttggtcttttcattactcagatggttgtatgtatattcacccaccagtttgacgttcttcaaaggagtaatcgtcacctttccgaagatacggatattgtttttctggatagtcgtcggataagcaagattaatcagattccggggagtattgatcggtagttcttctccgtcgatattcattgttccgatagggaaataagacgggaaggcaacggctgctccccagattccatatcctcccgaagtctccggcaattctgatttcgagttcgtgtatttgatatccagttccggagtaatccatgagaatacgtccgaacggatataagaagacacattgtaacgtttatacgcatccttgtccgaggccagcactccattctcatcgaccataccgaaagagaaacgataagatatatctttcgtgccgccacctacagaaagattgtgcgtctgctggaaaccggtctccatcatatcatcaaacagattggtttctgccagactatagcgcaatccgtccaccattgcatacccatcgggataagccgaaggattggcattgtattctttcaataaatccagccacgtatccacattctgtccactctgatagttgatggttcccatgtctttataagcctgcaccgtctgaagcggtgttgccttacgaggcatattggcaggtctgctaaatgagaaattgttagaataattaatagaaagcctggttgaatccgatcctttctttgtcgtaatcagaatgacgccaaatgcggcacgtgccccgtagatagccgaagaagcagcatctttcaagaccgttactgattcaatatcattcggatcgagcatattgatatccatttctacgttatccaccagaaccaacggtttgccattcttatccagactgttgacaccacggatattgaaactcatttcctctcccggcctaccggagttacccgtaatctgcaaaccgggcatcgcacctttcaaggcatcgctgaccgacactaccggacggtctcccaatacttcatccatcttcacactgcttaccgcaccggtcagattcgctttcttctgtacaccgtagcctactaccaccacttcgtcaatcagacggctgtcttctttcagagcaatgtgcaaaggagtctgatttttgacaacgacttcctgcgtagcatatccgatataagacacggataatcgtgcattcggagtcaccgacagagaaaagtttccatccatatccgtaatcgtaccttccgtagaattcagcactttcacattggcaccaatcactccttcacccgaaggatcggtcactttgcctttcaggacaaacgcttttccctgttccttttcaggcactgcggcatggaatatgaccacccggtttccgttcacttcataactgatccccgtaccagtcagcagttgggccatcacgtcattaattgtacccttgtccacgttcacagagactttcttattcaggtcaatgtcgttattgcgaatcagaaaagaataatttccctgcttcctgactacttcaatggcttctttcaaagtaacgttatctgctttgacactgaacttcttgttttgttcctgtgctgaaagttgaaaacctgtcaggacattacttagggacaaaagcagaaacatcaataatgtttttcttattatcaatctcatttttatcactattaaaggttaacatatagttatttatcgtagctgcggactgccggtatatctatcggctgtgtccattttctttctccttccttttatcttaccccctttcttttatcggtaataaagatggtgtcaccactgactttccacgtgtattgtttctcaacgttgatttcgtgtaatatatcataaatattctgattgctgtcgaaagaaccggagaagtgttcggccttcagacgttcgctttctatgctgatcttcacctggaatttacgttccagacgatgggcaatatcagcgaatgaagcattctcgaaggtcaacccgccatccagccaatcgcaggctttacttgcattggtcttcagcttttccattcgtccggtgttcttgttatacagtgcctgctcattcgggaataatttcatcacagaattagcagacgccgataaattcaccctgccttccagcagagacaccatcacataattatcgtcatcataagcacggacattgaataccgtgccgactacctgcacctgcacatcgttcgtcttcacgaagaagggaacctctgcatttttcgcaactttaaagtatccttcgccatccaacgtcacattacgttcgcggataccaaacccacggtgatagcgcaatacagaacctgcattcagagaaacctccgtcccgtcaggaagaacgatattcgttcttgatccggcaggaaccttgatttcgtaaggagaatcggcgttggtatatacttccgtcagattttccgtatacgtataccagaaatagttgcagccgatcagcagaataacggcggcagccactttcagccagacaggtatcagtttccggacaggcttcgaagaggcaggagcagtcattctctcctttatccgcactaaattggagttttctatttctgcaaacgacggtacggaagaaagtgcccatacggcagacatttcccggaaagtccgggcagctgcttcattggaagccagaaaggcaagcaacgtttctttttcttcatcggtactattgcccgacaaataattactaatctgtaattccagttcttctttatcgtaatattctatcataaaccgttctttttctatggtgtatataactagatacgcaataaaaaaagaaacgtttaaaagaaaaccgttttttttaaagaaacatcaaaatagctatcatatagggagtaccaagggattcgcgcaatttagtcagcgcaattttcatctgcaccctgacggtggcgacattaatattctgctcttccgcaatttcgctgtacgatttgccttcatacaggctcgccttaaaaacagcacggcatttggcagggagttcctctactttccgcagaatgatctcgttcatttcactgctttccaatgcctgcaatggattgtcggaagaaagaatatgattttctagaaaagcccatatttcctccatctgttcggtcattatgcgctcattaaaagcggaagaccgcaaataactgatacttgcattctgtatagcccgacgaagatacggaagggcaggataagtgatatggtggcgattctgccagaaagagacgaagacatcattgactatttcaccggcgactctcttgtcatgtacatagtaaacagctatcgcacacaggtataaatagtacgtatgataaattttatcaaatgctttggtgctaccgtgattcagttgttcgattagtttttcagagacttctggtaaattcattcgttctttttctttaagggacgggtgcaaatatagcgattaattcagaaactcaaaattccggttattaaaaccggaactttgaatcgtgaattataaccccatcggtatcttcaacagataccatacgataaacagcaatgtccatgctgccagaatgcacaaggagtacctccatgtatatttcagcaacgatccgtatgtgatctgtttgtcatattgccgcatatacgtcaacaccagcggcatatagaataagaaaggagtaatggcattcgtcgaactgtctccgatacgaaaagcacactgcgtgacgtccggcgaaatccccatctgcgcaaacatcgggatgaagatgaaagacataaatgcccatttggaagtggcggataccataatcagattgataaatgccgtaaacaggataaacaagatgagtgcggacaaaggagccggctcaaaagaagaaagcaggtccgctcccataatcgcaagacacttgtccaaatgagaatactcgaaacaggcaaacatctgggcagcaaaaaaagcaataacgaaatacacacccagcagtttgatcggctgggtaagtccttcgatcacatcattatcgctgcgataacgaccggaactgaacccataagccatccccgtaaagcctgcgcccagagatagcagaaacaggataccggcaatgaagggcgaatgcatcaaacctccgttaacgccacgcaggataccataggaagagaaagtaagccacaaaataagggcaacgtatatccctgccactacgacagccaccatcagcgcacgacgttctttccgtgacaaagggcggtaggcttcgactttcacacttccctcatattttcctaagttcgggagaagccatttctgagtcacccaataaacgatccctgtaattaccactgtcgaagcgctcataaagaagtagttgcacagcggctccgtgtttccctgatatcccatcagtgtgagcgcggcttcctgagtggtatgcgccaagagcgggtccatcgtactcagtacgatattggcactatatccgcaggccacggaaacgtaagccgtcacaatccccgctatcggatgaagtcccacccactgaaacagcatggcggcaatgggaagcagaataatataaccgccgtcaccaatgacgttcgacagcaatccgaggacaatcacccacaggataacttttcttttctctttccggtttcccactcccagacggatgcacgcatcgataaatccggaatgttgggccacacccagtccgaacatggcgataatcaccatgccaagcggagcaaaaccggtaaaattcttgatagcattccgcaaccaccagcgaattccctcaggactcagcaggctttgcacccgaatatcctcccctgattgcggcagcgttactttcagtccgtagatatcacatatccacgaaagaaagaccaccgccattgtcagcagcaggaacatcgtagcgggatgcggcatacgccatttactcttcatcagcttccagattatccagatcgataatgcgcaattccaatgcacggacagccagacgggtcgcgttcactcccacccgttctccattcgggaagagacgtccgatcaggtcattctgtcgtttctccagtgatttcacgccaaatggcatccctttcaggttggcaatcatatctttggtgtagcctaatgccagatggcgaagaaaacgctcgtcatattcatcaatatcatagttgattaccgcttcctgacgcttggcatcattcgctaccgactttttgaaacgatctacgatcttctccagaatcggatagttgaataccagcttcttgccgtccatcacagcttgtacgtctgtcttggtcagcaattctcctgttttgagaataatgccatccgctcctgcattcagcacatccacccacagtttttcattcagtatttcccccgtaaagatcaatacacgaacccccttataacgtttgaaaatattccggcagatatcaacgccaatcgtcgtagaacctcccagtcccaaatccagcaaaaccagatcgggaagctgtgcttccatcaacggccagaactcgctttctgtcattgccgtgccgatcacttctgcgttgggtatctcatgacggaaaatttcttctgtgcctttcaattccagttttacgtcctctacaataataactttaaacttctgttcttccattttatttatctaataacttttatgtgtcttcttctttatctgcgtgggatggtgaagtaaaccgtaaatcctcccccttctgccggttcggcattgatacggcatcccctgcgccccgcaaattcatcatggtcacggattatctgcttgcatatcagatattccgttccacgcaattctcctttttcaccggaagtcatacgagccaaattcggatagaacaactggttcagctccgtcacactcttctcgcgtctggtatccgtaaaaaggaaacggatatattcgttatccttacgagcctgcaagcgtatcactccttcttcacgaaccgccaatgcttcatcaatcagattctcaaacaggaaacgcaactgattcacgtcaccgatcactttggcgtccatcggttctatgattagttctaccttttccgtccgatttttcgtgaccttcctgaagtattttccagcagcatcaaaaagctcctgtaccggaatcgtattccggcggaaagtaacctcctccagctgtcgggcagcgcatgaactcagaatcgtaaagatccctttataatattctatcagttctgtaatcgtttccacagcttcccgttcatccttttccggaaggttctgcgtattcaaccgaccaataatctgtttaatcttgttcggataataaattgtctcatgtttaatcgttgaaaggcagttatcaagcaccatgttctgcacatgaagcatactgtcttcccacgaagcacggcgtgtttcctcgtgtgccgactcgatatcccggtattgcgtggcaagctttaccactgcattgaacaccacaatcgatacataacgtgctaccagctcaaaaagaagatgatccgtttcctgttgcgttccttccctccgttccagataaagcacacctacacattgatgctcacctccggcttccaccatcaacggaatcgcctgcaaattctgttctgagagatattcccctgtttcaaaacattgctgcaccatttccggcatttcctgcccgggacaggaagcatattccagccgatgcgtggtttcgttataaacagcaatgcccatcaggctgattgtcaacaactcatttactgagccaaaagcctcattcacgatgcgctgcggaatctctttaagtgtattttcctctctctgaagcgcttcctcgttctcctgagtctgaggtctgaccaaagaggcggcaaaaactttctgatttatctcaagcacctgttccaggttcagacggttctgcaacatcttcctcatatacaagagataatagccgatcagagaaacgatcagcaagacgaaacagaggatgataccaaccgtcttattcgtgttggatcgttccaactgcctgcaatacccttccaaagtctggtcttctccctgtaccttatataaatctgtaaaagcagaattattataactgtaggcatcaatttgtttcaaagcaaggaatgctaccgccgcttcatttctgatatccaaaatcacatgatagtctgaatcaaaaagttcattccaccaaaacagttcggcaggggttccttttcccaccagtttcatgtatcgatgcggcttcggggtacgcgtatatttcttataatgctcattcagcgacatcattgccgaatctatatactgcaatgctatttcgtagttctcatccacattggcaaaataagcggcattggcataatcagaggctgcatcaagcagatcttcataagtagaatctgtagtaatcgcaatggagtcactatcctgcaatatcgacggaaggggttcatgcagacaagaagccattcccaacggaagcaacaggcagagcaacacgccaatcactttacgtactcctgaaggcaagcggaaataaaaacggcttccctttcccggttcgctttctatatcgaatacgcatacccggaacagttcattcgttttcttatatttctctatgattcccttgcagttcatcaagccaaaaccgcttcccttattctctttcagttcttccggatctgccgcgtctttcatgccgatagcacgcgaatcatataccttttcaccaatgatatgcgcgatatcttctgctgaaagtcctctcccattatcttctacggagatttccacatacgcatcggtagcatgcgcatatactttaaccgttcccccctcaggcgtatacttacgggcattttcagccagtgtattaatcataaacaaggtcaatgcacgatcggcctttaccatcagggtggtcggttcgatttccagcttttgctttttcatttcaaaagcacgccgtccttttcccagcaaatcaaacaattcattcagactgaatgtctcaatgttcagactaagcgtaccttgcttcatcttgatccaaagtgccagaatatcattgtattcgttgatggtagtcaccagttcatcaatgtactggtacttctctttctttatcttggtgtcatcaatatatcctttttccgtcaacttatgtacttcgttcagaatccggtcgatataaggattaatcccgttgacgatggccatacaagccttctttatcagattctgacgtttgtttcctgcaatatgctgctcgtagatataccgctgtttctccagctgatttcgctcgtcgctcaacgtagccaccatttgttcattttcagcagcccatacgatataaggttccactacatgcaccaatgccttctcgtcccggttcagtcgatgggaagaaggtaccagtgcagcttttccttcttccggaatttccagcgtcagacgtcctttcccgaacaactggtcaatgccttgctgaatcagaggtacgttcatcggtatggaagaagtgatatcccgacaaagagagagaatccgttgcagacgctccacatccacctgattcctgattttggaacgtttgttgaagaaccaccaaaggataatcaccagtaccaagccgacaataaccagaaaaagaacgaccgtcatctgtcgcgaacctgcttccaaagacaaataacggctttccaactccttatcctgacgggtaaagttcaaaatatccagatagatattccggttataatcagaagcatccttcatccccagcccggcatatgaaacgcttaactgctcccttatccgtgagatccattcgggaacggtcttcaccttctcctgtccaatccatggaactccggtataagtagtatctccctcggcaaacgtatataatttatcaagcgtatccacttcattatgataataaagcatgtgatgatggtttacgcagttcaatgcttttgataatgtatccaaagcttcctgataacgtccatgcgcattcaggtatttgccgatagatacataagctccggcaatctgatacaagtcattatattcgcgaaatttctccagtgccagttgggccaaacgcaaagggaacaaagaatctaccggaaaatcaaactgatccaacgcatgtgtacgccttgtcttgaaaaactcaaaattagacggggatgccatcagattggcaagtccctgcattccattcccctcaaaatacggatgcttgctcttcacggctgtccgccaagtgaaataaagttcgtcaaactcgcggagtttccgttcttccggagtattcgctgcgaccaaagaagccgatcctttgagataatgataataaagaagctgattggtatcgctcaacgcttcgtcttcctgaatattatcgatagaggttatcgcttcctgccgttgctggagatagtaatagtaaatggaggaaacgagaaaaaattcggtaaatgcgtaatccagccgaagcgcttcgtgacggtcggcaaagaggtcgctctcttcacggatacgcttcatccgtcggagggcactgttccggtaatcataaaattctttgttgagcgctgtccgctggcagattttcatcagtccgatgtctgctatcaacagttcaagctcatttttagtcagcttgtatacctctttatgatacgcctcggcacggtcgaaatccatattcatgaaagcacagaaccccagattattggaagcttccgctttccccgacttatataggtttacttgccgatatgctttataggcgtatttgtaggaagagtccagattacggtaacgataagcatacgcttttccattcagcgagtcgataagcctcacttcttttgtgggcaccatgtcggtacacgaaaaaagggaggaaagcaacaatactcctattatatataatggagaatggaaaatggaaaatggagaataaaaagacaggcgataactatctttcattcttcgctcttcattttctgtttttcgtccataattcttcattcttcattctcagttcttcgttcttacttgcaaatctacaaatatttccgataagttggagagaaaattattttttctacaataagtctttctaaataataagagaaattcctacctttgcaggcaaattaacaaataggtaacatctattacaaaatgagcgaaaaagcaccctttatggtattctcgggaactaactcgagatatcttgcagagaaaatctgcgcaagtctcaattgtcctctgggaaacatgaacatcacccactttgcagatggtgagtttgccgtttcttacgaagaatcaattcgtggcgcacatgtattccttgtgcagtctactttccctaactcagacaacttaatggaacttctcctgatgatcgacgccgccaaacgtgcatctgcaaagagcgtcgtagctgttatcccctatttcggatgggcacgtcaggacagaaaagacaaacctcgtgtatctatcggagctaaattggtagccgacctgctttcagtagcaggtatcgaccgactgattaccatggatttgcatgcagaccagattcagggattcttcaatatccccgtagatcacctgtatgcatcagccgtattcctcccctatatccagtcattgaaactggaagacctggtgattgctacaccggacgtaggtggttcaaaacgcgccagcactttctccaaataccttggtgtacctttggtactctgcaacaagtcacgtgaaaaagccaatgaagtagcttccatgcaaatcatcggtgatgtgaaagacaaaaacgtagtattgatcgatgacatcgtagatacagcaggcaccatcaccaaagctgccaatatcatgatggaagccggagccaaatccgtacgcgctattgccagccactgtgtaatgtctgaccctgcttctttccgtgtgcaggaatccggattgactgaaatggtatttacagacagtatcccttacgctaagaaatgcgcgaaagtgaaacaactgagcatcgctgatatgtttgcagaaacaatcaagcgggtaatgaataacgagtccatcagttcacaatatatcatctaaatgaagaatgatgagtaaaggataagataaagaaagccggctaaacttgaatttagccggctttcttatttatctataattctttcttttaaagaagtcttcccattttataggttccttttttgatcacctttccgtctttatctgtttccacaaaagggccatctttctttccttgtttgaagaagccttcgaagcggttaccgtctttgtcgatctgaacgccttgtccgtcttccagtccgtctacgaaaccacctttatattgcataccggcaacggttttcagagagccctgaccgtgaggacgattatttttccagtctccttcgtaaacatccccgttactccatttatagatacctttgccttcgcgtttattgtttttccagtcaccttcatacacagcaccgtttgcccacgtgaaggtaccttttccatcctgcataccgtctttgaaatttcctacatatttatctccattggcatgatagtaaacgccttctccggtacgttctcccaaaagataagaaccttcgtagcgatctcccgtatggaaaaaataagtaccttttccatgctggatatcatctgcccagtcaccgtcatacttgtctccgttggtatattcgaatacgccttttccgtgacgtacatcatctttccagtcaccgtcgtacttgcagccatcgtcccagttcatggtacctttgccgttcttcttgtcattcttccagtgaccgctgtatttagcaccgttcgcccacgtataagtaccttcgccttcacgcttgtcgttcgcccagttgcccacgtataagtcgccattatgataatacatcgttccggcaccatgctgataatcctggaaccacattccgtcataacggttattattcataaaataatagattccttttccgtgttgctgatcctggaaccactgaccttcgtacttctctccatccggaaaagaatagattccgtagccttcacgttttcctttgatatattccccttcgtagacatccccatttttaaagaccgttttcccttttccgttcggtttgcgtcctttcatctctcctgtatagacgctaccatctttgaaagtataatttccgatttttatttctgtagagaatgtgtctttcaactttccgaagaacccacctttgctggtattgttatcttgtgccatcactcctccctgtgcaagaagagtcaaaaaaagtgtagtatatagatatttcctcattagttttactcgttactcattaaaattacagtttggacaaagatacaacttctctcccaaaaagtgccataccggaaagcaaattatgacaactttttaccagcaatgacctcttttaatgtctctttgcacaaatagcgctgtgccaattcctgtatttcctgaggtgtcacctcatttacagcctgcaaagaacgggagaaatactggtcatccagccccgaagtagcaataaaaatccacgcatccgccagcgagaaaggcgattcatagctccggcacatttcgcccagcatatagttgcgcaccatcgtcagttcttccataggaacaggctcccggtgtagtttgtctatctcattatatacttcctgtatcagcggttccacgtattcattatccgtttcggtcgagattcccagcaaaccgctatccggatagaacataattccggcagaaatcccataagtatatcctttctcttcacggatattagacatcagacggctgccaaagtatcctccgaacagcgtcatcagtacgcgtaatttcagatagtcaggattctgacgggtaatggtggtacatcccatcttcaccgcactttgcaaagcgtcttcacgctctatgaatattcgtttttcgggaacggcaacgaatgaaaatatcggttttgatgctttcagctgatattgtccgaaaggagtcccgaaagcaccggtcacccggcgaatgatatcttccgtcaccttacccgacaggaaaatggaacagttgcccgaatgataatgccgtccgtagaaatcacggagtacttccggtgtaatggcatgataatcctcctccactacaatttgcccgcatggatgctgtgtcccgtaaagcgcctgtaacaggccacggtgtgcaaggaagtctactttagaagtattgaccagatattgctggatattcgtatccaggatggtatgcagttctttctccggaaacacaggttccttaatcatggattccacgacttccagcgtttttgccagatacttgttcaacgagtagacagtgatataagcatactccgacgaactggacagttcgagccatgaaccataataatccagtttctctgcaatggttgccgccgtatacttctgcgtgccttcgcgtagcatccggtttgtaaacagcgcctgcaacttctgcgactgttgccagcgccctccggcaaaaagaatatccatacggaccacctcctgttcaccggcattgacaaccgtcaacgggacaccgttcggcaaagtagtccggacgggagaaaggatatggaaatttttcagggcttgtatttcaggttgtatcgtacgatccataaatcagcttctgttcttcaaaaattcttctgcatgtttcagatcctgcggtgtgtcgataccgatcgtttccacgtcactgatgcctacctttattttatatccattctccagccagcgcaactgttcgagtgattctgccaactccagagaggattgcggtagagcggtgatctccttcaatacttccgtgcgataagcgtacagaccgatatgtttgtaataggtatgtcccttcagccagtcttccttatcggcattgcgctgaaaaggtatgatggaacggctgaaataaagtgcgttccaattcttgttgagcaccactttcggggagttgacattctccagtacggcaaacggttcatcggctgtgaaaggcttcaccaacgtagcaatctgcgtggtagggtcttcgaaacaagcctttacagcattcagctgggaaggctggatgaaaggttcgtccccctgtatattgactaccacatcaaagtcgcccccgatctttgtgcacgcctcatagcagcggtcggtaccacttttatgatcaatggaagtcatgacaacttttcctccgaatgcttttacggcagcttcaatacgttcgtcatcggtagccacataagcatcatccaagatgcccgctacttgttcgtatacacgctgtatcaccgtcttcccccccagcatagccaatggtttcgcagggaaacgggtggatgcgtagcgggcaggtattattcccagaaatttcatatctgattgtattttaattcttctaatcctttcacaacatactctcttttcaggtcttccggcttcaacacccggtcatcgaaagagagcaaatcaatatccagactgactttttcttccttcttatcctccggacgacgcccggcggactgctcgatagctttcagctccttgcgcactctttcctcctccgcttccgagaagaacatcgccacctgattggagaacaatgccggacttctgaaaaacaaagggcgtgtctcctgttcagacgtaaagcggatggtaggaaacaaatccaccagtctcctgcgagccagaagaagattctctttccggttgtagttacttccgatacaaatgatacatttatgcacgatgagaggtttaattaaacaaatcgtccagtcccgtttcttcgaagacttctccgtccggtgtttccgaaccggcacaagggtcaaaaccttcgggcagtttaaacgtttccgtctggctgtatcccaaagtcgggtcatcgtagactttcttcatataagttgcccagataggcaatgcggcggcagccccttgtccataagtcattgtaccaaagtggatgtcacgttcatcacctcctacccagcaaccggacaccaatgatggagtaaagcccataaaccagctatccgagttatcattggtcgtacctgttttaccgcccatatcggccgtaattccgtaacggcgaacacgtccgcctgttccttcattgataacggaacgaagcattaccaacatcttgtatgcgctcgaaacactgataacttcttccatctgcggtgcaaacgtagaaagcacattgccgtcactatcttcaatgcgggtgacgaataacggagctacccgaatccccttattggcaaaagctgtatatgcgcttaccatttcaccgacagaaatttcgcagggacccaaacaaagtgaaacaacagggtcgatcgccttgtttcgtacaccaaaactatgaatcagccttacaaggttataaggattcagtttacccatcaggtaagccgaaatccagttatccgaattggccagtccccatttcagagtcaccatttcaccataacgtttattattggcgtttcggggagtccatgcctctcctgtttcggtaatcagcgtttgttctacatgacgcacctgatcacaaggtgaaaatccgttctccatcgccagtgtatacagatacggcttgatagtagaacctacctgacggcgtcccaccattgccatgtcatattggaaatatgtataattcggtcctccaacatacgccttcacatatccggtcatcgggtccatcgacatgaatcctgtacgcaggaagtgtttgtaatagcgaatagagtccatcggagtcataatcgtatccttctcacctgcccaggtgaaaacagacatttcctgaggagtatcgaatgctttgcgaatctcctgttcagaagcacccgctgacttcattacattataacgttcggtttgtttcatggctctggtcagcaattcttccacccgcgcctgcggcaatgcccttgcatacggggcgttcttacttccttgtttttctttaaagaacagaggttgcaagaagtcgcctaaatgttctttgatagcatcctcagcgtattgctgcatatgcgaattgatggtggtataaatcttcagaccatccgtgtagatattataattcgagccgtctttctttttatttttggcgcaccagccgtacagcggatttgtttcccatgaaagtgaatcttcataatacttctgcatctgccagccgcggtactcgctcttaaccggtttcttggcagtcatcacaccacgaagatattcgcggaaataggttgccagaccttctttatggtctacacgggtatatgcaagtttcagcggaagtgcctgcaaagaatcacattccgcatccgagatgtaaccggctttttccatctgacgcagtacgacgttacgacgtcccaatgcattctcacggattttcggatttcgggataccggattataacgggacggattctgacacattcccaccaacatcgctgcctgctctattttcaaatctttgggttcacagccgaaataagtagacgcggctgtctttataccgacagcattattcaggaagtcgaacttattaagatacattgtcagaatctcttctttcgtatagtaacgttccagttttacggcaatcacccattcgatcggtttctgcaacagacgctgcatagtattgcttgccaccttttccgtaaacaactgttttgccagctgttgtgagatcgtactacctccacccgcacttttctgcaacaataatccacgcttgacgatggcacggaaaagtgccttcgcatcaataccggaatgttcggcaaagcgaacatcctccgtcgcaatcagcgcatgaatgatgttgggagaaagatcggcatagctgctgtatacacgattatttttttccattgagaaggtacccagtactttcccgtcttccgagaatacctcagttgcaaatttataattgggattttccagttcttccacaggaggcatatagcctatccagcccttagagatagacacaaaaacaactacgatagctattaaagcaactgccaacaatacccaaagagcgtttattatttttcgaatcatgtttcttctagcttaaaaaagatgcttataattaagccgcaaaggtagataaaatatagcatacagcaaacgagtttttgatttatttgatattttaaaaccaaccgaaaaacgaataaaaagagaaaaaaagtttgtattttacattttcttcgtacctttacactccggtaaaacaagttctatccacataaaagataacaaaatggaaaacagaagtttagtaaccattgccgaacattctaaagaaaaaatcctctacatgctcgaaatggcgaagcagtttgaaatgaaccccaaccgccggttattgcaaggtaaggtagtagcaaccctgttcttcgaaccttccacccgtacccgtttgagtttcgaaacagcagccaatcgcctcggcgcacgcgtcatcggatttactgatccgaaagcaaccagctcctcaaaaggagaaacactcaaagacacgatcatgatggttagcagctatgcggatattatcgtcatgcgacactatctcgaaggagctgcccgatatgccagcgaagtagcacccgtacccatcgtcaatgcaggagacggagccaaccagcacccgtcacaaacgatgctcgacctctactccatctacaaaactcagggaacactggaaaacctgaacatctttctggtgggagacttgaaatacggacgcaccgtccactcactactgatggctatgcgtcacttcaatcctacattccacttcatcgcccccgatgaactgaaaatgccggaagaatataagctatactgcaaagagcatcagatcaaatacattgaacataccgaatttaccgaagaaattatcgctgatgccgacatcctgtacatgacccgtgtgcaacgcgaacgcttcaccgacctgatggaatacgaacgagtgaaaaatgtatatatcctgcgcaacaagatgctggagaacacccgtccgaacctccgcattctgcacccgctgccccgtgtcaacgagattgcttacgacgtggacaacaacccgaaagcatattatttccaacaggcgcaaaacggtctgtatgcccgtgaagccatcctttgcgacgtattaggtatcacattagaggacgttaaaaacgatattttattatgagcgaaaataaacaagcattgcaagtagctgccctgaaaaacgggacagtgattgaccatatcccatcagaaaaactctttactgtcgtacagctactgggcgtggagcaaatgaagtgtaacatcaccatcggcttcaacctcgacagcaaaaagctagggaaaaaaggcattatcaaaatcgccgacaagtttttctgcgacgaagaaatcaaccgcatatcggtagtagcaccttacgtaaaactgaacattatccgcgactatgaagtcgttgaaaagaaagaagtcagaatgccggacgaactgcacggcatcgtaaaatgcgccaatccgaaatgtatcacgaacaatgaacctatgcctacgttatttcatgtgatagacaaggataattgcatcgtgaagtgccattattgcgagaaagaacagaaacgcgaggaaatcaccatcctctagtttctccattcctcattcttaattttttattaaattgaaacaagactggaaaccgggaacgatgatctatccgctgcctgccatattggtgagttgcggaaaagatgaaagtgaatataatattataacagtagcatggacgggtacgatttgtacaaacccgcccatgtgctatatatccgtacgaccggaacgacactcctacgacatcatcaagaagaatatggagttcgtcatcaatctgacaactaaagacatggcgttccctaccgactggtgcggagtacgttcgggacggaattatcgtaaattcgaagagatgaaactcactccgggacgctgcaccgtagtcagcgcaccgctgatcgaagagtctcccctctgcatcgaatgtcgcgtgaaggaaattgtttcgctcggttcgcatgatatgtttatcgccgatgtggtaaacgtccgtgcagacgaccggaacctgaatcccgaaaccggcaagttcgaactggcggaagcgaacccgctggtatatgtgcacggaggatattacgacctgggagaaaaaatagggaaattcggctggagtgtagaaaagaagaaataaagaaaaaagtactgccatgaatatactgcgcaacataattcttttcggttggatggcgatagcttgcacagctttcgcccaagatcgtaacgcagataaagtggaacgtcccaacacaaagaaaatcaactttggtatcaaagccggatttaattcttccatgtttatggtatccgaattgaaaatcaaagacgtaacgatcgacgaagtacaaaataattataagatcggctattttggcgcgatcttcatgcgctttaatataaagaagcatttcattcagccggaagcatcctataatgtcagcaaaggcgagatcacctttgacaaactcggttcgcaacaccctgccatcgaacccgattatgcttcggtacagtccgtacttcacagtatcgacttccctattctctacggatataacgtagtgaaaaaaggaccatacggaatgtctatctttgccggtccaaaactccggtatctatggggaaagcagaacgaaatcactttcacaaacttcgaccagaaagggattcatgaaaagctgtatccgctcaatgtcagcgtcgtgatcggtgtcggcgtcaatatctcccgcatctttttcgacttccgctacgaacaggggataggaaatatctccaaatccatcgtttatgacaatatcaattcagacggcagcacgggagtcagccctatcattttccgccgccgcgacagcgcattaagtttctcgttcggattcattctttaaagaacatccgacagccggctgatgaacttttgatagtcggcaaccggcaaaaacagacacctcctattcattccgtacgataaattatccattatctattaatttcctccatttactaacatttttcttatagttccttcgttctttatttattttcactaactttgtgcgcttaaaataggtatctcgaattaaaaatttaatattacttataaaaagaatgaaaagagacgacttaattttcgacatcatcgaaaaagagcaccaacgtcagctgaaaggtatcgagctgattgcatctgaaaactttgtaagtgaccaggtaatgcaggcaatgggttcttgcctgactaacaagtacgcagaaggttatccgggcaaacgttactacggaggttgtgaagtagttgaccaaagcgaacaaatcgctatcgaccgcctgaaagaaatcttcggtgccgaatgggcaaacgtacaaccgcattcaggagcacaagccaatgcagccgtatttctggctgttttgaatccaggcgacaagtttatgggattaaacctcgcacacggcggacacctttctcacggttcattagtaaacacttccggcattatctacactccttgcgaatacaatctgaatcaggaaaccggccgtgtagactacgaccagatggaagaagttgctttgcgcgaaaagccgaaaatgattatcggcggcggctctgcttattcccgcgaatgggactacaaacgtatgcgtgaaatcgcagataaagtaggcgctatcctgatgatcgacatggctcaccctgcgggtctgatcgctgccggactgttggagaacccggttaaatatgcacacatcgtcacttcgactacacataaaacacttcgcggacctcgtggtggggtcatcatgatgggaaaagatttccctaatccttggggaaagaaaactccgaagggtgaaatcaaaatgatgtctcaattactggattcagctgtattcccaggtgtacagggcggaccgttggaacacgtaatcgctgccaaagccgtagctttcggtgaaatcctgcaaccggaatacaaggaatatgcaaaacaggttcagaagaatgctgccatactggcacaggccttgatagaccgtggttttacaatcgtttccggtggtacggacaatcactccatgctggttgacctgcgtagcaaataccctgatctgacaggtaaggtagcagaaaaagcattagtttctgctgacattaccgtgaataagaacatggttccgtttgacagccgttctgctttccaaacttccggtatccgtctgggtactcctgccatcacaacccgtggtgcgaaagaagacctgatgatcgaaattgccgaaatgatcgaaacagttctgtctaacgtggaaaatgaagaggtgatcgcacaagtacgtgcacgtgtcaatgagacaatgaagaaatatcctctttttgctgattaagatttctttctttgagtaaccaaatgccggtaatgtgaattagcagcatttgtgttcaacatttcataaagaatttcttttgaattttataagcctgctttctgtgaagaaaacaggcttttcttttttatttattaacagaatcagacaaactatctgctcgaaaagatgttttcttactacaaaaagagaaattgaaatacgcactatactcttccggaaagcagcgacttcaatcgtacagtgtatcagacaaggtcaacataccggtacactggactctatatacaatcatccccgtcttcccaaactatcagaagtggaaagacggggatttatattggatgattgacagtacagaaatatactaaatgaaatagtaaaaatcagctcagtccttcaatttcaccatctacaatgtcgatatgcaacgcttgcggttctttgggcaatcccggcatacgaaggatttctcctgcaatcgctacaatcatttcggcaccgttattaatcactatatccttgatatggaactcgaaattattcacggcgccataaatcttcggatcggcagaaaaagagtattgtgtcttggcaatacaaaccggataatgagtgattcccattttctcaatcagcttgatgcggttgcgggcgatgctgctgtacgtaatgacgctggctccataaaggttggtagccactttctcaatcttctgctgtatgctgtcttcttctttatacgtataacgcaaaggttcggacggattattttctatcgtatcgactacgaggcgggccatatctaccgctccatcaccaccgtcgctgaacgcattattgatggcgtaacctacccccaactgttcgcagtgctcgcgcagcatttccatttcctcgtccgtgtcggtggcaaacttattgaaagcaaccactaccgtctgtccgaaggagcgaagattacgaatatgtttatccagattgcgcaatccttctttcagtccttccatgttcggttccttgatgcggtcgagactgacaccaccgtgcatcttcagtccttgcgccgtagcgacaatcacagtcagtttgggctggagtccgcttttgcggcatttgatgttatagaacttttcagcaccgaggtctgcgccgaatccggcttccgtgatcacatagtcaccgaatgacattgccagtttggtggcaagaatagagttacagccatgagcgatattggcaaacggtccgccgtgtacgaaagcggcggtaccttcggtcgtttgcaccagattcggatggatggcgtctttcagcaataccgtgatagctcccgccactccgagatctttcaccgtaaaaggctggtcatcatatgtaaaaccaagcagaatattttcaatgcggcggcgcaagtcttccacatctttggaaaggcagagaatggccataatttccgaagccggagtaatatcgaagcctgactcctgcgtgatgccgttcgacttgggtccgagtccgactacgatgctgcgcaacgaacggtcgttcacgtcgagcacccgacgccagagaatttctttcaatccgaaacctttcgcctgattctgataaagataattatcgagcaaagcagaaatcatgttatgcgcggaagtaatcgcatgaaagtctcccgtaaaatgaaggttgatcttctccatcggaagcacctgtgcatatcccccacccgctgctcctcccttcataccgaagcaaggaccgagagacggctcgcgcaaagcgacaatcgccttctttccgattttgttcagtcccagggcgagaccgatagatactgtagttttgccgatacccgcctttgtcgctgtgatggcagttaccaggacaaggttacttttcttcactttctcctcgtcgatcagttgttcgggaatcttcgcgatgtagcgaccataattttcgacttcttcacgaggaattccgatgctttcggcaacttgcttgatctttttcaactcgacactgcgagctatttctatgtctgatttcatacagaatatgattagttttatttgaagtgacaaaagtataacaaaaaagcgaaactgagaaatttaagacgctctctcgtttacccgggacttccgcacaattaatttatatttttagaaactatgacgataacgtacttaacccactaaactctttttgcacaagaactgttgttatgaacataacctaaacaagaacaacatatatggaatggattattaatcaactcagggatcatcccgaacttgccattttcctcactttattcgccggcttctggctgggcagattcaaaataggaaaattttcgttgggaacagtaaccagcgtgctactggtcggagtactggtaggacaattaaacattagtgtagacggcccgatgaaagctgtctttttcctcctgtttttattcgctgtgggctataaggtaggtccgcaattctttcgcggattgaagaaagacggattgccgcaagtaggatttgccgtcctgatgtgcattgtcagcctcatcgccccatggatacttgccaaaatcatgggctaccatgtaggcgaggctgccggattgctggcaggctcacagaccatttccgcagtaatcggtgtggcaagcgacacgatcaatcaattaagcatcagcgatgcgcagaaagcgacatttatcaatgccatccccgtagcatacgctgtgacttatattttcggtacggcaggttccgcatggattctggcttcactcggtcccaaaatgctgggcggactggagaaggtgaaagcggactgcaaagagctggaagccaaaatgggaacttccgaagcagatgaacccggattttacaccgccctccgccccgtcgtattccgtgcttataaaatagataacgaatggttcggcaaaggaaaaacggtcagcgaactggagaactatctggtggaaaacgataaacggctgtttgtagaacgcgtacggcaaaagggcgtcatagaagaagtcaccccggatatgcttctacaaccgggcgatgaagtcgtattaagcggccgccgtgaatatgcaatcggcgaagaagactggatcggtccggaagtgatcgacgcccaactgctcgactttccggcagagacgcttccggtaatggtcacccaccgcacattcgcaggcgaaaaggtctccacgatccgtgcgctgaaattcatgcacggagtcagtatccgcagtatcaagcgagcaggcatcaatgttccggtactcgctcagacagtgatcgactccggcgatattctcgaactgaccggaacaaaactcgaagtagaaactgccgccaaacagatgggctatatcgatcgccccaccaaccagacagatatgatcttcgtgggactgggtatcctgctcggtggtctggtcggcgcacttgccattcacctgggaggtatcccgatcagcctgtccaccagtggaggtgccttgatcgcaggactcgtattcggctggctgcgcagcaaacatccgacctttggcggtatccccgaaccttcgttgtgggtattgaataatgtgggattgaatatgtttatcgctgttgtcggcatcgctgcaggacctagtttcgtgaccggtttcaaagaagtaggattcagcctgtttatcgtcggtgcactggcaaccgccatccctcttctcagcggactgctgatgggaagatatctgttcaagttccaccctgccctcacactgggatgtacagccggagcacgtaccacaaccgccgcactgggagctattcaggatgcattgggaagcgacactcccgcgttaggatacaccgtgacgtatgcagtcggtaatacactactgattatctggggagtagccatcgtattgctcatgtaaatgtcagtataatgaatgtataggaaatcaaaattaagtatcaaaacaataagaaccattatggaaaagaaaacaactggcacagttatcaccaagaactttgccaaaaagatggaaacgatcagccctttcgaacttaaaaacaagctcatcgaaatggctgacgagagtatcaagaaaatggcccataccatgctgaacgcaggacgaggcaacccgaactggattgcgaccgaaccgcgtgaagcattcttcctgttaggaaaattcggactttgcgaatgtcgccgtgtccaatccctggaagaaggaattgcaggcatcccacaacaggaaggaatagccgcccgcttcgaggctttcctcaaagagaacgagaaagaagccggagccaggttactgaaagaaacctataattatatgctgatggagcacgcagccgatccggacagactggttcatgaatgggcggaatcggtcatcggcgaccagtatcctgtccccgaccgtatcctgcacttcaccgaactgatcgtacaggattatctggcacaggaaatgtgcgaccgccgtccccctaaaggcacattcgaccttttcgctaccgaaggcggaacggctgccatgtgctatgtattcgattcattgcaggaaaactttctgttgaatcaaggggattccatcgccttgatgattcctgtcttcacgccctacatcgagattccggaattacgccgctatcagttcgatgttaccgaaatatctgccgatcagatgacaccggacgggctgcacacctggcaatataaagatgaagatatcgataagctgaagaatccgcagataaaagcgttgttcatcaccaatccgagcaatccgcccagttatgcgctgagtccggagactgccgcacgtattgtcaacatcgtaaagaatgacaatccgaatctgatgatcattacggacgatgtgtacggaacattcatacctcacttccgttcgttgatggcggaattgccgcataatacactctgcgtctattccttctccaagtatttcggagccacaggatggagaaatgcagtgatagccctacacgaagacaacatctacgacaaaatgattgcccgcctgtcggaggagcaaacagcaatcttaaacaagcgttatgcaagcctcagtttacaccccgagaagatgaagtttattgaccgcatggtagccgacagccggcagattgcgctgaaccataccgcaggactctcgctgccccagcaaatgcagatgagcctgttcgccgctttctcccttctcgacaaggaagaccggtacaaggcaaagatgcaggaaatcatccaccgtcgactgcatgcactctgggacagcaccggcttcacgttgatagaagacccgctgcgtgccggatattattcggaaatcgacatgctggtatgggcgaagaaattctacggtgatgaatttgcagactatctgcaaaagacctacaatccgctcgacgttgttttccgccttgccaacgagacttcgctcgtcctgctgaacggcggcggatttgccggaccgaaatggagtgtccgtgtttcgctcgccaatctgaacgaagccgattacgtaaaaataggacaaagtatcaagcgcgtactggatgagtatgcagaaaataggtaatacttattatttaaagcgggaagtatccacctcttcccgctttttctccttgtatcctccgaatttgtagttgaaggaaataccgaaggcacgggtagtcttcatatagtgattcttcacattctgttgtccgaaacggacattagtcgaaatggtggaagtattaaatatgtcgtcgcatttcaaggtcagttgtgcttttccctttgcgaaagtatagcgcagggccgcatccagatttcccgaacggggaaggtcgaaaatgccttgtatcgctttgttctgataaaatccgcttagggtaaacttcaaatcaggtttggtggagagagtgaaggtattgttcattgtcaatacaaacgtatatagtttgcggtcgaacgggatatcccagaaatcactgtctttctgacggtaacgaaagccgattgccgtgatgcgggagtccagccatttcttcactttaaagggaactaccattaccaagcccgcctgttccgagaagtcgaagttaaagcatttatatatctcgaccagacgttccggagactggtaaagcgtctgcatttccttgtttttcgtgcggctgtaataggcggtcagcacatatttaccttttaatatatagctaatgttagcttcgtaattggttgccggtttaaggaagggatttccctgaatttcggaataagcacccatgtaggaagtggagttctgcatactccagtattccggatattctttgtcgctgctcaatgaaaattgcaggatatgtcccggagcaggcaaataagtcaggttggcaaccggatacaggctccattcgttccacatatccgtatgatattgctcggcagccagagagacatccgttgaaagtttctcaccgaaactcttgctgagtccggcataaaagttcagcgtctgctcgcgacgacgggattgcatgttgttgtccggcagtaaagtttccgtttcgggatcgaaatacatttgataactattgtccaatgcggtcgtataagcaacaccataattcaatccccagtctgcgcccaaagtatgttcttgtccggcatagaaacgccattggttgatccgttggttatctttgctcaggaagttcagtgtttcttctcccagtgtgctgtaaagcagctgactgccgggagcatgataataggtaaattccgctccggctttcagtccgaaaggagtctgatagtcgagtttggcattatggagctgtccttccgagtgcgaatcggtgaccgagttctgcgcaccggtgactgtggcgtaaggtttgacatcggtgaaagcagtggtataaaccaagctcagcaaatgcttgtcggtaaaggcatagtccatcccaaggcgtatctggtgattgttgtggcgggaagtagtgatatcatacatattcatcggatgcaccgaaccgtcggcgagcgtgtgaagcgcttccttgtctgtctccctccgttcgcggctgtaagagtaagagtagagaagatcagcagaaaatttgcgtccggagtatagaaggctcgcacgctctgccagagattcgtagtgtaattggctgtaggcagtatatagttctccctgaagagaaggttcttttcccatgcccgaagtcagtatcaaattgatcatcggtccgcgcacctgataacgtgccggagcggaatacatcacttccgccttttcaatccgactgacgggcattgatttcagcagggtgcttaattgctctacagagagggtggtcacttttccgttgataaccacagtgaccggttgccctcccaacgtcagggcatcattcatggagacaactcccggcaggttctttaccgcatcataggcattgtctaccggcaggctgctgaccagtctcggaacgtcgtataccagtttcccctgttcggcttttactaccggacgttcgccggtgatcatgacttcgggaagttcccgatacaggctgtctatataggctacgttttttacgctgtcggcaggttcctgcgctgtctgtacctgctgtgcagaagcgtacatccaatacatgaaaagtaacaaaagcagtaaataagttcgtttcatatcgcatttatttttgagtatgctgcaaaatacgggagaaaaaacgaaactttacgttatcgccggcttatctagtgttatttagtcttatcaaagagaagaaaaataacagtttcatactatctttgtccgtatgaaactaccgttgaaacatatcattatccttgtcatctgctcgctgacaggcatctttgtttaccagacatattggctgacagggctttaccgcacgatgaagcaggaaatgaacaataatatcaaagacgccatgcgtacgagcgactttaatgaaatcgtgcttcgcgtcaacgagctgcaaaaggataatgtggaacatggttcggtcaccgtttccgccggatatggtgcagacggcaagtcgctggtgacaagccagaccgtctcttatacggacagtacctacaaagacaccctgcatacacgcacggaaacagcagtagataccctagccgtcaatgccaacgatccggatgccagcgccgttgcctccagcgaaagcggacttgatgtattattaaagaaacaggactcgatgaaagaactcatactcagcgtccaacagggtatgcactccggcgtggatacctacatcgacatcaacctgcaaaaatatgacagtctactgaccgatgtactgaaagcacacaacatagatgtgcctcaccgtaccttatatatatacagcggagctactcaggattcatcccagacattcatagatacactgggcatcgcaggagacagcacctatatccccagcccgaaagccatccgctacaactacgaattcaacaggcatcacagtcaacgctaccaactgataatggaacccatcacctccctggtatggaaacaaatgactggcatcctggtcacttcatttgtcatcttcctcatcctcggattttccttctggttcctcatccggacactgctgaaacaaaagacgctggaagaaatgaagagcaactttacgaacaacatcacgcatgagttaaagactccgattgccgtggcgtatgccgccaacgatgcgctgctgaatttcaaccaggcggaagagaaaagcaaacgtgaccaatatctgcgcatcagccaagagcagctacagcgtttgagcggactcgtcgaacagattctttccatgagcatggaaagccgcaagacgttcagactgcaccccgaagagatttgtctaaaagaactgattacttctttaatagagcagcaccagctaaaagcggatatccccgtacacataacactggaaacagaaccggaagcactgacgatagtagccgaccgcactcatttcagcaatatcatcagtaacctgatagacaatgccgtgaaatattcgaaacaagaagcagagattatgattcagtgccgccaaacgggagaaacggtgactatcaccgtctctgatcatggaataggtatccctctggataaacagaaacatatattcgacaaattctatcgcgttccgaccggaaatcttcataacgtgaagggatacggcttagggcttttctatgtcaaaagcatggtcgaaaaacatggaggcaccatcaccgtcaaaagtgaatccggcaaaggaagtacatttaccattactatctaaaacatcagaaccatgagcaaaaacgacattacagtattgttggtggaagacgaactgacactcgccatgattatcaaagatacgctcgaggaaaacggttttaccatacataccgcctccgacggcgaagaaggattgcatcttttctttgaacttcggccggacgtgctggtggccgatgtgatgatgcccaaaatggacggattcgaaatggtacgccgcatccggcagacggacaagcagacacctgtactgtttctgactgcccgttcggccatcaacgatgtggtagaaggattcgaacttggggcaaacgattatctgaaaaagcctttcggcatgcaggaactgatcatacgtatcaaggcgctgatgggaaaagcgttcagcttcacgaagacaaaggtatccagccgttttgagataggaagttatctgttcgatccggtcgcgcagacattgctgcatgccggagtgagacaggaactctcccaccgcgagtcggaaatactgaaacggctttgtgaaaaccggaatcaggtggtcaatacgcaggacgttctgctggaactttggggggatgacagtttcttcaattcccggagtctgcatgtattcatcacgaaactgcggcataagttgtcgcaggatgagcaaatacgtatcgtcaatgtgcggggaatcggctataaactcattgcaaactaagctctaaaatagtgtcactatcctactggcatagtgtcactatccccacaggatacttacactatcttagtgggatagtgacaccatcccgacgagacagcagcacactcctttttaaaggatttttctctaagaaaacataacggaagcaggcagtcagactaaaaatctctatctttgtcatcaatcaacctttacgaagatgagaaaactgattctatttctttcgctgatattatcggtcggttttgcatccgcacagtcggaggttccttccgatagtattcgtcgtgctccgtcgagcaatataaaggaattcggtggcttcctgctcgatatgggattaatgaatgtggcccctcccaaacttccgaaattcagtctcgatgtaccggatgtgagtaaagactataatcagatattccgtctgaatacagacgccagctatacacagggattcaccgacgcattttcttcccctttctccggtttcggatatgggtatggctggggattgtcgtcttcaccgcagttcatgcagatgggcaccttcaaactgaaaaacggatggaaaatcaatacatacggagactatgacaaagacggatggaaagtgcccaaccgtagtgccatgccttgggagaagaataatttccggggagcattcgaactgaagtcctccaatggtaatttcggtatccggatcgaggttcagcagggacggaacggtctttattaactacgctactcattatgatcgacttgtttcggctattagcatatcctgattagctattagcataatccgattagctaatagctaatcaggatatgctaataggatatttcaatcatcaataacaagatgagttatttactcaactaacgtttattctgcttcaaaagctctgtctgccgcagccatcgcgtcggctacacggtcgcaccatgaatcgaactccggatcaggagtctgtgtttcggggtgcgaaagcatatattgcactgactgtcttaaaccgtccgccatcgaagttgtacagataaagtccggcacaaggcgttttattttcgaattatcaaagactaccgttgcggctttatcccccaacagttcgccccgaaagtcatagttcccgccatgtctcgcaagaaaatcggaagccacatggagtgcgttcagaggtttccccagcgcatcggcaatggtttgataaatctgattccaagtcatactctcatctgtggtgatatggaaggcattcccgatggcatgagggttcgccatcagtcctacatatcctttggcaaaatctttggaatgtgtcagtgtccacaaggaacttccgtcaccagggataataaccggtttcccgtcaaggatacgtttaagtatctgccagttccccttatttccatgcaggcttacaggaggtttcgttccattatacgtatggctgggacggacaatcgtaatcgggaaaccggtggtacggtatgctgtcatcaacacttcttcggcggcaatcttatgccgtgaatattgccagtaaggattcactaaaggggtactttccgtaatacggtaatcagccaacggtttttggtaggcggatgcactgctgataaaaatatattgtttcgtcttattacggaacagacggatatcacgttctacatcttctgccgtgtaagcgatgaactgagctacgacatcataactttcatctgcaatagctttcgccacagcttcctcatcgtgaatgtcggcaatgatactgcccacaccttccggcagtttttttgagccccggttgagcagtgttatctcccaccctctctgttgagccaattctactacatcggtactgatcgtaccggttcctccaatgaataatgctttcataaaacaagtctttttaaattcacaggaacaaatatattaattctactattcacatcccttgattatcccgtttttttgtttccgacacgctgatatttagctgaaaaaagtgagtttgcatcccactacccaccggcattgtatacaaattactgaatcttatacccaaattactgttttgcaaatacggaatgagaaagatacatttaaaagctttatctttgtgacagatcaaaactgtaagccgtatggaagaaataacaaaaattgaaagcattgaccagtatgaccaactgttcggactagagaccttgcacccactggtaaacgtgatcgacttctcgaaagcgacaaagacggtagactactatcgtatgaatatcggattctactctctgtttctgaaagacgcaaaatgtggcgatctcagatatggacggaagtattatgactatcaggaaggaaccgttgtctgcatggctccgggacaggttatcgggatagataaccgcaagcagacaccaattcgtacaaaatctatcggccttttatttcatcccgatttaatccggggaacttctttagggcagaacatcaaacactatagtttcttctcttacgaagtgaatgaagcactgcatctctccgaacaggaaagggaaatcgtgaccgactgtatccacaaaatacaaatcgaactggaacatgccatcgacaaacacagcaagcagctcattgtccgcaatatagaactattgctcgactattgcatgcgcttctacgaacggcaattcatcacccgtaatcaggcgaataaagatatcatcgtgaagttcgaacagttattggacgagtattttcagaatcagactgcacttaccgaaggacttccttctgtaaaatactttgcggacaaagtctgcctttcttccaattacttcggagacctgatcaagaaagaaacaggaaaaacggcacaggaatatatccagcaccggatcatagaacttgccaaggaacggatattagaaggtagccagacggtcagccagattgcgtatgaactggggttccagtatccgcagcatttcagccgattgttcaagaagaatgtcggatgtacgccaaacgaatataagcaacagaactaaaacagctccattaatcaggatattagttacgtcatgggagataaagtacttaagataggaagtgtgcatcaatgtaattgctgcatggggagtaagacactgcaccctctggtcagtgtcatcgacctttcaaaagccgatttatcctcccatacggatttcaaattcggattttacacgattctgttgagcgaatgcaaatgtgaagcctacagatacggacatcagtactacgacttctcggacgggacacttctctgtctgactcccggcgagtcaatcagtatgaaggatagtgacaacacacgtccttccaaaggatggatactggcgtttcatcccgacttgatctgcggcactgcgcttggagcgaacattcgtgactatactttcttctcttatcgtcccgaagaagcactgcatgtttcattacgtgaaaaacaggtcatactggaacttctggataaaataaatgaagaattgcaacgctgcatcgactgctatagtcagaagatcatttccaaatacatcgaactactgcttgattattgcgaacgcttctacgaacgccagttcatcacacgcaatgaggctaacaaaaagattatcgaacggtttgaccgtcttttggatgatcatttcaatactatacaaagtcagtcctccgatcttcccactattgaggagtgcgtcagagtacttcgtctttctcccgcatatttcaatgatttgctggaatatgaaacagggaagtcgtacaaagaataccttcagttcaagcgtttcgagatagctaaagagtggttgataaatacagataaaacactcagccagatagcgcaggaactcggtttccggaatccgcaatatttcagccgcctgtttaagaagatcaccggttgtttgccgaatgatttcaagatgcctaactgacttttctcttaataaaaatagaattgagaattcaaattcttaatcaatgttataaaacatactattttccttggataatttgcaaagttcacagaagtccgtatctttgcaatgtatttttcatagtattagatttaaggttaacaaaggttggagcaaggcgttgctcctttttttatgtccatacgtgagctattggactttcgtatatagtagaattacgttatttttcagtagatttgcagtaacacttgaaaaggatacattcagattatattctgaatatataaatcaaaaagtgctctttttacgttatatatcaagaagtaactttaatcctgacaaaacaatgaagacagagcggaaatatcaccatttgattaaatcagttatcatcgtactattcctttcttttggcatgacttcgtgcgaaaaggaagagccagttccggtacctacagaacaaacggtattcatgtatctcccctggtctgataatctcacatccaatttctatcagaacatcagcgaccttgaaagtgtagttgaaaagaatatcttgaaggatgaacggataatcattttcatgtgtaccacagcaacgaaagccactctttttgaactcgcttatgagaatggcaagagtgtgcataaaactctaaagaactatacagatcctgcatataccacagcagaaggtatcacatccatcctaaatgatgtgcaacgctactctcccaccaaacgctattcgatggttatcggctgtcatggcatgggatggatacccgtatcaaattctaaatcacgtagcggtcttcgtaccaaaatgcactgggaatacgaaaatgtaccaatgacacgctacttcggaggattaaatgcccaatatcagactgatataaccacacttgccaaaggaatatccaatgccggacttaaaatggaatatatactctttgacgactgctatatgtcaagcattgaagtagcctacgctctcaaagatgtgactgattatctgataggatctacaagtgaagtgatggcgtatggtatgccatacgccgagataggtcagtatctaattgggaaagtagattatgccggtatctgtgacggtttttactctttttattccacttatagcacaccctgcggaacaatcgctgtcactgattgctcagaacttgataacctggcaactattatgaaagaaattaatcatcgatatacttttgatccttcactaaccagttctttacagagactggacggatattatccggttatcttctttgactatggtgactatgtttcaaaattatgccctgatgaaactctagtggcacgattcaacgaacagctcaatcgtacggtgccattcaaaagaaatacagaatatttctattcgatgagcagaggagaagtgaaaatcaataccttctccggtattacaatctccgatccaagtacgcactcgctggcctcaaaaaaagaagaaacagcatggtatgcagctactcattaagaacaaaagataagatcaggaaatctcttaataaaaatagaattgagaattcaaattcttaatcaatgttataaaacatactattattcttggat

SEQ ID NO: 56 - DNA, 47522 bp, Bacteroides thetaiotaomicron
ctattattcttggataatttgcaaagttcgcagaagtccgtatctttgcaatgtgtttttcatagtattagatttaaggttaacaaaggttggagcaaggcgttgctcctttttttatgtccatacctcatctcgtcagctaattttatcctttgatcaccgccataggcgccaattccaccaaaggtttcactaaatcccgctcattagcaattacctgcgcaatatctttgtaagctcccggtacttcatccaatccatccggcatgcgcatcggacctgataatgatatgcttaaattcgcaaaagagcaaaagaaaaagggaactacgaaatctatttgcgtaactaaaattattttctacttttgtgaaaataaatatagaaaagccatttctgaaccgaaactcactcatgtgactgagaaaaactcatatgactgaaacgaacgactataaaacagcccatgaagaatataataattatcggtgccaatggattcaccggacgccaaatactgaatgacctgtcgagcaaggcacaatataaggtaacaggatgttccctgcatccggatatccttccgaagaatggaggcaactatcatttcatcaccacagatatacgggatgaagcagtcgtaaagcaactttttaaagacgtacaacccgatgtagtcatcaactgttccgccttatccgtccccgattattgcgaaacgcatcacgaagaagcctggctaacaaatgttacggcagtagaacaattggcacatctttgcgaaagttacaaaagccggttcattcatttatctacagacttcgtctttgacggaaagatagacgagaagtccggacagctttatacagaaaaaagtctccctgctcccgtcaactattacggtttcaccaaatggaaaggagaagagaaagtgactgaaatctgtagtaactatgctattgcccgcgtagagattgtctacggaaaagcattgccgggacaacatggaaacatcgtgcaactggtgatgaatcgtttgaatgcaggacaagaaatccgtgtcgtatcagatcaatggcgcacgcccacctatgtaggtgacgtatcagccggagtacaacacctggtagaaaatgccgcaaacggaatttttcatatctgtggcgaggaatgcctgaccatcgcagaaattgcttttcaggtagcagactacatgaagctggaccgttcgctcgttcaccctgccacaacagaagaaatgcaagaagctactccccgtccccgtttcagtgggatgagtatagcaaaagcccggactatacttggttaccagccacgaaagctgaaagacatcctcatggagtggaaacattaaccgacaaatcctattaatcagattgtttgcacaaataaaagtatgtgctctacacaacatagaaatttgactcaggcatcgaactggcaactaaataaaaatgatataaacacataatatataaaggttaaggtctacataaccaagtttttactacattctattcctagtttcagctacctttcccattctaattattgcatatttattttgaaaatatgcaataagttcttatctttgcacccgaattaaagaaccagaagatgaatcaaacattacaattacataacgcccttatatttcatgcggaaattcccaatttctgcacgtcatgttgcgtgcatgtacattggttcagcggattcatctaaattccccttactcattcttacccctaactgcctgttgacttatttcgttactcacagacagtatttccatctgattgtcaataagatgtatgtctttttggggattatctatgctatttatgaattgtttaacctaaccaactaaaatatattacaatatgttctctattatatctaccatgtttttgggaatcggtatcggatacggattacgtaactggagtatcttacaaaagactgaaaagacaatttctcttacaatattcctgttactctttatccttggagtatccattggctctaatagcctgattgtgaataatctcggtaagtttggatggcaggcgatcattcttgccgtatccggcgtattagggagcttgttggctgcccggcttgtgttacaactatttttcaagaaaggaggtaaacaatgaaaggaagtctcatcgttatcgtatttttctgtgtaggctgtatcatgggagtttttaataaattccagttcgacacacatactgtttccatgtatatactatatgcgttgatgctgcaagtaggaatcagcatcggttccaataagaacctgaaagcgatcatctcacatttgcacccgaaaatgctgctgattccattgggtaccattaccggcacattgttgttttctgccttggcaagcattttgctaagtcaatggagtgtattcgactgtatggcagtaggaagcggattcgcctattattcgctgtcttccatcctgatcactcagttcaaggaaccgaccatcggaatacagttggctacagagctgggtaccattgccctgctgactaatatctttcgcgaaatgatggcacttttgggtacaccgcttatcaagaagtatttcgggaaacttgctcccatttcagcggcaggagtcaactcaatggatgtattattaccttccatcagcagatattcgggaaaagaaatgattcctatcgctattttgcatggtattctgatcgatatcagcgtgcctgtattcgtttctttcttctgtaacttataactctgtaccccatcataccataatgtccgaaaagcatatctgacctatcattctgtcagtagcttttcggacattatttttttattaaaatgagttttttaatgccccgccgtcgccaacacaaaacgaatatcagcgtaagaaacgtcatctcccaatgcagctttaatagccaccactcccataaattcatgggtctccagataagtccggaccttctttatcttgtccgctgtcactacctgttccaactttattttatcttcacggagataatgttccagatgagtagcaatcgttcctgtcaccaaatcacgagctttggctatctcttctatcgtcatcccctggcaaaacatttcataactcaccagctttgaatctttcttcttctctttctcctcattatgctgtgcatccagctttctttcccttgcatcctctttccccgaaacagaagtaaagatctccggtcgttccagtttgttctccttcatatatttgcgcacaatgcccaagatctcaagtccgtacttctccactcctttcgcaccgaaataaggtatcgcttccaaagctaccggtgtatccggtaacagattcacaatacccatcaatgccttttgctgcatgatcacataagccggcatattcacttcgcgcgtctttgccgttctccattccgacagagcacgataaagttccggatgcagaatatccgtcggaacttctactttcacctttcctgaattgctgcgagtgcgttctttccgttcttttttctccttcggagccttggtagaagaaccggaagaagcagtttccccttcgagacttaacatcactttcgccttccgtttcagataatccgttaccataaatttctccgtccgcatcgcatccagcaaagactctttaatccataaagcatcgtccaatgcctgcaaacgttcattcagttgtttccgcaactctttattatcaagaggcatactggtcttgtcaaacagcgcccggacaggaagcaatgcttcacagaaataagtagcaccagaatgaatcctttgctgtagctcctcatttccggcataattttcattcccgttaatcagacgcgtatattgattacgaaagcgattggaaacttccaccaccttctctttgagatgcggagccagttctttatactcggcaagcaacttcggataaagtttataaagctcttcatccatcatccggagcaaccgcttataagcctgctcaagcgaatagaaattaaataaatcattcaacagatcatagaaataagccttttgcatgtcgttcaactgcttgctccccggtttattctgttccacatctcttgtgaaattatctacaatgctatcgctgattatcgcctccctacgcaaaggagtctccaacaccattccttccagagtcttgcaacggctcaatgctacatacgtctgcccatgagcaaaagagttacgagcatcgataatcgcccgctcaaacgtcagaccctgactcttatgaatcgtgatagcccacgccagacggatgggatattgccggaacacaccttctatttcttccgtgatctccttcgtttcttcgttcagcacatacttataattcccccattcttcgggcaacaactgaaagacatcactactgtcttttccacgtacggacattcctttttcgtcaacactcatcacttcgcctatcatgccgttatagtaacgtttttctgatgaaacgtcattcttaaggaacatgatctgtgctccttctttgactgtaagcacttcatccgcagggtacgagtactcaggaaaatttccctctatctccgcccgaaaactataagcccgtccagacagtgatgccagttcacggtcgttcacctgctgggcctgatagttatgcgttgtcagtcggatatacccttcttctttccgtggacgaaaaccgggctgataacgacgattcaattcgttcaacacttcatcatctgctttattttcgcgtatcttgttcagaagagaaagaaagaaagtatcactctgacggtagactttctttagttcaatggtcatatacaccgtttccttcagtgcacggctggcaaaaaaatatggagtctcgtaatgattcttcagtagctcccattcattgtcttttaccacaggagccaactgttgcaagtcgccgatcatcagcaactgcacacctccgaaaggtttttcacggtcacgataacgacgtaaagccgcgtccacagcgtccagcaaatctgcacgtaccatactgatttcgtcgataacaagcagatccatgctgcggataatattccgtttctctttgctgaaacggtagtgcatcttggcagaattgaaagtcgtttccggcacaaacggagcaaaagacaactgaaagaatgaatgaatcgtcacccctccggcgttgatagctgcgattcctgttggagccaatacgaccatgcgcttgggggtatgttctctcaatcgttttagaaatgtagtttttccggttccggcttttccggtaagaaacagatgcgtgcctgtattttcaatgaactgccaagctagttgtagttcaggattattttccatgtttcctctaattttcggtaaaggtactgaatagattccaaccaccgaaattgaatgtaaggaaaagcaataatcaagccggtattttcatcatcatttctttactcccgaaatatttgtatacaaataaacaaaaaaggtcccggtatcttctcgcttgaagtacaccgggaccggatcaaatcagaacacaaagtcgtgtcacagttatatatcgaaattgtttttgtttcttaattcttgggagactgatatctcttgtaccaatctgtagattttgatccccaagaatcagcccaattcttgaaataaggatattccgtatcaatgttatgcgtctccgtcaccggaatgaaattcaacatcggaatatcgatggcaaacggataagctccgtcacgatcaatgtaatagacatccttactagaacctatcagcgatttgtcagcataagatgtcggtgaatatttaggcagatgtacttccgtccggttctgttgccctgccgcatattttactataatgtacggattatatatcttcagattctccttattaaaagtggccttttcaaaggttctggttatcgtacatgtacccactttccccttaacagcttgttttacacttgggaatacaataatagaagacgtttcgctctccacttttatatccttatctgaagtcactttaccaaactgtcctccatctatctgataagcaaatgcattatcatacatcgctccgtcgtgtgtgggcgtaaatgtatccacaatcttatttatcatgttttctgtgttgaaatatatggcacgattatattctacgatcacgtcgttcatgtcataatctcccccgtcaggccaaatatcttcaaaggctaaagtcccctttaagttctcctgtgcatccggcttttctattggtttatcatcactcgggatattgggtctgttcggattatcaatagaactttccggagaagcatctacataaaatagtagatcacaaaaacttctgtttgctccatcttccacaccaataatggtttttccactcttttcatcttttacagatacgaaaccaccattagaatacccattagaagttattaatggttttgtaatgtcaatttcattctcattttgatgatacccatctgcatatataaaccatcctactgtatatcctttcggaaatttttcacttggtttaccatcctcaccccaaaagagcagacgtactttatctccacacttcaaaatagataaagctccattatatacggaaaaagcaacatttggaaatacgatatacttcctcatattagagttactaactccatcacttgttttataataataatatccaaatgaattattaaatgaagcgtccctgtcaagaaagaccaaatctaacgtagttccctcttgtgttacattaatattagtgatttcagatcccttatacaaataagcgttgtcaacagaacctccggatggcttgaaaaaagagtttaaacgttctacaagatttccaatcaattcattacccacttgtttttgaggtgttacatatccattattaatagggtctggctttcctgtttgactattataaatataggtgagatttcctccttctccccacttacacaatgaatacaaattagcaccggaattgataagatacggcacgctacctttcgaaaagtcataagaacgcgttaccgctttagtattggcagtagaagaatcctttttactcatatcaaaactagccatcccatctttgatatctagttttacgcatcggggtactccccagcttgatgtatacaagtaaacagtctctacagaagtcggaatattcattttcccttcatattttccatttccatccgtgaaaattttgaataaagcttcaaccccttctttctttaccggaacattgtccactacttccatcgggtcttcatcatacacttcaagtagagccacaagtccgggcaaatcataatttactgaaagtttcacgtcgccacgtgtttcaaatccgaaatactcgctagggtccggaagaggttcttttccataattaggatcgtacagatctttttccatacatccagccaacagcccaccaatcaatgctgccgtagcaatagcaccagaaatgccgaataatcgcttttgtgtcataatctatatatttgttttgttagttatcaaggtttgttttgttcccatcaaaacaatctcacctctcaaataattttcaaatatatagattatttaattactagccggacaaagcttaaaaacggaataccgattcacaaaatagtgttatcgtgcaaagttatttactgcatagaaccacccacaatatccaataattcgttggtaatagcttgctggcgactcttattatattgcttcgtcaaatcctgaatcaattcgttcgcattgtccgtagccacctgcatcgccaatgtgcgtgccgcatgttccgaagcgttcgaatccacggcagccgtaaagagtttctggctcaataccgtcgggatcagattggcgatcagttcctctgcagaaggttcgataatgtaatcattcgctatttcacctccttgtacttcttcttccttttgcttctcttcctcatccacgacccgtgtcaggtcaataggcagataagtttcgcgaagcagaatctgcacgcccattgatttaaaatgatgatagatcagttctacccggtctatttctccggatacgtacatttccatcaggcgatgtgccagttcggaagcctcctgatacgatggtttgtcggaaagcgtcggtgaagtctcctgcggttcgaatcccaggcgcttcactgcttcatccaccttcttccctaccggaaatatcaggatattatcctgtcccagtgtacgaaactcaccgaccgtttgcagcagcatcttaatcacatttgcattaaaagcaccacagagcgacgtattcgaagaaaaggcaacgattgccacacgcttcacttccctcgccttgatgtaaggagattcaacaggaaggtcggcactcaggaagttggtcagaatcttgttaagcttcctttcgtaaggcagcatattttcaatggctccttgtgccttgtgtaacttggcagaagccaccatcttcattgctgaagtgatttttcgggtactctttaccgaatttattctggtttttacttctttcagtgaagccataactatttaaattaagaattaagaatgagtgtgtgtcaaaagtcagtcccagttcagttactattgacttttgacacagcgtcttcattttataaatattgtttagcaaccatagcggcagtctcttcgatagccttggtcacgttatcgtctatcacaccggttctcagaacgtccagcacatcttcctgatgattgagttgtaaagattcgatgaagctgcgttcaaaatcctgtacgttttccaagggaacatcgtggagcagaccgtgcgtgccgcaatacagaatagcaatctgttgttctaccggcatcggactatactgaggctgaatcagcaattgtgcattcttacgtcccttgtcgatagtcatcgccgtaatggggtccatatcactgctaaacttggagaaggcttccagttcacgatactgtgcctggtccatcttcaaggttccggccactttcttcatcgccttaatctgagcgttaccacctacacgggatacagaaataccgacattgatagccggacggacaccttgattaaacaagtccgtttcgaggaatatctgtccgtcggtaatagaaatcacgttcgtcgggatatatgccgaaacgtctcctgcctgcgtctcaatgataggcagagctgtgagtgaaccaccacctttcacgatacctttcaggctctccggaaggtcgttcatttcgcgtgccacttcttcttccttgatgatctttgccgcacgttccaacagacgggagtgcaggtagaaaatatcacccggatacgcctcacgcccggacggacggcgaagaatcaacgatacttcccgataagcaactgcctgcttggaaaggtcatcataaaccaccagcgcatgacggccggtatcacggaaatattcaccgatggcagctcctgcaaacggtgcataatactgcaacgctgccggatcacctgccgtagcggcaacgacaatcgtgtaatccatcgctccatactcacggagcgtatttacgatagaagccacggtagaacctttctgaccgatagctacataaatacagtacaccgggtcacctgccagaaagttattgcgctgattgataatcgtatcaatcgcaatggaagtttttcctgtctgacggtcgccgataatcagctcacgctgtccgcgtccgataggaatcatagcgtctacagctttcaagcccgtctgtaacggttggtttaccggctggcggtagataactcccggcgctttgcgttccaacggcatttcatacagttctccgccgatcagcccttttccgtcgagcggttcgcccaacgggtcgatgacacgtcccagcatgctttcacctacacggattgaggcgatacgcttggtacgtttcactataaagccttccttgattctgtcggtaggtcccagcagaacggcacctacgttgtcctcttcgaggttcatcacaatggctttgatgccgttgtcaaactccagcaattcgttggcttcggcgttccgcaatccgtagatacgtaccactccgtcgcttacctggagcaccgtaccgatctcgtcgagctgcacgttggtattgataccttcgagctgcttgcgcaatatatcggatacttcgcttactcttatattttcagacattatacaattctcctattcttatcaataaactgttgtttcactcgtttcaactgcgtggcaatgcttgcatcgagccgataatcattgatatcgaagatgaagcccccctctatcgagggatcgatcacagtatccagttccatttgggcatgcagaatatgtgctgctgcggaacggatccggttttctgtctccttgtccaccgggactgccgtaatcagtttgcctactccgatgtgtttcagtttccggtaaagatcgagatacatcaggctgatgaactgcaaatagccttcgcgcctgtttcgcagaaccagcgtgatgaaacggacaaactctctgctggattcaccgttaccatcggcagccgtacatatcagcgccaacttgtcctttaccgacaccacaggattatcaagcacttcgcgcagtcccggctggacacgaaaactgtgagacaatgtgaagaattcgttgtagagtctatcctccacacctttctcctgggcgtattcgatcatcgctttggcatatcgcattgagagtactccgacttccatcttccttagttcttattaggggttaatacttcatccagcatacggtcgatcattcccatctgggattctttgtcctgaaggttcttgcggagcaccttctcggcgatatcgacagaaagcacagctacctggcgacggatgtcgcggatcgcttcatccttctctatctggatttgttgtttcaccgcatccagttctttctgtgcggctatctctgcttgcttacgggcctcgtgaacaatcttgtcacgttcttccattgcctccttcaagattcgtccttgttccttgttggcagcagccacaagcgcctcgccctcttccttcaaatgagctaactgggcgttggcttcccttgccacctccaaggactggtcgatataggttttacggccttccaccatcttgatgatgatggggaaaccgtatttcgctaatatcacgaacacaaccccgaatgcgacaaacatccagaacaacaggccactatcaggtaatagtaatgacatatctatttaatattacaggaagaataccagcagacatactactaccgccaacagagccacaccttcgatcaaggcggcggcgataatcatattcatacggatgtcacccgaggcttccggctggcgtgcaatagcttccatagccgaaccaccaatcttaccaatacccaaaccagctccgattactgcaagacctgcaccgatagctgcacctaatttacttactcctactgctgctgcagtggcttgtaacaatactgatagtaacataattttcagttttaaaatggtttattttctcgtttatttatttgctctctcttcgcgtttattctgcttttacttttgcaccttcctgcgccagtccgataaatacggccgaaagcatggtgaatacatatgcctggatgaaagctaccaacagttcaagcgcattcataaaaatgttgaacagtacggaagctaccgtcagtgtaccgttgagcgcaggtcccatgcttgccgagataaagatcaggcaagtcagtaccagcatcgccatgtgtcccgccagcatattggcgaaaagacggatcatcaaggcaaacggtttcgtaaagattccgaagaactcgatgaaaggcatcatcggtacaggcactttcagccaccagggcacatccggccaaaaaatatctttccagtaatgtttcgttccaaagatgttgactgcaaggaacgtacagatagcaagcaccatagtaatggcaatgtttcccgtcacattcgcaccaccggggaagaaaggaatcagccccatgatgttattaatgaaaatgaagaaaaacgcagtcagcaggtacggtgcaaacttccggtagttgggtccgacacaactcttgatgatatcatcgttcaccatcatgataaacatttccatgaatccgataaaaccacccggcgccaacgctccctgcggacgcttcctgtaccattgcgccacactcagcacgataaccagcagcagcacactgttgaacaacaaagcgaatgtcaccttcgtaatggaaatatcccacggacgaacctgctctccggctgcattatactccaccagtttgccttcgtacttacttccttcgggggcgacggagagcccttcataagtgcctccattctcagcgagacgggaagaaaggaacgtatgccaacctgtagtagaactataaacaatgataggtaatggtatagtaatgtgcgttttaccccacgtcgtaatatgccattcgtatgagtcgccgatatgtccgaacacgatctccttcacatcgaccgtattctctttctgctcctgcggagtcacatcttcctgtgtctgcgcgaagaccggcagaccggctaccaacatcaggcagagcagaaatatcggagctactatgttacgcaactgtttcatttttattcttatttttctttttccgtttcaggttcacttcaaaggagaagaagaaccacgtttcatatatcagatacaacagatagaacgagataaacgtcagcaagaaagccttggcttcttcgcgtactgccagacaataaatcagcagcagaatcagcgagagaatcatttttatcatcttcattgccagatacagcagcgacaacttctgcggagcatgccgccgacacgcatcgaacatataaatactaaacaaaccgaagatatagaaatataccggtataaacggatatcctccgaaataatgccccggcaaggctatgtgtaaaatcactgctcccgctgctccgcttagtatagcaaacagcgtattcagtgcgataaaattccgtttagtcttactaatgttcaccatgtcgttgtgtttttctgctgtatattatccatctcgtcttccttacgagacacacaccgaagctgtcccgtcactcatttcaacaaaaccaccctgaatatccaatgtatgctcctcgccgtccatcgtggtataacccaacgttcccgctttcaatgacgagacgatcggcgcgtgtcccggcaggatagaaaacgatcctaccgttcccggcagtgtgacaatcttcacttctccgtcgaatacgctcttttcgggcgatacgatacttaaatgcaattctttcatcatggaatgttgtttcgattactttttcgcttgttccagcaatttcttgcctttctctatcgcttcttcaatcgtgcccacgttcaggaaagcctgttcggggaggttgtctacctcaccgtcgagaatcattctgaaccctttgattgtatcctcgatgcctaccatcacgcccggaacgcctgtaaactgttcggcaacggcaaacggctgcgaaaggaaacgctgcacacggcgcgcacggttcacgaccagtttatcttcttccgaaagttcctccataccaaggatggagatgatgtcctgcaattccttgttgcgctgcaaaatctgtttcacgcgctgtgctacgtcataatgttcctgtcccacgatgtgcgggtcaaggatacgggacgtagaagccagtggatcgacagccggatagatacccaattccgtaatcttacggtcgagcacggtcgttgcatccagatggctgaaggttgttgccggagcagggtccgtcaagtcatccgcaggcacatatactgcctgtacggaggtgatagaacctttccgggtggaagtgatacgttcctgcatcgcacccatttccgtggcaagtgtcggctgataaccaacggcagaaggcatacgtcccagcagagccgagacttccgaacccgcctgcgtgaaacggaaaatgttatcgataaaaaacaggatatcacgtttctcaccttccttgccggcatcacggaaagattccgctaccgtcagtccggacaatgccacagaggcacgtgcgcccggaggctcgttcatctgtccgaaaatcaaggatacctgcgacttttccagttcattatagtctactttcgaaaggtcccagtcgcccttctccatactttccttgaaagcctcgccgtagcggataacgcccgactcgatcatttcacgcagcaagtcgttaccttcacgggtacgctcgccgactccggcaaatacggagaatccgttatgtttcttggcaatattattgatcagttcctgaataagtacggtctttcctacaccggcaccgccaaagagtccgatcttgccacctttggcatacggctccagcaggtcgattactttgatacccgtgaagagtacctcctgcacagttgtcaaatcttcaaactttgggggatcacggtggatggaatatgcgcctgtacggtcgagactcttcataccgtcgatagagtcgcccactacgttcatcagtcgtcctttaatctgttcgcctatcggcattgtgatcgggcctccggtgggatacaccttcatgcctcgctgaagtccgtcagtgctgtccatagccacggtacgaaccgtattctcgccgatgtgttgctgaacttctacaaccagtattttgccgtttggcctctttatctccagtgcgtcgtgaatgcttggcagcattaactctgcgtccgtaccttcaaagtacacgtcgaccacagggccgatcacctgtgagatatgtccgataatctgtgacataagcaatctttatttatattattctttctttacctatcgaattttagtagcatgacaaggaacgtttcgcgttttatctactttaatctactatagtaaacagttaaatttagcttttgttcaatcatgcccgatttctttttaacaaaatagttaaataaacaaccgcgcaaatgtagaaacaaattagcatcgttgttcttcctttttcattatttgtcgttcaataacacttgttaggccaacaaagactacaaacagaccaatatcggaacattccaattacgattgtatagtaaaacaagcctgttaattataaaatatcattaaaactatgacttaacatcaagttttcccattcaacggtaatattcaaacacttaaacgagcgataaaatagtagcatatgcaactagttttatatccgggcacgtacatcctattaaacactccccatttgcctgaagcggaaaagttttcggcaagaaaattataaattccttaattttgccactttgttaaatgtcagcagaaaaaataagaagcaaaaaacactcttctgataaaaaaagaagaaatttgctgcattattaatcctaaaaattatggtaaaaaaaaccttttggcttttgccgaaaaaatcggcaactttacgttaaacgtaacaatggtagacaaagcaggcaatccgttgacagtagatgatatatctcaatgtcacctacccggattccccatcttatttactcaaaatgaattacttgaaatccttgcaaaagagattttcaagcaacagtttctttggaaatccgtacaggataaagacatcaaagagtgcaacaaagaagaacggatcatcaagcagataccgctgatgccacgctgtccggatgtactgaaagggctgttccattgcatcgaaatccgcgacgaacgctctccgaagcatgccatagcctataaaagctgtctgggaaaactggaggagatggtgaaagaccaatgggacgattggaacagaaatcagtcctaataatcgatttggtaaaaaaagagaagttcctaccttcgcagccggaagcccgtgataactacaccacccgcttccggcaacttatatattatatttcaaatgagaaagcacatgtaccaagtgtcactatttatcaacacttggagtaaaactcccacgactataacttttgaagattttttcgcaatggtacgcaacggacattggaaagtgcctacggaaggccaccgcagctgtctggcaaaagaccgcaaacacgacgcgcaaaccatcaaagacagcatggcatgtgtcatccccgcaggcatatgcaagaatggacacgcaaaaaacaaccttacctccctgtcactcgcactctgcatcgacatcgaccatacggacgaacagacaaaggatattttcgtacgtgcctgcctgctcgaatacgtactgggagcgtttatcagcatctccggacgtggtgttaagttgttcattcgtatagatatcgatggagtaaacgattatcctgccatttatgaagcgacggcaaagctcgtttccaccgttctcggcgtagagaacgacgggaaatgcaaggatatcacccatccctgcttcggatcatacgacccggacgcatactacaacggtgacgcaaaggccgtcaacgactttctgccgaacggtgcactcactctgcgcgtcacctacgctcccgtcacttccgctccccgtaccacctgcactcccacctctttctccaacggacatccgcctgcgatgccggataaccggatttccgccgctcccttcgtacagtcctacctcaccctctaccctgccgcaacgggcgaccggaacggaaccgttttccggctcagctgcgctgcctgcaaacgcggcatcgaccgtaacgaactgaccaccgaattggttcgcaccttggaagaagacaacttccgtgagcccgaaatcgcacgtactgtaaaatcagcttaccagaatgtaatgactgcggcagagacggaaagcttcgaaaatcctccttcaaattccagtaaagtccaaaagtccgttataggattttcagaaaacgaaaatccggcagaaaaggaggatgaaatcatcggagaagagctcagagagcagactccgacctttcctgacgaaatttacgatctcattcccgccatcttcaaggagtgcgtctccatcgcaagagatgagcgtgaaagggacggactcttgttgtcatgtattaccacgataagcagcatgctccccagtgtaagcatccgctacaaccgacggaattatcagcccaatatctactgtatcgtcgtagcttcctccggtgccaacaagaacctcatcggctatggtatacgcctgcacaagcactattgtgagtattgggagaagcagagtctgaagatcgaaaaggaatacaagaaagcactcagggactacaccctctccttgcaggcgatacgcaaaaagaatactgctgccaccaacctgccggacgaaccggaggagccgaagctggcatttccgctgatccctgccgacatcagccgtgcacagctcatcactcacctcatcaacaaccaaagttgttcttccttgctcaccagtaccgaagccagcagcgtcagcacagcccgcaaccaagattacggacacttcgacgatatcctctgcaaggcattcgagcacgaactgatcagttcgtcctacaagatcaacggacgacatccgctgaaagtggaatatccctccctgtcggcttttctcaccggcactccatccagcctcattttattcatcccgaccatggagacagggctgtacaaccgctttctgatcaataccttcagacttccggcagcatggcaggatgtgttcgcggaggaaaaggtgcgggcggacgatctcttcaacgagttgtccatgcgcttcgcacagatggcattgtttctgaaagattctcctacggaagtaaagctgacagatacacagaaaaaagaattcaaccgggtattcacgcaactgctcaaagatacggaccagttaggtaatgatgacctgctgggggtggtgaaacgttatggagtgataacggcacgcatctgctgcattttctccgccatcgacaagggaaccatgagaatggaaacacccgaagtatactgctcggacgcgcatttcaaagcagcgctcgccatcgtgctgtgttgcttcgaacatagtaaactggtcagtacttcggtaaaaagctctgccgaagatacgaaaccattacaatcgcccgataatctctcgcgacttctgacgaaactcaaaaagagtttttcagccaaagaagcatgtgctttgggagaggaattgaacctctcaagaagcaccgtttactacttattgaataaaggcattaaagcagggagaatcagcaagttaggtcacggttcgtatattctgaaaatctaatatggactttctggactttactggactttgaaaggggaaattcgtgacttttacttcattgtcacaagaaaaaaacaataagtcttattagcatatcgaaattagctattagcaaaaacaaattagctaatagctaatttcgatatgctaatagctaatttgtttcttccttacagacggacgacttatcaagaaacagattcacgactcatcgaaaaacagattcacggctcatcgagaaacttcacgatcagcctcacctgtctgctgctataagcatgatcgttttttccttctccaccgctatacatagcgtcataaagttctttattatttctgatccatccccgtagtttctgcatggcataaatcaatggcaaatgtggattgtacttgtgagccagctccgacttcaaatacggacggatgacaaacggttcttcttccgcttcttctttttctgttttcatatcgttgtttttaagttctttcgtacttcaaatatactaaaacatatttgcgcacacaagcaaacaagtaaaataaaatcaatcagaaagaaagtaaatacattctgaaagaaagtacgacgaagtacgataaagtacgtattctcatggcttaataataggctacctttgacacatcgaaagaaagaaacagagctcattctctctcccgacactgatcgagtgacagcaatcagtaattattaatttatatttttctaaatctttaatttatcatcatggcaataccatttaaaagaatgggtcgtaaagacccgcgaaaaattgacggggtgctgaagtaccacccccaactggtgacgatgggccaaagtgtagaccttgacggcatcgcctacatcatgaaagacaagagttccctctccctgggcgacatccaaagcgtactgaccaactatgtggaggcaatgcgagcggcgctcttcgacggaaaatcggtcaatatcagagacttcggtgtattcagcctatccgcccatacgctgggagcaaccacgaaagaagagtgtacggtgaagaatatcaaatctatacagatcaacttccgcccttccagcagcgtccgccccaacctaacgtctacccgtgccggtgacaagatcgagtttctcgacctcgaagccccgaaaaagaagaaaggcgacggatcaggagaggacaacacccccggtggcggtggaaacgaaggcggcggaggcgacgaggaagctccggacccgacagtgtaagaagtggagagttgagagttggtaatcaatgtacgagggattgatagttagaattagtggctttatgaggaagattcatttaattgtgattcactgttctgcaacgcgggcagacaaggagttgacggcttttgatctggatacgatgcaccgccggcggggatttaacgggacaggttatcattactatatccgcaaagatggaacaacgcatcttacccgtccggtggaacggatcggggcacatgcgaaaggttttaatgcggagagtatcggaatttgctacgaaggcggcctggactgccggggacgcccggcggacacacggacaccggaacagcgggcagcgctccggctgctggtgcatcagttgcaagagagattccccggttgccgggtgtgcggtcatcgcgacttgtcgccggatcgcaacggtaatggagagattgagccggaggagtggatcaaggcgtgcccgtgctttgaggtaaaggaggaaagttatgccttgcaatcattcattcggtaatgattcacttagtaatcaatcatgtaaagagtcggaaaggaggtgtgtaaagttatggcagtcaagagatccctttgggataccattttgaaagtagtcatcgcggtggcttcggcagtgctgggtattgtaggcggtaatgcgatgagtctgtaagatcaaagaaataacaatgttataaacgcgagagagaggatgcagtttcagacttctgccctctctctttatttataaatctaagtacagtataaacattgatattcttcctagaaagaaggagttatcatcagaagtaatagcgcaacccacccaacaggttaaagcgggtgattccacaacgctcgtcttctttcagcagcatccagtcttgtttgggcaggctaccgctaattccgttcagagtcaagccgagtccccaattggcggaaagcatatattccactcccaccgtggcatgaaaaccaaatccggtagcactgtagaggggatcatgataaaggaaaacgcccatcccgagtcccgactttaaaatccatctgtcgaacttcgagcgacctacccactcgggagctatataagagaaggtcatgtctcctccatcggagaaagactttctgaaaccggaatattgcaatccgattcccataccattgctccacgtatattcgtaagcgagcttccaatcgattcctcctttggagtctaaagtcgcaccgttgatatcatacattttgctggtcacccaaccatacccgaagctcgcttcgaacgtgttggcaggtgctctccgctcttccttttcttctttcacagccacccggccaaggtcaatcatgtcttgtacagggtttccttcagtcgcattcacctttgtgtccgtcaggcgaagcattaaagcgttgatttgatggcaggaacttccccagaaagaaggtttcacatgttcggtaatggcgagtccgtttccaccgttcttcccggtggcttcttgtgccaggcgcagcacttgatcataacgacaatttctggatgtaccccggtctacaacagaaacacttccgagcgtttcggctgtgtttggaactgtatctcccggttcgatgacataaaccgaatctgccggaacgggattcggataggttcttacaatatgagtgaccactttaggtgaacaggaagtcagtaatagcatagcagtagctgccaatagtttagtctttttcatgtttttcattatgagttatataagaggagatgatgagagagaatcaaaagcaatattcactatccttttgcttttgactcactctcattcttttttatttagtacacctctactttctcggcgattcgtttcgctttatcacgcaacgcatccagatcggagttcagcggtgcatagcaaagtacgactcccatgcgacggttgacgcgggtaaacggcttgccgaagatgcgcagataagtgtcttcttctttcgtcacttcttccatgccacgatactgaggacgttcctgactcgctatcggagaaaggataacggcacttgcaccgatccgctcctgcttgatgccggggatgggcagaccgagtacggcccgcaggtgaagttcaaactcattcagattctgtgttcctgccaatgtcaccatgcccgtatcgtgcggacggggagaaagctcggagaagtagactccgttttcatggctcaggaagaattccactccccaaagtccggcaccagtcaaggcacgggttactttttccgccatttcttcggcttctttcaagtgtgcagggtcgatgtgtgcaggctggaaactctcacggtagtcaccgcctttctgtacgtgtccgataggaggacagaacagcgtaggtccgtttttctgtgtaacggtgagcagggtgatttcactgtcgaatttgatgaattcttcgatgatcagttcgcggatatcgccacggctgccactgcatccgtattcccaggcatgttcaagctcgtcggcactcttgacgagagactgtcctttgccggaagaagacatcaacggtttgacgacacaagggaaaccgattttggcggctgcttccttcagttcgtccagggtcttggcataaaaatagttggctgttttcaagccgagttctttggcggcaaggtcacggatcgccttacggttcatcgtgaagttgacggcacgggcactgggcactacctggattccttctttttcaaagtcatagagacgctctgtgcggatggcttctatctccggaacgatgatgtccggatgatgtttttcgacaacgcgttccaatgcttcaccgtccagcatgtcgaagacttcaaattcatcggcaacttgcatagcaggtgctccggcataagaatcacaagcaatgacgtgttgccccttgcgctgtgcagagatcacaaactcttttcctaactctccggaaccgagtaacaatattttcttcattattttgagtgttttatgttagtgatgcaaaattagtatatttctttttattaatgacgtaccttaggatatttattgtggaaacggaaaccgagtccgagcatcagatagttgggcgtctggaagttctgcaaattgtatccgatgtgaagaaaggaactgcgggtaacggctattttcaatgcaagaatctggtaaaagcctctcatatcgccacggctgagcacgttggctcccataccgacgccaatggtaaaataaggcatcacatattccgcacgtcccgaaagtcccaaggccagttgatgctgaatgcccggtttcaggaactcacgtttagaactgctgctcccatattccacaattacatcttccctatatacattggcactgccatcatagacaccgtccagtgaagctcccacgcgaaatttataacccagattatacatcggggcaaaattgaatccggcaacgggatacgcattgggagatgcgatctgcttctctcctacccacactccctttcgacgccatgacccgaacagcacgacatcataactgatatgccggggaaaacgggtggtgacaggctgatagagtgatttcgagaggtcttcttccgtacgattgaaattgtagacgagtccgatcttggctccggcagtattgattcccgcattcgggaatttagtgttaccattggagaagtgcgtgaaatcgcctccgacaatcagatcgaagtaacgggaaaacgcccagtttatgtaaactccggcattgatataagcattcatccgtgaaccgaccgcaccattataggaattataataattgtcgtatggcttccatccggcggacaaaccgaaattccactcataattgagcgaggcacggggagagaaacgggcaattcgtgctccttgaaacacatagaatgagaaaggatcgcccaactgttttttatcaccaaaggtggtaagggacacaccgataccctgataagctccaccgtaaatacggtcggcacaagtattggggcgaaacttgaacgagtatttcaagtgggcggcaaacgatgtctgaatcggtttccagcgttcgttctctccttgcaggaaggggttggtaggaaatacatattgcggacgggcttccattcccaaacgatggataaaaccaaaagactcctgccctgccaaaggagtcttcggcaggcaaaacatgatggaacaaagagcgatggttttccatctcagggtcttgtttctcatagtgccgtcattgttagtctccagatcctgacggtttcataaatcaagggtctcaataaacttggcaacatgataaccatccatcagtccgtgatgacaagtgacggaaatggggagcatcagcttctctccttcccgaaagtattttccggtggatattttggggacgctatcgcccgaacgcatgttcgaagggtgtttcatatctgtaaaggccagccatgggacagccgaatagtgaatggcgttgggatggaaagttcctcctttgttcagtccggtggtggcttgcagccgctccatttcggttttcgccttacggataaaagtgagctcatcgggatcgtactcaaaggcagcaaaagaaaaagtatgatcggcacgccctactgtcgcttcgggaagaagactgtcatagcagactaccttgtcgccctcgatgcggtaacggaattcctcgactttgcttgcggcagtgatgatacgatgtaatagtaaaagagaaaaggagacgcctttgtctttagcctcctgataagaacgggtacagtctacatggactgtcactccgaaaaagggatcatcgaatgcgctgaaatgttcaaaatgctcttttctgttccatgttgcaatgtcaatgatcttttctatctgattcatcctaaatactctttttattataagtagtgactaaaaagtcggttgtatctacactagggctgactaaaagtcggcagtatcttaaatctcctccttcgggaaggaggagatttaagatagtactgactttttagtcagcctctcagattttgcttttacttaattagtaattataatgatcgggagagacatttgtctgtatctgccattcggacgaccgcggaggaggaagaatgacagactggacccaatcttgttttaaatcctactgatgctgctcgcgcaacaggtcgttcaccgttttcaccggattgaaagtggtaagaggaacttctacgaatactgtgttccagtcgctcatcgcaccattccataagccgggaagttcaagcgctttcaggtcttttccgttctttgatttataagaaatgaagccggtcgccttatctacatatttcaccaggtcgaacttgtgacctttataatcgcgtacggcacaaaccaagtctaccggattgaagtgcgtacccttttcgaacatttcctttttggcaggatcgttcatgtcgatctgagagctttcgaggatttgcagtgagatagttccgtcactgttataagcaaggaacggaccgccacccggctcacctacattcttcaccataccgcatacacgcatcggacggttcagtttgttcttcaggtagatcaccagttcggcatcttcgaggttcttcgtttcgggattcttgcagaaaagttgtttttgcaggaattggagaatttccatgatttgctcgtgcgtatactttccgctgtcgagcagttcgaggtattcgaatgcctttttctgcaaggacacgagtacgccggcaatcagttttttataagtaacggtgtcggctttcagtttatcgggtactacgttgtcgatattcttgatgaagataatatcagcgtcgagatcgttcaggttctcgatcagtgcaccgtgcccacccggacggaacaggagtttaccattgtctcggaacggctggttgtccatatcggcagcgatggtgtcggtatttggtttctgttcggagaaggtgatgtaatagtctactccgtaacgtttgccgaatgcttcggctttctcttccaccagtttcttgaagagttcgcgatgttcggtagagacagtgaagtgtacgttgactttaccactttttccggctgcatacatagcgccttcggcaagatgttcttccagtggagtacgtgaaccttcgggatatttatggaatttgagcagacctttcggaagtgctccgtagttgagtccggcagtttcgagaagggcagctactacggctttgtaattaccttcttccatcagccccggaatatcttttccggctgtacgctgacaagctacattcaagtcgtcatagaaagcaaaatccttgattccgtcgaagaatgcctgctcaaactttgtagtaggtttgtcatactctgcggacagaaactcgaacagattcttgaacatacgactggcagcgcccgaagcaggaacaaacttcacgatgattttatccgtattcttataagcatcccatgcagccagatatgcgttcttttcttctgcgtcaggagccaatatgcctttttctatggaagcggcagcgtccagtttcaaataaggaaaacccgtctggaagcaagccagctgttctgctatctgcgcctccgtgatgcctttcttggcaagcaactctttgtcctgtgtcgttatcataatatctatttttattaattgatgcccaaaaatacaaaatgttatttacttcttgccgaataaccgggaaaaaaactaattttacgtcgaattaacaagattgaatatggacgacttttttacatcagaggaaaagaaggagcttttttcactctacaggcatctgttgcaatctgccggagatacgattttctggagggattgccaaaaattaaagaaacatcttatcaaagccgcccagtgtaacgggctgcaacgcaataacttcgggatgaatcccgtcatcagagatttacaaacggcagttatcgtagccgaagaaattggcatgaaaggttcgtgtctggtcggcatcatgcttcacgaaatagtgaaggcacatatcctgtctatcgaagaagtgaatgccgaatatggcgaagatgtaggcagtatcatcaaaggactggtgaaaacaaacgaactgtactccaaaagtccggcgatagaatcggagaatttccgcaatctcctgctctcttttgccgaagatatgcgcgtcatcctgattatgatcgcagaccgtgtgaacatcatgcgccaaatcaaggatacaggcaacgaggaagaccgggtgaaagtagcgaacgaagctgcttacctatatgctccgctggcccacaaactgggactttacaagctgaaatcggaattggaagacttgtcgctgaaatatacgcagcgggaaacctactactttataaaggagaagctcaacgagacgaaagcatcccgcgacaagtatatcgcttctttcatcgatcctatccagaagaaggtaaaggaagccggactgaagttcgacatcaagggacgtaccaaatccatccattccatctggaataagattcagaagcagaagactccgtttgaaggtatctatgacttgttcgctatccgtatcattctggattccgaaccggacccggccaaagaaaagcaggaatgctggcaggtctattctatcgtaacggatatgtatcagccgaacccgaaacgtctgcgggactggctctcgattccaaagagcaacggttatgaatcgttgcacattaccgtgatgggcccggaaggaagatgggtggaagtacagatccgtacccgccggatggacgagatcgctgaacggggactcgccgcacactggagatacaaaggtatcaaaggggaaacaggactggacgaatggctgacttcggtacgtgaagcgcttgaaaatgcggataacgactcactgaaagtgatggatcagttcaagatggacctttacgaggatgaggtatttgtattcacgcctaaaggagacttattcaaacttgccaaaggagctactgtgctcgatttcgcattccacatccatagcaaactgggatgcaagtgtatcggtgcgaaagtaaacggcaaaaatgtacagctcaaacagaaactgaacagcggtgatcaggtagaaatcatgacgtcgaatacccagactcccaaacaggactggctcaacatcgtgacgacttccaaagcccgcaccaagatacggcaggcactcaaagagatggtagcacgccagcacgatttcgccaaagagacactggaacggaagttcaagaaccggaagatggagtatgacgaagccaccatgatgcgcctgatcaagcggctgggctttaaaaatgtgacagagttttatcagaagattgctgacgagacattggatgtcaacgacattctggacaaataccttgaacagcagagacgggacaatgacacgcacgatgagattgtgtatcgcagtgccgaaggatataatttgcaggcaactcaggaagaacctagttcaaaagaggatgtactggtcattgatcagaatctgaaaggactggaatttaaactggccaaatgctgtaacccgatctatggggatgatgtattcggatttgtaaccgtgagcggaggtatcaagattcaccgggcagactgtccgaatgccaatcagatgcgcgaacggttcggataccggattgttaaagcgcgttgggctggcaagtcagtcggtacgcagtatcctattacgctgcgcgtagtaggtcatgatgatatcggcattgttaccaatattacttccatcatttccaaagagaatggaatcagtctgcggtccatcggaatcaattctaacgacggactattctccggaacgcttacggtcatggtgggtgataccggacgactggaagcgctgatcaaaaagctgcggacagtgaagggagttaaacaggtaagcagaaactaagcactctatgctaacaacaaatctgttgacaggtctttaataaaaagactggcattatctccgtcaggataacgccagtctttttatttatgatagacaatcatgtcacggaaatagtgcgaaacgatttatctcactttctttctcttataatatggatatgtaaccagtataaagaaaatcaaagcaatcacagctaccacctgtcctgtatagagcatcttatccgcttccaaatcgaagtaacacgcaacagctattccggatgcgaatccgacttcgctggccaacagatgagtggtatttgccgtaccccgctgacaatgatgtgacagtttcacgaacatgaccagaaattccggcatcaccaaccccagtcccaaacccaagagtatggaaggtacgcctaccgggaaaccggaggccagcagagtgatggctacaatctccagtatgatgccgacgagcaccagccgcagagttttttctttcagaataaacagacgcgccagcaacagggaggcaagatatccgatgcctgtaccgacaaagaacggtatagggattccactgcttcccaatacggaatcgttaaggaaacggtgtacaagcggaatcaacaatcccggaacgaaggtgatcagaatcatattgatggcaggcacccatccacgcaacagcaaaaagcgatcgaatgaataaagcctggtcacaatcggtgcacggaaaggcacatatactccggataccatcaaaacacctgctgctccggtaatcaccgatacagacaatagatttttaaaggaatagctctgataaagccagacacccagaacaatgcctataatcatccccagacgtgccatccaggagaaactgacatttccggtactgcgaagtgtagcgttcgttatgtcaatggcaagtgtgattcctgcggtggtagcgattccgaaagccagtccctgtacggtgctcaacaagataagttccgtgatgttcgtcacaaaggcgtatcctgccgttgctgccaccatcgtggcaaaagagaacatacatacgtacttacgcttataagcatctacgagataagcatggaacggaccgataaggaacattcctaaagtgaaaaaaagaaagatcactcctgtctgtgccaccggtactccgagacggtctgccatctcaacggaaagtaccggaaacaagatatacagggagataaacaacagcaaattagctacgcatatccgcataaaatgaactgtccacaatttaactgccatatactgttttaatattgttccttctcgttagggaagtcgcaattcttcacgtcggatacgtaacggctgatagcgtcagtcatcaccgtatacaggtctgcataacgacgtaagaagcgcggacggaatccgttgttcattccaagcatatcctgaatgaccaatacttgtccgtcaacatgaccaccggcaccaatacctataataggtatcgtcagttcggaagccacacgttctgcaagagtagccggtatcttttcgagtacgatggcaaagcagcctgcctcttcgagaagatgagcatcacgaatcagcttttcagcttcgctgtcatctttggcacgtaccgtataagtaccgtatttattaatggactgaggcatcagtcccaagtgtcccatcaccggaatacccgcgctgatgatacgtttcaccgtatcgatgatttcttctccaccttccagtttcaaagcatcggcatggctttccttcataatgcggatggcagaagcaagaccttccatttcgttaccctgataagatccgaaaggcatatcgactacaaccatagcgcgttttacgccacgtaccactgatttagcgtgataaatcatctggtcgagagttataggcaatgtagtcacgttacctgccatcacgttggaagcggagtcgcctaccaaaattacgtccattcccgcaccatctacgatctgtgccattgtgtaatcataagaagtaagcatagatattctttcgcctctttgcttcatttcaaccaggcgatgagtagtcacctttcttgtgtcatctgatatataaccagccatgtttcttaaattttaaattaaaactagaaattaaataaggcgtcaacgccatcaaaaattgcggcaaagttataacatttctttcataagtgagaaagaaaaagaaaaaatcctttcaaacacctccccaagttaatgagaaggcggccaaaaggacaaatcaagaagataacaagaaaaaactaacgatgcaaagccaataagtgttcaaaggtcatttccgaaaagtcatctattatataatgtgcctttccggtgatggcctctcttgtattggtagtggcaagaccgataacggtggcaccggaagtcattccggcttgcagaccgtggaaggagtcttcgaacacgtacgagttttcgggagtagcaccgaatatttccataccgagcaggaaacagtcgggagcgggtttggaacgggcaaacatttctccggtcaggatgcggtctaccattcctttaaattcgggatgggcgttatagacgttttgcatcttctcttcgttggagctggttacaacggctatttttgctccgtgtttacgaagatcggcaataaaagcttctacaccggggatgtactcataggacatgcttttctcataaatattgagtccggccgtaatctcttgttgagcttcggggaggtccgagaaatatttctcgtaaatctgggtcagcgtctgtcccttgatacgacggccgaagtcttcttcattcagatatttacgcccttgttcatcccagaaaacagtgtactgtgtttccgtatccatgatgacaccatcaaaatcgaacagtgccgcaattgtctttgttgtatccatacgtaatctttctttttacctaaaacgttaaaccttgtgtattgaattgtgcaaagttccgaataatcatcgaatcaggcaaataattcgtacctttgccccacttaaaaaaacgtaacattcgttttcatccaacaatccatacgagcgcatgagcaaaaacgatccgcacatattaggaaaagaaagcatcggtaaactactgttgcaatactccattcccgctatcatcgggatgacaatcacgtctatctataatatcatcgacagcatcttcatcggtcacggtgtgggtgcgatggctattgccggactggcggtgagctttcctctgatgaatctggtcgttgctttctgtacactcgtttcggcgggtggttctaccatcgcttctattcgcctgggacagaaagatatgaaaggggctacggagattctgtcacatacgctgatgctctgtatcacaaattctttctttttcggtatcctgtcttttatctttcttgatgatatactgactttctttggtgccagtcccgacacactgccttatgcacggagttttatgcaggtgattttattgggaactcccatcacatacacgatgatcggtctgaataatgtgatgcgtgccaccggatatccgaagaaagcgatgcttacttctatggtaacggtagtagcaaatatcatcctcgctcctatctttatctttcactttgaatggggaatgcggggagcggctacagcaacggttatctcacagctgatcggaatggtatgggtggtgagccacttctgcaagaaagacagtacggtgcattttgagggaaaggtctggaaaatgaaaggaaggattgtagagagtattttcgctatcggcatgtctcctttcctgatgaatgtctgtgcttgtgccatcgttatcgtgattaataatagtttgcaggaacatggaggcgacatggctatcggtgcttacggaatcatcaaccggttgctgacgctttatgtcatgatcgtattgggactgacgatgggcatgcagccgattgtaggctacaacttcggagcacagaagatagaccgggtgaaacagacgctaaagctgggaattatttccggtgtagtgattacaagcagtggctttctgatttgcgagtttttccctcatgcagtatcggcagtcttcacggatagtgatgagttaatcggacttgcggtggacggtcttcggttgactgtacttatgttcccgtttgtaggagcacagattgtaatcggtaacttcttccaaagtataggcaaagtaaaaataagtattttcctttcgttgacgcggcagttgctttatttgctgccttgcctgttgttattcccgcattggtggggactgaagggaatatggatcagtctgccggtatcggactctttagcatttattacggcagttatcagtctgatgatttatataaagaaagtatcgaaagaacatccgatagcggataaagtggcggaataaagcaaaaaggacgctatgctaaaagatatatcagtatgaaaaatatttaggcacgaatacacggattaagattacttctgcaatgaatgcatctcataaaagccgcgttaatccgtgcctaaaagataataatattcttattcgctctttatacttttcaccggattctcattggcgatgtgccacgctttcaacacaacgcaaactacgatcagcaataagacaaacagcgccgtacccacaaacaataacgggttcatataaatctgttcggcaaactggtcaagccatgcctttccgacaaaataggaaacaatggtaccaatcaatatggaggatgcggagacatacagaatctcgcgtatcaacagacgcaaaatatgagaagcttcggctccattcactttccggatagctatttctttgcttcgacgttgcgtttcatcattcacatatccgatcaatcccattattacaatcagcagaataaagcttgaagtgatccagactgaattacggaaacgatatacactcttgtatatatcctttatcataccgtctacagaactgaaatgcaaggctacattcggaaatgtcttatcggcaaactcgttcagacgtttcagattttcatcatacggctctttcaaacggacatcaaatacatgattggtattctccgatcctatcaagacaataggtgcctgagttgaaaagaagctatagttgcggacatcccggaagacaccgacaatcgtaccctgtatatcattcagtttctttcctaccgccccatctgtccatttcatcagacgtaccaactcttcattcaccaataaatcgtcctgtttcttaagagtgctgccttcgataatctttattcccattacttcgggatagttataactgcaataattaaagttaagtgtagcgattcttttaccgtcattactcatcagtccgcgtgtccagtactgtccgattactccgcttgtagcaacagccactccctctaccataggctggcgacgcagttcatcggtgacatgctctaccgtttctttcggcaaccaggttcctgcctgaaccagtcccggaacgtttattcccatatcgcggctcatcagatggttgtattgcaggagcgttaccagcaacagccccaaaacaaatgagacacctgtgaactgtataaacaataacgaacgtttccaacccgttttaccatcagagtaacgacggaacacctgcgtgactggtatacgcgaaaacagccgtcccggtatgccacctgccaaaaggaaaagtatcacaatcgtaagcaaaggcacccatagtgtctcccacgcaaaaagtgaggatagacggacagaaagcaaatcttcgattatttcatgtgcgttgactatcagcagaagactaagaagtacggaaaagataacaaggattcctgtttctgccaaaaacatgccgaagatatttccggaactggcaccactgcatttatgtactcctactcctttggcacgacggcttagggtggcaatagatatcagcatataattcatgatggccacaaagaagatagcgaatcccagaaagccatatatgatcaaacgcttctgcacatcggaagatatcaaatgatacttcaccaatgggatgacactgaaattcattttccagtcatcatactgggcaggagtgtatttttcgattacccgttggatgttgtcattcaccttgtcaatatccgcagcattacgcaggcgaagaaacgtgtaaaagacatcatttcccttccagccatatcctccctgatatcctccatcccgatggatggagacaacaaagtcgtgagtgagcaccgtattctccggcatatccttgtatacaccacgaatagtaaaatcattttgcctgtctgctttaagaattttaccgatagggtccgcatctccaaacgtttcacgggcaaaatgctctgacacaaacacacttcccggcatgatcatatctttcgggttcccttttaagacagggataccaaaagtctggaagaaacaagtatcagcgtatatatagttaacgtccgataataatttgtcttcgtaatatatactcatcccttgtccggtgaggacacaactggcaaactctatttcttcgggcatatcctgcgccaaagtagatgcaaccacatcaaaaagtgtgtaatcataattgttgccgtcgtctcccattgtctcccccgtgctaaggttagtggtcaggcaacgtgcaatagccagtcgttccggttccggatagcaacgttcataactcaattcaaacgcaatctgcgaaaagagcaaaataccaatagtaagtcccagcgaaagagaaattaccctgatgatatttgtgccgcgttcgcgcagtaaggttcggatgctataatagatttgtctcattgtcgttccggtttatgccgttacacttgccactacactaccgtcaaacagatgtacggtacgatgtgcgaaactcgcatcgtgctgtgagtgcgttaccatgataatggtggttccctccttgttcagttctgtcagcaggttcattacttccgcgccattcttggagtccagattaccggtaggctcatcggcaaggataagctttggattagtcactaccgcacgggcaattgccacacgttgttgctgaccgccggaaagttgttgcgggaagtgtttggcacggtggctgatattcatccttttcaagatgtcttctaccatgcggcggcgttcggaagatttgataccaagataggtcagcggaagttctacattctcaaagacattcagttcgtctatcaggttaaaactctgaaatacaaagcccagtttgcctttgcggacgccggtacgttccttttctttcagtccggcaacttcttctcccaataatcggtaagaaccttcggttgggttatccaataaaccaagaatattcagtaaggtggacttgccacagcccgaaggtcccataatggcaacaaactctccttcctttacttcaaggttcacgtgatttaatgcgactgtctctacttcggtagtacggaatactttactaatgttttcaatctgtatcatcttgttcatttattatgttgttatactttttatttcttctttattcgctctttatactattgaccgggttttcattggcaatcttccatgatttccaaagtacacatgccacaatgactgccagatttgcaattgctatcagaagataggcagcccaactgagcggaacatgttcggcaaacaaatccatccacataccattgacgtaccatgctgctaccactccgattaaaactgcaacaacagctacataaagcacatctttcaccagcagttccaagattccggttgcttcagaaccattcaccttgcgtatggctatctccttggaacgacggcggacctcatccgtagtgtagcctatcaatcccatcaacatcacaaaaaacattgttattgccgccagcatcgtagcattactgaaaacacgaacagagttataattctctttgatcatctgttgcatcgaccgaaattcgatagtcttatcaggaaatgcactctccatctccttattcagtttgagaagattctcggcaaaaggttctttcaaccggacatggatacaatcaccaaacctcttggtgtgcataagcagcaacggttgttgcgggctggtaaaacttccgatgcgataatctttcatcacgcccactaccttacatacgtatcccgaattataaaccgtacgattcagtatattgtttccccaatgcatccactcggcaaaagtctcattgacgactgtctcatcgtcaccacggggcatacgtccctctttcagaaccatccccatcatcttcggataatcatccggaacactgcaataacgggatgaaaatagtgactgtccgctttcatcattaataatcgttccactatatccgtagacaggatgataagtggcactggacacggattccacataaggcatattccggaaaacattcaaggcataatttcctttttcttcctcaccgaagctggcattggccaccactacacgctttggattataacccaaatctttattcaagatataataatattgcatcatcaccacatacatcagtccgcaaataaatgctacaccggcaaactggataaacagcaacggtcgtttccagccctttttaccttccgtgtatcggcggaatacctgagtaacgggtatccttgcaaacagtcgtcccggcaataccccacccacaacgaaaagtacagccaccgttaataaaggtacccaaatacgatccaagctgaacaaagcgcttaacttgacagctgccgtatcttcaaagaaatcctgaaaattcaataagatcaatcccatcaggatcagggcaaacagaatgataatcgctgtttcccaaagaaacatactcaatatggtcatgtttcctgccccattgcatttatgcacaccgaccgctttcgcccgataggaaagtgatgaaacagaaatcaacacataattcaatgaagcgatgaaaagaatagtaatacccagaatagtcatgatgttccgcatccgccttacatctttattgtcacggtatacatcacggatgggctttacaaaagcggtatatccaaccactttttgatcttccgcaggacgatacttctgtatcattgcgtctatccgggcattcactaccgacttatcggctccgggacgaaaacggatgaacgccagccagctgtcgccgcctctccatgagtaatttccccatttgcggctccatatcgacggcagagaaatcaccgcttcaggccttaccgtcgcattctccggtatatcagcataggtgccttttaccgtaagttctatctccttactgtatgagataaccttgcctatcggattctctgtgtcgaacatctttcgtgccaaacggtcactcaggtaaactacatctttttgggctaaatctttcaccggagttccgcttaagacctcgattcccatcgtctggaaaaagagggaatctgccgccagctttctgacttcaaaacggacactaccatgatagagaggatcattcacccaaaggcagtaactggtagccgcctccacttctttgggaaagttttcaagaattgcacccgctaccggtccgcaattttgatcctgcggttcgagttgttcgccattcatcgtaaagatggaaaagacttgatataagttttcataatccttaaagcatttatcaaagctctgctcaaaagccacgcgggcaaataataaaatactcattgtcagcccaagccctaaagaaatgaccttgacaacattggaactacgcccccgcagcaaagttcgaatgacataatagatttgtctcatgattatataatatattcctgttttttttatgatgcagtgcagataacgtgccacaatagtgagaatactcattctcaatcatttatagttatctgtcctatcatctactgtctaataattagacacatgcgtctaattattagacaaagacaatcgtatttcttttctcagtggaaagtatgcattaatgcctatttattgttccatttttcttatttcgcccaagcaatcgcccatatctcaactgaaaactctatcttcgcatcaagttttcaattaaataaattattctatttatggtaaacaagaatttatacactctcctggtctgcctgcttctggccggatgcgatctgatagactaccacccctacgatgtacgtatcagtggagagacagacgtaaatgctcataacattgaacaaatagaagctaagtgcaaaggaaagacaaccatccgttttatcacgatgggcgattcgcagcgatggtatgatgagacagaagactttgtaaaagaggtcaataagagagatgatatcgatttcgtcattcacggaggagatatgagtgacttcgggctgaccaaagagtttctttggcagcgggacatcatgaacggactgaaagtgccttatgtcgtccttatcgggaatcatgactgtctgggtaccggagcagaaacttatcaggctgttttcggacctaccaacttctcattcattgcgggcaatgtgaaattcgtctgccttaataccaatgcgctggaatatgattattcggagcctattcccaatttcggttttatggaacaggaactgacggacagggcggatgagtttgaaaaaaccgtagtcagcatgcatgcacatccttttgcagatgtgttcaatgataatgtggcgaagccgttccagtactacatcacccaatatccgggactacagttctgcacggccgcccataatcacggattcgatgacagaatcctttttgatgacgatgtgcattatattgtcagcgactgcatgaaaagtcgcagttatctggtatttactataaccccggaaaaatacgaatatgaactggttgaatactaaatatatgatccgcgcaggagtactgactatgcttctactcttccccagcctgctttcggctacttgcaagccagataccattatcaggaactataaacccgactcgctgaaactggcaattaaggcagattctatcatagcctttcatgagggtgattctgcattcacaatagtcaaagcagacacagtacttccttatattgccgaaccggttcttcgcaccggctacgacagacgtgtacatcgcttccgcaaaaactgggaacgcatcattccgacccactctaaaatacaatatgccggaaatatgggattactctccttcggcaccggatgggattacggaaaacgaaatcagtgggaaactgacctgttgctcggatttatcccgaagtattcgtccaagaaggcaaaagtgaccatgacactgaaacagaactatatgccctggagcatcaacctggggaaaggattctctaccgagccgctttcctgcggactatatctgaataccgtattcggcaatcagttctgggtcagcgaaccggaacgttatccgaaaggatactatggtttttcaagcaaggtgcgtatccatgttttcatgggacaacggctgacctatgatattgaccctaaccgccgatttctggcaaagtccgtgactttcttctacgagataagtacatgcgatctttatctgatcagtggtgtaacaaatagctacctccgtccccgtgattatctgagtttatcattcggattaaagttccaatggctataaattcaaatccgaattttgaattatgaattactttttcgtaagtttgtagcgtacaaaccaattcggacatgagtaaatcaggaaccatcatcattgtagacgataataaaggggtgctgacagcggtacaaatccttttaaaaaactacttttcgaaagtcgtcacactgtcgtcaccggtcacactgaccactgcgatacgagaggaaacaccggaagtggtactattagatatgaatttcacttcgggcatcaataccggcaatgaaggattgttctggctgcacgaaataaagaaagtacgacgggagcttcctgtcgtactttttactgcttatgcggatattgatctcgctatccggggaatcaaagaaggtgcttcggactttatcgtcaagccctggaataatcagaaactggtagaaacactacaggctgccgcctcatccgcacagcaaggacgtaagacaggaaacaaaaaggaaccggtcaacactccggcactctattggggagaaagcaagtctatgcaacaactccgaacactgatcgaaaaggtagcctccacagacgccaatatcctgattaccggtgaaaacggaacaggaaaagaaatgcttgcccgtgaaattcacgctctttccaaccgcaggcaacaggaaatgattgctgtggacatgggagcaatcaccgaatctttatttgaaagcgaactcttcgggcatgtgaaaggctcttttaccgatgcgcataccgaccggacaggaaagtttgaggctgccgatcacagcacattgtttctggatgaaataggaaacctcccctatcacctgcaagccaaactattgacggctatccaacgaagaagtatcgtgcgagtgggaagtaacactccgattcctattgacatccgtctgatatgcgccaccaaccggaatttgcaggaaatggtagaccgggaagagtttcgggaagacttactctaccgtatcaacaccattcatatagaaatccctcctttgagggaacggaaagaagatattgtccctcttgccgaaagatttatcatccgcttctgcaagcaatatgataaggaactgatgaaattcagtccggcagcgaaggaaaagcttaccgcacatccctggtacggcaatatccgcgaattggagcacgcaatcgaaaaggtggtcatcattaacgacggggtgcaaatccctgcggaattgttccagttatcctcccgaaagacagaaacttccgagaagaatatttccaccttggaagagatggaagtacaaatgatacggaaagcgctggatgcttgtgcaggaaatctttcggcagtagctgcgcaactgggaattacccgacagactctctataacaagatgaaaaaattcggattatgaaccggattctacaacaagtagccaaccaatattggttcagggtatcactgacggtcatttgctgtctggcgactatctgtttgggcgtgcatcagtcttatgtctggttcagcgtcagtgcctgtctgctgatcttaagtatcatctggcaagtccggctttatcgcctgcacatcaagcaggtgctcttcatgatcgatgcgttggagaataatgacagtgccttccgtttccccgaagagtccggtactcccgagagtaaacagatcaatcgggcactcaatcgggtgggccacattttatataatgtaaaagcggagactgcccaacaggaaaagtactacaaactgattcttgactttgtcagcacgggactgctggtgctcaatgataacggagcggtctatcagaaaaataaagaagcactccggcttttgggactgaatgtatttacccatgtccgccagttgagtaaagtagatgctacactgatggagaagatagaaagttgttgttccggagataagctgcaagtggtgtttcacaatgaacggggaacggtcaatctgtctattcgcgtgtcagaaatcaatgtacacaaagaacatctgcgcatccttgcactgaatgatattaatattgagctggacgaaaaggagatagattcatggattcgcctgacccgagtactgactcatgagatcatgaactccgtgactcccatcacttcgctcagcgatacgcttctctcgatggtggaggacaaagacgaagagatcagccacggactgcaaaccatcagtgccacgggaaaagggctgcttgctttcgtagaatcctaccgcaaattcacacggataccgactccggaaccttcattgttttacttgaaagcattcatcgaacgaatggtggaacttgcccgccatcagaatccttgtgaccacatcacgttccatacaaagatcgatcctgccgacctgatcctgcatgcagatgaaaatctgatttcgcaagtagtcataaatcttctgaaaaatgcgattcaggcaatcggtgatcagccggacggacaaatcgacattcaggtttattgcaacgaaacggaagaagtgctgattgagattaagaataacggtcccgtcattccaccggaaatagtggagcacatttttatccctttcttcactaccaaagaaggaggcagcggaatcggactaagtatttcgcgtcagatcatgcggctttcgggtggaagcctcacgctgttaccggacaacaaggaaacgaaattcatattaaaattcaaataacagaccagcctatgacacctgcactcaccaataacccattattccgggggattactccggagaagttatccgccaatctggaagagatcagtttccacacccgttcttatagaaaaggagaaatactggcacgacagggagatgtgtgcaaccgtctcgtgatactgaccaaaggaagtgtccgtggtgaaatgattgactattccggaagactcatcaaagtagaagacattgccgcaccaagggcccttgcccctcttttccttttcggagaagagaatcgctttccggtagaagtgaccgccaacgaaccgacggaagtaatcgaaatccccaaagccagcgtactggagctttttcgtaggaacgagcagtttctggagaattatatgaatctatccgccaattatgcccgtaccctatcggataagcttttctttatgtccttcaagactatccggcaaaagatagcatcttatctgctacggttatacaaacagcagcaacagctacagatcaccctcgaccgctcgcaacaggaactgagcgattacttcggtgtctcccgtccttctctggcacgtgaactgtcgcacatgcaggaagacggtatgattatagccgaccggaaacagattactatcttacagaaagaatggctgatccggctgattcaatgaccaagagttcactccggtttcattatagctaatctttttttcattatagctaatcggaatatgattatagctaatttaatttagctcatagcatccgattttttttcgcccaatgtaacattggttacaaacttacctcaaactttccccctacttttgcgttcataatcaataagactaattaaaacgtaaaagttatgagtatgttctgttatcaatgtcaagagaccgcaatgggtacaggctgtaccttaaaaggagtatgcggaaaaacatccgaagtggctaacctgcaagacctgctgctctttgtagtacgaggaatcgccgtgtacaacgaacatctgcgccgggaaggacatccttctgaagaagcagacaaatttatctacgatgccctgttcatcaccatcactaacgccaattttgacaaagcggccatcatcagaaaaataaaagaaggactacaactgaaaaacgaactcgccagcaaagtaaccattgcaaatgctcccgacgaatgtctttgggatgggaatgaagatgagtttgaagagaaagccaggacagtaggagtacttcgcacacccgacgaagatatccgttcgctgaaagaactggtacactacggactgaaaggtatggcggcttacgttgagcatgcgcataaccttggataccagtcgccggaaatcttcgcctttatgcaaagtgcactggccgagctcacccgcaatgatattacgatggaagaattggttcagcttactttggcaacaggcaagcacggagtttccgccatggcacaactggatgccgccaatacaaacagctacggaaatccggaaatatcggaagtgaatctaggtgtccgcaataatcccggtatccttatcagcggccatgatctgaaagacctcgaagaattgctggaacagaccgaaggaacaggtatagacatttacactcacagtgaaatgctccccgcacattattacccccaactgaaaaaatacaagcatctggcaggaaactacggaaatgcctggtggaaacagaaagaagagtttgaaagtttcaacggaccgatcctgtttaccagtaactgcatcgttcctccgcgtgccaacgcttcttacaaagaccgtatctacatcaccggagcctgcggactggagggagcacactacatccccgaacgcaaagacggaaaaccgaaagatttctccgcactgattgcacatgccaagcaatgtcaaccgccgacggccatcgaaagcggaacgttgatcggaggttttgcccatgcacaggtagtggctttggcggataaggtagtagaagccgtgaaaagcggagcgatccgtaagttcttcgttatggcaggatgtgacggacgtatgaaaagtcgtgaatattataccgaatttgccgagaaacttccgaaagatacagtcatcctgactgccggttgtgctaaatacagatacaacaaactggctttaggtgacattaacggcattccccgcgtattggatgcagggcaatgtaacgacagttactcactggctgtcatcgcactgaaactgaaagaagtattcggattggacgacgtcaacaaacttcctatcgtatataacatcgcatggtacgaacagaaagcggtgatcgtattgctggcattgctggcactgggagtgaagaatattcatctgggacctactcttccggccttcctttcaccaaacgtaaaaaacgtattgatcgaacaattcggaatcggtggcatcagtaccgcagacgaagatattatgaagttcttgtcataaacacaagacgtatatacatgctaagccttaactattaaatataaaaaggaggagtgtcaatagtaactaaactggggctgattaaaagtcggtcctagtttagttactattaaccttgacacagtcctgactatttcaagaacagagtcaatcgtccttcggtaatatcaaattaagaagtactccgaccaaagcggccagtccgatgccggataatgaaaagtctccccacgtgagaacagctccgccaatgccgacagtcaatgtcagagagacaatgatgatgtttcttgtacggctcagatcaatacagttattcaccagattacctattccggcacaagcgatggttccgaacagcaaaagcataattccccccaataccgcactcggaatggatttcagcaacgcactgattttaccgacaacggagaataagatagcggatatggcagcaatccggatgacttgcggattggtgattttcgttaatgacatcgcacccgtcacctccgaataagttgtcaccggaggaccgccgaccaatccggcaaagcagcaagccagcccatcgcccaacaacgtacgatgcagaccgggatctttcacgaagtcttttcctgtaactgtattgactacgtatacatctccgatatgctctatcaccggagcaatagctaccggaatcataaacagtatcggctcccatgagaacttgggaaacacgaactgcggcagcccgatccatgccgcatccctcacaccggacaaatccagatcatagaaaagccatgccgccagataaccgacaatgataccgcaaaagataggaatcaacttcaaaagtcctttcgctttcatcgagacaacgactgccgtaaccagcgacaacaaggccagcacccagttctccttcgccatatttactcctgtccccgcgagtgacaaaccgatcagaataataaccgggccaataaccaccggaggaaacagacgttcaatcaccctcaccccttgccatttgaccaacgcgctcattacaaaataaaccaatgcgacgcccaccattccggacagagtgcccgctaatccgtaaagttctgtcgcttttattatcggggcaataaacgcaaaactacttcctaaaaagataggcactttccctcgggtaaccgcatgaaaaatgagtgtaccaatgccggctgtgaacaaggcggtggaagggtcaagccccactaaaagcggcacgagcaccgtagctccgaaagctacaaacaagaattgtactcctaccactcctttccgtaaaggagtaagattgtttgaatccataagtatgatgtagattaattgagtgcaaaattaatctttttagacaatttaactaccttttttcacaaaaatacatccaaaaagactctttatttgttttaaataatgtgtaacttcgcacggtgagacctattacgacacatttaataacttaataatatat

SEQ ID NO: 57 - DNA, 47466 bp, Bacteroides thetaiotaomicron
gaaaagaaataatctcttttctcgttatttcctaattcagaggatagaatactttattgattccatcaaaagtaatatcccgaaattttaaaaagttttcggcaactttgaaaatattgggagtaaagttgtgggagagtttctcccacaacttttatttgaaaaatctatttctattactaattccgaattacataatttcctcttgagtataccaagtccaaggattaggtataatttcaatagacaaccagccttcgtcactctcatccggcgttccttcgtccggatccggaatagccggatatcctggattgttaaacttcttaacattgatatcgtaaacagagttacgaacaactccaaattcacctaattcatttgttacagcactggtatcatcatgtttgatcataattttgtagtaacttacagcacctacataataagtaagacctgttacagttatagctctgtctttagctgcaacatttcctacattagcttttgttgctttaaaatcgtcaacaagactggtaatagctgtagcatcagctgtagcaggaaggctaatttcacctacaccaacagcagctaaatatctattatacgcagtagtacgagcagtcgggaaggtagtaggctctttatcagcatatttagctttcaattctgcctcaatccactccattaatgtagcaaaagtatagaagccaccattgattaacatccagtcaccgacaagtttcggatctgtttcctgagctgtagatggagtaccatcatttggcgcaggtctgccatattcagacggaatgaatttagccttcaacagtacatgtgtagtataagcatgtacattatgagttgcagtctgcgtattttcaagacaatattcagcaactttattcaccgtagttgtaggatcattccaaattgaaggagctgaagtactggtataagcattatagttagccaaagcttgagtactatagttagggtcaactctgtatgaaccgatcttatactggtcaaacggagtaatacatgtaccacgagcacctaaaggtttattagcaggagtctcattccaagtcaacgttctcttagatacagggaagaatgtcttgttagtagcattcaacacccatcccgcatccgaaatagttgcctttgcatcagaatcagcagtaacatatacacgaacttttgatacaacacggtcaattctgatagatattggattattagtagctgctgtctcagttgcataaagagccaaatcgacaggagcaccaaatgtccctgaagcttcattttcatctgaaggttccaacgaacccttagcgttagacatcataaatttaccagcagttgtcatagaagccgaagtatcgtcaagagctgcatttactgttgcataagtcgttccaacaggccatttttgatctgtctcactagcagtctttgcttcaaatttaggagatggattcgcaataatcaatattcgtttagaagttgcagggactttaaaagccttacctgcagccccactaggaataccattggcatcaagaccagcttcgtcattatccaatgtcaagtcagcagttacagttgcagcatcctcattcgcatttgccgtaaagaatatggcacgcactgtagtgatttttgattcgtcctctgttgcagcttcctgattcgggttatgcaatccacgagtttgtaccggagtctttacagctaatgccacccatgcgtctcctgtcgggtctgtcaccaattgattatcatcacctggattcccagtcggcactaaatcttcgttactacaagcagcaaaagccacagcagcaagcgctaacataaaaaaattctttttcttcattgtttttacaaattaataaaagcgtttgtaactagtttatttatccctattttctattttttctatttcagctgcattcgtttttttcttagccagttcctccaaattctgtccggcagcttgcagacccgatttggctgcggctttcaaatattcttccgcatgttcatactctccttttaataacattaatacacccatagcattgctatactcaggcagctgcttattgacatttaccatattcagatagcgttccgcagataccaagtcattacgcgaaagagcagcagcggcagcattaatactggcgatctcatccttcggatacattcggaccgcagtctcgaacacatcgatgaattcctgagaacccttcggatagctgttggcaaccataaacatttcattcaggctcagattctgaggacgtgtctttatgatctctttcgcttcgtccagattaaagttcttaatctcataattcaccttacaaatagccacacgaagacttgggaatatatatttcaacatatatcgataaggtactccgccacgaagctgcatcaacttagcttccctacctttttcaacagggatatcattgataatattcagcgcttcatctttatattcaaaatcaatcgtatccagcgccttcaccagtccatcccagttttcaccaccaaagatgatataatactgatttctcgagaaatcgtatctggatgccagataatcacgtagcgccatcgcacgtccttcggacagacgtttgttatttgccaatgatccttcaggtgaagcatagcctacaatatccaatttgtttaccttgatactaggatcagacttcaattcatcaatcatcgcacggatcttagccagctccttcgggttattcatatattccggacgaatattaatcttgttcacctcgaagtcaaggaaacattccgcctgtatatcacggctcttcacttcttccgctttaggctgcaaataggcaaagaaaggtgttaccacgtaaggtactaatatacgttccagttcaatatccccaagtggttccacatccatcagctgaatttcgccgcagccgcattcgtcgcgctgtacgtccacccgggcatcgtccatccacgattcgtaaggcaatatatatctgtatcgaatcgtatcatttcttttcttgctacccttttccaccacataaggtttttcgtagctatccttctccttcgcactcatcaatgaaagccagcgttcatacgccaggtattcattatgtcccttgatggatactttcggaagattgtaagtatatgcaggagcaaccagttgcggaataaaatccactccgtgtgccgatttgacctttacatcctccagaacgaagtcaatatttatataaaccgatttaccgcgctgttccaactgtaccggtactacagagataaccccgtcataagagcgtgtctgggcaactgccgaatttatattctgacataagatagccaatacacacacgatgaattgtatacttctgttcatcattctattctactttatttaattacgtaaataagtgacacactcgctttggtgggaccgaaatagtttttactactgtctttcagtttggtaccacacgccctgcacggatatttgtcatatacaatatgtgcataccccactcctaccgatgcttcgatgctccagcgtttcttcagaatccatgaatgaccgacggaaacacccccgccatacagatatccctgatagcggctgttctgcatattctcactaataaacgaccagtccgggaacccaccgacattgaagtccgcataatgtccatgcactccgatgaacgtacgtctgaacttctcacaaaaccagtagcggacttccggctgtattccccaatggcgcagacgtcttccgttgtccggcttccagggattatagttcaccggaacgtccagcgtccacttacgtgccagtccgaattccagcccgagattcatggtagtcgtagcgtcatatagaaggttgcttttaagcgcaactttctgagctttactctcgataaaacatccgagcaccaatactatgagtatactaactttcttcatttatcttacgtttattaattacccttttgagtgatatcaattttgatacgcttcaccgtactttcacctgtatataaactaccgggcataattgttgtcagatacacgataccgtttctcgttgttgaagccgtattaggcattattttaatatagatatgcccgtcttccactatgattttatccgtatcatttctgtccaccatcgaagatggcagtaattttatccattccttaggattgtcagtaccatcttccacctccccggtaaggcaatgataatccacctcaccagtcgtcggaaacggataactattggcaggcatgtatttaagtatggtaccgccggcatcaatagccgctcttcgtctgatatgaacctgtttttccaaatttccaagttttaatgttatatatgcattcactttatctcttccctcaaaactctgccccacttcactatacatcagccagctttgtatcaatacactgaccggagtgacacgtggagaagtgcttgctactataggcaattttccgtcagcgggactgcttagcgcaaacgaattatcagcttcggccatattgtcggttattgtacgcgcatccggaaaagccttttcacaatccgttatcactttaaaagcctcataagtactcgcatcatccggagaataagctataaagacagaattactcacacccagataataatcattgttagctataatctcataagaattactgtcgtccactgtaatttcaaaatccagatccgtattcgacggtttagaaagctttgcatccgctacggtatcatacccccgtccatgcactttctttattgtaaaagtatacgcatgattccgatatatattcatatagttcagatccttatctactatcgccattttgtaataatagcttttggtttcataaattccctgaatgatcagatatgtactataagtctgggtattggtttcatagatataaataggactgttttcggtactttgtttattggttatcgtttctgctgacaccaaaggcaacgagcatgaagcatcgtattgataattcgtcaaattaccagcattgcccataatagaagcagggataaggttatgcaactgcccctgtcgcggaacgtttgccacagcagacactccttccagttcaaagttcgatgcttcattaacaaccacgattttggcaaccgcccgaagaagcatcaacgaactcccgtcactcttttctatcttcgttgtattatccaccttatctacttccagcaaataactcatcggtatcgtctcacccacaccgctgaacgggatgcgggcaggagaagtacttgccggctccgtcagcaagttcgtacatgcagtagccagggtagttgttccctcaatcaacttctcagtaagttgtgactcattgaaaacatatcccgtagaagcatttccgtaataaaactgagccatcggattagctaatatcagcaactggtacttacttccatcagtccgcttagttaaaaggacatatcgctttcctgcaaactcgaaggcctgcacagcttctacaaaaatagcccctgtgccactccctctgaacacgagtacccagggagtcatttcgaccgtattttcatcccctagtgccctggtcgaaggcaggcggtatgaattcgcccgtgcaaaaatctcaagccgcaccttgtcttccgaaatatctcccggatcatccggctctcccgtcaacaatgtttcatgctcacaggcggatatcagtaagatgatcaccagaccaaatatcttcattatatatttcatcattttcttcatcttttcacgcaacgtattgataattaacctcctgtatcatcggaattaattgttcggacaaggaatagcgttctgaatacacaatatcattcagattatcataagcagtaatataattcaattggtttattacgggaatattatacggttcattggcaaaaaatacaaaatcatacgtttccggattgactagatgtgtactgctctgaacacctattcctctgatcgaaataaatgtccctttggcagtagtattattagtgaaagtatcatccatacaagataatatagctactaataataaaaggttgaacaacccaatattcactttaaatccctctaatctcattaaacattcgtatttacctgacattggtactcagtcaagccttaatctgtaatcagtcaaaatctcataatgcaaatgtcgggatattgcatgactctgcgaatttcattcatttctcatacagacaatgaaagttatcttatatggctaataaagaggtcgtccgaatggaatattgcgaaatctaaaaataaggagtagtaaaacaggcattttgcactattagaataaaaaaaagacaaaagtttcagcattcgaaacttttagtgtgaattaatataaataaattccataataaaacaagcccccggataatctcatccgagggctatgttatatactatgatacaggtgaaaaatcagagtgttttacgttctgtctccgtaggtgccacctcatccgggatactgaactcccggttggcaaacaaatccgccagtcccgaaatctgcttcaaacgcagcagttcatcccgatccattccgatatttttcataatccactggtcggacatgccggctctgtccaattctgctacaatgttacacatcagctcaatattatgcatcccacgggcacggttgtgccggatggtagagctcatacgattggacaaatccttatcgatcaccacaatcggaagcaatccgttctcacgcttataaatccgtttcgatgtcttcaataccgtatatcggtgataaccatctacgaggatataattatcttcctctttattgtaataacatacacaaggcattgtaaaaccgtcttcccagatcgaaagctccagtaacttcatttcgggaggagctacgacattcgggttataatcgttcgctaatactttttctacgggcactgctttcacctcgtagaccggacttttatctacactcatgatactatgattctatattgttccataacttgacttctcttactcatctcctctttggtcggcgagaatcccatgtatttgcaggcatggtcattcttgaggatacagatacacatacgcttgtaagtcggtatttccctaaattccggaatatcgatatcatcctgatattccatgcgcaccggcttcttgtatgtcttatagttgctattgtccatcacgataatcggcactttggcatcaatcagtttctgaatggtggaatcactcagacagcctcctttggttcgccaaaaatgtacactgacagacagtttacgcagatacccctttcgggcccgttccggcaaggtagagagcaggaagtacataaactccctccaggtgtacccttccggaagtttcaccatctgccatcccatagcgtgcgtgcctccatacataccggtgaagttcacgccattcacccgtcctatcatcttcccccaggtgttagggtcaagcacccggtagagcgccagactctcctgcgcttcattgatgaacgggcttgctacccgttgacgttccagattgactccggcacgataatacaggtcatacagtacattatagtcccactggaattttccgtttgccgtccacacatccgtcgtcttccagtcgaagatgggataggcattatagatgtcatttccgacctttgaagtccatctatacttatgatacatctggaatttgcggctcatatagatacatcgccagcggttaaaactttcctgcgtacggataccgatcagacagcaggtgcgtaccgcatcctttttctgatggagccactgcgcaaaacgcatctgaaattcataatcccacatggtcgtattgtaaaaaggaaaatcctccttcttcatggccttcttaggcatggagcgtacccagatatctttcttgttatcctcccagggccgccagaaggactggtacatagatgtacacgtagatacccggaaaggcacgcacacacggtatacatccaggatgtccttgttcgcctccagtatcctgtccacatagtcgatggtcatcttgtattgaatctcatagtccatgtgaaacactcccaaacgtattttcagattattccgcctgatgtagtcgatacacatattcagcagaaccccactatcctttcctcccgagaaagatacataaatattatcaaactcgttaaatattactttcagtcgctcttgtgctaattcatatacattttttgttcctgtgattgttttttttcccataattcatctgttcatttttacatagcgtgtccacttcttgtccatagatgcaaactcgaatttctcaaaagtttcctgatcttgtatcagcgtgacagagttaagcgtccaacccgcaggtataaatgccgtgactacagaagatagcagaagcgacaagatctcttttcgtttctcgtccaccgcagctacataataattattaatgacagcctttttcccgcttttctgttcaaccggaataaagcctatcacatctctgttatcaatcgcaatgtaccaaacaaaatcttcgcttgtcttgaacggatagttattatttgcacgtattacatccggatccattactagaggcgccaaaagctgatataaatgtttgtcttttccttttaattgtattacctgtatcatagcattcaaaaatagacagacaaaaataggtaaaatttcctcgtttcagcacaaagcatgcgtaaaaaatttattttttagcaattccccctcttgtttcataattatttccaattctcccaccatctgatgagtgcattaatccaatcgtatttttatgttccgacagccgattactttatacaaagcaatatggtttcttccttgtccctgcaatattttctcaatccttctttccctttccagtaaagtctcttcattattttccacatgaaactttttattatacctatttccattatacttataaaaaacaatccctttttgcttccggaaacggaaacaaagactatttttttcaattgggtatagccgtaacagatcggtaattctcttcacgattctatcaagaaaatttcgttacatcacttgtaccgacctcaatacagatctcaacgatatagcagtacgtatgtatccaactaacgaaacggcaaacctgaatagcatcaattatctgctgaatggtatccagaaacagacttttcacgactcagcacaccatatctacagttgggaaattgccgtttacgattcagtaaaaaaaaccggaagaaaataaaatcggcgcactatctttgaaccaaagaaaagaaaaagtataactcaaaaagtacaattatgaaaaagttatcaatcttatcaatgttgctattattcattagcatgggaaacattcaggcacaaactgtcaaagaagaatcccgcaaacaaaaaaaagctgaacaagaattactcgaccaaatgtttttcgatgaagctaaacaagctatagaaatgaaaaacttcattttggaagcagatcatgttatgtttaaatatggtaccacagctttcgtttctcccaacacaaattttgtagcggtaaaaggtaataaagctgtggttcaggtagccttcaatattccgatcagcggtcccaacggtctaggcggcattactgtcaacgggaatatatccagatataagcagactaccgacaaaaaaggtaatatatccgtttcgatgaacgtaatgggagtcggaatatcagcacaggtgaacatccgcttgaataaaggaagtaataacgcatcggtagacataagtccgaacttcaattcaaacaacttttcattaacaggaagtttactcccaatggctaaggccaatgtattcaaaggcaattcactctaaggtagaaaatgtgtgtttagtaaataaacaagttaaaatattttagctgactataggcattaaattaaaaacaactatggtttaacacttaaaagaaagaatatgaaaaagtatctgtttataggattaatggcagtacttgccacttcgtgtgaaaaagatccggatttaagtaagcttgacaataatttcacagtttacaccaattatgacagcaaaactaatttcaatgatttcaaaacttattgtttgcccgatagtattctactgataggacagggaatgaaggcggagttttggaaggatgagaatgcacaagaaattattaagcaggttgctgatgagatggatacccgtggttatacaagggttaaagtgattaagaatgctaacattgggttacagctctctttcacgcgccaaacaacccaaataataggaaccggcggatggtatggaggcggatggtataacggctggtggggacccggttattggggaccatattggaacgactggtattatccgtatcctgtaacttatagttataatacaggaacattgataatggaaatggtaaatttgacagaccatcccgaggatacaagtcagaaagtaaagttaccggtaatctggcattcatacgcaaccggactattatttgagaattccaaatataacatgcaactaacgttggatgcggtcaatcaagcgtttgaccaatctccttatatcaagaaatcctaaaaagcaaaattatgaaaacaataaaatttattccgaagaaaaagtatattctggcattcatgatatcgggcctgttttatttcagtagttatgcacaggatatcagcgatagattgcattttaatgtagactggcagatgaatgctcctctcaatacgaattttgccgataaaatcagtggttggggtatgaatctggaaggaggttatttccttactccacactggagtctgggggctttccttgatttccatacaaatcataaatatgttccgcgtcaaaccataactgaaggtactgcttcgttgactactgaccgacaagagtcggctttccagctaccattcgggcttgccgcttcataccgatttatcagcaatggatgcctgaaaccttatgttggcaccaagataggaaccatgtatgcccaaaatacaacatatctgaatactataagtctgacagataaaccctgggggttctatgtctctccagaaattggagtgaacatttatccgttttcccaaagccgatttggtttccatctggctgcatattatagttatgccaccaacaaaagcgagttgctgaccggttgtcaggatggaaataataatattggattccgcttaggtgtttgtttctgacatgatctagattctctcaaaaagacaagaggaagtacaaaatgttatagttacttttggcgacctcttgtttttttgttaaatttgtaatatataaagtctacgttcaatatgcggcaaaagttcaattatctgtttattggtttgctattctcaggattggcatttttctcatatctgtttctcttgctttattccgacttcaccccgcaacatctggaagtactgatttctttcaagtcatttatcctgatacttgccgcctttaatttagtcggtttcggagtattaatgatccacaactggcaaaagcgaagctttcagtttctggtcaaacgaaaagagcgattgattatcgattgcattctgacggcaattattctgtttttaatgaattatctggtcttgtcaatagtcaaagccatatttgaggttcctgcaccatttactctgaaagggtccgggctgagaatgatagccttagtctggctggtagaaatggtaataaccaaccttactttgactatcaatttttacaggcagctagttcttctgcacgaaagaacggaacaagtcgaagagaattccattaaggcacagtatgcagctttgcaaaatcagctgaatcctcattttctcttcaacagtctcaatacacttatatccgaaatagagtatgctcccaaaaacgcaattctatttacccaacgtttgtctgatgtataccgatatatattacaaagccagcaacagcgtctggttactatagaatccgaactctctttcatcgactcttatatttttcttcataaagtccgtttaggagactgcatccggatagagaatagaatagaagctgataattatgatttgaaactcccctcattaaccctgcagctattggtagaaaatgtcattaagcataatataattaatatggatatgccaatgaatattttgatcgattatgattctgagaatggaagaatattggtaaccaacaaaatcaggataaagcccaatgtggtcagcaccggcatgggattaaagaatctttcagcccgttacctcctgatatgcaatcaggatattaccatagaaaacaatacgaattattttaccgttaaaatcccagtactgaatgaataaaattacagcagtcattattgaagacgaaattccggccgcccgtcggttaaacaatacattaaatgagttacgccccgaatggcaaattacagtattacccggtagtgtaaagaagagtgtagaatggtttgcggaaaatccccatccggatcttgtttttctcgacatacaattgacagacggcatttcattcacattcatcgaacaggcacaaccagaaagtactatcattttcaccactgcgtatgatgaatatgccattcgggcatttacagtcaacagtatcgattatttacttaagccgattgataacatccgactggaagaagcaattgtaaagttcgaacatctgactaccaaatacctgaatcaggggcaaaagccaattgacttaatggaaattttacaaaacatcacccaaccgggaaagaaataccgtacccgtttcctaatctcaggcgatgacaaactttttaccttacaagtggaagacattgcttatttttattcagaaaataaaataacctttgccgtaaccaagcaaaatagagaatttatcattgacctttctttggacaagcttatggaacaactcgatccggatgtttttttccgaagcaatcggcaaacagtagttagcatcaatgccatcgtaaaggttgagtcatattttctgggaaaagcaatcttacatgtaaagccgccttttaaagataagataattgtcagccgtgacaaaatagctcctttaaaactttggctaaattattaaatttcagcagagttaattctgcatgtctcaatattcatattcccaatcaattgctttttcactcagtaagattaataagaaaagctccgatcccgttaagaaccagagcttttcctaattataaaaatcaaaagaagcggtgcgtacgggactcgaacccgtgaccccatgcgtgacaggcatgtattctaaccaactgaactaacgcaccaaaatttcctttttaattcgcatctctctcgattgcggatgcaaaggtagacatttttttgaaacctacaatagcaagagtatcttttttctgaaaaagtgtgtttattaagaattatcatgtacatttgcaagcattactataaatagaaaatagaatgaaaaatacaccaatcgaacgaaatgtgattgacgaaacgattaatgagtttcaaattgtcgacttttcgaaggctactatccgtgaagtgaaagcgatagcttcaaaggcggaagcagtatcaggcgttgaatttatcaagatggaaatgggtgttccgggacttccggcctctgccgtaggagtaaaagcggaaatcgaagcgctgcaaaacggaattgccagcctgtatcccgatatcaacggattgccggaactcaaaaaagaagcgtccgactttatcaaagcattcatcaatgtagatttaagcccggagggatgcgtacccgttaccggctctatgcagggaacattcgcttcgttccttacttgcagccagtgcgatgaaaagaaagacacgatcctgtttatcgatccgggatttcccgtacagaaacagcagttggtagtgatgggacaaaagtatgagacatttgatgtctacgactaccgcggtgacaagctgaaagaaaagctggaaagctatctgagaaaaggaaatatatcggctattatctactcaaaccccaataacccgagctggatttgcctgaaagacgaagagttgcgcatcatcggcgaacttgccacccaatatgacgtaatcgtactggaagacctggcatactttgcaatggatttccgtcaggatctgagcactccttatcaagctccgttccagccttcggtagctcactacacagataattatgtgttgctgatttccggttccaaagccttcagctatgccggacaacgtatcggcgtgagctgcatttccgataagttgtatcaccgcagctatcccggactgacgaagcgttatggcgggggaacattcggcacggtcttcatccaccgcgtactctatgcactgtcttccggcacaagccactccgcacagtatgcgatggctgccatgctgaaagctgccaatgaaggtcaatacaacttcctcagcgaagtgaaggtatatggtgacagagcgcagaagttaaaagagattttcctccgtcacggattctatctggtatatgacaatgacttgggcgatccgattgccgacggattttacttcaccatcggctatccgggaatgacaagcggcgaacttgccaaagaactgatgtactatggagtgagcgccatttcactggtcaccaccggaagccaccaggaaggattacgcgcgtgtacctcttttattaaagaccaccagtacgcacagctcgacgaaagaatgaagctgtttgccgaacatcacccgattgcctgacagccaaatagcgtatttatgccggaactgatgttcatgtcagatgcgaatattcataaaagctgctcttaaaacaaaaaaaatgggaaagtatggctattattccatttcttttcttatattagtggcacgaatatcaatctgatggcatgaatatagactctgacatatttaaaattcaatcgaataatgtattgccatcacgaggaaagattctcatctccgaacctttccttcgtgatgccacattcggcagatctgtagttctgttgatcgaccataccgaagaaggcagcatggggctgattatcaacaaacaactgccgatatttgtcaacgacattatcaaagaattcaagtatatcgaaaatatacctttatacaaaggcggacctatcgctacagataccctgttctaccttcatacactggcagacattccgggtgccatacctatcagcaaaggactgtatctgaacggtgactttgatgagataaagaaatacatactgcaaggaaacaaagtagaccgctacatccgcttcttcctgggatactccggctgggaaagcgaacaactgagcaccgaactcaaagagaacacatggctcgtctccaaagaagagaatgcctatctgatgaacggagacaccaaggatatgtggaaacaagccttggagaaactaggcagcaagtatgaaacctggtcacgctttccgcaagtgccgactttcaattaatgtctcttcggattcagatactggaagatagcagcatctttgtaacatccaccgacctgtaaccaatccttcaacagtccgcattggacgaaaccgcaggaagtaaacagtttcatacagacttcattgtccgtagccacatgggcataaagttgagtcagcgacaagaaatcgaaagcatactcgcacagcaactgcaaagcgtccgatgcgtaaccttgccggcgatagtctttatgaacggctatgccgacctcaccacgagagtggagaggaacaaaatccgtgatatcaatcgtccccaatatccgatgatcggacttactcattatcatcaggcgcaactgcttgtcggcaaacacatcacactgggaaccctctatatattgccggagcacgtagcgtgaataaggaacggtaaaattactgatatcccacatggaagggtcattctccatctcatacatcacatccatatcttccggctctaccgcacgaagatagatgcggtcattacttaaaaaagactgtttcataccggcttattctttattaatatggagttcgttacgaagtcttttctcactgggcagacaaaaaagggaagcggtcagcccgatcagcatacagagatttccggtgttgctaagagtcagataatagcataatacgttgaggacgatagccacttcgagcaatccgaggcgtaccatgctccactgcacataacgcttcaatgcaagaggaatcgtcaggaggtctatcttctttttcagtaccagactgaacagtttcaaggcaagcggcacacacaaggcggtcagcaggatgcctgccgtctccagataataggtagcctgtgcattatcgaccaaagctcccacaggaagaaggtcgaactcccctgccccaagcaaaaaggcgggaagcacccaaaagaaaacataactgatattcaaatttctcactgcgcgttttatctgttcttccatgttagttacgatatgcgttcaaataattaagttagattatacggttccggtaaaaagagtccggttgacaatactgcgtcccaaagtgatctcatcggcatactccagttcgtcgccaacggagatgccccgtgctattacgctgagtttgacacccatcttctccagtttacggtagatgtagaagttggtggtatctccttccatcgtcgtgctcaaagcgaggatgacttccttgattcctccttcggacacccgctgcacgagactttctatttgcaggtcgctcggtcctaccccgtccatcggagagatcactccgcccagtacgtgataaagcccccgatactgctgggtggcttctaccgccatcacgtcacggatattctctaccacacagacagtagaggcgtcacgctgcggattggcacaaatctgacaagtctcggtatcagatatattatgacatactttacagtactttacttcacgtttcagcgtaatgatggagttgccgaatgcctccacagtagccgtgtcctgccggagcagatgtaatacaagccgcattgccgtcttgcgcccgatgcccggaagtttggaaaattcgcctactgccttttcgagcagtacggaaggatattgttggttcatagattacgaatgaaattctatctgtttcgggcgcaaagatacggattattgtttttaatacaaagaaagtattacctttgcagccgatatgatgatattagtcattattatatgctattttgcgggcttgttgttaatagcccacattaccggacataaaggcggatcaaatgcagcgttctttaaaggagaaaacaaatcaccctggtatatagtctccttcggcatgattggcgctacaatttccggcgtgactttcgtatccgtaccgggcatggttcgcggaatggacatgacgtatatgcagaccgtattcggattcttcttcggctatatgatcgtagcacacatattgctgcctctttactacaggctgaatctgacaagtatctacggatacctcggtacacgcatcggcgtgaatgcctaccgcaccggctctttcttcttcctgctctcccgtatgctgggaacggcagccaaactgtatctcgtctgtctgatcctgcatacgcacgtatttcaggatatgcacatccctttctgggtgattgccgtcggctccgtggccctcgtgtggatatacacccacaaaagcggcatcaagacaatcgtatggacggacaccctgcaaacattctgcctgatcgcagccctgctattcatcatctacttcaccatacagaagctggatgtaggcttcgacggcatcgtacagaccatccgccacagcgaacacagccgcatcttcgtattcgatgactggatgtcccgtcagaacttcttcaaacagttcttcagcggcatctttatcgtcatcgtcatgaccggactcgatcaggacatgatgcaaaagaacctctcctgccgcaatctgcacgaagccaaaaagaatatgtactgctacggattctcattcatcccgctgaatttcctgtttctgtgcctaggcattctgctgatcgcattagcgggacaaatgcaactggaactaccggccatgaatgatgatatccttcccatgtttgccacacaaggatatctgggacagtcggtactgattctttttaccatcggcatcatcgccgcagctttcagcaactcagactccgcgctgaccgccatgaccaccagcgtatgtatagacctgctgaacacggacaaggacacggaagaaacagcccgccgcaaaagaaagaaagtacacctgtccctctccatcctgctggctttctttatctgcctggtggagatgctgaacaacaaaagcgtgattgacgcgatctacatcatcgcctcctacacatacgggcccttgctgggtatgttcgccttcggactgttcacccggcgccggactaaggaccggctggtcccgctcatcgccatcgcctctccggtgctctgctacgctctggactggtggataaacaaagaaaccggatataaatttggctatgaattgctaatgttgaacggaagccttacctttgcggggctcatgctgctgtccggaaaagagaaaacggtggaaacgccttgaaaacaggcgtccggagtttataataaaaagtagtggagtttattataaacgtgaccatagtttattataaacgataagagagtttattagaagtagaaaaacaaagaaataaatgacaataaaatggaaataacgagtgcagaatttgtgattagcaacacggacgtgaagaaatgtccgactggagtatttcccgaatacgccttcatcgggcggtcgaatgtaggaaagtcgagccttatcaatatgctgactgcccgcaaaggactggcgatgacctctgccacaccgggaaagacaatgcttatcaaccacttcctgatcaaccaaagctggtacctggtcgatcttcccggatacggctacgccagacgcggacaaaaaggaaaagaccagatacgtaccatcatcgaagactacatcctcgaacgggaacagatgaccaacctgtttgtactgatagacagtcgcctggaaccgcagaaaatagacttggaatttatggaatggctgggcgaaaacggcatccctttctccatcatcttcaccaaagcagacaaactgaaaggcggacgtctgaaaatgaatatcaacaactacctgcgtgaactgagcaaggaatgggaagaacttcccccgtatttcatatcttcttcggaaaaccgcacaggacgcacggaaatcctcgactacatagaaaacatcagtaaagaagtctataaaaataagtaaacgaaaatgaaaaagaacattttatttattgcatgggttgcattattctcactctttgcaagcaacagtcaggcacaatcattaaaggatctgctcaacaaagacaacatctccaaagtagtaaatgccatcaccgggacacccgaaacgatagacatgacaggtacatggacttacagcggttcggcagtagaatttgaatcggacaatctgctgatgaaagcaggaggagccgcagccgccacgatggcagaaaacaaattgaacgagcaattgagtaaagtgggcatcaaagaaggacaaatgagcttcacgttcaacgccgacagtactttcaccagcaccgtcggaaaaaagaaactgagcggcacttattcgtacaatgcttccaccaagcaggtagacttaaagtacttgaaactgctgaatctgcatgcgaaagtgaactgcacttccaactctatggatttattgttcaactccgacaagctgcttaaattaatgacattcctcggcagcaagacaaacagcacagcactgaaaactgtcagctcactggctgaaaactacgacgggatgatgctgggattcgggttgaagaaatagtgttttatttgcaaaaccaaaagctctgaaacgccttctggcagggctcgaaaaccgaatcctaaccgaaagggaaaccgaaccttaaccagtagagaagagtagagtatataattctattctaaagaaatagaattactaagaaagagaagaaagaatttcgccgccgccgattcactttcggtgtagaaatgaatcagaccagttcatctttgattcgatgttctctctgttctctacgttgttgaatgcgtttgtacaacttaacaataaatgctataaagtaattcaactcataaaagggagtcatatgatagaaatcaagttttgttttcataatagctggattttatgggtttgttccaaatatagtaattttttatgcgataaacaaaaaatatgagtattcattagcgtgttgaaatgaattaatttagcgaacagagatcggcagtattcacctcggtgctcacttctgctcgtctcggtgctcagcgtttttcgcctcgctgcttactctcattcagctcggcgctcagtgttccccacctcggtggtcaggattgccaagcccaaggacgatgataaacagaagttattttattccctttttcgataaaattaactctgccgacgggataatttcagggaaaagcgttacctttggcgtttgtaatcaataaaaagaaggaaaaatgaaaaagatactttttttaatgaccttgttagtggtaggagtaagtttcgcttttgcccagactaacgctgatatcaagtttgacaaaacaacacacgactttggaaaattctcagaaaacagtccggtagtaagctgcgtattcactttcactaatatcggtgatgctcctttagtaattcatcaggcggtagcgtcttgcggatgcacagtgcccgaatataccaaagaaccgatccagccgggaaagaaaggtacaatcaaagtaacttacaacggaacaggtaaatatccgggacacttcaaaaagtcgattaccctgcgtaccaacgcaaaaaccgaaatggtacgcctctatatcgaaggcgatatgaccccgaaagacgagaagtaagaaaaaatagacataacgtaaaggagaatctttcgattctcctttttttttgtttactttgaagtccattaagcataaactactaaaaatataatatgaaacaagaagaagacaaattcaccggactacccgagaacgcgttcagagagttaaaagcaggagaagtgtacaatcccctgatgagtccttccaaaaattatccggaagtaaacttctggtcagtaacatggggtatcgccatggccatccttttctcggcagccgccgcctatctggggctgaaagtgggacaagtattcgaagccgctattccgatagccatcattgccgtaggagtctccggtgcagccaaaagaaaaaatgcgttaggagaaaatgtaattatccagtctatcggagcgtgttccggtgtaatcgttgccggagccatctttaccctccccgccctttatatccttcaagtcaaatatcctgagatgacagtcagctttatgcaggtatttatcagctcgctgctgggtggtgtactgggtatcctgtttctgattcctttccgcaaatatttcgtcagcgatatgcacggcaaatatcctttccccgaagcaaccgctactacacaggtgctggtgtccggagaaaagagcggcagccaggccaaaccgctgttgatggcgggaatgatcggtggattgtatgacttcatcgtggccactttcggctggtggaacgagaacttcaccacccgcgtatgcggagccggagaaatgctggctgagaaagcgaaactggtattcaaagtaaatacgggagctgccgtactcggtctgggctatatcgtcggactgaaatatgcttccatcatctgtgccggatcactggcagtatggtggatcatcattccgggaatgtccgccatctggggagacagcgtgctgaacgcatggaaccccgaaatcacttctacggtaggcatgatgagccccgaagaaatcttcaagtattacgccaagagcatcggtatcggcggtattgccatggcgggtgtcatcggtatcatccgttcgtggggaatcatcaagagtgccgtcggactggctgccaaagaaatgggcggtaaaggcaatgtagaaaagaatatcgtgcgtacacagcgtgacctttcgatgaaaatcatcgctatcggctctatccttacgctgattctgatcgtgctgttcttctacttcgatatcatgcagggaaatatcgtccatacgctggtagcgattgcgctggtagcaggcatttccttcctgttcacgacggtagctgccaatgcgattgccattgtaggcaccaatccggtatcgggaatgacattgatgacactgattctggcttccgtagtgatggtagctgtcggactgaaaggtccttcgggcatggtggccgcacttgtgatgggtggtgtagtatgtacggcactgtctatggcgggcggtttcatcaccgacttgaaaatcggttactggctgggtagtacgcccgccaaacaggaaacatggaaattcttgggaaccatcgtttctgctgccacggtaggcggtgtaatgattatactgaacaagacatacggcttcaccagcggcgcactggctgcaccacaagccaatgcgatggcggccgttatcgaaccgctgatgagcggcgtaggcgccccctggttgctgtatggcatcggtgcaatccttgctatcgtgctgacattcttcaagattcccgcactggcctttgcgctgggtatgtttattccgttggagctgaatgtgccgctggtagtaggcggtgccgtcaactggtatgtgacaagccgcagcaaggatacggcactcaatacggaaagaggtgaaaaaggaacattgctggcatccggtttcattgccggaggcgcattgatgggagtagtgagcgcggcaatgcgtttcggcggtatcaatctggtcaacgaagcctggctgaacaatacctggtcggaagtgttagcattaggagcttacgctttattgatcctctactttatcaaggcttccatgaaagtaaaataagatgaggaaactgttatctgttatagtatcacttatgactgcaatggcatttgcacaacagcccgtcgagctacctttgtggcccgacggtgctcccaactccaacggactgaccggcggggaaaaggaagtgtcgccccacagactcagcaatgtcaccgcccccaccataaccgtttatcgtgcaccacaaccaaacggaatggctgtcatcatgtgtcccggaggtggctacagccgcctcgccatggatcatgaagggcacgatatggcatcctggttctgcggacagggcatcacttacgttgtattaaagtaccggatgccgaacggtcattgcgaagtccctttgtcggatgcggaaagagcaattcgcatcgtacgcgagcatgctggagaatggaatatccatccccgcaaaataggaatcatgggagcatccgccggaggacatctcgcctctacccttgccacccattacagtgcggcatcgcgtcccgactttcagattctgctttatccggtggtcaccatgacgcaaagtactcatggcggttcgagaaaagagcttctgggcggaaatccgaccgcagaacaagaggtactcttctccaacgaactgcaagtgacatccgatactccgcaagcctttatcgtcctgtcttctgatgacggtgccgtgcctccttccaacggagtgaactattatctcgctttacagaaaaacaatgttcccgcatcgcttcatgtctaccctaccggcggacatggctggggattccgggacaacttcaagtataagcaacaatggacacaggaactcgaaaagtggttgcgtgagggtgtcgtatttccgaaggagacagcaccgatgttgagaatcggaaagacgtaccttggaacaaagtatgtagccaacacactggatcagggaacggaagaaaagttagtcatcctgccccaaacggtagattgccttactttcgtcgaatatacgctggctcaggcgatggggtcttcttttgccgataatctgcaaaagatacgttatcgggacggtgtgatcgacggatacacttcgcggttgcactatacctccgactggattgagaacggtgtccgccaaggatttctggaagacgttactgcacaaaacagtacgcagaccaccaaactgtctctctcttatatgtccacccatccccaaaagtacaggcaactggcggattcgccggagaacgtgaaacggatggccgagcatgaaaaggcattgtccgggaaaaaggtacactggctacctaaaggaaaactccccgacgcaggacttccgtggatcatggacggtgatatcatcgccatcaccacgaatcttccgggactggatgtagctcatgtagggatggccgaatatataaacggaaagttgcatttgcttcacgcctcttctacgcttggcaaggttgttgtcagcgaagagcctctcagccaaatgcttcgcaataataaatcatggagcggcatacgtgtcgtccggatgtctcacccttaaaacaaatgattatgaaacgagtaaaacatttacttctcgcgtcgtgtctgttgcctacttttttgggggcacagggagtggcaagcgcctcttttctggagattactccggatgcccaatcggcaggtatggccggcacaggactggctatcactgacaatggaagcacggctatctttcataacgcttccaccatcgctttctcgcaggatgtaatgggtgccagctactcatacgctgacataaataaagactttggaatgcatagcgcatcccttttctaccgcatcggacgggaagggaagcacggatttagcgtaggattccgtcactacaaggatgccgattttcattggcaggacggtgcggaagatcatgcccgcgcatggaacgtagaagccgcatacttcagaaatgtagccaaaaacctgtccctttcattaacactcagatatctgcaggcaaaagcctataaggatgcggacagcaaagggtcagtctccgtggacctcggtgccagctatcatcgcagcatgggtattctggacgaaatggcttcatggactatcggatttcaagccgccaacctgggcagcaagctggacggacagaaactgcctgcccgactgggactgggtggtgccatcgacctgccgttcagtatggacaaccgcttgcaggtggctcttgacttcaattacctgctcccgtccgagtaccgccatcttcaagccggcatcggagcggaatataatttcctgaaatatggaattatccgcggaggataccacttcggggataacgacaaaggaacaggcaattacggtacactgggctgcggaatcaacttctggccgattcgcgcggatttctcttatgcactggctgataaagactgtttcatgcataagacatggcagctcggcattggaatcgttttctaggcttttccttcgggcagtccgctaagttttatcattgagcagagtctgccgggttctttcattgagcaatctgctgttttttttcgttcagcagtctgccaagctcgcattcaaggcgttgcttcacttcgtccataggcacttcgtgcttcagttcctgacgaagagaagtgacgcctttatctataaagccacaaggatgaatatagctgaaatagcgtaaatccgtattcacattcaaggccagtccgtgcatggtgacgtagtggctgctcctcaccccgatcgcacaaatcttacgggcacggggcgtactcccctccagccagacacctgttgccttttcaagccgtcccgcttcaatgccataggaggcacagacacgtatcacagcctcttcgagcaggtgcacatattccttcaaccccaaatgaaactcttccagattcaagatcggataacagactagctgtccgggaccgtgatacgtgatatcccctccccgatctatatggaaaagggtagcctgaatggctttcagctgatcgtcattcaacagcatattattttcttttccgctacgtcccaaagtatagacgtgcggatgttcgcacataataatacggttttcatacgcttctccctgcgcttttgcgcggacaagagtatcaaaccattccgtctgccgctgccatgcctcggcgtacggaatcaaattccagtctactaacacagttttcatgaggacaaaagtaagaaataaaaagaaaaatcgtacatttgtagatcgaatataacaagcactctaaaccaaagataacaaacactcttatgaaaatggaagttccacaagtagatttgccactggaggtgttggcatggactaaagtaactgaagatattctgaacatctacaagcaatcgtgccggctgcaggcgtgtattttcgccatctgtacggaaggaaccatgaaagtctccatcaatctgttggaatacgaggttcacccgaatgatctgattacattacttcccggaacaatcatacagttccgtgagaaagcggaaaaggtaagtctttgttttgccggattctccgcgaaatgtatcggacatatcaacttgctgaccaccatcgggaacgcttatcccaagctgatagaacagccgatcatccctctttccgagaatatcgccgactatctgaaggaatattttgccttgttgtctcatgccagttgtgacgagtctttcaagatggactccaaattggcggacttgtcactccagactattctgacaagtatccaactgatgtaccggaattattcgggaaacaatcattcgaaccgtaagaaggagatttgccggaagttgattcaactgatcactgaacactacaaagatcagcgttgtgcacagttctatgccgatcaactgggaatctctctgcaacatctgagcaccaccgtaaaacaagtgacggggaaaagtgtattggatactattgcttatattgtcattatcgacgccaaagcgcagctaaaggggacggatatgactattcaggagatagcttattcgctgaatttcccgaatccctctttcttctgcaagttcttcagacggcatgtagggatgtcgccgctggaatttagaaatagttgagtccgttacttctaaaatcaatggatcagtcggaaataccgtttttgattccagatatacagatttgagccaactatccgcatggattcccctctttctcgaaggaggggtgaccgtagggcggggtggtaggtaaaacaaggttatctctaatttattgtgaatgaaagaattgcgtattcacctaccacctccccctacgggtactcctcctttccgaaggaggagaatgaagatactaccgactttttagccagccccataaatccataaaagaacattaagcaggctctcttcttaaatcttccttcttcccaaactcaacgaattgagcactacactcacactggagaatgccatggcggcacttgccagcatcggattcagcaacaatccgtttatagggaacaatactccggcagcgataggaataccgatcagattgtagatgaatgcccagaaaaggttctgatgaatcagtcgtacagtctgcctggatagttcgaaggctttgggaagtaacagcaagtcggatgtcatcagcgttaccatagcgacatccatagcaatatccgtaccctttcccatagcaatgctgacgtcagccaatgcaagtgcctgcgagtcattgataccatcgcccaccattgccactttctttccctgcatttgcagttcacgcacaaattcggctttgtcgtccggcaaggcatctgccacaaaccgctcgatacccagacgggaagagactgccagagccgtccgctgaccgtcaccggtaagcatacagatatcgatgccctgacgtttcagttctttcactgcttcggcagaagtagccttgatcgggtcggaaacggcaatgatagccaaaagttcattctcacgtccgaagtatatgattccgtttccgtctgattcgtagtgtaccagcatatccgccatgacatcgctcactgtagcgctgaaatctttcagaagtttatggctgcccacccagtaagtcttgccttgataagacacctttatacctttgcctgtgatgctctcaaaactgctcaaaggagcgggagttatcttttcctcgtcttgaagtacggcgacaatcgcgcctgccaacgggtgttccgatttcagttcggcagccagaagtacatctttgaagtgttcttcctgcggctgtgcccacaaccatccggtagcggtaggatgtccttcggtcaaagtaccggttttatccagtaccaccacatctactttacgcatctgctccagagcgacggcgtcttttatcagaatatgctgtccggcagctttaccgattcctaccatcagcgcagtaggtgtagcaagtcccaaagcacagggacaggctatgaccagaacggatacggcagaaagaataccataagaaatatactcactgccaccgatagccacccacagcacaaacgtcagaatggcaattcccaacacgacaggaacgaagatgcctgtaatacggtcgacgatgcgctgcacaggagctttgctgccttgtgcttcctgcaccatgtgaatgatgcgtgccagcacagtatcgcttcccacctgagaagcacgaatgatgaaggaaccgcgctgattgattgttccggcaaggaccttatcgccctttttcttctctaccggaatcggctcaccgctaatcatactttcatccacatacgaatcgccctccgaaagctggccatccacgggaatctgttcgccgggacggactaccaccatatcgcctacctgcaacaggtctatttgtatctcttcctctaccccaccacgcaatacacgtgccactttgggctgcattcccatcagtttgcgaatggcatccgaggtatttcctttggcgcgttcctccatcatctttccggtcagaacgaaggcaatgatcactgcggaagcttcgtaatagacgtgcggttccagtccgcgatctgtccagaactgcggaaagaaggtgttgaacaaactgaaaaggaaggctatcgaggtactcaacgcaaccagcgtatccatattgctacgaccgatcttcgcctgtttccatgcccccgtgaagaaacttcctccgaagagcaccattaccggaatagcaagcaacatttgtatctcgttagagtatggcatatgcattaataacattgaaaagataagcaacggcactacaaatatccacgcaccgatcactttccgtttcagacgaaggtagcgcttatgctgttcttcttcccgacgttcttctttattcgcttcttctactatcagatcataaccggcagcaagtaccgctgcacggatttctccgggggtgagcttgtcgtcctcataagaaatcgtcaatgtatttgaagcaaagttgacggaagcatcaacgactcccggcaactttttcactgtcttttctacattgttagcgcatcccgcacaatgcatattaagcacgggaaacgctttttttgctatattacccatataatcctttactctttaattaattagtatttataaaacaagcaaatacgggtatttgttcgattacttcttatcggccttcttatcctctttcttagattcttgtttgccatctttcttgccgtcctgcttggtttccttcacaaactcggcctcataattgaactttttgaatcctgcctgcaacttcttcacatctgtcttttcggcatcgtaggtgatggacacggttttgttcttcagttcggtggaaagttccttcacgcctttctcgaagcgcatgttatttttcactttcttctcgcagttctcgcagtgcatctgagagactttgaatatgactacacggatatcctttgccaacacggctgctacgctcaaaagagccaccacgcaagtggccatccatctttttgttctcatttttcttattcgtttaatggttattattcatttcttgccagattgaaacgtattccgatataggcttttgccccgtgcacaggtccccatatcatcgttgagtcgaagtttcctccccacgggtttgctgcgtcaatgatcggattcttctgtttgaagtttgtcaggttctcccctcctatgtagacagaccagcggcggaaatagcgggtaatctgggcactcagttgctcgaagctgccatagcggcgctcccaagatagctgaccgtctgccaactcgtaaggggaaggcattcttcctccgccattgagctggagcgtagcatcaaactgccatattccgagtggagtctggtacgaagcggtcagcagtcctttgtatttgctggtcaacggtttctccatccgctgacctttgtaggtggtctgagcatccgtcagacggtaagctcccgtcaaggtaaatcctttaaaaaaaggatagcttgcctctacttggaatacatgcgaataggaacgcccgtccaaattgtaaaaggctacttcgtgaggattactgtccatatccaccacgacttgcttcaggaagtctgtgtaataatattcggcattgatattcagcgttttgccaaatacaggtacgtaggtggatacactggcaccatagttccatgcttcttccatgtccagtcctttcgctatttcgacctttcggctactggaaagcaggtagttattttctgccagtacatgattcgtacggtaaccttttccggcagagaggcggaagtgtacgtactcattcggattgtatttaagatgtgcacggggagtcacaaagaaaccgtgctcattgctatagtcaccacgcagacctgccatcagcatccactgatcattcagattcagcgtgtattgcgcataggctccgggaaccgcttctttggcaaaagccttgatgagcggcaattccgtttgattctccaaccgataatgctggtcataagcgtcatagttgaaactcagccccgccgagaaactgttctgcttattaaactctgtttcaaacatcaaagaggcatacacatttgtctggtctacattgtatagttttcgtccgtacatggcatcctgattgtgccaactggcagaaagaatcagtgccagattcgtattcttctccttattaaatatataagcattcttggtgaaaaattcgtaacgttcggtatcgattcctactttataaagatcacccgtctgcatatccgtatgatgtgcctgcccgctagtgcgactttcggaaagagccttgaagcctgcctgaaagacataatgatctcccatataggcccatcggttccacacgttatactgctctacttgggggatatccacgaagccgtcatcattgccgtcgtgcgctttggtttcgttttcataatgcgccagtaaagaggtactccaacgttttgacaactttaaggtggcgtccgcattcgcctcataccggttggtactgcttgcgaaaagattggcagatacccaatcggcctccggcaactgcggctttttgaactctacattaatctgtcccgtgatggcttcgtaaccattcttcactgatgagattcctttggaaacctgtatgctttgcatccacggaccggggacatatcccagaccataaggagatgccgcaccgcgatagttcgggatattctccgtgagcatctgtacataagttccggacaatccgagcagtttgatctgcttggctcccgttgccgcatccgaatagctcacgtccaccgaagggttggtcacgaaactttctcccagattacagcaggcagccctgctcaattcggcactgcttatcatctcttcgttcatcacgctgctgcgcaacttcatcgttcccattctgcggctgactacattcacttcgttcagttctacaccttcccgaagggtaatatccagttcctgattcttcttgctgacatgaaccgtgtcattctgaaagccgataaaactgattaccagcatgtgactcttcgaaggtttggagatagaaaagctgccatcttccttggtagttacaccctgacccgtattcacccagaatacattagcacccggaacaggctctccggtattatctttgactattccccgcacctgcgcttgtgtcgtaactgcaagtaatgagaacagtcccattattatatatttcattctttcttggacttagttttgcgatacaaaattaattcatttctcttgcaactgagttgcattcattctccttgttttcataccctgcaaaggctgaaaacaaagtacaatcggacaaaaaagatgaaataacagctaaatcagaaaaacggaatgtaacgccagcttctgcctcggacagggagatggcggagaaggaagactggaaaagtccaccgtccggtctatagaagtgaaagcaaatagctgacaatactgttcacagaaaagtgttatcaccggaacggaaactgtcagttcggaaatatgcttcatcaaatcgggcttatagatagttgccgtacagcccttttctctacaatctttctttgaatcgcaagtatgagacttcttacatttgggacagccatcggcacaacagccctgcacagtctcacaacgggaacagcaataatgaacaatagatactcccgcccctgaatagataatcaggagagaaaggatcactgctgttatgtaggctagtctcttcatttcgggagacaaagataaggtattccggcaacaatatcaaattaaataattctccatttttattcgtactactgatattatccgtatatttgaccacatattagttcttttaaatacatcatgtcatggaatatcatcgtatatctttcatccacaacgatacagagtattcgttcattaaagctataaacgggaacttaacaggatacgctttaatgtcagcttgccggatagaagtagtcaattatatgaaagaaaataacttgaaaggcagctatatactaaccggaatgtcaaaggcttaatcacatgaaagctaaaagagagcagatattaatcagaacttcctggattagtactattggtaatgccatactttccacatcaaaaatcatcgtaggtttatgggccggcagtcttgccgtgctaggcgacggtattgattcggcaacggatgtgatcatctccattgtcatgattttcacagcacgcattatcagccagccgccttccaagaagtacgtattcggctatgagaaagccgaagggattgcgactaaaattctttcgcttgtgatattctatgcaggggtgcaaatgttgatatcatctatcggaagtatcttttccgaagaagcaaaagaaattccgtcagccattgccatatacgtcacgatcttttcgattatcggcaaacttctattggctttatatcagtacaaacaagggaaaaagatagatagctccatgctgacggccaatgccatcaatatgcgcaatgatgttatcatttcctccggtgtgctgctgggactgatattcacgttcatattcaaactgcctatactcgactccatcacaggactaatcatcagcctctttatcataaaatcttcgattggcattttcatcgattcgaatgtggaattgatggatggcgtcaaagatgtcaatgtgtacaataagatattcgaagcggtagaaacagttcccggtgcgagcaatccacaccgggtaagatcaagaatgatcggaaatctttatatgattaccctcgatatcgaggtaaatccgcagataaccatcacacaggcccatcagatagccgacgctgtggagaaaagcataaaaagctctatagacaatgtctatgatatcttagtacacgtggaacctgccggcgaatgtcagacagacgagaaatttggtattgacaagggtatggtgaattgacggaaggcgttaaggagcaagtatatgctcccccgaagctgttatgattactccaccacaatcactgaccaccgtctcgtgctttccatccggagtgactatgatggaaccggtctgtatgatatgctttccgtccgtcgtcacacgtatgcgggcgcttgtttcttctttttctttcttttccttctttgcagattcctcctcttccttatcctctatggctctgttccggtccatacagccattggtataataacttttcatcttagtcacccggtcatcaacgaaccagatattaacgactcctgcaatacttgactcggaagtacgaaattccagcatctcactctcttcgtcaaaacttcgatagctcggtttacccataatggctattacttctttagaagacatcccacgttggataatactcaaattctcataagtaattctgcttgcataacaactgctgagcaatatcaccagcagcaaagacataaggatttgactctttttcataataggtatagtttagtagttttttgaataccccaaatgtagtatgagaaaattcccttcgcaaagacttcttcctacttgcaaatagggatttccctatctatgaaaaacgacaggtataatctacaactactaacatttcttctctcaactatcctattggcttatctatcataccgtccgccacagagaatcaatgactgcataccttactgatatcgaccgtaaattcctcaccggcaggcatgaacttcccttttcgtttaagaaatccgatcagttcgtctacttccatattatctgccgaacaagtataaaaacgctgatgttcgccaaacttctctacgattgcagccctcagagatgcctcagtataactatttccctccatcatgtgaaggacttcgtgtgcatgtaactgttccataatctatttttttctgcaaagataagtacggcgtacagattaaaactgtaacatatgatacagaagcaagaaaaaaagaatcattaacaatggcatcccctatatacattgccgaagaaagtagctgaatatttttccttttttattcgcagtattcggtaatttcatttatatttgtcgatagtgatagatatgatcaatgttgaatttatagaaaaaacgagtatgaaaaaacaatatgtcagtctgcttgcggttatactttcggtaagcggctttttgttttcttgtcatgacaagatgaacaaaaacacgggagcattacaattcgatagtatacaggttaacgagacggcacacctctttaatgacaccgccaaacccgcgtgcaatattatcatcaacttcgcctatcccgtcaagtcatcggatgatatgctgaaagacagtctgaacgcttacttcatctccgtctgcttcggagacaaatatatcggcgaaaaaccggaggcggtagtgaagcaatacgccaagaattacattgacgagtatcgccacgatcaggagccgatgtacgccgaagacgaaaagaataaagaaagcgatgcagtggtaggcgcatggtactcctattacaagagcatcgaaagccacgtgcaactatatgagaaagacctgctagtataccgcgttgactacaacgaatataccggaggcgcacacggtatgtatatgtcgactttcctgaacatggatctcactctgatgcgtccgctccgcctcgatgatatttttgtaggcgacttccaggaagccctgacagatctgatctggaaccagctgatggccgacaacaaagtgactacgcacgaagcgctggaagacatggggtatgcttcgaccggagacatcgccccgacagagaacttttatctgagtaaagaaggtatcaccttctactataatatatacgacatcacgccgtattcgatgggccctgtcaaagtcaccattccatactctatgatggaacatctgctgggcagcaacccaattctcggagatctgaaagattaaacagctattaaaagattgaacaccaatgaatatcctgttgttattgccccgtgtgatgcagaaggatattcatttcacttataaatcaaaattcaccattcaaaatacttaaagtggaaatcatactgaaatattttccggatctgacggaagagcagcgtaaacagtttgccgctctatacgacctctacatcgactggaatgcgaaaatcaacgttatctcccgcaaagacatcgaaaatctgtacgagcatcatgttctccattcattaggcatcgccaaagtgattcaattccgtcccggaaccaaggtcatggatttgggtacaggaggaggatttcccggcattccgctcgccatcctgttccccgaaaccaagtttcatctggtagacagcatcggcaagaaagtacgtgtggcgacagaagtggccaatgccatcggactgaaaaacgtcactttccgtcatgcccgtgccgaagaggaaaaacaactgttcgacttcgtcgtgagccgtgccgtaatgcctttggcggatctgatcaagatcatcaaaaagaacatttcccccaagcagcagaatgctatgcccaacggactgatctgtctcaaaggaggcgaactggagcatgaaacgatgccgttcaagcataaaacagtcatccacagcctgagcgaaaacttcgaggaagagttctttgaaacaaagaaggtagtatattcacaaatataggaatcaggagttatcaaaaccatgaaaataaagagatttgagtttaatatgtttcccgtaaattgctacgttttatgggatgacacaaaagaggcggttgtcatcgatccgggctgcttctacgaagaggaaaaacaagcactaaagaagttcatcctcaccaatgagttaacagtgaaacatctgctgaatactcacttacatctggatcacatcttcggcaatccgtttatgctgaaagagttcggtctgtcggcagaagccaataaggcggatgagttctggatcgatgaagctccgaaacagagccgtatgttcggcttccaattgcaggaagaaccggttccgttggggaaatatctgcatgacggagatatcatcactttcggacacaccaaactggaagcaatccatgtccccggacattcgcccggtagcctggtgtattattgcaaggaagaaaactgcatgttctccggcgacgtattgtttcaaggcagcatcggtcgtgccgatctgtcgggtggcaacttcgacgaactgatcgatcatatttgcagccgtttattcgtacttcccaacgagacagtcgtataccccggacatggtgcgccaacgaccatcggaatggagaaggcagagaatccatttttcagataaaaaaaagaatacaagtaataggtaataagtaacaggtaataatcgtagctgccagtatatttatccgcatggatattacttattacttattatctattacttaaaaacatcccccataaattatgaaaacagatttgttagctagccgtcacatcggcatcaatgaagaagacacagctgtgatgctccgcaaaataggcgtagactcactggatgaactgatcaacaaaaccatccctgccaacatccgactgaaggaaccgctggcactggccaagccgttgacggaatacgaatttggaaaacacattgccgacctggcaagtaaaaacaaactgtatacgacatacatcggattggggtggtataatacgattactcctgccgttatccaacggaatgtattcgaaaatcccgtatggtatacttcttacacgccttatcagacagaagtgtcgcaaggaagactggaagcgttgatgaatttccagactgccgtctgtgacctcaccgctatgccgctcgccaactgctcactgctggatgaagcgactgccgccgccgaagccgtaaccatgatgtatgctctgcgttcgcgtacccagcaaaaagcaggtgccaacgtagtctttgtggacgaaaacatcttcccgcagaccttggcagtaatgaccacacgtgccattccacaaggcatcgaattgcgggtaggcaaatacaaagagtttgaaccctcaccggaaatcttcgcctgcatcctgcaatatcctaactccagcggtaatgtggaagactatgccgacttcacaaagaaggcacatgaagcagactgcaaagttgccgttgccgccgatattctgagtcttgccctgctgactcctccgggagaatggggagcggatatcgtattcggtacaacacagcgactgggtacaccgatgttttacggcgggccttcggcaggctacttcgccacacgtgacgagtacaagcggaatatgccgggacgcatcatcggatggtccaaagacaaatacggcaagctctgctaccgaatggctttgcagacacgcgaacagcatatcaaacgcgaaaaagccacttccaatatttgtacggctcaggcattactcgctacgatggcaggtttctacgctgtatatcacggacaggaaggaatcaaaacgattgcttcgcgtattcatagcatcactgtcttcctcgacaagcaattaaagaaattcggatatacgcaagtcaatgcacaatatttcgatacgctgcgtttcgagttgccggaacacgtttcggcgcagcagattcgcacgatcgcactgagcaaggaagtgaacctgcgctattatgaaaacggtgacgtaggctttagcatcgatgagacaacggacatagcagctacgaacgtgctgctttccatcttcgccattgccgccggcaaggattatcagaaggtagaggacgtgccggaaaagagcaatattgacaaagcactgaaacgtaccacgcctttcctcacgcacgaggtgttctccaactatcatacggaaacggaaatgatgcgctacatcaagcgtctggaccggaaggatatttcattggcccagtccatgatttccctcggatcgtgcacgatgaagctcaacgcagccgctgaaatgcttcctttaagccgtccggaatttatgagcatgcatccgttggtgccggaagatcaggcggaaggatatcgtgaattgatcagcaatttgagtgaggacttgaaggttattaccggatttgctggtgtcagcctgcaaccgaactcgggtgctgcgggagaatatgccggtctgcgagttatccgtgcctatcttgaaagcatcggtcagggacatcgcaacaaaatattgattccggcttcggcacacggtacgaatccggcatctgccatacaggccggatttgaaaccgtcacctgcgcttgcgacgagcaaggaaacgtggatatgggcgacctacgtgccaaagccgaagagaacaaggaagcactggctgcactgatgatcacctatccgtcaacgcatggtatcttcgagacggaaataaaggaaatctgtgaaatcatccacgcttgtggcgcacaagtatatatggacggtgccaacatgaatgcacaggtaggattgaccaatccgggatttataggtgcagacgtttgtcacttgaatttgcacaagacatttgcttcaccgcacggtggcggcggtccgggtgtaggtcctatctgtgtagctgagcatctggttccattcttaccgggacattcgatcttcggcagtacgcaaaatcaggtttccgcagctccgttcggcagtgcgggtatcttgcctatcacatacggctacatccggatgatgggtaccgaaggcttgacccaagctactaaaatagccattctcaatgccaactatctggctgcttgtctgaaagatacttatggcattgtttatcggggagctaccggtttcgtaggacacgaaatgattttggaatgccgcaaagtacatgaagaaacgggtatctcagaaaatgacattgcgaagcgtctgatggactatggttatcatgcaccgactctctctttccctgttcacggcacattaatgattgaacctaccgaaagcgaaagcctggcggagttggacaactttgtagacgtcatgctgaatatatggaaagaaattcaggaagtgaagaacgaagaagcggataagaatgataatgtgttaatcaatgccccgcatccggaatatgaaattgtgaatgacaactgggaacattcctacacacgtgagaaagcagcgtatccgatagaaagtgtgcgtgagaataagttctgggtgaatgtggctcgcgtagacaatacgttgggagaccggaaattattgccgacccgctacggaacgttcgaataagaagaagctttcaaaggaaatccgtacatgaaaaaataagcccggagctcagcaaatgtgagctccgggcttacctttgttaagcaccgagcgtattccaataagcaccgagctaaatgaacataagaagcgactccgaaaccttacggttatcatgctgctcttcattccattccatgtttgtcgaaaacatagtctggttctatctgacaacagtcactgttccggcttttaccattttctcccttagtgagattttaggatcagcatatcctaaagctacacagccatatactttatgattctccggtacacccaaagaacttataaattcacgaacttcgggatcatcgcaagtcgtacccaactgattgatccagcaagatccgattcccagagaatgggcagccaaaaacatattctcaatcgcgcaggcacaatccatgccggcccaccattgagtgggttcgttggacacgatcaccaaagtcggggcatgataataacagcaatacgccttgctatgaccacgttcctgtaatttcggttcatcgcttttagcaaaagcgcctttaatccgttcattcaattctgccagtttatctgcattctgaatagcggtaaaatgccatgtctccaaatgcatcccactgggtgcaaaagtggcagcttccagaatagcctgtaagtcttcttccgaaacttgccggtcagtataagcccgtacactacgacgtgctttgatattttctaaaacttcattcgttttcatatactatatttactatacttacaactcgttcaccacttgcatttatcgttttaccaatccgatctttgcattcagtttgaagtaatacgtaccgttctctctttccaaaaagccgtatttgtccttatccagagaacctttctccaaacgggtattcaagaacaggaagtcctccataaccggtttctctgacttgtgatagcaaagaacttccccactcccatccatcaacaggataccttcaacagccgaatcctgtccagtatatatctttgccggacgcatacccaaggctaatgccatcaggaattgcttcactttaaactcatagaaaccatgtttgtttaccaattcatcttttattttcaacgggttcatctgtttgattacttccgtcagttcactgatacgggtgatgtcgtccaagtgcatgatgcgcaccatttctgtcagcacacgaggaaagtgtaagtcaatcattaaaagattgctacggaatacccgatctgccacgtccgagtatttgagtacaccacccaagcgctcaatcagcaacattcgttctgctacttcattaggggcttccggcaacgcattaatcttattcaccgtaggtgttgcaaatttgactccgctctgttccagtttcaagttagccgcacggcctccgtccaacagcggattcatagcacccaatcgcgaacgaacgctgaacccgctcaacggtgcctccggatgccagaaggcaatataaaaatcggtacgatcttccgtcttcgcttccagatcgaaaattgcgacttcatccaaaaactcttccactccatccggagaagtgacttcatcctccgaagaggacttgacagcctgcaaaatcaaatctgccacaatcccaaaatcttcccggggaacgaatttctcactattttctcctttgatgcggaccatctctttttctatatagtagcagcgtgttccgtcatgttcctcccgttgaatcattgcaataggccagtcgatttctcctttctttgccttagccgtacccaacgttacttttccttctgtcagcagacggaagaaagtatacagttcacaccattctctttttgttgcttcaaatgccatatattcttatttttctttattttactcttcatcaagaatccttgcggtctccactttctccaatcgtgcacgcagtttgggcatcatggaacgacgaatacacaacgtcatgctgcaatccatatcgtacgattgactgagaatttccggttcttcctcctttacaatacgcatgatatcgttcataaaaggatattcaaacattacggtcacttcttcatctaccgttttttctataatggtagcggcagatattgcttcggcagcagctgctttataagctacaatcagtccgctcgttcctaacttgattccaccgaaataacggactacaataatcagaatatcagtcagttcattagagttaatttgcccgagaatgggctttcccgccgttcccgaaggttcaccgttatcattggctcgaaaatcctttcgcgctgcacctaacatataagcatagcacacgtgccgtgcatcataatacttcttctgatacgtttcaagatgcgcttttatctcatcaagggtacgcacaggcaaggcgatggcaataaacttgcttcgcttttctgtataaataccttcggaaggttcgacgatagttttataagtatcttcagcagtcatgccgcaaagatacggctttcttgacgaaattccatctgctgttcgaaaatattaaagcttctcattgaaacgagcgcttcatttcatgcagtcaaacggtcgatggggtgcaatcaagcagtcaattggaggtagtcgggtggtcgttttaacggaatcgggcggtcatttatacaaaaacaagcggtcaatctctcacaaatgtcctgttgattgtgagagattgaccgctctattttctatatagaatatgtcttaatccaacttatggataaccaatcctgaacgaagtttcggttcaaaccaagtcgttttgggaggcataatgttgccagtatcggcaatatccatcaattgcttcatggatacgggataaagagccagagctactttcatttctccactgtcaacacgcttcttcaattctcccaaaccgcggataccgcctacaaagtcaatacgcttatccgaacggaggtctttgattcctaaaatctcatctaaaatcagattggaagaaatagtaacgtcaagcacgccgataggatcattgtcattgtatgtacctgcctttgccgtcagactataccacttgtcgccaagatagagggagaaattgtgcaaaccggacggtttatagatatctgtacccttttcttctacaacaaaattcttatccaatgcagcaagaaattgttcgggagtcagcccgttgaggtcttttactacacggttatagtcgatgatagtcaattgattggcagggaaacatacagccatgaaatagttatactcttcatcgccacgatggttcgcgttttgctttgctttctcggcacctaccagagcagcagcagcggaacgatgatgcccgtcggcaatatataatgccggcattttagcaaattctgcagtaattgcagcgatatcttcgtcctggtcaacaatccagaaagtatgtccgaagccatcacccggagcgataaagtcgtaaacaggcttttcggcagtgtatttccgaatgattgtatccaatttcgcattatcgggataggcaaagaatacaggttcgatattcgcattgttcacacgaacgtgcttcatacggtcttcttccttatcacgacgggtaagctcatgcttcttgatgataccgttcatatagtcaggaacataagcgcctactaccagtccatactgagttttcccgttcatggtctgggcatagatgtaatagttttcctttgcatcctgcactaaccagcctttatcctgaaacagccggaagttttcggcagctttctcataaacacgttcatcgtgttcatccgtaccaacaggaaagtcaatctcgggcttaatgatatgataaagggatttttcatttccagctgcttctgtacgcgcttcttctgagtttaatacatcgtaaggacgggaagcaacctgttcaaccaggtcttgtggagggcgaacgcctttaaaaggtttgataatagccataagtcatggtatgttttaagattagtagaacagatacgccctcgcaaaagccgagggcgaaatctgataacatatttctaaatatactgcttaatgaccagcacctatcatcaaataagtgactgagcaacgataagcagtcttacgattcatctcattatttgtttactctgaacttctcacagccgtctttcaggaaaccgacaatctgttgagcagcagcaataccggcattgatattcgcttcggcagtctgtgcacccatcttcttcggagtagagaaataacgtcctgcgaacttctcagcaaattccgcattagcagcaggcatgatatctgtcatatacttgaagtcagcacggtcttccatcaatttgatcagctcggcttcgttgatcacttccttacgggcagtgttcaccagcatagcgcctttcggcatatctttcagcagagcgtagttgatagagttcttcgtttcagcagttgccgggatatgaagagacactacctgacaagtcttgtacagttcttctgcagagtcaagtgccttcacgccatctttttcgatcacttctttcgggcagaaagcgtcgtaagcgtacacttccattccgaagcctttagctacacgggcaacgttacgaccaacgtttccgtatgcatggatacccagtttcttgcccatcaattctgtaccggaagtaccgttatagaagttacgaacggcgtataccatcatgcccaaagccagttcggcaacagcattggagttctgtcccggagtattcatcacgcaaacattgtgagcggtagcggcagccaggtctacattatcgtatccggcaccagcacgaactacaatcttcagttctttagcagcatccagcacctctgcatcaataatatcactacggataatgatagcattagcatctttcactgcatccagcaactgtgctttatcggtatatttctccagcaaagcaagctcatatccggctgcttcgatttctttacggataccgtctacagcaactttggcaaacggtttttcagtagctacaagtactttcataatttatctgtatcttttaaaaaagattcaccacagacttcaccggcctacacactatattcaataagatttcagtgtaaatccgtgcaatctgtggtgactctatttatattattaatgaagtttttcaaattcctgcatgcagtcgatcaaagcttgtacactttctttcggcagagcattgtagcaagatgcacggaaaccacccactgaacgatgtcctttgatacctaccatacctttttctgtagcgaacttcatgaagtcagcttccagatccttgtattcgggagccatcacgaaacagatgttcatgcgtgaacggtcttctttggcagcagtacctacgaacagtttgttacggtcgatttcagcgtacagcatatcagccttttcgatagcacgacgttccatttctttcacaccaccctgtgccttaatccaacgcaggttcaacagtgcagcatagataggcactaccggaggagtgttgaacatagaaccgttatcgatatgagtctgatagttcagcattgacgggatgtaacgagaaactttacctaccgcatcattcttcacgataacaaatgtaacaccggcaggagccagatttttctgcgcaccaccatagatacagatatatttggatacgtcgatcggacgagagaaaatatcagaagacatatcggcaaccatcggaaccggagaattgagatcttcttttaattctgtaccgtaaatcgtgttattggtagttatgtggaaataatctgcgtcagcaggaattgtgtaatctttcgggatgtaagtatatgtagcttcagcggaagaagcaacttctacgacttcaccaaaccccttagcttctttcattgctttctttgcccacacacctgtattcagataagcagcctttttttcaaggaagttgaaaggtaccatgcagaactccatactagcaccaccaccaaggaacagtaccgaataaccttcggggatattgagtaattccttgaataatgcctctgcttcgtcaaccacaggttggaagtctttggcacggtgactgatttccatcagggagagaccagagccgttgaaatctaaaatagccttcgctgtatcctctatcacctcacgcggaagaatggaaggtcctgcattgaaattatgctttttcatttgaagtttgtttttggtttaacatttcgttagtttatgtcttttgaccttgcgaatttacgaatttatttccggtgcacaaatctttccttataaaaatactgttttaaagcagatttctctttctttttattggtttatacaagatatatacaccat

SEQ ID NO: 58 - DNA, 47158 bp, Bacteroides thetaiotaomicron
atagtgtatatctaatagtttatgcaatggggaatttaatttcattttttaagaaagtagccgatgggctacgggcagagggaaactttgggactgcccatgtgtatcgaagtactttgaacattgtgacaacctttcatgggagcagatatcttgattttcatcaggtaaatcccgaatggttgaaagattttgaagtctatcttcgcagtcgtggttccagttggaatactgtttccacttatcttcgtgtgttgcgtgcggtttataatcgtgcagttgatcttcgtaaagcggaatatatcccgcatttattccgttctgtttacacaggaacacgtgcagacaggaagcgtgcgctggaagatgaagatatgcgaaaagtttttagtcgtttgtcgaaatcatccacaattccttcagatttacgtcgtacgaaggaactgtttattctgatgtttctgcttcgtggtttaccttttgttgatttggcttatttgcgtaaaagcgatttaagaggaaacgtgataacgtatcgtcggcgtaagaccggtcgttccttatcagtgactttgacgccggaatctatgcttttattggaaaagcacataagccgggatcttagttctccttatttgtttccaattcttcatagcattgaaggaagtcaggaagcatatcgggaatatcagttagccctgcggagtttcaatcagcatttggaattgttaggtcagtggctgggactggaaagcaaacttagttcgtatacagcccgccatacctgggctacgacagcttattattgtgaaattcatccgggtatcatttctgaggcgatggggcattcttccattacggtgacagagacttatctgaagccattccgtaataggaaaattgatgaagcaaataataggatcgttgattttgtaaaacgctctgctggcggaataatagtttgattactaacctgttacttggtaggtaacgggactgaatagcactgcaaatatggacatattttggaaaacatgcaaacaaaattgaaaaaatctctgataaaccactaaaaaaagaacacataaacaacaaatactgcggattctttgtattaagactatattaaccttaaattttggcaaaagatttttctcccctctgctacagcttctaagcaggggtaaaagatttagattctttttgaatcagttttctacaaaaactactttataaaggttaccacaaaggtttccccgttacctaccaagtaacgggacaggcattattgaaacttagtgtttaataatatattattaatgtaatttttaagtagttatgaaaagaaaatttgtaaaagtgatgttcttcggggcgttagcactttctaccgtcacctacgtaggctgtaaggactacgatgatgacatcaaaaacgtgcaggaacagattgatgccatcaacaagaaaggtgctgatgttacaactgaagcaatgactgctgctattaatagcgcagtagccggattgcagacacaattggatgctatcgcaagtaaagcagacaaaacagcacttgatgagctcaagaaaacagttactgacctgcaagctgctttaaataacaaagcagatgcgataaaacttacagaactgcagaccaaactggatgaggctattgctaaagtaaacgcatctattgagagtagtgtaggagctgcaaaaacagaattgcaagctaaaattgacaaactgcaagccgatttagaaaaagctgatgctgatgctgcagaaaagattgcaacggaattggctgctgttaaaactgaattgcagggactgatcaatgcaaacggtgagaaaattgctgatctgtatgaaaagatcaaaggtttggatgctatcaaaactaaaattgaagctttggaagaagctgacaagaatttcgttaccatttctcagttgaatgattatatgaattcagaggctgtgaaagcgtatgtggatgaagctcttgtagactatctgacatctgccgaagttactgaacaggtaaatgctgtaaagacatatgttgacggcacattcaaggctgctattatggctgagattaaagctgaatacttgagtcttgaaaagtataacgcagatatggaagctttaatggaaaagattgatacatatgtaggcaaggaagatgctgcatacaagaaaatttttactgatattacagcccttcagacctatcaacaacaaacaattgaggtactcgttgcatctcttgctgagaacaatacaattgaaaatgcaaacaaaattgttggtgctttggaagatattacaacattgcaaactgaaattgcaaaatgtgcgaagaccacagatttggatgcttacgtaaaaggtacagaattaggtggactgatcgatacacatttacaagacaaatttgcaggttatgatggtgaaattgcagatataaagaaacgtctgttagcacttgaaattgatgttgacggactaaaatcaatggttcaaagtgtaacattcgttccatcagattcagaaggtaaagtgtatttctcttcttattatgtagtgtcggaaggtgaaacggaaaagactttgatagcttctaataatacagtgactgtgaaattccgtgtttctccggtttctgctgctaaaaacttcttcgataattatactgcatcattcgatgcacaggagattactacacgtgctgctaatatttttgaaggtgaaggtaaggtggaaaatgcggatgaaggtattatttcgtttgttatatctactactaccgaacagagtcatgctgtttgtttaaatatcatagctaaaaattctgttccggagaatgcggaaactgctataaaaggtacggactactttacgaatatcaactctaattatttcccggtaatcgttacaacaaaaacaattagtggtattcaagtagaatcaactaatagcacagttagttctatctattacaacaaagaggcatctaagattgattataaagcaggcgttgctttgaaagcaagatttgtagatggtggaaatgctactttagatccggaaaatgtagatctgtctaatcttgttacaagttatgagtttgataaagacatgactaatcctgatgctccggttatcttggatggcgatggaagttacaaactggaagatggtgtattgtctttaaaaaattatgcagctgaatctgcaggtaaggaagctacagttgtggcttatgttgctgtaaaagatggtgacaatactttgaaggaattcaaatctacagcttatgcaaaagtgacggcagctaattatactgatggtacagtgaatctgacacctgtagctcctactgacgttttgtatgatggaacaaaagtaacttcaactagtgcttatgcgctgactgaattgtatacttcagctggttcgaaagatatctatgaggctattcctgttgacaaatttactccgactgctgataagggagttacatttgttattggtgaaaagaatgctttgactatcaatgttcctaaaggaactgcagccggtacatattctccaacattgaaaattcaggtagatgcagtgaaggttatcaatgtttcagctagcgtgaaggtaagctatcaggatattaaagttgtaattgatggaaatatcgttagtgcaggtgcaatgacattgaaaccgacttatcagggatcatatgaaaaaccgacaagtgttggcttcactttagatttggccactctttacactaactatgctacgcagttggctgctgttaagaaagtaggcggagatattactcttactctgaaagatgctgtgaagggcgcttctatcaatggtactacattgacagtagacaagacttacaatgcacatgcagatgatattaacccgattgtaattgttgccaagactgtatatggcgaagctacattagacaatagtacagtagaaactaaaattaatctgactgagatcagtggaacatgggcattcacaattaaatcagcagcatttggtaaagataatctaaacagcacattgaatattgcaaaaacagcttcttggacagactatagaggtaaagtgatgtgggcagatggtgctgaaaaagctcagggtactactgaatggggagctaaaccacttagtgtatatggtttcaccgcacctgtatttagtatagctacagctgatgcagataaagctaaatatgtaaatatcacaactgatggtaagatttccctgaccgatgcaggtaagaatctggcatctgcaattactctgaaagtgaatgtagctgctgtctctaactggggtacaatcactgactttgcaagtaataatgaagttacagttaagatcgatttgtctcaagacgctgcggatatttaattgtaaactagcagaattaaaatggatactaattattttatttacgtttaaatgatggttagctaacattttatttctccaataataatcaaagggtatctctgattccataacgccaggagatacccttccttttctttcttcactacatggtgaagattgcatgagagatagcagataataagattatgcttgcgaaagtattttttggtatatgtatctctctatgataagaagatacctcccttatttcccacaggtattttctttatagtcttagcgtatctgtcttattttcccgagattactacttttaatgtaatccccttattccccactaataagaagatgcttaagaatgcaaaagcccgggcttgcgaaagtctgggctttcgtatattactgtttgcctctgtacggcttaatctgccggaaatccttgtcatacagccctaccagtaaactctgtcctttattatctactctcaatccaccataagcggcacgattatagacagaatcctgtccttcttcaaaaaagaaggattcggcaccgaggaataacctgccatttattgttttatatttcaggacgatctcattttcatttactggttcaagggattcctgaagacgtattatttctccgacgtgattcttgtcaagcttgagcacagcataaccgcgtttagctttctgtctgtttatcaactcggaatttgcttctttatagttaagtctcatataatctccttgcatcagcgaacggggatcgacaggagccagttgcaataatacgagttgtccctctttcagcgtctgttctttctgataaacagaccagttaaaatatcccagaagaagaattaaattagcgataatcagtattcggctatattttttcatgtcttgtctttttttgagtgaaaatataccaggctatgagcaatgcgattcccgtaaagaacaaggtgatcgatttcgtcagcaaggtgatatccagatcatagtaatatttggatatggaatagatgaagaggaggagcgcaactgcggactcagctttataaccgtactgaaaacatatcagtatcagcaggatactgcccgatagataaggggcatgcagactgggaaagcagatcaggatacaaagaagatagatgcacacctgatgtaccggactcttaacctgcatcacctgcacgattttataaaccatcagaaggatacccaccaacatgaaaacagatatgatccagtcatttgtgctttttgtcaagtaattgacagacaacccggccaatgaaaggacacaagatacgaacagaccggaatgaataggtttatatttagacaaatccccgttcgtatagctgagtatttttgtctcagatagattgacgaataagaaaattgctataataggcacggcagccacattcagcggattcagtgaagagaataaattcgttatctctccgaacagtgccatatagaatgagattaccgaaaggaaggtcaggatgaaccctttggataacagcatcgttactacactgatccctatcagtacaataaagaggacatccatgtttctattcattccataaccggctaatatacatccggctatgtagcatgtaatattcatcgcatccagaaaaggtttggtcaggaggcgattgacaaataaagtagtaatgatcaggatacttcctgtaatcaggcaggatgtttcggatcggagaatggaggaaagtacaagaaatcccagaaagaagatagcggtcagcactcctccgataattgaaaggacttcgattgtcaggttactcttctgtgccataccattgtttttttaggtgaaggattgcataaatcaataaagtggtaccggtgataacaataattcctgagaggaggaatatgttgacgtccctaaggttactgtgacagataaacagggatagtaaaatcatcagtatggcaaaaggaatggcggaaagatagaataaattcctttgtctccatccgaaccataaccctgccgagaacagcagaacggtacttgcgagcggaatggatacgattgtatccttttcgcagattactgccatcataagataagtcacatgcacaatggtcgccagagaaagcaggctgacaaaccaacggttttgtcggctgagggtacctttgatactcatccattctgtgacgaccgttgccgaagcgcaaatccaggttactgcattggtcagtaaagtgactgcccattggttatccggcactatttgcatagcgtatagccatatggtagtacagagcagtccgataaacgtcagccagagcggagtgaaacggatggcgaatgcccaaaggatggtgaacagtgtccagcccagaaataagtcatacgcatcagcgcctgtctgatagatttgtccgaatacggcaaagagtgtacccacaaggaatgtggctccggtgaggattatctgtttgataagtatattccatcgggtaaatactgttagcagaacagatgcaacaagcaatgtttgtacgattcccagtttggcgaatttgggaagatcttcccagttataggcgaagaaaaagataattcctgctaccgtaaaaccaacgcctgctgctaacagaaaaatagaaagaaattgtttccattgttttttatcggcatacatcggttgcctgaataggagtgaagagtccggtttttccatgtacttttcttttttgatgattacaaacataagaaaataaaatgattatctttcggttggatatataaaaaaggcagaatctgattcattgttagtctgtaatgagatcagattatacctttctgaagataatcatcttgtctgtgtgcaaggataaatatcgttgaagaaggaactgtcagaagacttcccgtatatgtttataattcgaattaatagtatcgatcacttcctgtgagcgtccgttaatcaacagtttatacatggactgggcgaagcctaccatctgccccaactctatcttaggaggcatggcaagagcgttcggatcggtcatgatatttaccagtaccggaccatccagttcgaatgcatttaataaagtagtcagtacttcttccggattgctgacattgaagcctgtcattcccattgcttcggctacttgcgcgaagtccggattcagcatatttgtctgccagtccggcaggccgtctacttccatttccagttttaccattcccagggagcggttattgaagacaatgatcttaatcggtaacttgtattggacaacggtttccagatctcctaaagtcatcgacagacctccgtcaccacagagcgccactacctgacggtcggggtaggcaagcgctgccccgatggcctgtggcaaagcattcgccatagaaccatgattgaaagaacccagcatatgccgttttcccgtagcttgcagataacgtgcaccccatacacaagtcattccggtatctacggtgaatattgcatcgtccgacgccagtttatcaatctcggacatcacatattccggatggattttttttatatctcctttattttccgtataggctgccaggtctttctttactccttcatatcttttcagttgtttcagcaggaaagtatcatcagtcttggggtccagcatacgcaataatgcctgaatagtcattcttacatctccgcaaagtccgatatccactttggcacggcgtccgagccgttcgggtttgatatctatctgtgctatcttgatgtcatcgggcaggaaagcggaataaggaaagtctgtgccgagcataagaagtacttcggcttcgtgcatgctgtaatagccggaaggcattcccaacagtccggtcattccgacttcataaggattttcatattgtacttccatttttcctttgaaagtatataccacaggagcattcagcttctccgaaagcgcgatcacttcctcgtgtgctccccgacagccgatgccgcagaaaagagtaatgcgtttatggttgttcagcaactctgccaattgtatcaagtcttcttccgccggacagacttctggcggagccggataattctttaccgaagaatcgacggaaacggaagatgctttggccaggtctcccggtaagcctacaacggctactccttttcgggtgatggctgtctgaatggctgattgaagcatacgcgggaattgtcccggagtagttgccacttcattatagtagctgcaatcgttaaagagttttatagtattggtctcctgaaaatattcagtcccgaattctccgctggggatggtggaagcgatggcgatgaccggtgcgcctgagcgttgtgcatcatatagtccattgatgaggtgaacatgccccgggccgctactgcctgcgcagcatcctatccgtccggtcagttgcgcttcggctgctgcggcataggctccggtttcttcatgccgtacatgtatccattgtatcttattgttctttctgacagcttcgtttacttcatttaaactatcgcccgtcacggcatagatgcgctctacgcccgattcaactaatgtatcgatcagttgttctgctattttttttgccatatttctaataggtttaggattgattcttaatgtaataacagatgtatgccaagaaaagttctgttttaacatatgctaataagtccgttgtgtcggtacacatcgcaggttttatgttaaaaataattttgtaacaactttttagcatcggggagggaacaattgtgatatccatttgttatctttataggcgaaatcttaacctaatgtttttaacctcttaatagctgtagaaaatggatagaaagcaaatcggtgtgtatgctggtaaagtctggcaactgctgagcaacaatgagaaatggggctatggtaccttaaagagaaagtccgggttgaaggataaagaattgggtgccgctctgggctggttatcgaaagagaataagatagagttcgatcagtgtgatgaggaactttatgtatatctctgcgtaaatgtttatattggatgaaagaatgtctgatgttttaatgagaacagattaaatccccgaagttacatctttgtagatgaggcttcggggattttggttttttattctttctctttcttctgtattttcatctcgatgaggaaagctgtcagcagccctgcaccaccgaaaagaagtacgcatgcgccatacacgacacttgcctgacgttccacgtcccagtttctggaagcggtgtatcccggaaatgagttgatgcagataaagaaggcgaccagtagacctaatcctattccaagcatcagcagaccgctttttaaagaaccgaaggtaaatcgggagcgggagtaattaaggttgagggataagttactgttgatttctcctgtgttgactctgtcagccagcttttcaatcatggctatccgctctttcttgcatacaaaaagttcaaataatttgtagattcctaatgtaatagtacctacgaccaagggaatggtgataaaatccatcataattatactgtttttaagtgaatattttcgttctttgtatcgtttgacgcagtggacggaaaaaggttacactgaaaagcggataatttataatcctgtattttttctttcccggattgtaaccttttgtatcgggcagcgtctaaagagtcaagatggaacagaaagacgaatcatactatatcgaacgcatactggatggagagacggaatacttttccgtatttcttgaccgctacagtcgtccgttgtatacgttggtagtgcagatcgtcggttgtcccgaagatgcggaggaactacttcaggatatttttctgaaagctttccgcaacttgaatcgttataaaggcgagtgccgtttttctacatggatttatcgcatcgcttacaatgccgctatctcggctacccggaaaaagaaacaggagtttctttatatagaagagaatacgattaataatgtacccgatgagatggcggacaatgtgcttgctccggcagaaaccgaagaacaactggagcgtttggagatggcgatagatcagttgagcggagaagagaaagcattgattactttgttttattatgaagaaaagtcaatggaagagatcggtgaggtgctgaaactttcgatcagtaatgtgaaagtacggcttcatcgtacccggaaaaagatttgtgtattgatgaataataaatagaagagaggatatggaagaggaaagaaagataaacgagaatacgggcaatatgctgaaacaagcattggaacggaggcaaacggaacgactgtcttccaatttttcgtatcggatgatggagcgtgttcatcaggaggctgagaagcagacgaagcggaaaacgagaatcggttgggcagctttgctgatatcggctttggcgttggtagggctgggtgtctatgtgctgactttctatctggaatttaactttgccgatgtgatgccgcaaatgaatgtccggcaggattcttctttgtttgcattttatgtctatatcgcacttcttgcattggtcttgctcggattagattattggctgcgcaagaagtatatctggaaataattctgttactttgcatgacaattaaaacaatgcgaagaaacaagaagaaacaatgagaagttttgcctctgataataattccggtgtgcatccgttggtgatggaagcattgagccgggcaaacgcagatcatgcgttgggttatggtgatgatcgatggacggaagaagccgtagccaagataaaagaaacctttacacaggactgtgtccctttgtttgtattcaatggcacgggcagcaatgtggtggctttgcaagtaatgacgcgtccgtatcattcaatcttctgtgcagaaactgcccatatttatgtagacgagtgcggctctcccgtgaaaatgacaggttgtcagattcggccgattgccacaaccgatggtaagttgactcccgaactgatgcagccttatctgcacggtttcggcgaccagcatcattcgcaaccccgtgcgctttacatctctcaatgcaccgaactcggaacgatttatacacccgaagaactgaaacgtctgactgactttgcccatctgaacggtatgtatgtccacatggacggagcaaggattgccaatgcctgtgccgctcttcatctttcgctcaaagaactgactgtagactgtggaattgacatccttagtttcggcggaacaaaaaacggactgatgatgggggaatgtgtgattatatttaataaggacctgcaacgggaagcccgttttgtccggaaacaatctgcccaactggcttccaagatgcgttacctttcctgtcagtttactacctacttgacggatgacctgtggctgaagaatgccgctcatgccaatgcgatggcaggcaagctctatcgggcacttaaggaactgcccgaagtcacctttacccaaaagccggagagcaaccagttatttctgaccatgccccgtccgactatcgaccggatgctggaatcttatttcttttatttctggaatgaggcgaatcacgaaatccgcctggtgacttcttttgacacaacggaagaggatgtaaatcaatttattcgacttttgagacgttaaaggagaagaatggaacaacaaaagcgtctataatactgttgtaataggaagtttggggctaactttgtccccgtaatattgcttcttgttatgatggatgctagacgaaacggacttgtattattggcgctattgttgttgacacaaaccactataagtgcgcagactgattctatgggcaaagatgtgccgatagattctgtctctgtggcaacctcagactcgcttcagacaaagcgcggttttttcaagaagtttcttgattattttaatgacgccaataaggaaaagaaaaataaaaagttcgatttcagtgtgattggcggtcctcattattccagtgatactaaattcggtcttggattggtggcggcggggctgtatcgtacagatcgcaatgattcgatccttcccccttcgaatgtttctctttatggagatgtctctactgttggtttttatctgttgggagtaagaggcaatcacctgtttccgcaagagaaataccggttgaattataatctttatttttattctttccccagtctttattggggaaggggatatgataatggggcgaactctgataatgaaagcgactacaaacgctttcaggcacaagtgaaagtcgacttcatgtttcgtgtagcgaaaagtttctatatcggaccgatggctgtattcgattatatagacgggcgcgactttgagaaaccggaactctgggaaggaatgtcggcacgcactacaaatacgagtctcggcctttcccttctttatgactcccgtgattttctgaccaatgcctatcagggatattacttgcggatagaccaacggtttagtccggcttttctcggtaataaatatgcgtttagcagtacggaactgacaaccagctattaccatccggtatggaaaggcggagtccttgcaggacagtttcacactttactgaactatggcaatcctccgtggggattgatggcaaccctcggaagttcttactcaatgcgtggttattatgaagggcgttatcgtgataagtgtgcgatggatgcacagatagaactccgtcagcatatatggaaacgaaacggagtggctgtatgggcaggagcgggaactgtatttccgcgcttctccgactttacgccgaagcatatccttcccaattatggtttcggctatcgctgggaatttaagaagagagtaaatgtacgtttggatttagggtttggcaagcaccagaccggatttatatttaatatcaatgaagctttttaagaacataaagaaatggtttgaaaatcaggaacacttgttttacctgttcctgatcatcctgataatgcccaacatcgttctgggtttcacagaacccttaccgttgatggcgaaggtaagcaatgtcttgttgcctttagcctgttactatctgctgatgactttgtcccgcaactgtggcaagatgctatggattttgttcatcttcctgtttttcggcgcctttcagattgtgctgctttatctgttcggacagtccatcatcgctgtagatatgtttctaaatctggtaaccaccaattcgagtgaagcgatggagttgctggacaacttattgccggccatagtcaccgtagtcatactttacattcctgccctgatattgggcatgatttcaattatccgcaagcgccggctttctgtggcatttattcgcagagaacggaagagagcgttcatcctgcttggaatctctcttctcgccctgggcggagcttactgggaagactcccgctatgaactgaaatccgatctttatcctctcaatgtatgctataatgtgggacttgcttttcaacggacggcattgacgcaaaattaccatcatacctcgaaagattttactttccatgcccaagccactcatccggtggacaagcgtgaagtgtatgtaatggtagtgggagagacttcccgcgcattgaactggcaactctacggatatgagcgggagacgaatccgcttctgtcccgtcaaccgggaattgttgctttctccaaagtcctgacggagtcgaataccacccataaaagcgtacccatgctgatgtccgatattacagcctgtaacttcgactccatttaccatcaaaaaggaatcatcacggcctttaaggaggcaggttatcagacagcctttttctccaaccagcgctataatcattcctttatcgatttcttcggaaaggaagccgatacattcgattttataaaagaagattcgctggattccgcctacaatccttctgatgatgaactgctggcattagtagcgaaagaattatccaagggaaatcagaaacagtttatcgtacttcacacatacggctcacatttcaattatcgtgaacgttatccgtcggaagacgctttctttctgcccgattatccggtagaagcggaagtgaagtaccgtgataacctggtgaatgcttacgataacaccatccgctatacagatagctttctgtcacgtctgattcatatgctcgaagaacagcatgtggatgctgcaatgctctacacctccgatcatggagaggatatttttgacgattcccgtcatctgttccttcatgcttctccggttccttcttactatcagcttcatgttccgtttctgatatggatgtccgacacctatcgggaagcttatcccgaacattggcaaaccgtgaccaagaataaggataaggacctatcttccagccgttcattctttcctaccatgctggaactggggggagtgcaaacttcttaccgcaacgattcctcatctgtagtcagccctctttacaccatgaagccgagagtatatctgaatgatcataacgaaccacgccccttggatgatctgggaatgaaacagcctgacttccagaaatgtcaagtattaggtattaagtattaggtaataggtaataagtaataggtaataagtaatacaccgtagccgtacaggcaaggctatacgaagctacgattattacctattacttattacctattacttattcattaatccttgttaattcttatatccaaaagcatgattggcgtgttatttgcgatataaaagtatgaacgattaaattcataaaacatggcttatatagattattataagattcttggagttgacaaaagtgcttctcaggatgatataaagaaggcttttcgtaagttggcccggaagtatcatcctgacctgaaccctaatgacccaagtgcgaaggacaagtttcaggaaatcaatgaagccaatgaagtactgagtgaccctgagaagcgtaagaagtatgacgagtatggggagcattggaaacatgccgatgagtttgaagctcagaaaaaagcgcggcagcaagccggtggctttggcggtgccggaggcttcggcggattcggtggtggcggtcagggattctctgatggtgacggaacgtattggtattcgtccgacggtggcaaaggattctccggaggtaatgccggtggtttctccgatttcttcgaatcgatgttcgggcatcggggcagaggacaaagctctgccggattccgtggacaggactttaatgcggagcttcatctttcactgcgtgatgctgctcagacgcataaacagatattgactgtcaatggtaaacaagtacgtattacgattcccgcaggcgtggccgacgggcaggtgattaaactgaaaggttacggagctgaaggtgtgaacggaggtccggccggtgacttgtatatcactttcgtcattgccgaagaccctgtattcaagcgcttgggcgatgacttgtacgtagacgtggaagtagacctttatactgctgtattgggtggtgataaagtcgttgacacgctggacggtaaagtgaaactgaagatcaaaccggagactcagaacggtacgaaagtacgtctgaaaggcaagggattcccggtctataagaaagaaggacaattcggtgacttgattgttacctattccgtcaagattccgacgaatctgacagaagcgcagaaggagttgttccgtcaattacagagtatgaactaaaatgaatgagcactatgcagaccgaattaattattgtcagtgaatactgtcagaagtgtcatattgaaccttcattcattgagatgctggaagaaggtggtttgattaatgtacgtaccgaagccggaaagcattatctgcttgtctccgaacttccgaacgtggaacgttatagccggatgtactatgacttatccatcaatatggaaggcattgacgccattcatcatatgctggaaagaatggacgatatgaggcgtgaaattacttccctccgcaagcaacttctgttgtttcgggaaagggaaatagaagaagcggactggtgaaaaaacgaagcctctgtttggtgcaaacgaaggctctatttatagcaaacagaggctctgatctacgtgaacagagcctctgttttattcgggcggtacagtacaaagaaaactatccgatgtacgtgcagatttcttccagatagcgtgcgtccgtttcatcaaagctgtccggtgtatcgctgtctatatccagcactccgatgacgtttccttcttttataataggtactactatctccgatttggaatcggaactgcaggctatgtgaccgggaaactgctctacatcaggaacaatcagcgtctgcgcttccttccatgccgtgccgcagactcctctgccgaaacgaatgcgtgtacaggcgatgggaccttgaaacggtgccaatacgagttcgttgccttccaccagataaaagccgacccagaaaaagtggaaagtctgcttcagtgcggcggcaatatttgccagattggcgatacgattcgtttccgagcttaccaatgcttgtagctgtggaagcagttcacgatatttctcttctttattaccagtgtggatcagtaaattttctgccatctctgtttctatttgatttggtttagaatactcgggtcttttattttatcatcctctgcgaagaagatgattttcgtcagtatctccgctgttttcgggtcttcatccacaaaaggcaggaacagtcgtccgcgactttgcgagtgtaccggaagaacggctatttgtgcaccgccttctttatggataacaccgctgcccaaatgaatgttgtatttgcccagcttaccttcgatgtatgcaaagttccctttcaccctgacgttgctgaagtggaacaggggcagggtgagttctaccaatgcacggcgcatctcgatggtggaatggctggtttccggatcgacacttccggcgtgagccacactgacggcgaggtctacatccctcatcacttcggagaagacaacaggtggaatctctgaaatcttcatcggcttataatccttgcgattatggaagcagacaaattccagcgtgggagcttcgatgtcggcaggagagaaccagtccgccatcgcataaatcgtggcaataatattctctttatagtatatcttctgaagtccgtcttcgtaatcggctacccagcggcgtcctttcagtacggcaaccgttttctgcggttgaatctgatttccggcataacggcgggattgcgtagcgctttcctcttccgttgtcgggatgtacaattctcggaatacctgcttgaaaggctggcggatggctttgtcaaacaggaacttctgataagcatgccagttgccgctcgcatacaggtctgtaggatgggcgatacgtagttcatctttcgaagtgagcggaagacagatgccgtctgccgttatcaatagtccgtcggtgtagaagcctgttctgccgttgctggtaaagaccaggtttctcagtagcggccagataaccggattcttcatcagcttgcgcagttcgttttccttaaaacgggtacagtcctccattgcctgttcgagcatgacgcgggaacgggcgtgctggtctttcagtattttgtgtaccgctttcagctcttccacgtatgggtgctttttcagtttgggaggcaggctgttcagctcttttccggctcttacttgtttgatttccggtttgccctcattgttgacttgcacatagacttccacgccttctatttctttgggggtcaggtaaggagtgatctccttgatcagttccgtttccatgctccatgtcagacgggtgacgtctccgtaaccggagttgcgtgccaggttttgcagggcgatggcgacggctttcttttcactttcctgtctctgtgcaccaaattccttgctttctttcaggaacttttgcaagaactgatagcgttcgagtaattccttgtcggccttccggcccagcgggataaggccgtagctcatcagtaagtctttatttcgcttcgctatgatttctttcttcgcgtctgccgctttggtcttgccgttgacggcatcggcaaatttacgggcgcgggtatgggtgttgcttaatgaaatatatttggctgcattgtacactacttcaaagcgttccttgccgatggctttgtaggcttccttgaaccagtcgatgtcaaaagcaccttcctgaaggtcttctatggcaatcggggtatatcgggcgatgatcgctttcttcttgtcgtcgaaacactcgctggtatgggcatggaagtagtaagcggcgctttccagtcctttccatccggtcgctttttcggtgagttccagccattgcggggcgaacatggcagcttccaccagtcgtatatggctgatgtcggcctgactggcgaggcttttgagtgtatcgctgtcgtcgtccggagacgggtagcaggcatggagcaggctgctcaatactccccgtttggtgttgcgccagttgtaactgtcacgtatgaaggtgtctttgccgaacgcttgcaggatacggatcagtgtttctgctccgtagacgcggtgaagctcttccgccagacgggtgacctgagtctcggaatctccccgctgcaattctatttccagaattcggttcactactttctgggtcagtgaatggaagagggagtggttgcgctcgtccagtgccgaagtgatatctttgatgcgtgtgggcgagttgacacgtcccatcagttcccggtatatttcttcggtaggaatcagtcccagcatccatgcgtgggcaaagtccatgctttgcaggtagacatccgtttcttccagttcgggcgtatgctccatatagttggtgagcttgtagagctggtaccgtacggtgaaataacgggtgaagagagcgtcattgatgggatgctgaggcgcatcgagccagaatcgtacgaacttgttgttgtgtatcgggtaaacgatctcccttgctccatattcctgcttgtctctgagccatgtatgcttattggtgtattgacggaagatattcttcgtattgagcagaggaagcaactgcaaaagcatattgacggagaactgctgataagttgcctcgtttctgtattcatgtgccagtccgtcgataatatcttctatctgcctgtaataggtcagcttgcggagcgacttttgcagcccgcggtaagtgaagcctgcatacatcttattgataagcggttcgaacgtgttgagcgattggatggcggcttccttgtcttcctgttcttcttcgtcaaattcatcgtcttcgtcctcttctatttcgttgggtgctccggtagaggccagcatgaacttcatcatcagcaatttgtcgtaactgccgatttcctgttgatagaaattcagccagagttccggaagtccgagttcgctcagtccgtcgtagtgcttgtaccagttcagtaagacactgttgcccaccagacgtacttcaccgtatttatccgtgaactcgtcttctttatgcttttcgatgtatttgttcagcttgtcgaagatcgctttggcttttcctaaacgaataaactcaaatgctttcttcacattgaatccggcatcgggagtaatcggaggcaggctgacttcaagcgccggatcgtatagcccgaagccattctctcgggtatagttacttgtcgggctctgttccgtaccgtctccgatcagcgattcgatcagaatcttttctttggcgttcggcttctgaatctctctgacggtggacaggagtttctgataactgtctttcaggaaatcgacgttgcggatgctcttcatcatatccagtccggcaaggcggcgctcggcattcttgtcgctcagcaatcggcggatactggctgccagctgtgcttccggctgtttcatcagcagattgatggcattgatacgcatctcgctatatttgaaacggagcagttcttctatatgctgatactgttcgggggacagggacatttcggacaatactttgtatgcttcatcccgtatgtctgccgaacggtctccgagtgattgcagcacatattcctgctccaccttgctttcggtacgggccaggacgattccgatatagctggcacggttgtaagattcgagcgcgggaagatacgtgcaaagttcctctctcagccggatatcgttggtcatccatgcgatgtacgccattttgaggactacatccgaacgggtgagcaccacacaatcccacgggaatacataagacgaatagacttccttggcggaaatagactggtagacttgtttcagatatccgtagtgacggaccgcctcttccggcgtttcaaaataatcgctgagtgtgggagcttccttgttatcgctgtatcggcttagataaagcccgtccatataaagaggaaggatagccgccaccactttcggatcgtcgtgccacacttcgaatgcgtctttgctgatcagatgattcatctgagacgattgcgtgcagcgcaggaagtacagtaacgtctgtatctgatgcttggctccctttcggatgatgtccggtacgatggctctgatctcgtccgtatcatagaatccgatgctccacaaagccagataaagttcgactgtatccttgctttgcagggtattgcgggctgtttcgggatgattcaggaaattccagatcagttcgacatacttgttggtaatccgttcgctgctgtcctgttcgccgattccggtgcatacggcgatgcttcgcttgacggaggcaaaacgttgcagtccgttgttgtagatgatggagaacaggtagaggtaactttcgggacatccttcgtccatcgtttccacgatggcttggcgcagtccttcttgtagcttggctgccagcagcagtttgccttccagttccaacagcgggcggtgtccgctgatggcgatggcgtggagataccagcgttgcaggcggtggacattgttttcgctggtcagtacctgattcaggtattcgattactttttcgttaccttgcgctatttgtgcggccagccagtaggaagagttcatatagccgctgaattcttctgtatcttcgggtgtatttcctccttttaagatcgcttccactgaaaatccggtagcgcgtaactttaaaaactgtagccatgcgtctctggcatggtccagatgattggacggatgggcggaacgctgggcgcgccggtcgtatccgatggtatgcggacagcgtgcttcgagttgcagataagtatggaacagtccggcgaattcgtcgcccaacatatagcggaacagcgtgttaagtctgccatccatcagattggcaatgctttcgatgttttcttcccggatgatctcctccagacgaggttccagtatctcactgaatataccataccgtcctcccatgtccaaatcctccatgaataggtcgaacagggtaagcgtttccggctccaggcttgatttttcctttagtaaactctccaaataggggtttagcagcttgttcaatttgtcgttgtaagtaattctcatgactttaagcttttagagtttatattgcagttaccaaagtcttcctgacagcattgccagccggataaaggtaagtgtagattcttctttcagttggacggaggaggataattctccgagttccgcatcgtccagaaagatgcggaagattccgtcttcatacgattgcaaagcattgatgatggcttcggtttccacagccggtctgccgttatagtttgcttcgaagcctactttgccggcggcggccttgtcctccatctcttcacaggtgaggtatttcagcatttcactttgttgcagccgttcgttgtactcctttacttgccagcagacgaccgcttcaatcagttcctgcacactggcaggaggagtggggaaatcgatcggcatcttttcgatgctgcatttcctttttcctacttgcttgacttggatatatgctttcatacttacttttatttttcgatttgaatactggacgtgattgcgtccagatcagcctgagccttttcgtccgcaaccagcatgacgatggcaaagactcttctcttattctcctgaaagtacaataatacggtttgttgcatttcttctcctttttcgtcggggtggccgatccgcaaaggattggtcgtcttcgtcataggcagaccgttgatgttgactttgctctgcttgtaatcctccgagggctttccttcctcatttcgggggagggtgaggagcagcttcttcatacgttcgaactcatcctgcgtatcatagctgttgctggtcacggtcagctgactgccgccattgacgagtttcagcaggggaggctccgaatcgggagtcggcgctttcgtgccggttatcttgtaccagttggtaggatactggcaactgaactttgatacagcatcatagcatgaaagccacgtatcctcatccgacatgggagtatacgggaactgttcggaagtggaagatttccggggactgccggtcaccgggcggctggcgctttttttctgttcttcttcctgttccttataataggcttctacaagtccgcttttccattcgttacgtatttcctgatacgtcgaggggatattgcggcagagtgcaaggaagctgaacaggaagacactgaagatgatcagttctccgatgatggaaaccgttcttccggcttcgggcttcttcatccgttcgccgaatacatagatgaatcccaaaaggaatccgctgagtaaaccgccgatgtgtgcggcattgtctactccggcccgtatgccgtagatgagattgtagcctacgaagataagaatactggtcagcaaagccttccgctgcgacctctcgatgcggtggaacagcaggaaagccagaaagataccgtagagtccgaagatcgatccggaagctccggtactgatcgtttccgcatgcatatagaggctgaagacagccgaacagagtcctgtcagcagataagagacgaacatacgacgcgtacctatcagatgttccagccagatacctatatatataaaggcgtacatattcatcagcagatggaaagcgccgatatgcacaaagttgcaggtcacggcacgccaccagtcaccggtcagggtgagcggaccgaagtcggcgccccagttcagcaaggccagtgtggaaggttccagaattcccgctccggtagctgccatcagtatgaagacaaggatattgatgtctatcagaaccggtgtcgcgatgaatcctttccgggggataaagaaatggatgaaagacgactctttttcgctttctgcctgaagcctccgttcttcttccgtcagcgggcgggtgagttcttcttccagttcgttggctttttgtgccagttcctccggtgtcagagcagatttaatctcttccatcgtttcctgtagtttttggatattcttgcgatttttgccataatctaccagttgtacggaggcgcattgactgcggacggatatttcaccgctgtttccttcttcgatggtgaaagtcacttcttctccttgggaacgcatacccattggaacataaaatatgacttcacgaagagcgattccttcgatattccattcaagtttctgagacgcttcgagtgccagtatcagaatttgtgtatttgataaatctgcaaaatgtagcttatcctcgtgtaaaggtctgagtctaaacgccatatttctctcttttattaagtcgtagattgatattactctctttttgtacaaaagtacagaataataatgaaatagagggtaaatgggagggggatatttatgcggacaacgagaatactaatactttgagatttagtaagttccttttggaaagaagaggacaaaaaaagcatccgcttcgttggaagggatgcttttatcgttagtcacccttttagggttactttttgtagaaagcaaggtcttctttatccatatttttgataaagttggtatgcttcgtaacttccgcttcagcaaagttcagatatacatgtgcagatttggagaacaggtcggcagccttgcttgcgtcctgaatcagcaggtggcacatgatgatatcggcagccatttccatcagtctgcgggctgtgaagtcgagcagttcctgatcctgtgcttctttaacggcgttggtgctggcttcgaacaggtctgccatcttcttcagacgtgacatcagcggttccatttccggtgaacaaggtactgtttcgaattcgcggatcgtagcaaggtaagaaccgttggttacatagcggatagcggctacagtctgcaactgggtggtaccttcgtagatgctggtgatacgtgcgtcgcggtagatgcgctggcaggcatattccatcatgaagcccgagcctccgtgaatctgtatacagtcgtaagcgttctgattcgcatattcggagttcatacctttggcaagcggagtgaaactgtcggctaactttgcgtatttcttctgttccagacgttcttccggagtcagcttgcgttcgcgtgagatgtcgtccagtgctttgtagatgtctacgtagcgggctgtctgataaagcagcgcacggccggcatccagcttacctttcataatggcgagcatgtcatacacggcagggaagtcgatgattgcttttccgaactgcttgcggtctttggcataggccagtccttcattgtaagcagcctggctcaatcctacagattgtgcggcgatacccagacgggcaccgttcatcaatgccattacatatttgatcagaccgagtttgcggtcaccgcaaagttcggctttggcattcttgtaaaccaattcgcaggtaggagaaccgtggatacccagcttgtgttcgatacggcgtacatccacaccaccctgacgcttgtcatagatgaacatggacagaccgcgaccgtctctcgttccttcttccgaacgggcaagtactagatggatatctgcatcgccgttggtgatgaaacgtttcacaccgttcagcagccaacaaccgtctttttcgctgtaagtagctttcagcatcactgcctgaaggtcggaacctgcatccggttcggtcaggtccatagacatggtttcaccctgacatacacgggggatgaagcggctgtgctggtcggcattaccgaattcatacagtgtttcgatacagtcctgcaaagaccagatatttccgaaacctgcatcggcggcagcaacgatctcggcacacatggtgtacggagtgatcgggaagttcagtccgccgaaacggcgtggcattgtcattccgttcagaccggctttgaccatcgcatccagattttctttagtgccggaagcgtattccacccgtccgttggcgcagtgtggaccttcttcgtcaacaccttcagcgtttgcattgataatttcgcctgttatttctccggtgatctccaatactttatcgtaagagtccagtgcgtcctcaaaatccagaggagcgtagtcgaattcatctttatctctgtagttgcgttctttaagttcgcaaatacgtttcatcatcggattgttcaagtgatacttgagttccggtatttctgtgtaaaaattagccatctttctttacttgctattctgtttataatacttaatcatcttcggcacaacttcttcgatggttccgttgattacatagtctgcaatcgtgttgatcggagcatccggatcgttgttgatagagatgataataccactttcctgcataccggcgatatgctggatttgtcctgagataccacaagcaatgtagagtttcggacgaaccgttacacctgtctgaccaatctggcggtcgtgttctgcaaaacctgcgtcaacagcggcacggcttgcacctacttcggcgtgaagttcctttgccaggctgaacagcaggtcgaagttttctttcgaacctactccgtaaccaccggcaatgatgatcggagagcctttcaggttgttcttcgctttttctacgtggcgttcgattactttgaccacatagtctgtgtcggctacgtacttcttcacgtcgtggcggatcacttctccctgataagccggagaaacgatttctttcttcattacaccttcgcgaacggttgccatctgtgggcggtgttcggggttgacgatggttgcaacgatgttaccgccgaatgccggacggatttggtacaacaggttcttataaacttttccttctttcttatcttcgtggtcaccgatttcaagggatgtacagtcggcagtcaaaccgctggtcaaagccgaagaaacacgtgggccgaggtcacgaccgataacggtagcgcccatcagacagatttgcggctgttcttctttgaagaggtttacgaggatggaggtgtgaggaagtgaagtataaggatagagtccttcagcgtcgaaaacgtggagtttgtctactccataaggaaggatttgcttttcaatttctttgaggccggtgccggcaactactgcttcgagttggcagttgagttcgttagccaacgaacgaccttttgtcagaagttccaggctgacgtctgcgacgatgccttcttctatttcgcaatatacaaataagttattcatgattatccgatggtatggttagctaacagttcaacaatcagttcttccacatcacggtcgctgccgctgatggttttgctctctttggcctggaacacgatgttctggatggcttttactttcgtaggcgaaccggacagaccgcattgggcgaggtctccgttaacgtcggctacgctccattcgggcaggttgaggtaatcgcgcttgtcatacaggtcggtatagtcgaggttaccttgttgtttttccgtaacggttttggcgtgtttgtacttctgtaccagcttggcgttacgcgggcggcagggagcagccgaaccgttgactgtgataacgatgggcagcgggccttctaccgtttcaacgccaccgtcgatgtgacgtttcactttgattttgccgtcacctacttccagaatctcttcagcgtatgtgatttgcgtcaaaccaagtttttctgccacctgcggacctacctgtgccgtatcaccgtcgatagcctgacgaccgccgattataatgtcgcactcaccgattttgcggatagcagttgccagagcgtagcttgtagccagcgtatctgcaccggcaaaagcgcggtcagttagcaaataaccattatcggcaccacggaaaagtccttcacgaataatatcagcagcgcgtcccggtcccattgtcagaatggttacggtagagcctgggtgagcatctttcagacgaagagcttgctcaagggcattcaggtcttcggggttgaagatggcagggagtgccgcacggttaatagttccgtcggctttcatggcatctttcccaacgttacgtgtgtcgggaacttgttttgccaatacaacaattttcaaactcatgctattaattttagtattagtatttctacacattagcagccagtagtcaagtagtaataatcttgctatccaaactatccggttaactatcagcgtgcaaatttactcaaacacttggttctgacaagaaaaccgagtaaaaaatgcacattattaagttttttgagcaaataagggcaagtttatgaggttagccatagtcctatggcagtttgggggagaagggggatgggaatggggaaaagagacactaccataggaattgttttttataaaaacatctgtcaccgtcaccgttcgaagggtaactgtctgactataaatgattcatctggtgacagcaagtggtgacagcagtgtgacggaagaagttgccgtcacaacgtgataggagggacaacggataaaaagcaggtaaagtaacaagggatggcggctcttgtttttattctatatacaggcgatttcaggaatgccttagtctagttggtttccatgcgatgaaactatagttccaaagccttgaaaccaatggttccaacgccttgaaactaatggttccaagctgcagaaactttagttccaagccgcagaaactaaagtttcaagctgcagaaactctggtttcaaggtgatgaaactgtagtttcaagcggtggaaactactgaaagctatatatgcttgggttataaggtaaggccgactacaaagtatacttgctcttcataaggattggcgatcacttttccgaagatcggcaaagagaaagtagaggtaatctttagttctttggtggccgaaagtccgatgttgacaacgttgaatttatcggaatacatgccgtcccaaggggtaaagcctgcttcaagggcaaggtccaccttctttatactgaacggataactgagttcgcagtaactggaccacgcacgtttcccgttttcgcggtaatcattccccgcaaatgtggtgtaccagctgactgaaagcgggaacttttcactaatcatatatccggcaccgacttcaaaagtatgtccggtggagtgtgaactgtaattgaagtacttgaaaggttcttcttccgtttgcgtgaagtagttgttggcgtataaggtcagattcctgtattcgtattccaatgacaaatctatttcattattcttatggcgaaattcggtcgaaccccagacgtaggcagtcagtcctttccagttgacgcccaatgacggttgtacgctggcgttaccgctgtccatacctctccaaatgtagctgctgacaaaatccgctgttacaaaaacatcctgtgcctgtgctaaaacggaacaaaataagagtgcaatcagtaaaattcgttttttcattttgatgactttgttgtattcgggcggcaaagatacgaattgttgacgaatctgaaaggacccggaaacagaaaaagcattcggacaggtggttaaacgggaagagtaaccaccattttgcagccggaagtatagccggtatctattctgatttgccctccgagccgttgtatgatgatgcggcagatgtacaggccaagtccggtgcccggtttgaagtcatctactttggtgaaacgttcgaacacccattcctgcttgtcggcagggatgccgatgcccgtatcggtgacggagatcaccagttgtcctttttctttgtcgatgttgcaggtcagtgtgattgttccgctttctgtaaacttggcggagttacttagtaaattgccaatcacacgggagagataaaaggcgtttgtctgtgccgtcattccgtctttatcgcctgtgatgatacattcgatgttcggcttggacagagtttccttaagtttggccatttcttcaacacatagtccgtatacgtcggtagactccacaggaagaggcagttcggagctgacaagctgagacagctccagcatattgtccatcaaagaagctaacgcggtagaattgctttgtatcaactgccggaattcttgtctggtggccgtgtctaaagattcatcgaagatcagttcggagaatccggcgattgaattgagcggagtacgtatttcatgacagatagagttgaggaaagccgttttcatcttctcgctttcggtggctttcatgctttgttttctgacttcttcgtgcgcagtcattagtgcgcagtgcattttcttcagccgttttaccatcgttcgctgatagatgctccatccgattgctgccagtaataagataaaagtaccggtcagtgcgatttgtttgtttttgttggcgagtttgctcttttccagttccagtttgttgacgtcgaagcgggtttgcatttcgatcatttgttgctctcttttttgtgatttatccgacatccggttcttattgctttcttttaaagtcagatatgcgtttttataatcattcagtttatagtacagaccggctttcgcattgagtatgggaacgaggttgactggttggaaatggtctgtttgagtggcggaatcaatgtaagctatcgcctttttgtattcgcctattgtctgataatatcttgctgtcgtctcgtaagtgctttttacaaccttctttttatttgctatctggatatatttctgataatagtcctttatctcttctttcgaaataagatctgccatgaaaataatctgcgaatatttagccatgtagtaatgtgattcgtccagaaatctccggtcgaaagtcgtattcagatgattccattgcttgtgtagctcgatcattttgttcacttcgtctactgcctttttgttttcaacagttgtatataagtctgccagttcgtagtggcacaatatttcgaagtgcaccctgtcttgcaaaggataaggggctagtatctccagtgcgcgctctacgtaaggaatggctttggaaacttcattgtatgaatgtgtcagtaccgctgaataatcgagtgatactccggtcagatattcccattgaatttgttcttcaggtgtcatttgtccgtgattttcctttttcagcttgtccagttcctgttcgattgtttccagcgaattgttctttcgcatttccgcccagatgttgtaacaatacaagtaataccggaaaagggtgttgtgttcttccggcagatattgtcgggcgaaggttatatacttttctaccttctctttgtttttggaagcatatcgttgtatcagattatcgagtgcgagcttcatcatatattcgtctttggcttttgcggcctcggtgagggctttgtcccaatattgggaggaaatgttgaggctgtctacgtggatatccgccagatgaatatagataatggcccgttgcccggcatccgtgtcgttttgcaagagattctgcagactgtcgacggaagccgtaacggcggaagcacgtgcgatagagggcgctagcaggatagctccgatgagaaataagaattgtatttttcgtgtgatcagattcttggtcatatgattagatattatttgttttggaataaggatatgtgaaagtcagtacgggaccttccggagtattcggttcaatcgtatatgtacctttgaaatattcgattgtcagacggttgatgctatggcgtacttctgctttttgtgtttgcaaggccggatcggctaacggactgttgactacccgaaagacaaatagttcccgttgcgtgtcacgttccagatagagagacactttccttttctcttcacacgggtctgtgtagatcagtgtactgagaatcaattgtgtgaatcgggcggtgtctacctgaaacggctggctttctatttccgtatgaaagtctgcctgtatcttatctccgcatctcatgcgtaccataccgagaacgtccgagcacaaggagatgatttcgtgctcctgtatctgccatttcgttcttccggcctccagtctggagaggtcgagcacgtcgttcaccagttgtatcagttcggcggagttggtctggataatctccgaatattctttccattggtcggcatccatgctttccggatcagtagtcatgagttgagaaaaccctaagacgttattcaacgggatgcgtatgttatagctcatgttaacaaggaagcggctttttacttcgttcgcttcttccgcaatctggctcatcttgcggatttcctcttcttctttcctcaatttcttgcgtacataatagatacgtatggtagacggaatcaggataagcagtgcgatggctatcagagtcagtccggcataatgaaccattgctttgtactgttctttttcaagaagcaggttgtccatgttgcgcatctgatagatttcattcgtctgcgagatggatagtgcccgatagaatgagtcttttttcgccagcaaactttggaataacgggattgcttcatccgcttgtcccgcctctgtaagaatgcttgcatgttctattttgtagttcagcccttcattgtccgatacttcggacaggagttcgatagcattttgagagtatgacagggccttttcgtattctttggtaatccggtaataatgggaatacacattataatataatccccggcaaggaatgtaagtggtaggagagaagtattcatccatctttttcagatgggggcgggcttcgtccagtgtgccttcattcagataatagtcggcatagagagactccaataacaggtagctgtatgctttgggtgtctgctttgcttctgatagtgtgtccagcactttcttgtattcctgcaggtacttcaggaagtttttgtttctagtggcggaacaagataaggctatttcttggagcacgcttttgcgcgattccagggaggcggcgggtggcagaaggcggtaggcttcgaatccggcctcttcgccttctttaaagcgggcggtcatcatataagcagtcatcaggcatagtttggccgatgacattccttggggattgtttaacttttgtgccagtttaaacatctcttcggcttgggtgatgctatattctattttatgctttatgatatgtatggttatttctgctctttttccttcgaagtataagctgtaggagttgttttttaaagcaaccggagagagcttgtccatccagatgactgtgttttcttcgtcttggtggttgaagtaataaacgacatgggcatacagagcaagacactgataatacttgttgtcctgtgtggtagcttcctccaataattttcccagatagtagacgcaggaaggtgacatcgggtccagataagcgagtgaataaagcatctccagccgggaagaatcggccggcaaagtgtccagtatctgaagcagactgtctttggcagcttcgttattgctggagagagccttgccggttcctcctgccagtacgatcagtatgaagaatatccataaccgtttcatgactgtgcctcctttccttcttttgtggggttgatgggatgggtgaaataaaatctgcatccggtggtgtaggcagggtctatccatatgctgccgccgatccgttcaatgatcagttggcagatagagaggccgagtccggttccctgtgctccttcgttcagtttttcaaagcggttgaaaatggaactttgcttttccagtgggattccgcaaccggtgtcggtgacggagaagagcgcaaattcttccgattcctgacggacttccagcgtgatacttccctgcggggtgaacttcgtggcgttgatcaataggttgatcagtaactgttgcaggcgtgaatcgtcagtgtataactttagggaagccagcgatgtgttgaaacggagctcggcttgtgtctgctttactttgttgacggtatcgattacgttattgcagatggcgatagcgtcacaataggtgaagttgaacttcatgtttccgatctccagattggaaaggtcgattacgtcatttattagttttagcaacaagtcggagttttgctggatgatgtcgccgcattggcggcgtgtttcggcgtcgagtgcctgctcggtcagcagactggagaagccggagagggcactcagcggagtccgtatctcatggctcatgttggagaggaaaagacttttggtctgcatggcattctcggcgttgagtcgtgattgctccatgcggattttggattccgctatcttcttgttttgttttaatatgtgtatcacgaggtaaatcatgatgcccagcactatgactcctattaaaatgccgcccatgaaaatacggttgaactcggctttattctctactttcatccggttttcctcataagatgcccgaaggctgttgatgcggtgtgcatagctgggagcgactaccgaatcggtgacgatactgatttcttcatacagatgcgccgcttctactttactgcccatttctatcagtaagttcgctttggcataagctacttgcaggtagatgatggagcgcgtcttttgccggatgccggtcagaatctcattgtaatactgtaatgcaagattgtagttccctgttgcttcgttatatcgtccttgcatataattgtaggtggtgcgataataaggttgcctgtccgaaaggtagatttgctctgcttgcagcaggcagttgttcgcattgcgcagatcgttcttctggatatagtaagaaacatctgtagcaagtgtcagaaattgcagcgtctgatgggtctgtatggattttgattcggaaagtatctttctgtatttctctgcttcctctgtcctttgagtcagaataagcacctgtataagtttcaggatagtcatttctttataatggttgttctccgaaggcgaggcgggataacggatggcttccttataagaatcagtggcttcttcgggcatattggagcagaaataggcatctccgatagctgcgctcgaaagggctattcctaaatcatatctcatcgtttctgctttttcgtacatttgtcgcgcttcgtcgattgctttcccgatgtctccgcgcagggagtagatgtaaaccaccagttgccggatgctgaaagacagttccatcttgttttccttttccagtatagggctcagttgctgtccccaggcgataacgctgtctatcggcgcgatggaatcgtacgcaatgttgttttctatcaggcgtttcaaattggacagtcgttcggtattcaggtttactgaatgtgaggggagaatccggataaacagacctatagtaaataatatatagatattcctcttcattaaaagtggtgttttgttgtatgtgttatactagttgccaaaaataagcaaaaatcacaaagaagcggtaggttggcggtgaatatttttctctttgtgttaatatacgttgctgcttgttcgtttcattggttctgttgccggccatccgggagctgaggctttattctgtgtggatgtatataaaaaaatctgtcggggaagtctccccgacagatttaaccagtaatctaagtgagtttttcagaatgtgatgtccattttcactacaaaagtacggggagcggctactgccatcgggcggtaactgtattctttattcaacaggttgttgaccatgaattggaaggcgacttctttggtcgcttttaccccgaagcgcaagtcaacggtggcatagtctgtattatgttttttccagtaagtagccagtgtttctcctctcgattttccgaagaggatcgtgcgtacatagtccattaagtcttgttgttgcttttcacgttcgtccatcatgaggtagtccactgccagtatcttgctcttccatgcaaagttggcacccagattgatacgcttccattggaaatcgactgttgctttaaagctgtgcttcgggcggtatttcagatatttgcctgtattcgacttctccttcatctgaagggcgtcggtgtataaatcttctatttcattgcgttccttatagtcagcgtcgcgaggctcggtatatacatatcccagattatagaatagtttcgtattcttgttgaagtcataaacgccgtttgtcgaaatctccataccgtagatttgcgctttcgatacgttgtggaactgtgctccgataccgaaacctttgccgtccgtcaccatctggatggcatcgctgatgctgttgatcatgctgtagtctgcgttattgaacagtccgaactgaaattcaaccatgtctctgtactcggtatagaatccggctacgtctacaaatccttggaagttgccgatcttgtatccttgcttgaatcccagttcggcattgtaacctttctccggtttgatgtcgaggttcggatagatacctactcctccgatgtccttgcggagatatttctcgttgatggacgggttgcggtaaccttgtccggcgctggcacggataaagctgtaatcggctaactgatagttcagtccggcacggaacacggggcggaacggaactttggctccgaatattttcgtttctgcttcacggtgatggttgttcacacggtagtattcggctcgtacccctgccgatacgctcaggcggtcccagaagcgctggtcgtactggaagaaggcggctacattatcgcttttgtacacctgatccatgatggaagaattgtagcggacgtgctcgtaagtcattccggtagtgatctgtgcgccgccgtcccatttcttgttgaactggtagtcaagataataattatagttcttgtccgttttcgtctgaacgttgtttcgggtcggattcattacgttggacagccaggggatgagatcactggggacttgtccattttgtatgccgttcatcaggtcacttggcagtccgttgtccatcacccacgagatgaggtcacaataatcggcggtagtggcgttggggaagatgttgcccaaggaagtgaataccccgttcatggcatcttccagattattgttgatcagaccggagccgatgccgaccaatgccgggtagagcgaactgtaatcgccgcctgctatattctgtatagtctgggcattcgttcccatatttccaaggatgtcggtgatggagtttccctgactgggtttgactatgttgtcggcactatgatagaaacgtcctttgatcttgtgtgacgttccgttttccggattcacgtagttgatgaacgggtcgatgtggaagttgttttcttcgcgtcccatgttggtgaaaggagaaggtttgtaaacttctgttggtgatctccagatgaagaaatctccgtactgattggaaagaaaatcaacattcagaccatagttcaatatcttcatacccatgtccggttgatgataagtcaggttgccgcccatgcggaaacgtttgttatatccttgttgacggtatccctcatcggtaaagaggttaatgcttccgctgacgtcaaagttgccgatacggcgggagtgggagagatcgaagccttcataaatagggtttcgtatgccgctgagaaggtttccgcgcaggatgggtttgacggaatacttgtcgtctttccagaaactcttgtcgctccattggtattcatcgttttcggcatcaccatatataccgatataggcgctgaagcgggttttcggtgttaatcccggacgggcggtacggatattgataataccgttgagagcagacgaaccgtacaaaacggatgaggctcctttgattacttctatctgttcgatgttttctagaggtacggtgttccagttgatttctccggtttttggatttagggtgctcattccgtctaccagaatctggctgcgggcacctactccgtaggtccatccgctgccgccacgcatggaaggctgtttgtccacaatgtccacgccgggcagcgtgcggagagtagaagtgatatccgtcggtgcctgacgggcgatatcgcctgctttcaccaagtccatggatacggtgacattactgagcttttgctcaaagcgtccggcgcttaccactacctcttccagcagcttggtactttctttcatgtacacgtctttagtgatcacttcacgtttgccgataacaatgggcatcagaacgtcttcgtaaccgatatagctgaacacaaggtcgacacctccctccggaagtttgatttcatacgctccgtttatatcggacacggttccctgattgccgtgcaatttatacgttactgcggcgccaaccaaaggttcattggtattggcgtcatatatatgccctttcaatgtctgggcaaaactattcccgaatccggcaaggcagatgaataatgtcagaatatatagtttcttcattgtttctgtaatttatgttttttcttctggtggaaagtctcattcatttttgtcggtcaggtcgagtcccaagtccagttgggtgatgatagaccagttgtcatacagtggacctaaataggaattgtacaacatcggaccgaagttaggaataccttccatcactggctgaagatgggggatgaaggctatgagaggactcagcgcttccctgttcagatagatatgcgtatgtccgttctccttttctatctgcatggggataccttcctttatccatgagaagaacatctgaaaactttggtgatccatattggcgatcatagataataaagagttgtccaatgattcgctcacaactcccagtagagtcttcagtaagaaaggattggatttcaggatagcatctgcaatgcctgctatcagatgagcatcgaccgtctgtccctgcccttgcatggccaagctgataatgcttggaaggttcagtttgacatagagaaggtcatttttcagataccagaaagccagtccccggggagaatctgcataattgcgtccttgggttgcggcagtaatatcatcggcagacaatgtattgaacattaacttcatcataatgaaattaatgacttgttgctgggatgcgggattatccatgtcgatttcgctgaacttctgttcccccaattgcagttcgtccgatgtatattcggccgtaatgtttccgtcggattccagagtgacacttttgagtaattgcggcaggaggtatcctcccatgccttttataataacggatacggttgcgtacaaacttcccgcctcctttaccatctctaaatccatgtcggtataaagggctgctgtcagtatctgattgtccgactctccccattcatattcgccggtcgtctgattgcgtatgacatcttttcctctgccgcgtgtcagttcgctcatctgataagtttttatccattgattttgcggcatcgttacattcaagtccagtttcatcgtcttcggagtaatggagccggcgtatttcacggttgctcctgcgcccgaaactgtttctccgctgaacgtatagttgtcttcctgctctgataagtttatccggaatgatgtctctttttctcccggaatgatatcgtttaatgtcaatgttccttttttactgtcttctgtctgaaagctgacggtttttccgattaacttttctccgctgtaggtcagatccagagtggatggtttgatatacgagccatattcctgactgagttcgcctggccagaacagcttgtcattgtaggtttcttcgcaagatgtaaggaagaatgttgtacaagctacataaaatagttttcgtaatgttttcattctcttttttgtttttatttcaacgtatttattaaaacattgcaaatgtcggttaatattgtttctacatcaagctctattcttggtattcgatgttctattttaactattttatatgcacgtgtatttgaatagataactgtaatgttctcttttaaataatagatgttctgtttttcatattttaataaagaacttggaggaaattcgaatggaaaaagatatctttgtggaactaaatttcttaattatgatcatagatgatgctcttcccaagtttgaccttccggtcgattttgttacagatgacagcataaccggtgatattctgaatcaatacggtcgttttccctgccatataaaggcgggagtctttgttctttgcacgcggggaactgtacgtgccactatcaacctgtccgagtataccattacccataatgactttgtgactgtcctccccggatcattcatacagattcacgaagtatcttcggatacccgtgtctgctttgcgggcttttcttcggaatttatctcccgtgtaagttatgtagagacctatctggattttctccctatgattttggacaatcctattatggcattacaggaagaggtagcgcaattataccgaaacgctttcagcctgcttatccgtgcctattctttaccgaacacactggataacaaagaaatattaatgtctatttttactatattctttcagggggtgggtgagttgtataaacgctgtaagccgactactaacgaacctatcaagcgggaacatgaactttatcgccagtttatccagttgctgatgactcactatacacaggaacacgaagtttctttttatgcgaagaagtgcggagtaactccggctcatttttccggtgccatccgtaaagccagcgggcatagtccactggcgattatcacgggaattattatcatgaatgccaaggcacaattgaagtcaacccgattgccggtgaaggaaattgctttttcattaggatttaataatctttccttttttaataaatatttccgtaaacatgtgaaaatgactccacaggaatacagggaatgctgaatgttaacgatcggatacatttttcgttcatacgcagttttctttctgtggaaaataaaggcagtttaccgataagaatacccgattcattgattttttttcttattcttctctttccggcatatatttgtaattgcgcaattataatatgataataaagggaaattatgaaaaagaatgtactatttttaatgttgtcctccttgctgttgttgtcggtaagctgtacgacggattcgactgagtttgacgaggggaaatggggaggcggttcggatgaagaaggaggcagccagcccaatcctactgttcctgaagaatcggatgatttgctgaattttacgattgctttcgatgaaagtgatcggacaacttacggcagtatgtcagagactgtggtgacggatgaaaatgatgcgaattatgatgattttatagaaaactcatcattcacttctgtagttactgtcagttatgacggggccacggctactgtcagcaatgaagttgatggggtaagtgtttcgcagaacggagcgcatatagtagtgaactctacggtcaagggaatagagtatgtcttgaaaggtgctacgacagacggttcgtttaaggtatatagtgaaaagaagttcaaactgtcattgagtggaacgtctattcataatcctgtgggtgctgccattaatattcagtcatcgaaacgggtatttgttgtctgcgcggagggtacgaccaatacactgaccgacggaacatcttatacactgactgacggagaagatatgaagtcctgtttctttagtgaaggacagctgatattcagtggaagcggttcgctgtcggtaaccggaaattataaacatgcgatagtcagtgacgaatacatacgtctgcgtagcggatgcaatatctcggtaccttcggcagtgaaagatggaatccataccaatgatgccgttatcatcggcggcggagtgttgaatatctcttctacggaagacgccatccaatgtgaagacggaggaatcacgatgacaggtggttttgtcaaagttgccactacggctgataaagcgcatggttttaaatcggagttagatgtgataatcagcggaggcgctcttcaggcggaagttacgggagccggttccaaaggaatttcgtgcaatggaaacctgacggtttccggaggaaagataaccgcattcacttctcagaaacctctttatgaagatgatgatctgagttcgtgtgcaggaatcaagtgtgatggagatatagtaattgaaggaggcgaaatagctcttcaaagtacgggagctgcgggcaaaggtatgaattgcgacggttctattactatccatgacggtacggtaaaagtgatcactaccggtacacagtatgtatacggcaagctcgattcatcagctaaagcaatgaaagcggaaggcgcattgaccatcaacggaggaacggtgctggtaagagccacgggaggagagggcagcgaaggtattgagagtaaaagtgtgctgaccgttaatgatggtatgattgccgctctctgttacgacgattgtatgaatgcgagtaacagtattgtgatcaatggcggaagtatttattgctacagttccggcaatgacggcatcgattccaatggtacgctgaccattaccggcggagttgtgatcgcttcaggaactacttcgcccgaagacggtttcgattgtgatcagaatacgtttaaaattaccggaggaattgtactcggcataggcggggggacgagtactcctacttcaagtgtgtgtacacagcgcagcgttatttatggcggttcgggatcgaacggagaaattctgaatatccagtctgcggatggtaccaatgttctgacatatcagattccccgcaattattcccagatgacgttgttgttcagtagcccgaacctggcttcgggaggcagctatacgatctccaaaggcggttctgtttcgggaggcagtgagttcttcggactttatacgggaagttcttattccggtggcacgcaggcggctacctttacagccggttcaatggtgacgcaggtaggaaatgtgaactccaatccgggtggtggtcagcccggtggaggaggacgccccggaggatggtaaaatagcagtttaccgttgaaataagtcctttggtcgattatttttgtggagaagaagtaacggttctatctttgtatcagtaatttggaacaatgaagcatggaaagactgcgtaaacaacaattgctggagcagagcatttatggggctatctggacagttatttttcttctcccactgataggcggatactttgccgtcagtggtggactcgaaaaagaagaaatccgtgtaattgttcatgattcatggttgagcatccttccttttttcgtcttgtttttgttgaataattatggattagttccatatttcctgtttaagaaaaagtactggcaatatattatttctttggcttttctaatctctactgcttgttgggttattcccggtccctctatgcagcgttttccaaaggaattcagatatggcgatctacgcaagggtaaaggaaaaagtcagagagacctgattattaagatgagagagaaggctcgacaggaagagtctgttcattgggaagcgcctcaggcaaacgatccggttttggaaaaaccgcaacgaccgggcggcttccctaaaccgactccttatcccattcctcccttcaccatccgttaccttattcattgtgtaattgcctttttgatggtaggatttaatattgccgtcaaactgttttttaaatcctttcgtgatgaagaaatgctgaaagaactggagcatcagcgtttacagtcggaattgcagtatctgaagtatcagataaacccgcatttctttatgaatacgctgaataatattcacgctttggtcgatatcgatacggggaaggcaaagagtacgattgtggaactttctaagctcatgcgctatgtgctttatgaggccagtaataaaaccattctgctttcgcgcgaggttcagtttttggagaattatgttactttgatgagtttgcgctatcctgagaaagtttctattgaaaagaatttccctctcgaagtgcccgaagttcaaattcctcctttactttttatttcttttgtggagaatgcttttaaacatggagtgagctacaggaaagagtcatttgttcatgttgtgatgcaactggaagaaggaaaccgccttgctttcagatgtaccaatagcacggggacttcgtctgacgagcaacatcacggcatcggtctggagaatatacgcaaacggttgcggttgttgtttggtaatgattacactctctccattactgaggaagatgataaatttgatgtcttacttattatacctttattataatgaaatgtatagcgattgatgatgaacctttggcattgaagcaattgacggattatatatcccgtgttccttttctatctttagtcaagtcctgtcaggatgcttttgaggcgatgaaggtattggcagacgaagagattgacctgatatttgtggatatcaatatgcccgatttgaatggactggattttatccgctctttaatcagccgtccgatggtggtctttactacagcttattctgaatatgcggtagacggtttcaaactggatgctgtcgattatttattgaagccgtttgaatttcaggatttgctgaaagcggcggataaggcacgaaaacagtacgaataccgaatgttggaacagcagggagaactgggaaatagttcgcagattaaaggagattccttgtttgtaaagagtgactacaaagtggtgcgcattgatgtgaaaaatatccggtatattgaagggatgagcgaatacgtgcgtatctttatagaaggagaggataaaccggtcataacccttgccagccttcaaaaaatggaggaacggcttccaacgtattttatgcgggtacatcgttcttacattgtcaatctgcgtaagataaccgaagtttcccggcttcgtattatctttgatagaaatacatatattcctgttggtgataattataaggagagatttgcggagcatatcagtaagctgagtttctcttagaatgttttttataattacattttgttacgtcttataattgaatgatattatgcttgttttgaaaaaaatgaatattcacattctctttacacattggtttttatctgatttcccatttctcaccgaggaacaccctcttggttttaaaggaacggcccgttggttttaaacccaaaataggtatttataaccatttgatattcaatttcttataaaagtaagcgtctattttataaatatctgtgatttttattgacagataatgcagacttcatgatctaaacgatttttatgtgtatgaaatatgtttatattttgattaagatgtctagttctgtacagcattgaacaaatttatccctatctttgtcttcttaatatttagagaatagaaaaacaaagaatactggagaaagtagtgggtaagggaacgactttctccctgaacgtatctttgagtattatttaaatcagtagaaaatggggaatttaatttcgtttatgaaggaagtagccgatgggctgcgggaaagtgggaattatgggaccgcccatatttacaggagtagcctgagtgcaatccttgcctttcatggaagtgataagcttcctttccggaaagtaagtcaggagtttcttaaaagtttcgaatcgtatctgcgtggcaggaactgtagctggaatacagtttccacttatatgcgtacgttgcgtgcagtgtataaccgtgcggtcgaccgccatcttgcgccttatgtgcctcatcacttccggtatgtctatacaggaacgcgcgcggacaggaaacgtgcgctggataaggaagacatggagcgtctgatgaaggaacttccgaaacagctgtgtcaggacaacaaggaactacagcgtactcgtggtcttttctttttaatgtttttacttcgtgggattccttttgtggatcttgcctatctgaaaaagcatgatatcgatgggaatgtaatgacttaccgccgtcgaaaaaccggcaggttattaacagtgactcttgtgccggaagccatgaagctgatcaagcggtatatgaatacagatcctgcttctccctatcttttttcgctgatcaccagtggagagggaacggaagctgcttacaaggaatatcagctggcattgcgcaactttaattatcaattaatgattttgaaacaagttttgggactgacatctgaagtaagctcgtacactgcccgtcatacctgggctacgatggcatactattgtgaggtacatcccggtgttatttcggaagcgatggggcattcttccatcaccgtgacggaaacgtatctgaaacctttcaagaataagaaaattgatgaagcgaatgtagcggttatttcttccttgaagaaggtctatcgtgcaggtaagctattgaattagagagctgttactttgtaggtaacgggaagaaaagacgctgcaaatatgggcatattttggaaaacatgcaaacaaaaatgatattttttctgataaactactaaaaaaaggaaacacactgaacaaaactgcggattttttgagaagaacacggcctggtctttaatttttgcaaaagatttccctcccctctgccatcgtctaagagcaggggttaaaaatattctttacttatttaatgaatgtagtcc

SEQ ID NO: 59 - DNA, 46750 bp, Bacteroides thetaiotaomicron
tattaattcttgttttaattttaaataaactatggcagacaaaaaagaaaaactcttctcagacttttctcctgtctccaccgaacaatggatggagaaggttacagccgacttgaaaggtgctgattttgagaagaagctcgtttggaagacaaacgaagggttcaaagtgaaacctttctaccggatggaagatctggagggtttgaaaacaacagatgcacttcccggagaatttccctatctgagaggcaccaagaagagcaataatgagtggctggttcgccaggaaatcaaagttgaatgtccgaaggaagccaatgccaaagcactggatattctgaacaaaggtgtggattcactttctttccacgtaaaagcgaaagaactcaatgcggaatacattgaaacactgttgaatggtattcaggctgagtgtgtagaactgaacttctctacttgtcagggacatgtggttgaattggctggtctgctggtggcttatttccagaagaaggattatgacgtgaagaaactgagaggttctgtcaattatgacttctttaacaagatgctgactcgcggtaaagaaaaaggcgatatggttcaaactgccaaagccctgatcgaagctatccaaccgcttcctttctatcgtgtactgaatgtaaatgcaatctcgctgaacaatgccggagcttacatttctcaggaattgggctatgcattggcatggggtaatgaatacatgaaccagctgacagacgcaggtatccctgctgctacagttgccaagaaaattaagttcaacttcggtatcagttccaactacttccttgaaatcgctaaattccgtgcagcacgtatgctgtgggcaaacatcgtagcttcctaccatcctgaatgcctgcgtgattgcgacaataagggggctaatggagaatgtcgttgtgctgcgaagatggcggttcatgccgaaacttccactttcaatcttactttgtttgatgctcatgtgaacttgcttcgtacacagactgaagcgatgagtgctgcattggccggtgtggattcaatgacagtcgttccgttcgataagacttattcgactccggatgaattctctgaacgccttgcacgtaaccagcagttgttactgaaagaagaatctcattttgataaggtgattgacccggctgccggttcttattatatcgagaatctgacagtgtctatcgctaaacaggcgtgggaactcttccttgccgtagaagaggcaggcggtttctatgctgcattgaaagccggtacagttcaggcagcagtgaacgaaagcaacaaggcccgtcataaagcagttgctcaacgtcgtgaagtgctgctgggtaccaaccagttcccgaacttcaatgaaaaagcaggtgagaaacagccgatagaagcaaaatgctgctgcggaggtgatgctcatacttgcgagaaagatgtggatactttggtattcgaccgtgcagccagcgaatttgaggcattacgccttgaaacggaggcttccggcaaacgtccgaaagcgttcatgctgactatcggtaatctggctatgcgtcaggcacgtgcgcaatactcttgcaacttcctcgcttgtgccggatatgaagttattgacaatctcggattcgaaacggtggaagccggagtagaagctgctatggctgctaaagctgacattgtagttctctgttcaagcgatgacgaatatgcggaatatgcggtgccggctttcaaagcattggacggccgtgctatgtttatcgtagcaggtgctcccgcctgtatggatgaactgaaggcagcaggtatcgagaacttcatccacgtgcgtgtcaacgtattggataccttgaaagagtttaacgccaaactattgaagtaagatgagaaaagattttaaaaacttagatatatatgctgcatttcagcccgctaacggtgctgaatggcaaaaggctaacggtatttccgctgattggaatacaccggaacacattgacgtgaagcctgtttatacaaaagaggacctcgaaggaatggaacacctcggctatgctgccggacttcctccttatctgcgtggtccgtattcagtgatgtacactcttcgcccctggactatccgtcagtacgccggattctctactgccgaagaatcaaatgctttctatcgccgtaacctggcttccggtcagaaaggtttgtccgtagcatttgacttggctactcaccgcggttatgaccccgatcacgaacgtgtggtaggtgacgtaggtaaggctggtgtatctatctgttcactcgaaaacatgaaagttttgttcgacggtattcctttgagcaagatgtccgtgtctatgacgatgaacggtgcggtacttccgattatggcattctatattaatgcaggtctggaacagggtgctaaactcgaagaaatggccggtactatccagaatgatattctgaaagagttcatggtgcgtaatacctatatctatccgcctgcattctctatgaagattatttccgatattttcgaatatacttcgcagaagatgcctaagttcaactccatctctatctccggttaccacatgcaggaagcaggtgcgacggcagatatcgagctggcttatacattggccgacggtctggaatatctgcgtgccggaacagcggcaggtatcgatatcgatgcgttcgctccccgtctgtctttcttctgggcgattggtaccaatcacttcatggaaatcgcgaagatgcgtgctgcccgtatgttgtgggctaagattgtaaaacaattcaatccgaagaatccgaaatcactggcattgcgtacacactctcagacttccggctggtcgctgacagaacaagacccgttcaataacgtaggacgtacttgtatcgaagccatggctgccgctttgggacatacacagtctttgcataccaatgcgctggatgaggctattgccctaccgacagacttctccgcacgtattgcccgtaatactcagatttatattcaggaagaaacctatatctgtaagaacgttgacccatggggcggttcttactacgtagaagctctgaccaacgaactggctcacaaggcttgggaacgtatcgaggaagtagaaaaactgggtggtatggcgaaagctatcgagaccggtattcctaagatgcgtatcgaagaggctgctgctcgtacgcaggcccgtatcgacagcggttctcagactattgttggtgtgaacaaatatcgtctggaaaaagaagctccgattgatatccttgagattgataacacggcagttcgtcttgaacagatcgagaacctgaaacgtttgaaagaaggacgtaaccaggcagaagtggacaaagcactggcagccatcaccgaatgcgtggagaccggtaagggtaacttgctggaactggctgtagaagctgctcgtgttcgtgcaacgctgggtgaaatctcctatgcttgcgaaaaggttgtaggacgttataaagcaataattagaacaatatcaggcgtgtattcatcagaaagtaaaaacgatggcgacttcaagcgtgcatgtgaactggctgagaagtttgctaagaaagagggacgtcaacctcgtattatggttgcgaagatgggacaggacggtcacgaccgtggtgccaaagtggtagcaaccggttatgcagactgtggcttcgacgtagacatgggaccattgttccagactccggcggaagctgcccgtgaagctgtagaaaatgacgttcacgtagtaggtgtttcttcattggctgccggacacaagacgttgattccgcagattatggaagaactgaaaaagctgggtcgtgaagatatcgtggtaattgccggcggtgttatccctgcacaggattatgacttcctgtataaggcaggtgtagctgctattttcggtcccggtactccggtagcgaaggctgcttgccagattctggaaatcctgatggatgaagaataagtacggaatttaatcattttttctatttttttatcccgccttatagctccattcgggctgaaggcgggatgtttttttcatctttatgcggtcagtgagaaataatcatgtaactttgtagactgttagtataaaaacaagaagagaaaaaatgatagtttgcatagccgaaaagccgtctgtagcacgtgatatagccgaagtactcggcgctcatacaagaaaagaagggtatatagaaggaaacggataccaggtaacctggacattcggtcatctttgtaccttgaaagagccgcatgaatacacccctaactggaaatcatggaacttgggtagcttaccgatgattccgccacggttcggcatcaagctgatagagaaccctacttacgaaaaacagtttcacattatcgagggactgatgcagaatgcagatgaaatcatcaactgcggtgatgccggccaagaaggagaattgatccagcgttgggtgatgcagaaggcaggtgcccgctgtccggtgaaacgtctgtggatttcttcgctgacagaagaggcgatccgcgaaggatttgccaaactaaaggatcagtccgactttcaatcactgtatgaagcgggactttcccgtgcaatgggggactggttgctgggaatgaatgctacccgtctttatactatcaaatacggtcagaacaaacaagtgctttccatcggtcgtgtgcagactcctacgctggcattgattgtcaaccgtcaactggagatcgccaacttccagccgaaacaatactgggaactgaaaacaaattatcgtgataccaccttttctgctctgatccgtaaaagcgatgaagaaattgctgcggaagaagaaaagagtggcggaaagaagaagatagacaatcccggcatcgaccctatcgccaaccgggaggagggagaagcgctggtggaacgcataaaagaccttccgttcattgtcaccaatgtcggcaagaaggatggaaaggaatatgctccgcgtctgttcgacctgacttcccttcaggtagagtgtaataagaagtttgcctattccgctgatgaaacgctgaagctgattcagtcgctttatgaaaagaaagtggctacttatccgcgtgtcgataccactttcctgagtgacgatatttatccgaagtgtcccggaatattgaaaggccttcgggactatgaggtgctgactgctcctttgtcaggtgcttcattgcctaaatcgaaaaaggtatttgataattcgaaggtaacagatcaccatgccattatccctacaggcgtttatgcacagaatctgacggatatggaacgtcgtgtctatgacctgatagcccgtcgttttatagcggtgttctatcccgattgtaagatttctaccactaccgtgatgggcgaagtggacaagatagaatttaaagtaatcggcaaacagattctggagccgggatggcgtgtcgtttttgccaaagatgtgaaagatacttccgaagaaaaagaggaagaggatgaaaatgtacttcctgcctttgtcaagggggagagtggtcctcatgttccggacttgaatgagaagtggacgcaaccgcccagaccttatacggaagcaacattgcttcgtgcgatggaaacagccggaaagttggtggataatgacgaactccgtgatgctctgaaggagaatggtatcggtcggccgtctacccgtgccgccattatcgagacgttgttcaagcgaaactatatccgcaaggaaagaaagaacctgatagccacccctacgggagtggaactggtacagatcatccacgaagaactgctgaaatctgcggaactgaccggtatatgggaaaagaaactacgtgagattgaaaagaagacatacgatgcccgtcaattccttgaagaactgaagcaaatggtatctgaaatcgtgatgagcgtactttcagataatacgaaccgacgtatcactattcaggaggcagttgcccaaacggaagaaaaggcaaagaaagaacctaagaagcgtgagcgtaaagcaagtgctcccaaagaaaagaaggcgaaagcagaaccgaaagttcctgcatcttctccgtctcctgctctgactccttctgctcctgcctctgctccggctaccggtaatgcagatacttttgtcggacaaccgtgtccggtttgtggtaagggaaccatcattaaagggaagacagcttacggatgttcggaatggagaaatggatgtacttaccgaaagaatttcgaatagtttgtggacagtgtctcacataacagtgatttctcttttttcaaagaaaaagagtcccttcttttctgttcgcaccataaggaattagatagccgttttgctatcacgctctcactatccacttgtatccctttattcatcgatgtttcagggatggtagcaagcgtggtggcaagtatgagagcaaacggttgctctcactctgtctcgtcctgattagtatcgtttttgtaatgttatcttttgatttacaggatgttaatgtctgatgtgtcagttattaacgtttgatttctcaaccattaataactgagaaatcaggtattaaagactgagaaatcatgtattattgaccaataattgattttatgcttcctaagagaacagctcaatcggaataactgatatggttaatgtgattgaaacgtgcagtcaagtcaatcaaatcaacagtacattcagatagtttcagacgcttgaaacttttggtttcaacctttgaaaccaatggtttcaaggcatgaaactattagttccaacgcttgaaactaaaagtttcaaaggtcgaaactggtgattgatctatgtaaaccagtattatgataacgggattttaccgtataggtatatgcatccggggtggtccgattgtcgggccggatggaccacctatacctctgtttttatcaaaaacggcattgcggagaatctcatatataataccacccacatccaaacccagtgtgaacttatcgaaatggtagtaaggaatcataacgggaaccgtttcccaacgtccgctcatcgcgtcatagtatcgctgtactcccatttccatcccgaagcggtcggacatatcgacggacatcgtagctccgtagctatgggtactcattccgtaagaatttccgatgtcgtatgacccgaagaccttgaaggtgacacggtcggaaggatgataaaggaaggcacccgaagtgctgaaagcctgcccggtgatgtgggacatgttgaccttcagcgcattggcacggacttgtaactcaaattgctcattgaaaatatgctgataacctagtgaagcactgttgaaacgcccgatgcctgccatacttgtctggcttccggaaccgaacagtgctccatgatcgaattgatgcaataccccgcctgtactgtaatcacctcggaagagtagggaaggattggtctgataaggcagggagatatcccttttgagtgaaaagcggggtatatgctccaactgtccgggtgaatataaagaatatgtagtgctcttttctggaaacaagttaatgttggcctgttttagtacgtcgtccagcgttatggatgcaccgttacgaagtatgtgcgtactgtcgttgttttcttgcgcagagagtgattgcggaacaaaatacagcaaaagaaagattcccaaacgaattggaagctgtgatatgctaactttttgtctcatacgcatttgccctccttagtttttatgataggttatgtacaaaaataatgaaatcccatttgaaaagcaaataatgtgtaatgtttccttccatccgcaggcttttttaactcaaataagagcggataagattttttctgaataaattcccttttttcccttaaatttttctctctctcaggcaatatacgttgtatatttgttattatagatataagagtatcaactatttaatttggaagtaatatgaagaaaaaacttacgggtgttgcattggtgttagctgccgtctctttgatgggcatacagccggcgggagcatgtacgcgtgccgtatatctggggccggaccgaatggtggtcactggtcgcacgatggactggaaagaagacattatgtcaaatatctatgtgtttccacgtggaatgcagcgtgcgggacacaataaagaaaaaacagtaaactggacttccaaatatggaagcgtaatcgcaacaggctatgatataggtacttgtgacggaatgaatgaaaaaggactggtggcaagcttgctcttcttgccggaatctgtttattcacttcccggagatacccgtccggcaatgggaatcagtatctggactcaatatgtgcttgacaattttgcaacggtgcgtgaggcggtagatgaaatgaaaaaagagactttccgtattgacgctccccgtatgccgaacgggggaccggaatctactttacacatggctattaccgatgaaacaggcaacacggcagtgatcgaatatctggatggcaaactgagtatccatgaggggaaagaatatcaggtgatgaccaattctccgcgttatgaattgcagttggctgtcaatgattactggaaagaagtgggtggattgcagatgttgccgggaacgaaccgttcgagcgaccgttttgtgcgtgcctctttctacattcacgccattccgcagactgccgatgcaaagatagctgtccccagtgtgctgagtgtgatgcgcaatgtctccgttccgtttggtatcaatacaccggagaagcctcacatttcttctactcgctggcgttccgtttccgatcagaagaataaagtgtattactttgagtctactttaactccgaacctgttttggctggatttgaagaagattgattttagtccgaaggctggggtgaagaaactgtccttgaccaaaggagaaatttacgcaggagatgccgtgaaggatttgaaggatagtcaatcatttactttccttttcgaaactccggtgatgtagtcgatagttagttatgtggtaagaggtctttttttgaataaaaaggaacggtaggcaaaggatttatccgcttgtctaccgttctccttttatcttcgtgtcctgcgtgcggctataggcagcctttatcttttcgcatattcctgatggaactcaatcactgcctctattcctttccggaatatgtccagcgagaagttttcgttgggtgaatggatcgcatccgattcaagtccgaagcccatcaatacggttttggttcctaatacctgttcgaatgtcgaaatgataggaatacttccgccacgacgtactgccagcggttttttgccgaaagctatctcaaaacctttttccgcagcctgataggcaggaagggaaatcgggcagacatatccctgtcctccgtgcattggggttacttttacctgtacggtgtcgggagccatttgtaagatataatctgcaaacatctgcgatatcttgtgatgatcctgatgcgcaaccagtcggcaggaaactttcgcatacgctttcgagggaaggactgtcttggagccttcacctgtatatcctccccaaatgccgcatacatcgaaagacgggcggcaactgttgcgttccagtgtgctgtatcccttttctccgaagagttctttcactccgatggcttctttgtatttcttctcatcgaacggaatatgggcgatcatttcccgttctgcttgtggcacttcttctacgtcatcgtagaatccggggacggtgattcttccgtctttatctgttactttgctgattatttcgcaaagtacattgatcggattagctaccgcacctccgaagtgtcccgaatgcaggtcacggttcggtccggtcacttctatttcccagtaagccagtccgcgcagaccggtggtgagggatggaagttcggcacccagcatgctggtatccgaaaccaggataacgtctgctttcaacagctctttatgctcttcgcagaaggcttccaggctgggagagccgatttcctcttctccttcgaagataaacttgacgttatttttcagcagttcgttcttgacgagatattcgaaggctttgacctggataaaggattgtcctttgtcatcatccgctccgcgtgcccagatgtatccgtcccgtacttcgggttcgaagggctggcttttccacagttccagcggttcggcaggcattacgtcgtagtgggcgtagaccaatactgttttggcattcgggtcaacgatcttttgtgcgaaaacaatcgggttacccttggaaggcatcaccaatgcttcatccactccggcttcgagcagtagttgtgcccagcgttgggcgcaagccagcatatcgtcgtgatgttccggcagggcgctgatactgggaatacggatgaggctgaacaggtcctccataatcttcggttcgttcgctgcgatatatttttgaatttcgttcataatgaatagtttactggcggttatttagcctatgtgccaatagcctgacagatttttagtgcaggtattggcacatgggtagattgacatattgatacttattaaagctgcgttgtcttatccaacagataataatcaaggatagtcatggcagccattgcttctacgataggcacggcacgtggcagtacacaggcgtcatgacgtccgcgggctttcagtgtcgtatctacgccgtcgatgttcaccgtttcctgctccatcagcagggtagcaatcggtttgaatactacacggaagtaaatatcctgtccgttactgattcctccctgaatacctccggagtggttggtatgcgtttcaatccgtccgttgttgttgaagaatacgtcgttctgctcggagcctttcatcttcagtcccttgaatccttcgccatattcgaaggctttggcggcattgatactgagcatggcgttgcccaaggcagcgtgcagtttgccgaacacaggttgccccaatccgataggacatcctttgatgacacaggtcagcgtacctccgatggtatcgccttcgccttttaccttatatataaggtctgccatttccttcgccttttcagggtccggacaacgtacatcgtttgtttcgatcaggtcgagatcatagtcggaataagtgccttccaatttgatggcaccgacttgcgatgtataagctgtgatgctgattcctaactggcgaagggctaatttagccaatgcgccggctactacgcgtgaaatagtctcgcgggcagaagaacgtccgccgccgcgatgatcacggatgccgtacttcactttgtaggtgtaatccgcgtgtgaagggcggtatacctctttcaggttattgtagtcattggaatgttgattctcgttccaaacgataaatccgataggacatccggttgatttgccttcgaagatgcctgaaagaaactccactttatccgcttccttgcgtggtgtggtgaggatggattgtcccggacggcgtcgatttagttcttgttgtacaaattcttcgtcgattgtgattccggaaggaaatccgtcaattactcccccaactccttttccatgagactcgccgaagctggtgagccgaaagatgttgccaaatgaattaaacatagttgtggcttttttaaaattactctatgcaaatataacaaagtttttgataagaaggttgtgaattcaaaatatcttcggaaaaggaagcaaattgaaccttttttcctctttttagtttataaatgacgattatttaataactaaacccgaaaattatgaaaaagaatctattgtatttgtgggcattgatatgctctgtctctcttttgacggcttgtagcagtgatgatgataatacggtcaatgatgaaacgactcctccggaagaagaggctgtggtgactgctcccgatgtggtgggaacgtattggggaaatctcgatatttcaatgctgcccgatggctccgaccaggaagttgtgattgccgacggacttccgaagtttattactttctctcaggtcagtgatacggaagtaaagatggaactgaaggaatttgaactgtttataaacggaaacatattaaagttcggcgatatcgtaatagacaagtgtgcagtgaaaaaggaaacggacgcttcgactttcaccggacagcaagaccttacttttcagggggatgccgctgctttgggtacctgtgccaccagtatagaaggaacggtgcaaagtggaaatgctacaatgaatattcaggtaaaagtacctgcattgaagcagaccgtgaaagttgctttctccggtgtgaagcaggtggaggaatccggtaaggattaatccgtctttggtcagctagaaagcatatccgaatccgatattcaagtagatcggatacatagcaaaagtaatggtctgaaagtcatttctgaagatatcattcaatccccaggtgaggtctgcatatatattgaggtgtttgaatgctctccatccggctcctatttgcaggccccactgaaaatgtctcaggtcgtccgagaagtcataagtagcgattttaccatccgtaaattcgactttggggcctacggggtcgccttcacgcaggtatccttcatatacgtgccccgaaaattctcttgaaagcagatacgaaaaataaggtccggctttaatattccaacggttgctcaacttgtaagtagccattagaggaattgtcagtccggaagtgtggactttggttttgactcctcctgtccagacaccgctgattctttctcctccctgtccgaggatttccatattatagtttttgacggtggcttccgttgtcatggctttattctccagccgcagccctacaatgactccgagcttgttttgaacggcaaaccatttggttacttctcctccgatgctgatagccagcgttgggttgtagccgtcaatcgaacggatttcgacaggcagcgggagcggggctgtaccgccgatgctgaaccctgctttgatttcatattccagtccgtgaagagcggaacggataagcgtttcgtttctgtcaacctgtgaatagccggggagggctattaccagacaggcgagtaaactgaatatataggaatggattttcatcttttcattattattaaatcattagttatttcattatagttgctctgttctgccttccatagctgctatcagatcattggtcgaatggaatcagtcttccgagcgatagattagttcgacttcatcaatcagcaatgtacttccgatagctccgttgaaatgatctccttccaggctggaagtgaatacgatagctacattatactttcctgccgttagcttctctttatcgatgtattttccggataacatatggaagggaagtttaaagtatgtccactcatccgtctctttggcgtcgtcaatgcgtgctattgaaaccaggttgggactggtgaaagcattcgttccgtcaagagtcggcacagattcactggtttcatacatgatggcataaatatcgcatatatcccgtttgccactgacgggtttgccgccttctgtaaactgatctccggctttatacttgtaatagcctgccagataagttggtatatgccggaaaggcagaccgaatttggtcgctttcagtggattgctcattgcatttcctacatcaaaagagccgataaacaggttcccggctgcgataggcattcccataatgctaccgaagaatccggtactgcgggttactaaggacaggcattttccggtttttccgtttgcaaactgaaaagtcggatagtcgtcggctgtcttgggaactccggtcattgcataacctgcgtttccgctggcccattccatcaccactttttctccttcccgttctacgaagatgtagtatttctgtccgccgagcgtatcctcaaaattgtaaatagtagcaagttccgtatcaataacggatacggtgtacttcttcttccaaaagccatcggcagccgtaacggtatattgctgaggcgaatggaaatctctagccgtcccactgggaggatcgatagtggctcccggagtcaatgtaaattcgggtgcaagggatgaaatgtccgttcccggtcctacaaatatattgatggaattattagtgataatcggactcgttgtcatgactactcccggcaatctgcaactgagtatgtctgcctctgcattgggagcttcttcgcgaatgcaagaagaagagaaaatggctagcagcaaataaagaataccgtgttttgctttcatttttctactattctaactgttaaagttcggttcttggaagattttataacaatctgcaattttatttgttcactaatggatgtttgataaaaaagaattttctacttttgtggaaactaaagccttatagggtatgattgaatcggaaagaaaacagataatagacttgatcaaaaaagaggtgattccggcgatagggtgtacggaacccattgcggtagcgctttgtgtagctaaagctgccgaaacattaggaatgaaaccggaaaagattgaagtgttattgagtgccaatatattaaagaatgcaatgggagtcggtatccccggcacagatatggtcggacttcctatagctgtagccttgggagcgttgatcggccgatcggaatatcaattggaagtgttgagagactgcacaccggaggcagtagaacaaggcaaactgtttatcgcagagaagcgaatctgtatttctctcaaagaagatattacggaaaaactgtacatcgaagtaatctgcacagccggcagccaaaaagcgacggctgtgattgccggcggacatactacctttgtctatatagctacggatgaaaaagtactgcttgacaagcaacagactgccaatgaagaggaagaagacgcttcactggaactgaatctgcgcaaagtctatgattttgccctgacatcccctctggatgaaatccgttttattctcgatacggcacgtctgaacaaagcagccgccgagcaagcctttaaaggcaattatgggcattctttaggtaagatgctccgtggaacgtatgaacataaagtgatgggtgacagcgtattctctcatatactatcttatacttccgccgcttgcgacgccagaatggccggtgcaatgattcccgtcatgagtaactccggcagtggcaatcagggcatatccgccacacttcccgttgtcgtatttgccgaagaaaatggtaaaaccgaagaggaactgatccgcgccttaatgctgagtcatctcactgtaatctatattaaacaaagtttgggacgtctctctgccttgtgtggctgtgtagtagctgccacgggttccagttgcggaatcacctggctgatgggtggaaactataatcaggtagcctttgccgttcaaaacatgattgccaacctgacgggaatgatttgcgacggtgcaaaaccgagctgcgcactcaaagtaacaaccggagtctcaacagccgtattatctgctatgatggcaatggaggaccgttgtgtgacttctgtagaaggcattattgacgaagatgtcgatcaaagcattcgtaacttgacaagaatcggctcgcaggccatgaacgaaacggataagatggtgcttgatatcatgacgcacaaaggaggatgttaacaggtaataagtaacaagtaataagtaataggtaatagctggaataacggcataaaaaaagtattaagtattaacttccgcctatatccgcatggaattaatacttaatacttattacctattacttaaaattagtggcagtgtccgccttcgcaaccgcagtcatcgccacagtcgctgccgcagctgtcgcatccgcaaccgcaaccttcaccgctcatcatcttcaccagttcctgaatttcttcgttggtagcaggacggctttcgattacttcaccttcaaagatcaggtcagcgcctgccaatgggtggttaaggtcaactactactacatccggtttgatttctacgacgctggcgtttacgcgttgaccgtctccggtcatcaaaggtacaatgctgccttctgttacgcgttcgctgtcgaacttgccatctatttcaaagatatttttaggaagatcaaatacatgttgctcatcgtaggctccgtaagcttcatctgccggaatggtaaaatcgaatttatcacccttagaaagagctgttatctggttctcgaagctttcgagcgttgtgcctaatcctgaaatgaactgaaaaggatgttctgcatttgtttcttcgaacaattctttttcaccatcttccactgtatatagcttatatgcaacggtgatgtacttgttttctactgtttccatctgatatttatagtttctaattaataaatcccttatttagggtggacaaagatacgaataatttgcttgctaccgggtgcatacggagtaaatttcagattattaagcgcttttgtcagaaatggacagtcattctctactaactgatagttgcaaattcaacctttaagtgataaaatttaggtttattaccgttcttttcttacgattattcgctttttagtgatttttttcttcgatttgtttggagataataaaaaagcccttacctttgcagcacgaaaataaagaaaagaagatatgaatatattacatacatctattaacctagcagttctgcatattattcgcgtcgtggtggtgccatcaagagcgtgagaaaggttttgtgtatgtattcgtaccataaaagatagaatttggagcctttctcactgatgtgagggaggctctttaattaaaagatagattgaaatgaaaaagcaattacgcagttcgtttagtacacaaggccgtcgcatggcgggagcccgcgcattatgggcagccaacggcatgaagaaaaatcagatgggaaaacccattatcgctatcgtcaattcgtttacacaatttgttccgggacacgtgcacctgcatgaaatcgggcagttggtgaaggcggaaattgagaagctgggatgcttcgctgcggaatttaatacgattgctattgatgacggtatcgctatgggacatgacggaatgctttactcgcttccttcccgtgatatcatagcggacagcgtagaatatatggtcaatgcgcacaaggcggatgcaatggtatgtatcagcaactgcgataagattaccccagggatgctgatggctgccatgcgcctgaatatccctaccgtatttgtatccggcggaccgatggaagccggagagtggaacggtcagcatctggacttgatcgatgccatgattaaatcggcggacgacagtgtaagcgatcaggaagtagcgaatatcgaacagaatgcctgtcctacctgcggatgttgttccggaatgtttacggcaaactcgatgaactgtctgaatgaagctatcggcttggctcttccgggaaacggcacaatcgtggctacgcacgaaaatcgtacgaaactgtttgaagatgctgccaaactgattgtggaaaatgcaatgaaatattatgaagaaggtgacgaaagtgtacttccccgcagcatagctacccgtcaggcattcctcaatgccatgacgctggatattgcgatgggcggttctaccaatacggtgcttcacctgttggccgtggcacatgaggcaggagtcgatttcaagatggacgacatcgatatgctgtcacgcaagacaccctgcctgtgtaaagtcgctccgaatactcaaaaatatcatattcaggacgttaaccgtgcgggtggcatcattgctatcctggcagagttggcaaaaggcggtctgattgatacttccgttctccgtgtggatggcatgtcgctggcggaagcgatcgatcaatattcaattaccagcccgaacgttacggaaaaagcaatgagcaaatattcaagtgcggcaggaaacagattcaatctcgtacttggttctcagggagcttattatcaggaattagataaagatcgcgcgaacggatgtatccgtgatctggagcacgcctatagcaaggacggaggtttggcggtactgaaaggaaatatcgctcaggacggttgcgtagtaaaaacggcgggtgtagacgaaagcatctggaagtttaccggacctgccaaagtattcgactcacaagaagcagcctgtgaaggcatcctcggaggccgagtcgtcagcggcgacgttgtcgtcatcacgcacgaaggtccgaagggcggtcccggtatgcaggaaatgctttacccgacttcttatatcaaatcccgtcacctcggcaaagaatgtgccttgattaccgacggacgtttcagtggtggaacttccggattgagtatcggacacgtttctcccgaagccgctgccggaggtaatataggaaaaatagtagatggagatatcatcgaaatcgacattcccgcccgaacgattaacgtgcgactaacagatgaagaactggctgcccgcccgatgactcccgtcacccgtgaccgttacgtgccgaagagcctgaaagcatacgccagcatggtaagctctgccgataagggagcagtgagattaatagactgatccacttcattatccattatgaatcatccattatccattaaagaactatgagtaaggacttaataacaggcgcagaggcaatgatgcgctctctggaacatcagggagtgactaccattttcggttatcccggcggttccatcatgcctacgttcgatgccctgtacgaccatcaaaatacattgaaccatatcttggttcgccatgaacagggagctgcccatgcggcacaaggctacgcccgtgtatcgggtaaagtcggtgtttgcttggtgacaagcggccccggagcaaccaatacgatcacaggtattgcagatgcgatgatagacagtacgcctatcgttgtcattgcaggacaggtgggaacaggctttcttggaacagacgcttttcaggaagtcgatctcgtaggtatcactcagccaatcgctaaatggagctatcagattcgccgtgccgaagacgtagcctgggcgatagcacgtgctttctacattgccagtagtggtcgtcccggtccggtggtactcgactttgccaagaatgcgcaggttgaaaaaacgaaatacgagccgacaaagcaggagtttatccgcagctatgttccggttcccgatacagacgaagaatcagtaaaggctgccgccgaactgatcaataacgccgaacgcccgcttgtcttggtaggacagggagtggaactgggaagcgctcaggaagaactgcgtatctttatcgaaaaggcggatatgcccgcaggttgtaccttgctcggactttccgcattgcctaccgaccatccgttgaataaaggaatgctgggtatgcacggaaatctgggaccgaatatcaatactaacaaatgtgatgtactgattgctgtcggtatgcgtttcgacgaccgtgtgaccggtaatctggctacttacgccaaacaagcgaaagtgatccattttgacattgatccggcggaagtaaataagaatgtaaaggtagacattgccgttttgggcgactgcaaaaagacgctggctgctgtgaccggactgctgaaaaagaaccggcacaccgagtgggtcgatagtttcaaggaatatgaagcggtagaggaagaaaaagtcattcgtcccgaacttcatcctgcaacggattcactgagtatgggcgaagtggtgcgtgcggtaagcgaagcgacccgtcacgaagccatattggtgacagatgtaggtcagaatcagatgatctctgcccgctactttaaatataccagggaacgtagtatcgttacttcgggtggactcggcacgatgggttttggccttccggcagctatcggagctactttcggccgtcccgaccgcacggtatgtgtatttatgggtgacggcggactgcaaatgaacattcaggagctgggtacgatcatggaacagaaagctccggtgaagattatctgcctgaacaacaattatctcggcaacgtgcgccaatggcaggctatgttctttaatcgccgttattcatttactccgatgctgaatccggattacatgaaaatcgcttccgcctacgatattccttccaaacgtgtcttttcacgggaagaattgaaagcggccatcgacgaaatgctctcgacagacggggcgttcctgctcgaagcctgtgtggtagaagaaggcaatgtcctcccgatgacccctccgggcggttcagtcaatcagatgttgctggaatgttaatccttaatttagaaagttatgagtgataagacattatatacgattatagttcattctgaaaatatagccggattgctgaatcaggtgaccgctgtatttacccgtcggcaaataaacatcgagagtttgaacgtttctgcttcttccattaaaggagtacataaatatacgattacagcgtggactgataaggacactatcgaaaaggtggtgaagcagatcgaaaagaagattgatgtgattcaggcgcactattttacggaagacgagatttatttccatgagatagccttatataaggtatctactcctgcttttcaggagactccggaagcatctaaagtgatccgcagatataatgcccgcattgtagaggtgaatccggtattctctatcgtcgagaagaacggcatgagtgaagagattacttccctttacgaagaacttcgggctttgaaatgtgtgctgcagtttgtccgttcgggccgtgtggctattactaccagctgtttcgaacgtgtgaatgagttcctggacggacaggaagcgaagtataagcaaagtaaaaaggaacaggagtaatgagtgaagaaaataaaatagggacttatcagtttgtggcagagccgtttcacgtagattttaacggccgtctgaccatgggcgtgctgggaaatcatctgctgaattgcgcaggttttcatgccagcgaccgtggatttggtattgctacgctgaacgaggacaattacacatgggtgctttcccgcctggctatcgagctggatgagatgccttaccagtacgagaagttctcggttcagacatgggtggagaatgtctatcgtctctttaccgaccgtaactttgccgtcattgacaaggatggaaagaagatcggctatgcccgttccgtatgggcgatgatcaatctgaatacccgtaagcctgccgatctgttggcattgcatggaggaagcatcgtcgattatatatgcgatgaaccttgcccgatagaaaagccttcgcgtatcaaggtgacaagcaatcagcctgttgcgacgctgacggcaaaatacagtgatatcgatattaacggacacgtaaacagtattcgttatatcgagcacatacttgacttgtttccgatagaactgtatcagacgaaacgtatccgccggtttgaaatggcgtatgtggctgaaagttatttcggagatgaactctctttcttctgtgatgaggtgagtgaaaacgagtttcatgtagaggtgaagaaaaacggcagcgaggtagtatgccgttccaaagtgatatttgaataatatagagtataaaatcaattaataacagatggcgcaagtcatcaaaacaaaaaaacaaaaaaaaatggcacagttgaattttggcggaactgtagaaaatgtagttatccgtgatgaatttccattggaaaaagctcgtgaagtattgaaaaatgaaacaatcgctgtaatcggttatggcgtacaaggtcctggacaggctctgaaccttcgtgataacggtttcaatgtaatcgttggtcaacgccagggaaagacatatgacaaagcggtagctgacggatgggttccgggtgaaactttgttcggtattgaagaagcttgcgaaaaaggtacgatcattatgtgcctgttgtctgatgcagcggtaatgtctgtatggcctactatcaagccttacctgactgcaggaaaagctctttatttctctcatggttttgctattacatggagtgatcgcacaggtgtagttcctcctgcagatatcgacgtaatcatggttgctcctaaaggttcgggtacatccttgcgtactatgttccttgaaggtcgcggcttgaactcttcttacgctatctatcaggatgcaacaggcaacgctatggacagaacaatcgcattgggtatcggtatcggttcaggttatttgttcgaaacaactttcatccgcgaagctacttccgacctgacaggcgaacgtggttcattgatgggagctatccagggtctgttgctggcacaatacgaagtgttacgtgaaaacggtcacactccttccgaagcattcaacgaaactgtagaagagctgactcagtcattgatgccgttgtttgcaaagaacggtatggactggatgtatgctaactgctctactacagctcaacgtggtgctctcgactggatgggccccttccacgatgctatcaaaccggtagttgaaaagttgtatcacagtgtgaagactggtaacgaagcacagatttcaatcgactctaactccaaaccggattatcgtgagaaactggaagaagaactgaaagcattgcgcgaaagcgaaatgtggcagactgccgtgacagttcgtaaacttcgtccggaaaataattaatcagacttatactatataagtttttcaaaaggcgggaaaagcgtattttcccgctttttctatgtagataccggtcttttgagtaatagaaaaaggatgaaagtagaaaaaaagattaaaagatactgataatataggtgaaaaagagcatttatgattacctttacggcaacaaataaaacagaataggcaatgaagaaactttttacttacagaagatcgatacgtatgaagatgatttcttctttaataaatagtatatcagaatgttacattaaaagatatttaagttattctctaccgaatggtagctgtaataccatttcaagtcctttttatatttcgtgttccattagtgattcgttgatatgatgcagaattttattctgtagcaggaaaaagtatgcgttaaattgaatttaagacagagcttttggaacagaatttagtgggaaaataacattgtttgttttgtttgtaaatgggagtcctctttcgtgagaaagggggcttctttttttatcccgatgattcaggaggataccgcttcctgccggatatactgtatcagtttccggtagaacgcatgcttggtaagagtggttgcatctcccaaaatcacaagtttcatccgggcgcgggtaatggctacgttcattcgtcttaaatcattcagaaaaccgatctgtccgtcctcgttcgcccggacgaggctgataaagacgacatcccgttcctgtccctgaaagccgtctaccgtgttgaccgtgatgaggctgcggaaagggcggagaaaactgcttcctctgattttacttctcaggtattgcacttgcgccttgtagggcgaaatcagaccaaagtcgatgctctcgtccaggatgcgtgctttgccgatccggctgatataggcttccagttcttgcagtaacaagttggcttcctgcttgttgatgcgcccgaagctctcgcctacaaactcttcgtggaagtccatttccgaggtatctatccagttcatgggagtgtcgaagtcaaggataccccggttgcgcacttccggtgcggcttccagttctccgttgtagaaccattcggagggaaagcgcatgattgcttcgtgcatccggtattgcactttgagcagcgagacggcagaaggtttttgctgcacgaccttttccattagagtgtggtccagtccgccacgggcggcttcgatacatttgattgtaggagggagctggcaatggtcgccggcaagaatcacacggtcggcctttcggatggcgatccaacaggcggcttcgagtgcctgggcggcttcatcgataaataaggtggggaaacgccgtccgttgagcaaacggtgattgctgctgaccagcgtggaagcaatcacacgggcactgtcgaaaagatcggcgttgatcaggatttccagttcggtggcacggtcgcggaggcggctcatccggctgcgcattccttccctttcggagtaacttccccgacgcatccggctgcccatttcacggatcgattttcggattccccaaagttcggggtaggccgaatgattctcaaagcggcgttcgtaagtgaaagaaagcattttgtcattaacacgtgtagggttaccaatgcggaggacaggcacaccccggtctaccagtttctcgcaaatccagtccacagccgtattactttgggcgcagaccagcacctgcggttcgcggtgaagcgtttcgtaaatggcttccacgagcgtggtagtctttccggttcccggagggccgtgaacgatggcgacatcgcgtgtgcataacactttgtttacggctgtttcctgcgtgctgttcagccacgggaaacggacgggatataattcgcggaatcccggcttttgtgttcccagcaaggtgtcccggagttcggcaaggcggttgcccttagcgcggattgtgtcttccagcgcttcgaacatggcacgataggacgtttcatcgaaataaagttgtacacccagcacctcttccgtttgcagttccagcaaggcgcccgcactgggaagcacgaccaccatccgttcgtcgtccgcataactcaccgttgcaatgaaattcatgtaattcacttttccgtcaaatgactgccggaaaaagcagacgggacgaccgaattcgaaggaatgctcgatttctttattttcggtgcgtgtaatatctattacaagttgatttagagaattatagtaacttcgaccgggagaggcgggataccagcacagaccacgtttcactttgcgggcgacacccattgtttcagtctgccgcttgaattcctccttttcgtgttcatactccatgcgtagcaggagttgctgttgctgaaggtcgatgattggacttttcggatgattattcataatagacgcaaaggtaataaatcttcttcctgagacgaaaatatatttcattttgttaaacattcctcgaacgccgttcgttatttttatagatagactaaaaaaaataaaagcaatatggtgtatgatttgactatgttagaggctttttattctgcttataaaggaaaagtggaacacgtgcgggctgttttgaaacgcccattgacgttagccgagaagattctgtatgcccatctgttcaatgagggcgatctgaaaaactacaagcggggtgaagactacgtaaatttccgtcccgaccgcgtcgctatgcaggacgcgactgcccagatggcattgcttcaattcatgaatgcaggaaaagaaaaagtggctgttccctccaccgtgcactgtgaccacttgatacaagcgtacaaaggagcaaaggaggacattgctacggcaaccaaaacaaacgaagaagtttacgactttttgcgcgatgtatcctctcgttacggcatcggcttctggaagccgggcgccggaatcattcaccaggtagtgctcgaaaattacgctttccccggcgggatgatggtaggaaccgactctcacactccgaatgccggaggactgggcatggtggccatcggcgtcggcggtgcggatgccgtagacgtgatgacgggtatggaatgggaactgaaaatgccaaggattatcggtgtccgcctgaccggaaaactgagcggctggacttccccgaaagatgtgatcctgaaacttgctgggattctgaccgtaaaaggaggaacgaactccatcatcgaatatttcggaccgggaacagcttccctgtcggctaccggcaaagcgaccatttgcaatatgggtgcggaagtaggagctaccacttcgcttttcccgttcgacgggcgcatggctacttatctgagagccaccggcagggatcgcatcgtggaactggcggaagccgtggactgtgagctccgtgcggaccaacaggtgacggacgaaccggaaaagtactacgaccgtgtcatcgacattgacttgtccacgctcgaaccttatatcaacggccctttcacaccggatgccgctacccctatctctgaatttgcagaaaaagtattactgaacggctatccgcgtaagatggaagtcggactgatcggttcgtgtaccaactcttcttaccaagatctcagccgtgccgcatcccttgcaaggcaggtgaaggaaaagaatctgagtgtggcttccccgctgattatcaatccgggttccgagcaaatccgcgctactgccgaaagagacggaatgatggatgacttcatgcagatcggcgccgtgatcatggcaaatgcctgcggtccttgcatcggtcagtggaaacgtcatacggacgacccgacacggaagaactcgatcgtcacatccttcaaccgtaactttgccaaacgtgcggacggcaatccgaacacatacgcctttgttgcttctcccgaactgacgatggcactgaccattgccggtgatctttgcttcaatccgctgaaagacagactgatgaaccatgacggcgagaaagtgaaactggccgaacccgtaggagatgaactccccttgagaggtttcacctccggcaatgaaggctatatcacccccggcgggacgaaaacagcgatcaacgtcaacccggcttctcaacgcctgcaactgctgactcctttccccgcttgggacggacaagatatactcaatatgcccctgctgattaaggcgcagggcaaatgtactaccgaccatatttcgatggcgggaccgtggctgcgtttccgcggacatttggagaatatttcggataatatgctaatgggagccgtgaatgcgttcaatggcgaaacgaacaacgtgtggaaccgttcgacaaacacctacggaaccgtttcgggcacagccaaaatgtataaatccgaaggaatcccctctattgtcgtggccgaagaaaactatggagaaggctccagtcgcgagcacgcggcaatggaaccccgtttcctgaatgtgcgtgtgattctcgccaagagcttcgcccgtatccacgaaacgaatctgaaaaagcagggcatgcttgcccttacctttgcagacaaagcggattatgacaagatacaggagcacgacctcctttcagtcatcggcttgccggactttgctccgggacggaatctgaccgtcgttctccatcacgaagacggaacgaaagagagttttgaagcgcaacatacatacaacgaacagcagattgcctggttccgtgccggctctgccttgaatgccagataattaaaatgatagaaatgaacaaaataaccatgcaaaaagatggtacgctatcggtgcccgatgtgcctgtcgtaccttatattaccggagacggagtaggagcggaagtgactccgtcgatgcagtccgttgtgaacgcggctgttcagaaagcatacggcggcaaacgtcggattgaatggaaagaagtgctggcgggcgaacgcgctttcaacgagacaggttcgtggttgccggatgaaacgatgaaggctttccaagaatatctgatcggcatcaaggggccgctgacgacccctgtcggcggtggaatccgttctttgaacgtggctttgcgccaaactctggatttgtatgtttgtctgcgtccggtccgttggtatcaaggcgttcattctccggtgaaagcaccggaaaaagtgaacatgtgcgtgttccgtgaaaatacggaggatatatatgcaggaatcgagtgggaggcaggtactcccgaagccgaaaagttctatcaattcctgaaaaacgagatgggagtgacgaaagtccgcttccccgagacctcttcttttggagtgaaacctgtttcccgtgagggcacggaacgtcttgtgcgggctgcctgccagtatgcgctcgaccatcatctgccttccgtgacactggtgcacaaaggaaacattatgaagttcaccgaaggaggcttcaagaaatggggctatgagctggcgcaacgtgagttcggcgacgccttggcagacggccggttggtgataaaggactgcatcgccgatgctttcctgcaaaatacattactgattcccgaagaatattccgtgattgccacgctgaacctgaacggagactacgtttccgaccagttggcggcaatggtaggcggcatcggcattgctccgggagcaaatattaactacaagacggggcacgccatttttgaagcgactcatggaaccgcccccaacattgccggaaaggatgtcgtgaatccttgttctatcattctttcggcggtgatgatgcttgaatatctgggatggaaagaagcggccgcgcttatcgaaaaggcgttggaacagagtttcctcgatgcccgtgccacgcacgatctggctcgctttatgccgggaggtacatccctgtctaccaccgctttcacacgcgaaattgtggaaagaatcgaaaagtaaatgtaacgattaaaaacgaagtattatgaagaaagagtatttgatttacaagctctccgaggagatgaaagaggcaacccggattgacaatgaattgttccccaagtttgacgtgaagcgtggactgcgtaatgaagacggcaccggtgtattggtaggtctgacaaagattggtaatgtggtaggttacgaacgtatccccggcggcggtctgaagccaattccgggaaaattgttctatcggggctacgatgtggaagacatttcccacgccatcatcaaggaaaaacgtttcggcttcgaagaagtggcttatctgctgctttccggtcgcctgccggacaaggaagaactggcttctttccgcgaactgatcaatgacaatatggcgctcgaacagaagacgaaaatgaatattatcgagctggagggaaataatatcatgaatattctttcgcgcagcgtactcgaaatgtatcgtttcgatcccgatgccgacgatacttcccgcgataatctgatgcgccagagtatcgatcttatctccaagttcccgaccatcattgcgtatgcttataatatgctccgccatgctacattcggtcgttccctgcacatccgtcatccgcaggagaaactctctattgccgagaatttcctctatatgctcaaaaaagattatacggaactggatgcccgtacgctcgacttgctattgattttgcaggcagaacacggcggtggtaacaactcgactttcacggttcgtgtgacttcttccaccggaacagatacatattcggccatcgccgcaggtatcggttcgttgaaaggcccgcttcacggaggcgcgaatatccaggtggccgatatgttccatcacttgcaggagaatatcaaggactggaagagcgtggacgagatagatacctatttcacacgaatgctgaataaggaagtgtataataagaccggattgatttacggtatcggtcatgctgtttacacgatttccgatcctcgtgcgctgttgctgaaagaactggctcgcgaccttgcccgtgagaaaggaaaagaagaggagttcgctttcctcgaactgcttgaagagcgtgccatcgctactttcggacgtgtgaagaacaacggaaagacggtttccagcaatatcgacttctattcgggcttcgtatatgagatgattggtttgccgcaggagattttcactccgctgtttgccatggctcgtattgtcggctggtgtgcgcaccgcaatgaggaactgaacttcgaaggcaaacgcattatccgtccggcttataaaaatgttcttgatgatctggcttatatccccatcaagaaacgctgataagaacaaatccttttatgcaataataactaacctcagacgtacatctcggtaatccctgcatgtacgtcttggtaatccccagttgtacatcttggtagtacccggttgtacgtctggggtgacttgtttcaggaagaacatccgatgttcatttaacatttaacactttgcggttgctgtatttttcatccgatggaggctaaggcatttatcgttggtagaaagggcacagcctggcaggtagaaacgcccttttaacgctacgttaaaagggcgtttctacaaccgatgaattatacattctatttctttggatatcagtgaactatgatctttccctttgctggaggagagattatggacaggtgacctgttgagaacaaacttgttattttaataattaccgtcgattgcgtctttgctgctattattgggataaggtataatgtctattaaatcaaaatacattaagcgtgtttttagatgcgttccggtttcaaagcctgtatattccacttcttgcgcttccgtagagaaaaggtatttgaaaccgtttttcagataatagttcagaggaatattttcattgtaagcgtcaacaattaaaaagcgacaccctgttttgtttcccgcatcaatgaaccatgattttatgaaagtcatcagatcactgcctatgccctgatgcttgtattctttattgattccaagtctgccgattaatacacccggatagcggtgcatttgtttggctcggggaatgtctttctgaactttcttttccctgctgttggggaggatatttactctgatactatcgttagaaacagtgaaggcacatactatgtccgaaggctttttatctgaacgaaaacagtaactttttcctaatagctgtgcattatagagaggagcatcgttatgaaagaagtcgtctaagtcttggtgcccacatgagaaagggtcacattctttaatcgtatcttcatcaagtacggcaaaagtacatttctcaaaaagaaatcccatgttttataacattttagcctttttgagcacagcacgggcttccagcacatgtttgctgaagtcttgtttgttttgatttttataagccttgtccgctgccttaacgaagtgttccgcttcttttccttttaaggtcggtatggctttaatttccattgccattgctttttctattatttagttcataaccaactgcaaagatagctgatttttaatgaataaacaaagaatgccggaagtctgttgtcgtttgatctgttttttatttgagttatttttgtgaccattcttttctttttttgttatttttgtgaatctcaaaagaaaatcaagatgagtatagctgcctttaatctatttttgggcgtcatgagtctgaccgctctgattgttttcatcgccctctactttgtgaaagccggttacgggatatttcgcaccgcctcctggggagttgccatttccaacaagctggcgtggatactgatggaagcccccgtatttctggtcatgtgctggatgtggatacactcggaacgtcgttttgatccggtcatactgacattctttgtcttctttcagattcattattttcagcgcgccttcgtctttcccctgctactgaccggaaagagtaaaatgccgctggcaatcatgtcgatgggaatcctgttcaatctattgaacggctatatgcagggtgaatggatattttatctctcacccgagggaatgtatcattccggctggttcacttccgcatggtttattgcgggcagtctgcttttctttgcgggcatgttgatgaactggcattcggactatatcatccgccatttgcgcaaaccgggggatacccgtcattatctgccacaaaaagggatgtaccgctatgtcacttccgccaattatctgggcgaaatcattgaatgggcaggctgggcaatactgacttgttcactatccggacttgtattcttctggtggacagtggccaatctcgtcccccgtgccaatgcaatctggcatcgctaccgtgaagaatttggctcggaagtaggcgaacgcaaacgtgtatttccttttatctattgatttgaaataaattatctattgacataaaatagcgtactatggaatctaaacttttcacccctgttactttcggtccattgacgctgcggaatcgtacgatccgctctgccgcttttgaaagcatgtgtcccggtaacgccccttcacaaatgctgctcgattaccaccgctcggtggctgcgggcggagtcgggatgacgactgtagcctatgcagccgtgacacaaagcggactttccttcgaccgtcagttgtggctgcgtccggaaatcatttccggtttgcgtgaagtgaccggagctatacacacggaaggtgcggcagcaggcatccagatagggcactgcggaaatatgtcccataaaaagatttgcggaaccactcccatttcagcttctaccggtttcaatctctattctcctacattcgtgcgtggcatgaagagagaagagttgccggagatggccagagcctacggacgggctgtccacttggcacgggaagccggcttcgacgccgtcgaggtacacgccggacacggatatctgatcagccagttcctgtctccctacaccaatcaccggaaagacgactacggcggcttgctccaaaaccggatgcgctttatggaaatggtgatgaacgaggtgatgacagcggcgggaagcgacatggcagtcattgtaaaaatgaatatgcgcgatggcttcaaaggcggcatggaaaccgatgaatctctgcaagtggccaaacgcctgctggcattgggcgcgcacgcattggtactgagcggaggattcgtcagcaaggccccgatgtacgtcatgcggggagcgatgccgattcgttcgatggcttactacatggactgctggtggctgaaatacggagtccggatgtttggaaagtggatgattccgaccgttcctttccgggaagcctatttcctggaggatgcactgaaatttcgggcggcacttccggaagccccgttgatttatgtgggcggactggtgtcccgcgaaaagatagatgaagtattggatgccggcttcgatgccgtccagatggcacgtgcgttgctcaacgaaccggagtttgtcaaccggatgaggcgggaagagcaggcgcgctgtaactgcggacacagcaactactgcatcgggcggatgtacacaatcgaaatggcctgccaccaacatctgaaagaaaaactgcctccctgcctgcaacgggagattgaaaaactggaaaagcaatgagtgaagagaaatgggcaatcatcaccggtgccgacggcggcatgggaacggaaataacccgtgccgtagccgaagccggttaccatattattatggcttgctatcgtccgtccaaagcggaaccgatacggcagcgtctagtgaacgagacaggaaacgcaaacatggaagtcatggcagtcgatctgtcttctatggcatcgacagcttcttttgccgatcggattgtggagcgtcatctccccgtttccctgctgatgaataacgccggaacaatggaaaccggacttcacatcaccgacgacggctttgaacgaacggtcagtgtgaactatctggggccgtacctgcttacccggaaactccttccggcattgacatgcggagcccgtattgtaaacatggtttcttgcacgtatgcgatcggacacctcgattttcccgatttcttccggcagggaagaaagggaagtttttggcgaatccctgtttacagcaataccaaactggctttgatgctgtttacgatcgaactttcggaacgcctccgtgaaaaaggaatcactgtcaatgccgccgatcccggcattgtttctaccgacatcatcactatgcaccagtggtttgaccctctgacggatatctttttccgcccctttatccgcacgccgaagaaaggggcttccactgccgtcggcctcttgctggatgaggcagtggccggagtcagcggacagctttatgcgagcagccacaggaagcagctgtccgaaaaatacctctgccatgtgcagcaaaaacaactgtggcaggaaacggaacaggctttggaacgctggttgaaataatactgtttttatttaatttatgctgtgattacttatttttaggtattgtatatctccggatatcttctttttgttgatctatttttaccaatagatggggattgtcccgcatctctatttgtcactacctttgtatcgttttagaattcgttatcggaactatatagtaggtattaagtaaatagagtaaaaagagatgatcaataaaagttttctggtttttcttgcgttcttattttcagtgtcagcattttctcaacatgggcgatccggagggatgatttccggaagagtgatttctactgtagaaaaagaagtggtggactttgcgactgtatatctgaaagggacgaacagaggagcgactacagatgaaaagggattgtatcacttgaaagcggcagcaggcgactacactctggttgtatcggccattgggtatacgacagtagaaaagaaagtgacactgaaagccggtgaaagaataagggtcaatgtaacgattgctccgcaggtgacggaactgaatgaagtggtagtgtccacttctgcagtgagccgggtaaataaatctgcctttaatgcggtggcaattgatgcgaaaggtctgcataacagtacacaaaacctttctgatgccttggcaaaagttccgggactcaaacttcgggaagccggaggagtggggtcggatatgattctttcgctggacggattttccggcaagcacgtcaagctgtttattgacggagtgccgcaggagggcgtaggaagttctttcggactgaacaacattcccattaactttgctgaccgcatcgaagtgtaccgtggtgtagtgcctgtcgggttcgggacggatgccttgggcggagttatcaatatcgtaaccaataaaaaccggaaaaactggtttctggacgcatcctactcttacggctcgttcaatacacataaatcgtacgtcaacttcggacagaccttcaagaatggactgacttacgaaatcaacgctttccaaaactattctgacaacagttactatgtggatacccctgtcgaagagttttatgaaggcggcggctcggctatcaatacggacaaggtagaacatgtgaaacgctttcatgacaactatcacaacgaggctgttgtcggcaaagtagggctggttgacaagaaatgggcggatcgtctgatgatcggactgacgtactcgcgtatgtacaaagaaatccagacaggagtggtacaaaaggtcgtatttggtgaaaaatatcgtaagggaaactctctgatgccttctctggaatatcgtaaacgtaatttattcgtcaggaatctggacgtagcattcacagccaattacaaccggaactttacgaacaatgtcgatacggcaacgtaccgtttcaactggcttggtgagaaaacctctctgaaagggagaaaaggagaacagtcatatcaggatatgaagtccgacaacgacaactggaacgctacttttaccgccaactaccacatcggcactgcgcatacatttgtgctgaaccacgtcttgaacacctttcatcgtgaaaatcacaactccgtttctgtcgatgaatcgaacgctatcgccaaagtgacccgcaaaaatataaccggattttcatacaggctgatgccttcggagcactggaatttatccgtattcgggaaatattacaaccaatataatgcggggcccgtgtccgcatcgaccagtggaacgagtaactacgtccgtctcaccaataatgtaagctctgtgggatatggcgcggccggtacttatttcatcctttcgggattgcaggcaaaactttcttatgagaaggcttaccggctgcctacgaacgaagaactttttggtgacgaagaccttgaactgggaaaaataggactgaatccggaaaaaagtgataacctcaatttcaatttgagctataatcgccaattgggtaaacacggtctgtatgtggaaaccggactgatttaccggaatacttccgattatatctatcgcagtatcgaaacaacgagcaaccgttcatacggctcttacagcaactatggaagtgttgaaacaaaaggctatcatatttccgcgcgttataattactcctgctgggtcagtatcggcggaaactttacacaaatggacgtgcgtgacaatgtggagaaaacgcagaccgggcaggaaagtctgacttatggcgcacgtatgccgaacttgccttaccgttttgccaattcggacatctctttcttctggcggaacctctggaagaaaggaaatacgctgaccgttacctatgacaatatgtatgtacatggttttccgctttactccgaagcattgggagcggtggaaaccaaagacatagtgcctacacagttttcacataatctgggcatcacctacagtctgaagaatggacgatataacgtatcgttcgaatgtaaaaacttcactgacgaaaaactctatgataacttcagtctccagaaagccggtcgtgccttctatgggaaagtgagagtgtacttcggcggaaattgaaacagaaagaattttaaacctgagagaaataaaaacaatttgattaactacaaatactcaaaaaaagatgaagaagaattttttgatgtggagctttgcaatggctctgttgacaggtacgctttgtacctcttgtgatgaaactgagggagccgttgctccggaagaaacgcaatccgtacagaagggaatagctattacctatctgcatgtgactgaccagatcatgaaaaacagagatgtcatccgtggcgaaaactttttgggaaatggcgagtacgttactttcgcaggtattcttgaagccaacaataaaatttataccgctcctattcctatgggactaagtgtatacgggtcggcttttgaagatggcaagtgggtgaaatatccggaactggtgaaaaccgaagacggaggcagcaacagctccagctatgagaaaggggaactgcagtggactcagtaccccaacgaagcatgggtggctatctacaacgatgaaaacttcaacaacccgacgctgatcaggacggacaaaatcagttatgcttgcggacgtatgcgttcacagtattatcagacgatttgggctgccgacaatggagacgtatatgtgttttccccgagttatgccaagatcatggatgccgacgtacagaaaaccaacttaccggcaggagtggtccgcatcaaagctggcgcgactgactttgacagctattactgtaatctggaagaactctcgggcggcaagtcattcctgcgctgctggcacatcaccggagactatttcttgttgcagatgtacacaggcgaaattaactcacgtggcacgggagctacgcgaatggctgtcttcaaggcgacaggaaatggggataagggagaactgtactatgtagacggactgcctgaaccggatcgtatctcttctttctccggtaccccgttttgtgagaacggcgtggcttatgtcggcgtcattcccattactgcagacggagaaaccaatcatccggctatttataaaattgatccggttactcatacggcaacaaaagggctgactgtcaacgctaccggaatcactgcgataggtagacttgccaaggattcgcactcaacttacgtcgtatcggctaccgtaacatcggccaacagtacagccaactacttactggctacctcgactctcgaaagtggcagtgtaactcccggcaacaataacggatttgaaactgctaccggtactgcctggattttctacaaagaccaatatctgtatcgcctccaatacaatcagggaaatgaaggtgtaaccacagcttatgaactgaatacaaacggcggtattgcgaaacgttcgaacgaatatacgattacccgctttaccacttacggtatttttggagaaaatatcatctcttcatcagctgttgacgctactttcacagactaaatgttgaatattctttgccaatcatgaaatcagcaaggttgtgccaaaagtaacccatacaaatacaatgagaaagttttttcgaaaaattcatttgtggctctcagtccccttcggaataataatcacgcttatctgtttctccggcgccatgctggtgttcgagaatgaggtaaatgaactgatgtggccggaactttactttgtgaaacaggttgaggcagctccgttaccggttgatcagttgttggaaaaggtggctgccacgttgcccgacgatgtttctgtgtcaggtgtcagcatttcctctgatccggaacgcacttatcaggtgagtctttccaaaccccgccgttcttcggtgtatgtcgatcagtatacgggcgagattaccggaaagaatcagcgcagcggtttttttgcgtttatgtttcggatgcaccgctggttgctggatagtatgaatccgggaggtgaggggattttctggggaaagatgattgtaggcgtcagcactttgatgtttgtcgtagtcttgatttccggaatcattgtctggtggccgcgtacacgtaaggcattgaaaaatagtctgaagatatcgggcacgaaaggctggaagcggttttggtatgacttgcatgtggcgggaggaatgtatgcgctggttcttctgctggctatgtcgctgaccggactgacgtggtctttcacttggtatcggacagccttttataaagtttttggcgtggaagtgcagcagcagggcgggcatgggcacgggcagaaagaaagcacttccaaaggagatgcccgactggctttgcaggatggaaagccgaaggctgaaactgaaggacgggagaatgccgaagaacgtggaagtggcagaagaggtcgtccggacaggccgcatcgagaaaaacaggaaggcttatccgcagattattcacaaagtgaacggcaggaaggcaacctgcatgagggcggcagacattggaaacaccagcaaactgaacagccaaagcctgttgtttctgcctttgcttattggcaggaaatatatgacaagctgagtcttcagaatccggcatacaaacagatcagtgtttcctccggtacggctagcgttgctttcgaccgtttggggaatcaacgtgctgctgaccgttattcatttaatacggaaaatggtgaatttacagagacgagtctttatcagcatcaggataaggcaggaaaaatacgcggttggatttactctgttcatgtaggcaactggggaggtatgacgacacgtatacttacttttttggctgcattagtgggcgcttccttgccgttgaccggttattatttgtggattaagaaaatgataaataagagaaagcgtgaaaagacgatcgctttatctgccgcggggaaaagagatattgcttgaaagaatgccggtatatcggttcggactcctggaaatagtgatagctttattgaaacaagaacggtggaccattgaatctctcattgcgtccaccgttctttatattaccttatatgaatgtattacctttattatatagaaagttctttcaatacattgaccagatctctcttgaccggcttatcattcttgatagctttgctgaatggtacgtagacgatttcatcgtgctcgatacctatcatcacgttgcgctggtcttccatgatagcgtcgatggcagcggcacccaaacggcttgccaggatgcggtcgtgagctgtagggcttccaccgcgctgcaagtgtcctaagatcgtcacacgcacatcgtattgcgggtattcgtttttcacacgttccgcatagtgcatggcaccgcctgtcagttcgctttccgctaccagtacgatactgctattcttggatttgcggaatccgttcttgataaattcttccagttggtcgacttccgtactgaactccggaataatggctgcttcggctcccgaagcaatggcgccgttcagagcgaggaatccggcgtcacgtcccatcacctctacaaagaacagacgttcgtgtgaagtggcggtgtcacggattttatctactgcatccagaatggtgttcaatgcggtatcatatccgatagtggtatccgtgccgtaaaggtcgttgtcaatcgttcccggaagtccgatacatggaacatcgaattcctgtgcgaagattcgggcgcctgtcagcgaaccgtcaccaccgatgatcaccaaagcatcgatgccttctcttttcatattatcataagccagctggcggccttccggtgtggtgaactccttacagcgggctgttttcaggatggttccacccagttggatgatattacttacgttctggctcttgaactctttgatttcgcctgtcaccagacctttgtatcctctatatataccttttacttgtagtccgttgtagatagctgcacgtgttactgcgcggatggccgcattcattcccggagcatcacctcccgaagtcaaaataccgatacatttaactgttcccataacaatctttcattaattagtttgacgtggcaaatgtacaacaaaaagttgaaagcagtgtttcataagttttttttcgtgtgtcgaaaccattaaaaatattcaaattgtctcttctatctttctttttaatcttttatcaatagctggatatggtcatgtattttttccatcagccatttgggagtggaagtcgctccgcatacgccgatggatttcacattccggagtaaagtgggatcgatttctttctcattatcaatcagatgtgagttggcgtttactttcaggcattcttcaaaaagcatctttccgttcgaactctttttcccgctgacgaagaaaatcagatcgtgcgttgccgcaaattccctgagattgggcatacggttagctacctgccggcagattgtatcgtaatattcgaaagtggcatccggtgaaatgtggagtttgatgtattctacaatctcctgaaactcgtccagagactttgtggtctgtgagaaaaggcggatgcttttagtgaaatccagctttttggcttcttccgcactttcgatgacaatggcttgaccgccggtctgccctaccagtcccagcacttctgcatgaccgttcttgccgtagatcacaatttgcttttcttcaaaatcttccttccggaactcttgtttgatgcgcttttgaagccgcagtacgaccggacaggttgcatcgatgatttcgatattattcttgtgggcgatctggtaagtctccggtggctctccgtgtgcgcgaagcaatactttggcattgcgcaattgtctgaattcatcacggttgatcgtaatcagtcccattgccttcagcctttctacctcccggctgttgtgtacaatatctcccaggcaatagagcgtttctccttttgccagttcttcttccgccttgtggatggctgtgaccacgccgaagcagaagccggaaccttcgtctatctctactttaatcatacactcgatttctatcctctattcctttactactttcccgaattgttccgacagccattccttctgctgttcgatgctcagattggaattgtcgagcagcagagcgtcgtccgctttgcgcaatgggctcacttcacgatgctgatcgatgtaatcccgttgctttacgttctcaagaatttcctcgaaactgccttcctggccttttgctttcagttcgtcaaaacggcgttgggcacgaatctccggtgtggccgtaacaaatattttcagttccgcatccgggaaaaccgtggttccgatgtcccgtccgtccatcacaatccctttttctttacccatggcctgttgctgtgctaccatcgcttcgcgtacaaaatcgagtgcgctgatagggctgactttggacgaaacccccattgtacggattttattctctacgttcaccccgttgaggtaggtgtccggacgtcccgtctccggattggggcggaaagtaatccggatatcccggattgcttctttcagcttctccgtatcgataacgtctccgttaaatatcccgttttcaatactatataaggtgactgcgcgatacattgccccactatctatataaatgtatcctacttcgcgggcgagatctttggccattgtactttttccgcaggaggaaaagccgtcgattgcgattgttatctttttcatattatctgcttcttatatttgtccgccaaagatacgcttattttgaaaatcagccatagatttgactgtaaaagcaactgaatgagtatgaaagaattaaaaaagttaaaaagccggataaaaagatacaaagaaacggacggttatctgaaaatgtagtatatttgcccagagacacataggaagacacttttttttattaatcattatattaacaaaattatggaagttaaaaaatcacccaaggcagacctggaaggaaagaaatccacatggctgctgatcggttacgtggtggtattggcttttatgttcgtggcgttcgaatggacccagcgtgacgtgaaaatcgatacaagccaggctgtagctgatgttgtttttgaagaggaaatcattcctattaccgaaacccctgaacaagcgaccccaccaccacccgaggcaccgaaggtggccgaattgctggaaattgtcgatgaccaggcagatattgaagaatcaactaccatccttaatgaggataacacaccgaaagtggaagtaaaatacgtaccggtacaagtagttgaggaagagccggaagaacagactatcttcgaagttgtagaaaacatgccggacttcccgggtggacaggcagcattgatgcagtatctggctaaaaatatcaaatatccgactatcgcacaggaaaatggtactcaaggtcgtgttatcgtacagttcgttgttaacaaagacggtagtatcgtagatgcaaaagttgtacgcagtgtagacccgtatctggataaagaagctctccgtgtgatcaacacgatgccgaaatggaaaccaggtatgcagcgtggtaaaccggttcgcgttaaatttacagttcctgtaatgttcagattgcagtaatttgtaacactcatacatttaagaggctgcgaatgcagcctctttttattcattaatctttgttttcatcatgtttacagcttctcaattacttgataaaataaacaaccacctatctgaaattcagataacccggactccggaaggactctacgaaccaatcgaatacatcctttctctgggaggaaagcggattcgtcctgtattgatgctgatggcatataacttgtataaggaagatgtttcatcaatttacgatcctgctaccggtatcgaagtttatcataatcacactttgttgcatgatgatctgatggatcgttcggatatgcgcagaggaaaaccgactgtgcataaggtctggaacgataacacagctattttgtcgggtgataccatgctgatactggctttccggtatgtagccggttgtgcgcccgagcatttgaaagaagtcattgatttgtttagtctgactgcgttggaaatttgtgaagggcagcagttggatatggaatttgagtcgcgcaacgatgtggcggaagacgaatatattgaaatgattcgtctgaaaacggctgtattgcttgccgcaagtctgaagatcggtgcgattctggcaggagcgtctgccgctgatgcggagaatctttataattttggtatgcagataggggttgcattccagttacaggatgatttgctggatgtttatggcgatccggaagtgttcggaaagaaaatcggtggagacatcctttgcaataagaagacatatatgctgatcaaagcactggaacgtgcaaacggagaacagctggaagaactgaatcgctggctgaatgcagacaactgtcagccggcagaaaagatagcggcagtgacggagatttataatcagttgactatccgcagcgtttgtgaaaacaaaatgcgcgaatattatacgctggctatggagagtcttgaagcagttgcagttgcagaagagaagaagaaagaacttaagaatttagtgaaattactgatgtatcgggaaatgtagtaaagttggtgggaaatgccttacagacgattgccaaatacggatcaagccagagtacgggcgctgaaagcagcggtcgagaagggtgacgtgtataatgtgcgggacttggctatctcactgaaaacattattcgaagcccgtaattttctgctgaagtttgaagctgcgcagatttactatacccaatgttatgacaaccagtcgagagccagtcgcaagcatcaggcaaatgtgcggatggcacggctgtatatatcccattttattcaagtactcaacctcgcggtgcttcgcgatgaaatcaaatcggtgcataaagaactttatgatcttccggaagcgaatgtggtaccggatttattaagcgaagcagctttggtagagtgggggagaaagatcattgaaggagagcagcggagaacctcacaagggggaatccccatttataacccgactattgcgcgcgtaaaagtgcattatgatatttttctggatagctacgaacgtcagaagagttaccagtccgccaccaaccggagtctggatgagctggcttcgatgcgtgaccgggcagatgaactgattctggatatctggaatcaggtagaaacaaaattccaggaagtgaaccccaatgaagcccggttggaaaaatgtcgtgactatgggctggtatattactaccgctccaacgaaaaagtaaaagaagaaagcgaattgtcatgttaatagatactcattcccatctttttttagaagaattttccgatgacctgccgcaggtgatggaacgtgcacgtcaggcaggtgtttcgcgtatttatatgcccaacattgacagtacgacgattgaacccatgctgtcggtttgcgcggattatccggatttctgttatccgatgatcggactgcatcctacctcggtgaacgagtcataccgtcaggaactgtcaatcgtccgggagcgtctggaagcacccaataactttgtagccattggcgaaattgggcttgatttgtattgggataaaacctttctgaacgaacaactgtacgtttttgagaaacagatagaatgggcgctcgaatataaattgcccatcgtggttcattcgcgggaggcattcgactatatatataaggtaatggagccctataaaaacactgctttgaccggtatttttcatagtttcaccggaaatgccgaagaagcggcccggttgcttgaatttggcggtttcatgttgggaatcaatggagtggtcacatttaaaaagtcctcactgccggatactttgctgacagtgcctttggagcggattgtgctcgaaacggattcaccgtatctgaccccggcccccaatcgggggaagaggaatgaaagtgcgaatgtgcgtgatacgttcctgaaactggtagaaatttatcggaccaccccggagcacctttcacaagccacttccgaaaatgcgctaaaagtgttcggaatggtcaaataaggttccaaaggttttaaattatattaatttgcagtatttatttaagataaaaaagggataatgctttaggaaaagaaaaaaaaggatacatttgtagctgaaaatgcggaaaactcataaggagaggtgctcgagtggttgaagaggcacgcctggaaagcgtgtatacgccaaaagtgtatccggggttcgaatccccgtctctccgcagaacaaaagttgaaacgtgaagtaaatacaataaataataatc

SEQ ID NO: 60 - DNA, 46593 bp, Bacteroides thetaiotaomicron
agcaaaatatcttactttataacacataatctaatattactattatgacacagcacttcagatatacgacattggtacttcttacaacattatctaccgtttatgcctccgcacagtctctgcgaaaattaatggaaatgtctccgcgcattattgaatcgaaatgggagcaaactccggaaggaggaacagaattaaactattacaacggagacctgtgcagttactaccttttccgcgaaaatgatcgttcatacaatttgaaccccggaaagaacacggtattcagaatagagaaaggctccaatgccagcaattctttcaagacttcaagcaggtatatgttcttccgcggtcaattccccaaagactttcagatcagtactccttatgcacttcctgtaaagaccggcgaagaaacacaatggcagatcgctcctcaggaatctgccaaaactatgatattccaaattcaggaaggagacaccgtctatgcaacccgcagaggagtcgcctgtgcgacagtgctgccacagcaattgttgatataccaccccgaccatacctttgccgcttaccttatgatgcgtcaaaacttcatccagacgggtgaagaagtcatgaccgggcaacccattgggatagccggagtactcggagtatccatctcttatttttttcttgataacaataaattcgatgcaaacggcttcttaggttatccatattctcactttactcctgtattccgcacggacaagggggatgtaaaactggaggagaaaacagcctataaatctgccacagatgatgaactgattatgctcgaaatgagcaaacgtgaaaaaaagaaatttcagaagcagaaatactcaaaataaagggaaacaatatgcgtatattttatcttatcctctgtttcatctgcctttgcgacctgctccatgcgcagactgtaagaatctcttatgaaggcgacccgcttacggacaaagaacgccggaagattgaacagaccctccaatatgaagtcgaattttatgcacaattcggacttcccgatacgcttaatcttcaattgactgtattcaacaaaagggaagatgcgctggtctatctgaacaaattcaatatacatcctcccaaaagtacaaacggaatgtatatatccagattacaaaaggccatcatattaagcagagaaaaagaataccaacaaggtctgggcgtcatctatcacgaactgagccatcacctcaccttgcaaatcacggcaggacgtcctccgatatggttcaacgagggacttgccgaatattttgagcattgtaaagttaataaaaaaggacttcagcacacgtttaccgattacgaaaaaggaagaatccgcactatatatatgttgggggacattgatctgctcacctttatcaacagccgccaaaaggaatttatgaagcagcaaagaaccgacgaacaatacgcctatatcctctctcatgcactcgtcactttctggatcgagaaagttccccggcagatattacgtgattttgtactctcctttcaaaacaaagatgactcatccattgtttccgaacggatagataaggtttacaccggagggttcaaacaatttgaaaaagattttgaagccttctgcaaatagttttatcttttttctatctttgcaccggctatgggattagcctttaaccgccctttggagctgatgatccctacaatttgaatgtataactcttaaattgtcagcttatgctcaagactttactctttatcggtatgggaagttttaccggaggcgttctgcgttatctcatctcgcgttacgttcagaatttcttgacaccttccttccctttgggaacacttctggtcaatgtactcggttgtttcgccatcggcctgttttacggactcttcgaacggggaaatctgatgaaccccaatctgagaatgtttctcaccgtaggattctgtggaggattcaccaccttttcaaccttcatgaatgagaactttcagttaatcaaagacgataatttcttctacctctcactctatgtaggcctcagcttgtttgtaggattcattatgctgtacttgggatattcacttgtaaaacaataaacataacatatctacatcatatgatcaaaagaaatgcagccaagcccgtccgtgtggctcctcccatgatggaggaacaggaagtcagtacaagcaccttgcaagaactgctcgaaaaagaggaaaccgtctcaaatctcatattcagcaaaggaagagaagagggaatcagcaagtcttacaagagtttcaagaactgcactttccggaatcagacattcagcgaatgtaaattccgttcttctcagctggcagatatacggtttgagaactgcgacctgtccaatatatcttttgcagaaagctccctttaccgggtagagttcattgcctgcaaattactaggaaccaacctttcagagacgaccatgaatcatgttttattgcatgactgtaatgcctcttacatcaatctggcgatgagcaaaatgaatcaggtacgcttctcgcactgccatttccggaacggaagtttcaatgactgccgtttctcttccgtcgccttcgacagttgtgatttggtagaagctgacttttctcatgctccgctccgtggaatcgacctgcgtacttcgcgcatcggcggaataacacttaatatcagcgacctgaaaggagctgtcattacttccttgcaggccatggacttgcttccgctgttgggagttattatcgaagactagaattctaccaatttcatccatccgcattcaaacaaaaagcatcgtcacattgttatttaataagaccggactaatgacatctagggagtatgattcgaaagaatacctatttatagtgattttccactctctgtcaagtccgtacttttgcaaaaatattattcaaaacaatagaaacgatgaaaatagaaaaaattgtagctcgagaaattctcgattcaagaggtaaccccacagtagaagttgacgtagtattggaatcaggtatcatgggacgtgcgtctgttccgtcaggtgcttccacaggtgaacatgaagcactcgaacttcgtgatggtgacaagcaacgttacggtggcaaaggcgtacaaaaggcggtggacaatgtaaacaagatcattgctccgaaactgatcggtatgtcttctctcaaccaaagaggaatcgactacgcaatgttggcactcgacggtactaaaaccaagtccaatctaggtgctaacgctattcttggcgtatctctcgctgtagccaaagcagcagccagctatcttgatctccctctctatcgctatatcggcggaacaaatacatacgtaatgcctgtaccgatgatgaatatcatcaatggcggttcacacagtgacgctcctatcgcattccaggaattcatgattcgtccggtaggtgcaccctcattcagagaaggtttgagaatgggcgccgaagtattccacgctttgaagaaagtactgaaagatcgtggcctcagcactgccgtaggcgacgaaggtggtttcgctcctaacctcgaaggtacggaagatgctctgaactctatcatcgcagccatcaaagctgccggatacgaaccaggtaaagacgtaatgatcggtatggactgcgcttcttccgaattctaccatgacggtatctacgactataccaagtttgaaggtgccaaaggcaagaaacgtaccgccgaagaacagatcgactacctggaagaactgatcaacaaattcccaatcgactccatcgaagacggtatgagcgaaaacgactgggaaggctggaagaaactgactgaacgtatcggcgaccgctgccagttggtaggtgatgacctgttcgttacgaacgttgacttcctcgcaatgggtatcgagaagggatgtgcaaactctatcctgatcaaagtaaaccaaatcggttcgctgaccgaaactctgaacgctatcgaaatggctcaccgtcatggctatacgactgtcacttcccaccgctccggcgaaacggaagacgcaacgattgcagacatcgcagtagctacgaatagcggacagatcaagaccggttcattaagccgttcggaccgtatggctaaatataaccaactgctccgcatcgaagaagaactcggtgacttggctgtatacggatataagagaatcaaataatctttattctcttttcagatatctttcccccgggcaatgtgttgtccggggatttttttatatatttgatgacttacaaacgacctgaagcattttgctacgtatcatatagtaaacaggaataaataatgatgaatcaggaaaaaatacaggaactggtcagccgaagtcagcaggacgacaaaagggccttcgccctactggtttcagaattccagccactggtattccgactagctttccgtttactttgtgatgaagaggaagccagagacataacacaagaaacatttgtaaaagtatggttatccctgaaaacgtacaatcaggaaaaccgcctgtcaacctggctttacaaaatcacctgtaacacctgttacgaccgtttgcgttcgttacgccattctccgctggataatgaatccgccttttccgattcggtaaatattccttctgacgatcatattgagatatctctttccaacaagcagttgaaagaactgatattgcgatataccaacgaactgcctccccagcagaaactcgttttcacgcttcgggatgtcgaagagttggaggtagcagaagtacagattatcacaggattatcgcccgaaaagataaaaagtaccttgtaccttgccagaaagaacatacgtaataaaatgaatcaaatagatcccgacttatgaaacaagaagataaacagtatgaaaaatggctgaccgaagtcaaaagtaaccagccgatattggaaaatccggaggaactgaccgctaccatcctcaacagaatatccgggatctcaccggaaaggaaacggagaaagtttctcataggagcatgggcatccggcattgccgcctcattattactcctgctattcatcaatgacacttgcttcacttctgtccctcaccggacagaaatgcaaaatgaatatgataactggtcaaacagcattccattacctgacaactgggaagaaatgcgactgctggaaaagaatacttatctatcctctcaatatatacaacaccggaaatcccggaagatgcaaatcttacaagtcatcaaaaaaaaacgattaaaatagacagaatatgaaaaccaactatttcttaataaccatgctactgttacttagcatgacttcttgcagcacctattatcggatgacttcacgggttgaaagggacggaagtatgtacagagaaatctatgcacaaggtgattccgctttcatcgcaggagataagacacataatccatttctgtttcaaccgaatgccaactggcaattagtaaatctagactctacaattaaattcaacttctggggcgaagaagaaaagctgaatgtaaaagcctgccaaaaactctccggagtagatggagaatacttcactgttgacaaaggtaaagagcatctgagtgccatggctatacctatggaacgggtaaagaagagtttcagatggttctatacctattatatatataccgccacttacaaagaacttcaggacaaaggtcctgtacctcttgacaattatctgaataaggaagagcaaatgatttggcttcatggaaacgatgatgccttcagaggcatgaacggcatcgaaatgaatgataaactggataaactcgaagctaaattcggagaatggtataaccgcaatgtctatgagatcaattgggaagtcatccgccacttcacttctttacaaggagataccgcttgcctgcagtgtctggaggaattgaaagattctgtctacaagaaacattcgtcagaaaaaggcgacagtatgggagacgctgatatcgaggaggtctgcggtatgtttgataaagcttgcagtacgaaatacttttcggacctttataaaacaaataaagaaatgatggatgccctgtgcgaagagaaaatcaacatcgccgaagtcttctatcatgctatacaatttgagttgacactgccgggcagactgctcacctctaacgccaaagttctgaaagataatgtagtcatttggaaaatagacggcttccggcttctcgctggtgattatatacttaccgcagagtcacgggtcattaattactgggcattcgggattactttattcatgatgctgtttgtcttaggaattttcatcaaattatacaggaggagatcataaaagcagtaacaaatagcatcgtcgttttcagactcttgcagcagtcctcaaccggatgattgataatcatactgtatagcagataagccttttcgtttcatcaagtaaatcattccattcatcagattaatttgagtacgcgaaaccatcagggtaattttgaggtcagaaatcaattaaactatttaaatgatgaagactcttaaaatctatttcctgcttatgctgctgattcagacaatcagcatatccgcacagtcagtcatatcgggtaaaataaccaataacgacagttcacccatagtcggcgcgacaatattgttatcaaacggtatggactctacctatataacagggacgacctccgacttggacggacgatttaaaatgataaatgtcaaatcgggcaattactttctttccttgtcaatgatcggatataagaaagcaaatatccccctgcagatcaaggaaagcatgaatctggaattgggtgacattacactggaagaagattcttatatattgtctactgtaaatataatcggcaagcgccctccaatcaaggccgaaccgggaaagatgacagtcaacttatcatctgccctattgagtacggacggtaatatactggatgcactgagaaaactaccgggagtaatcgttcagaatgacggaacaattattcttaatggcaaatcaggggcgaatgttttaatggatgataaagtgacctatttatcgggagagaacctcatcaattacctgcgctccatccctgccagttctattgaaaatatagaactgatatcccagccatcatcaaaacacgatgcttcaggcagttcgggcatcattaacattcaaaaaaagaaaatcaaagaacaaggtataagccttacagcttcctccggtctggaacaaggaaaacatactaaagggaatgaaaacctgactctgaactttcaccacaataaattgaatatgtatgccgactattcttattattggggaaaagattttatagaactatcggtttccggtcattacctggatccgatgactttaaaacctcttgaactgagaaaagattttgatagtgatataaaccggcaatacaaagggcattatatcaaaacaggggtcgattatgacttgtcggagaagatagccatcggaacatacttctcatcaagctggctcaataggaacaaacaagaagtgactgtatctgacttttttaataacgacaagactcaaagcgactcaaccttaacagcgttaagcacaccggactatagctacaccaatatcatagggggagcgaacatgatatacaaatttgcgaaaacaggaaaatgggatgcttcttttgattatcagctttttaatcaagaggataaccatctgctgaaatccttttttcagacaggtattcatccggtaaaaggagacacattgtccggtataaccaatggggacattaaaatatacagcggacaaactaatttgagctatgatatctctgacaagttcggaataaccaccgggctcaaatcggttttcgtacatataagcagtgatgccttatacaaaaacctgattgccggtgattggagagaagacagtgatctcagcagtagttttgcttatcatgagaatatctacgcagggtatcttcagctaaacgctaaatggtctgccagattttcaacagaaataggcttacgattagaaagtacatatacaaaaagcaattataattcagccgttcaggactcggtattcaaccaaagctatgtacacctcttccctactttgatggttcaatatcagctttccgaaaatcataatttgtctatggcatacagccgtcgcatcgtccgccccaattacagaaatatgaatcctttcgttgaggtcagagaccagtttttatatgaacaaggaaataccgaattaagaccagaactaatagataatatagaaatctcatggctactcaaaaaacgatattcattcaatgtattctactctcacaggagtgatcctatctcgttaagttttttagtcgaagataataaccgtgtcttactaatgccgcaaaatttatcaggcaataactcattcggagtaagagccggcttgaataacctaaaaccattccaatggtggacatcccatataaacggatctttaacttataagaaattcagttgggcaacacttgggaaaacactaaaaaatgaagtgacaacacccatgctacatatcagcaatcaatttacattaccatacggctgggatgcggaagccctcggattttatagtggagaaatgattgaaggacagaccagagtgaaacctttatggacaatatctctcggagtccgcaaaaacctgtgcaataacaaatttagtttgtatatttacgcacatgatatatttcattcgaaccgcccccatgtaagtatggagactaactatctgtattacgcgtctcaggaaaaaaacgacagcagaatgataggcatatcgctcagttatcgtttcaatcgaggcaaagagattaagaaatctcagaatgaaaacagaatagaagaaagtaaacggataggtttgtagtatcaaagattaaaatagcaactaatgaacttaaagtacgaatggattaacaccctatttataatactgccactttccttgtgcgtatttattattgtagatatcgcttataatgagcgaatatgggaactggatacttttgccgtaaaagcacgtttacaggcattgggcatcactgttgcttacttctatcttttaaactatatttttaagcgggtagcccgcttctttatcgacaaaagcaaagatgagaagaaagcaaactggaaagaatacgtatgggtgtttctgataaacttcgtcttcctaaatatcatgcatacattcattatgttttgcataacgatggccgggactttcaaatggggcgaatcggcattgatcaatgtgacaggagctctcctggcgtttctatattatataatgatacgcaatagaattttattcaagagtcttatcgagcaaagccttcaattagaaaaagtaaaagtcgaccaactggagaccgaacttaaatttctgaaatcccaatatcatccgcatttcctgttcaatgctttaaataccatctattttcaagtggatgagaataacaaagtagccaaacaaagtatcgagcagctctccgacctgttgcgatatcagctttatgatatagaaaaggaagtgacgatggaacaggaaataaattacctgagatcatatattgcctttcagcaattgcggatgagcgaaaggcttatgttggatttatatttcgacccgcaactaaaagagcaaaaaatacatcctttattacttcagccactgatcgagaatgctttcaaatacgtaagaggagattacaaaataaaactggaaatcaaagttgacggaaaccagattcagtctgagataaaaaattcaatatcctcctccccatctactgccaacaaaaaagagaaagggataggcattgagaatttaaaacgccggcttgaccttctgtatcctgaaaaatacagcttagacttcaaacaaacagaccatatgtttatcgctaaattaaccataaacactgattgatatgaaaataaaatgtatcattacagatgatgaacctatagcaagaaaaggcttgcgagggtatatcgaaaaagtagatttcctcaccttgaccggagagtgtgaagatgccgtccaactaaatacaatactgaagacccaagaaatagaccttctgtttcttgatatcgaaatgcccgaaatgacaggtatagaactgttgtctaatctaacaaatccgcccaaagttattattgtatcagcttatgaacaatacgccctaaaaggatatgagtttaatgtagtggattatcttttaaaacctgtatctttcgatcgttttatcaaatctgtcaacaaaatctacgatttgttacaaacggagcaaaaagaaaagaatgattatatatttgtgaagagcaacaaactattaaaaaagattctgttcaaggatattctctacattgaaagcatggaaaactatgttgtcattcagacagtctcatgcaaggaagtagtgtatactactctgaaacaactcaatgattcattgccgaaggatgtttttcaacagactcaccgctcatatattgtgaatcttgaaaaggttactgctattgacggcaatcagctgaccctctcctcttacaaaataccagtagcccggaccttcagagacagtatcttcaacctgatactgaataaccggctaataatcaaaagctaaaccggagcgacacaggatataaaagaaaaagcatccaagtaaaatacctgaatgcttttttctttctgagcctcttgtcggattcgaaccaacgaccccgagattacaaatcacgtgctctggccaactgagctaaagaggcgggtgggtaagcttactatatcgcgccgctacaaccaactacctttgctgcgatcaagccctggaggattcgaagggagctggccgtataggacttacccgttttgcggttgcaaaggtaggcatttttatggattctgcaatagctgtaggtaacttttttgcataaaaggaagtaatactctacgtttcaagcaattaaaaatcaaaaaaaatattcgagtgccaacttttactgctttattaactttaacaaccatattccctttaccaaccgatattatttgtacctttgtgcgcaatttattaacgaagatgacagagaacagaagctatttacagaaatatgccatgcactttggcacgtatatgggaatctattggatattgaagttcattttatttccgttgggatttcacatccctttcctttcactattatttgtaatcctgacgttggcagtgccgttcattggttatcactacgtgaagatgtatcgtgacaaaatatgtggaggaagtatccaattctctcatgcggttctctttaccatattcatgtatatgtttgcttccctgctggtagccgttgcacactacgcctatttccagttcattgaccacggctttatcatcaactcctatatccagttatgggacgaactgatgactaaaacacccgctttgatggaaaatcaagagataataaaagaaacgatagatactgcccgttcacttacttccatcaatattaccatgcaactcctgtcatgggatgtattctggggaagtttactggccattcctaccggattgatggtaatgaagaaagcacgaccggaaaacaataccccggcccaatcataattcgtaattcataattattaaaaatgaatatatcagttgtagtcccattattcaatgaagaagagtcactgcccgaactctacgcttggatagaacgggtaatgaaagccaacggattctcattcgaagtgattttcgttaacgacggaagtacagaccgttcatgggaggtaatagaaaaactcaaggcccaatcggactgcgtaaaaggcatcaagttccgccgcaattacggtaaatcacccgcactctactgcggatttgcagaagcacaaggagatgtggtgatcacaatggatgccgacttacaggacagcccggacgaaataccggagttataccggatgattacggaagacggatacgatctggtgtccggatggaagcaaaaaagatatgatccgctatcaaagacactgccgacaaagttattcaatgctaccgcacgtaaagtatcaggtattccaaacctgcacgacttcaactgcggtctgaaagcctatcgcaaagatgtcgtgaaaaacatcgaagtatatggcgaaatgcaccgctatatcccctaccttgcaaagaatgccggattccagaagataggtgaaaaggtagtacaccaccaggcacgtaaatatggctctaccaaattcggattcaaccgtttcttcaacggatatctggatttgatttctctttggttcctgtctaaattcggagtgaagccgatgcatttcttcggattattaggatcgcttatgttctttatcggaatgatctccgttatcatggtaggtgtcagcaaactgcacgcaatgtacaacggtctcccctaccggcttgtaaccgattctccttatttctatctatcgctcacagcgatgattatcggtacacagttattccttgccggattcctgggagaactgatctcacgtaatgcccccgaacggaacaattatcagatagaaaagaaaatttaattcacgcccaataaccgattatgaagaatttaattcgtatctttttaatagtagtaattgttggtgcaggtataagcatcggcagttcgtgttcggacgaaaatgattgctcgctggcgggacgccccatgatgtactgcacattgtacacaattgacgagataaccgatctcagggtaaatgacacactggactcattaacaattacagcattgggaacagactcaatcattctcaacaaccagaaaaaagtacatacgctgatgttaccgttacgctataccagcgatactactgtatttatactctggtacaatccgaatagtcctactaacaaaaaagatgttgatacattatatattatacaaaaaaacacaccgtattttcaatcaatggaatgcggatatatgatgaagcagaacattctcagtaccaaatttggaaataccaaaaatagttcggaaagaatagattctctacatatacaaaataaagaagccaatacaaatgaaattgagaatttacaaatattctatagatatcgcgaccgcacgcctcctacgattgagtagtgtgctactcctcttttgtattggaatcccgacaattgctcaacaacaacgaccgactcccgtacaaaaaagagaccagaagaagaaagaggctgtagtcgataccatcccgttttataatgggacgtatgtcggtgtggacatatacggcatcggaagtaaaatgctaggtggcgacttcatgagttccgaagtcagcataggcgtcaaccttaaaaacaagtttatcccgaccatcgagtttggtatgggaggaacagatacatggaatgaaacgggaatacactacaaaagtaagaccgccccattcttccggattggtgtagactataatacgatggcaaagaaaaaggagaaaaacagctatctatatgtaggtctccgctatgcgttcagttcattcaagtatgatgtatcgaccctgccggttgacgatccgatttggggaggaagtatcggaaatccgagtctggaagacgactactggggaggaagcgttcctttcagtcatttagggatgaaagggtctatgcagtggtttgaattagtggtaggtgtcaaagtacgcatttacaagaatttcaatatgggctggtctgtacgcatgaaatataagacaaatgcttcgaccaatgaatacgccaacccttggtatgtgcccggctacggaaaatttaaatcaaataacatgggaattacctattccctcatttacaaattacctctttaaagaataatgacaggactagagatttggctgcttgcaataggcttagcgatggattgtttcgctgtttcaattgcaagcggtattattttgaaacgtactcaatggagaccgatgctggtcatggctttggcgttcggactttttcaggctctgatgccattcattggatggatgtttgcaaagactttcagccacctgatagaaagtgtagaccactggatcgccttcgctatccttgccttcttgggcggacgtatgattcttgaatcttttaaagacgaggactgccgtcagacatttaaccccgcaagtccgaaagtcgtattcacaatggcgatagcgacaagtatcgatgcactggcaataggcatctcctttgccctgctcggaatcaacaactataccgaaatcctctctcctatccttatcatcggattcgtatcattcgtcatgtcgctcattggcctttacttcggtatcaaatgtggttgtggatgtgcacggaaattaaaggcggaattatggggcggcatcattctagtcgctatcggattaaaaatattgatagaacatctattcttacaataataagcattggttcctctaataaaaaaaacagaaaaacgtatgaaaacaaaaaagagtttcctttggctggccttcctcatcttggcaacgatctggatattagccagacgtaaccaaaaagcagagtttaataccgccagtggttttgtgtttgggacagtatacaagatcgcgtatcaacatgacgctgatctgaaaccggagattgaagcggaattaaaacgtttcgaccagtctctctcaccgttcaatgacagttcggtcattagtcgcgtcaatcgcaacgaagagttggtgacagacagctttttccaaacttgcttcaaccgttctatggaaatctcccgtgaaacaaaaggagcttttgacataacgatagcccctcttgccaatgcctggggatttggctttaagaaaggcgccttccctgattcattgatgatagacagcctgctacagattaccggttacgaaaaagtgaagctggaaaacggaaaggtagtcaagcaagatccgcgtgtaatgttaagttgcagtgcggttgcaaaaggctattcggtagatgtaatagcccgtctactcgatcggaaaggaatcaaaaactatatggtagatataggtggtgaagtagtagtaaaaggtaaaaatgcgacaggagatctgtggcgtatcggaataaacaagccgtacgacgactcattagctgttaagcaagatatacaagtagtactcaacctgacagatttaggtatggctacttcgggaaactaccgcaactattattataaggatggcaaaaagtatgctcataccatcgaccccagaacaggttatccggtacagcacagtatcctatcttctactgtgattgccgaagactgtatgacggctgatgctttggctacctctttcatggtaatggaactggaagaagccgaaaaattctgtaaagcaaatcctatgatcgatgcctactttatatatagcggcgagaatggagagtttaagacttactatacggatggtatgaaacgatatatgcctgatgccaaatagaaaaatgctttacaaataagcatataaacggaggctccatttcatacgaatagagcctccgtttatataaaacagcacctctgttgaagccaaacgaagcctctgtttcagagtggctgaaacaattatttcataaacacaaaataaacagctgcaatcaggcaaacaaatgctgccagatggttccagtgcaatgtttctcccttaaagaaaacagtggtaaaaacagtaaatataatcaaagtaatcacctcttgaatcactttcaactgcatcagcgagaatggaccgccattcccgacaaagccgatacgattcgccggtatttgacaagaatattcaaaaaatgcaataacccaactaaaggtaatcacacctatcaacggaagagcagcaaaccaagaatactcttgtttcatctttaaatgcccataccatgcaaaggtcataaagacattggatacaatgagtaataaaattgtatagaaacctttcatcttattatatactaaaattagtaattatcagtctattttatccggcaacaattcttcctgcacattcgtcatgctcccccacaagctgtagcgagcttccggattcatcgcttccaactgtcgcagaatacccttcatatcacttcggctggactgtgattcataaggacaattcttcacttgtttccggtagtcatgcaatgcagccagttcaatcagatcagcctcgtgcaccatacacatcggtcggataattgtcatatcaaatttcttcatcaccaagcgaggcggcatcgtactgaatgccccctgataagtaatgttcatcaacaatgtttccaaaatatcatccatgtgatgtcctaaagcaatcttattgcatccttgctccttggcaaccgtaaacagagctttccgacgattccaggaacaaagaaagcagggagacttgcgcgtatccgtagcaggatcaaaggacgtttcgtactgcacaaaaggcactccaaaagagtcacaatatgctttcagatattcagtatcactttggtaaggaatattattcatcaccacatggacagctatcacagaaaaccgaggcttataaatacgcgcccgcttgcccagcaactctacaagtgccaacgaatctttcccgcccgacagtccgataaggattttgtccccttcttctatcagtcgatactgcaccactcctttattgaatcgccgttcaatacggcggatcgtcttctcttcttccgtaaattgtgtcatatcttcaaaaatcggctgcaaaagtaagcgaaaagaatgatttaaagaagaattaacataatagaatctctgaaaaagggtttatttctaataaatttgtacttttgaacaattgatgcatggattagtgaataaaacaatgaaaagaaaatatattctatttataatttgcagtttcttcctcggaggagtatctgcacaaacattggaacaggcacgcaccttatttacaaaaggtgactacgaacaagccaaacccgtatttcagaaatatgccaaatctcaaccatccaatggtaactacagctattggtacggtgtctgctgcctgaaaaccggagaaccggaagaagccgtgaagtatctcgaaaccgctgtaaaaagacgggtagccggtggacaactctatctgggacaagcttacaatgatacttatcgtttcgaagatgcagtcaactgctttgaagaatatatcgccgacctcagcaaacgcaaaagatcgacggaagaagctgaagctctattggaaaagagcaaagctgacctgcgtatgctcaaaggagtagaagacgtgtgcattattgacagtttcgtggtagataaagcaaatttcctgagcgcatacaagatcagtgaagagtctggcaagctatttacattcaacgaattcttccagaccgaaggagatcatccgggaacagtttatgaaacagaaatcggtaataaaatctattatagcgaaaagggagaaagaggcaatctggatatattctccaaaaataaattactgaatgaatggagcaacggtcgcccgttgcccggcagcatcaacgaatccggaaacgccaactacccgtttgttttatcggatggtgttactatttattatgcaaccgatggcgaaggactgggaggatatgatatttttgtcactcgttacaacacaaatacggactcttatctgacgccggaaaatgtgggaatgccgttcaattcaccttataatgattatatgtacgtcatcgacgaatacaataatctgggttggtttgcctccgaccgtttccagcccgaagagaaagtctgcatctatgtattcattcctaattcgtctaaacagacttataattatgaggcgatggacccgcagcagatgatccgtctggcacagattcattcgctgaaggaaacttggaaagatgaaaatacagtaacggaggcactgcaacgtctgaaagaggcaatcaatcataagccacaggaacgtcgtgtggttgatttcgagtttgtcatcgatgatagcacgacctattatcagttgagtgacttcaaatcacccaaagcaaagctactgttccaaagttaccggcaactggaaaaagattatctgcaacaggaagataaactgaacggtctgcgccagcaatatgcaagcgccaatcaacaaggaaaagaaaaacttgctcccgcaatccttgatctggaaaaaagaattctgcaaatgaatgaagagctggatgctcttggagtaagtgtgcgtaatgccgaaaaaacaaaatcaaaataatacagagttatggacatactgattatcaccgttctcatcattgctgcagtaatactatttttggttgaactgtttgtcattccggggattagcctggctggcatttcagcacttgcttgtattctctatgccaactattacgctttcgccaatctgggtatggcaggaggatttatcactttagggatatcggctgtcgcctgtatcggctcgcttatctggttcatgcgttcgaagatgctggataagctggctttgaaaaaagatattgactcgaaagtagaccgcagtgcggaaaagagcgtcaaggtaggcgacacaggaatcagcactacccgcctggcacaaatcggttatgctgagattaacggtaacatcgtggaagtaagatcgatagatggcttcctcaatgaaaaaactcccatcattgtgagccgcatcactgacggtaccattctagttgagaaacacaaaatataatattcacttaatataaattatcaatggaaacatctttgtacttacctatcgttctgattgttggaggtattattttcctaatactatttttccattatgtgccgttcttcctttggttgtcggctaaagtatcaggcgttaacatctcgttgattcaactcttcctgatgcgcatccgtaatgttccgccgtatatcattgttccgggcatgatcgaagcccacaaagccggattgaagaacatcacccgtgatgaactggaagcccactaccttgccggaggccatgtagaaaaagtagtacatgcgctggtatccgcatcgaaagccaacattgagctgtcattccagatggcaaccgctatcgaccttgccggacgtgatgtgtttgaagctgttcagatgtctgtaaacccgaaagtgattgatactcctcctgttactgcagtagccaaagacggtatccagctgatagcgaaagctcgtgtaacagtacgtgccagcatcaagcagctggtcggtggtgccggagaagataccatccttgcccgtgtaggtgaaggtatcgtttcctctatcggttcttcggaaaaccacaagtcagtactcgaaaatccggattctatctctaaacttgtactccgcaagggattggatgcaggaacagctttcgaaattctgtctattgatatcgcggatatcgatataggtaaaaacattggtgcagctttgcagattgaccaggctaatgcagacaagaacatcgcacaggctaaagcagaagaacgccgtgcaatggctgtcgcttccgaacaggaaatgaaagctaaggcacaggaagcacgtgccaaagtaatcgaagcggaagcggaagtacctaaagcaatggcagaggccttccgtagcggcaatctgggtataatggattattaccgtatgaaaaatatcgaagccgatacttcaatgcgcgaaaacattgccaaaccaacgactggtggtaccaccaaccagcctttgagtaaatagtctaccaaacgctggaacccgattcctattcagttcatctgcgtatcttctctttgacaaacttgcaaaagaaaagaaagatacctcttccgaactaaaatccggttccggcgtttctatttatatatacgacttattgtaaaactaaaaccgttcaataacatgaaaaagtactttccatcctctgaactgattatcaacgaagacggctcggtattccatcttcacgtaaagcccgaatggctggcagataaagtgatccttgtaggagatccaggacgtgtagcactcgtagcttctcactttgaaaacaaagaatgcgaagtggaaagccgcgaattcaaaacaatcacgggtacatataaaggtaaacgaatcacagtggtttctaccggaattggttgcgacaatatcgacatcgttatgaacgaactggatgcacttgccaacatcaactttgagacacgggaagaaaaagaaaagttccgccaactggagttagtacgtatcggtacgtgcggcggcttgcagccaaatactccggtaggcaccttcgtttgttcacagaaatctatcggtttcgacggattattgaatttttacgccggacgcaatgcggtatgcgatcttcctttcgaacgtgctttccttaatcacatgggctggtcgggaaatatgtgtgcccctgcgccttatgttattgatgccagtgaagaactgattgaccggattgctaaagaagatatggtacgtggtgtaacgattgccgcgggaggcttctttgggccacaaggacgtgagctccgtattccgttagcggacccgaaacaaaatgataagattgaagcatttgaatataaaggctttaagattaccaacttcgaaatggaaagttcggcacttgcaggacttagccgactgatggggcataaggcaatgaccgtctgcatggtgatagccaaccgactgatcaaagaggctaataccggatataagaatacaatcgatacactgattaagactgtactcgacagaatataggataatatatccatcataacaaaatggcttgaatcatactctgtattgtatgtttcaagccattttttcattaatatccaatcgtaaatctctcttggtgatgcttgggatgttccaactcatcgatcattgcagccgcatagtcttctacagaaatatggctgttacccacgatatccacaatcatatcatctttgcccaaacggtaacgtccggtgcgtactcccggcctcatatctgctgccggagagaaaaatacccagtcaatctctttctccttcatcaggaaattcaagtaaaactctcccaaagctttaactccgggcaggatattctcaggaacttcacccgaatccatcagtcgcaatcccggcgcaataaacagtgagccggcaccacctaccatcaggaagcgatttactcccgctttcttcactccatcaatgatagtcagatatactttgatggtttcgtcatatatatcaggattattccatcccggattgaatgcactgataacggcatccgctcctttgcaaacttcgcaaacttcatcgagcgaagagacatccgctttctttactttcagatgctcgttctctatctttattttctcgggatgacgaactacagctgtcacttcaaagccacgattcaatgcctcatttagcagagcggaaccaacaaagccgctagctccgatgaggactatctttttcactttctccatattccaacaaaaattagattgttattattactttaataacaatctaactttcagaatgttggtctccttttagaaaattaattatccgatataggtttctatcgtttctttcagtttctccaaagaatatggtttggagataactgcattgcatccagcctgaatagcctgttgctgttccgtatagaacgcataggctgtgactgcaataataggaaccgaaagagaaatagttcgaatcttctctgtagcctgaatgccatccatcacaggcatacgaatatccattaatatcaagtccggtttttcccgaataaagctattgattgcttcctgtccgttacgcacccacagaatagtatactctttcttcagtaagatattcaactgggcaaagttcgattcgatatcctccacaaccaaaatctttttatgacgtacggattcagaatcaatcttagtagaaagactccgttcggcaacttctaccggtatctcctgataaggcagataaagcgcaaacgtactaccttgtcccagttccgagctaacttcaatacggccaccgagacgttctacaatactcttgcaaatagaaagccccagtccggtaccttgcacaaagtcattcagtttttcaaaacgagtaaagatttgaggaagtttctcttccggaattccacagcccgtatcgctgacaaacagtttcagccagtctccctcctgcttcaatcccaatgtgatacttcccgtttcagtattcttaatggcattggataaaaaattgaagagtacctgcatcacacggtttcgatcggtagaagtccaaaactctccttgcggacgaaccactttcaagtccacattcaacttcatctttaactgatgcaccttctccacttcatccaccaagccagctatttcgacttgctggaagtgcatctccgatttaccggattcgatgcgggacaaatccaaaatatcattgatcaactgcaacagcagattgctattcttctggataatctccagatattcatgtttttcctcttcattctccgttaaagccataatctccgaaaatcccacaatagcattcagcggagtacgaatctcatgactcatatttgcgagaaatacagacttcatccggtcggcatcctctgcacgtcgtttcgcttcaattaattcctcggaacgacggatacggtcaccaatatcgtgtattaacgccagcacggtgttaccttcaaacggagcgatgcgtgcctgaaaataatgtttactcccatccacttccaacggatattcaatctctttcagcttcccgtccttcaggcattcgcgaatattgcaaagaaacaaatcacttacttccggagaataaatactgcgcccgtccgctcctttcagcacttctaccggatgcagcagaatcgtacccggcgccatcagcacatccgttataaagaaattttcgtcaaagatgaagataaattcgggtaaagcttctattattttacggttatgttcttccagatgtttaatatgctgttccttttcacactgggaggtaacatttacagtatatgccaacagtttatccggatctccttcttcattccctttataagacaagaaatgatcttccagccaaatcacttcaccatgctctccgacacaacgaacctgtatctgagatgctttggactccgaagcaagcattttagcaaaagctgtctgataggcatttatatcttcggggtatgcgaaatggtaaaagtcattaatatctttaaagactacccccgcctctttcaagcctaacgtacggaagtaatcgtccgtgaagctacatttccctgtcggaatgtcatattcccataaagctatttgatgtgcggcaagtacagaaagtatcttttgtgaattttcccgtatgatttcattattctcattcggtgaatataagtttgtatccggctccatagactatcattgtattttgtatgtgcattgtttgaacggcagcaaatataaacaaataaagcacaagttgtgtctaatcttactttttttacttagaaacaattatctttgcatcatccaaaaagaaatataatgaatcaagatactatctgcgctattgctaccgctcaaggaggggccatcggaagcatccgtgtttccggtcctgaagctatttctattacaagccgcatcttccaaccggccaaagccggcaaattacttagcgaacaaaagccttatacgctgacattcgggcgtatttataatggagaagaagtcatagacgaagtccttgtgagtcttttccgggctcctcattcctatacgggagaggatagtacagaaatcacgtgtcatggttcttcctatattcttcagcaagtaatgcagttgttgattaagaacggttgccgtatggctcaaccgggagaatatacccaacgcgcgttcctcaacggaaagatggacttaagtcaggcggaggctgtagccgatttgattgcatcttcttccgcagccactcatcgtttggccatgagtcagatgcggggaggttttagcaaagagttaacggacctacgaagtaagttgctaaacttcacttccatgatcgaactggaacttgacttcagcgaagaagatgtggagtttgctgatcgttcggcattgcgaaaactcgcagatgaaatagagcaggttatctcacggctggttcattcattcaatgtagggaatgccattaagaatggtgttccggtggctatcatcggtgaaacgaatgcggggaaatctactttactgaatgtattactgaacgaggataaagcaatcgtcagtgatattcatggtaccacgcgtgatgtcattgaagatactattaatataggtggcatcactttccgattcattgatactgccggaatccgggaaacaaatgataccattgaaagccttggtattgaacgtacattccagaagttggatcaagcggagattgtactttggatggttgattcatctgatgcatcttctcagataaagcaattatcagaaaagatcattcctcgttgtgaagagaagcaactaattgttgtattcaacaaagcggatttgattgaggaaatgcagaaagaagaattatctgctttattaaagaacttccctaaagaatacacgaagtctatcttcatatcggcaaaagaacgtagacagaccgacgagttacaaaagatgcttattaacgcagcacatctgcctacggtaacacaaaatgatattattgtgacaaacgtaaggcattatgaagctttaagtaaagctttagatgctatccaccgggtgcaggatgggcttgattcacatatatccggagattttctttcgcaggatatacgagagtgcattttctttatttcggatattgcaggggaagtgacaaatgatatggtgcttcagaatatttttcagcatttttgcatcggcaaatgatggcttgtaaacagccataagcaaccataaccatttagaataaagtcgctgaaatccagcgacttttatttttgtgtctattccagtcaattctgacagactgccgattttcagcatctttttgtaccataattctaccgccgaacaaataagcgggcttctcgctcttatcatagcgacatcttgggcacgatgtgagacattatgagaatgagcgaaaccgctatagaagacacagcgtgagacgctatgagaaattgtgagacgcgttgagacgaaatcgacgaaattaaaggcgaccaatatatggaggtacagagaaaatgccagtggtgcggcaaaccatttatagcacacacgatggtaacacggttttgcagcaaatcgtgtactgaaaaagcgtataaagacaggaagcgcaggcaaaaattgcaggagtacgaggcgaagcaaaacgagcaaccaatgcaggaagtcggcattgtgggaggcaaaccgttcctctcccctgccgaagccgctacccttttaggcatcagtcgtgccaccatctatcggcacatggctgccggtatcattcgggcgttgcaacttcgtgggcgcaccatcatacgcaaatccgacattgaaaagatgttcgacaatacgcccgactacaagaaacgcagctatggacggaaacagaccatcctctattacaccacgaatgagattctggagaaataccaaatccaaaagaaaaccctgtatcgtcgttgcaaactatacaacatcccaaaggttgaagaaggtagccgtgtgttctacaaccgcaccctcatagacaagtattttgccgaccttgccgaagaaatcaatccggactgttattacacgccggagcaggtcatggaaaagtacggtatgagccgtaatgccgttgtcacctttgccctgcggcacaatattccccgaatcaaccgccaccacgaggtgtattattcccgtgcccatatagacgctatcaaagaaaagcaggacaaactgaatcccgactattatacctattcggaaattaccaaggaatacgggcttaccaaaattaacatcagctattatgtcaacaaatacgatataacgaggttcaaacaaggaagccggactatggtattgcgcaccgagtttgacaaggtatatcgtgagcatcgggacggtacatacatccccaagaagcgcgaaagcaaatccggtcagcaggtaccgaaagagccttttacaattcccgacggctactattcgtcagaacagattgcagtcacatatcagatgaccaagaaaaccatttgtaggctgtgccgtgaaaacgacattcctaaaatcagtcacggagggttcaactactacaaacagttggcagtaaaccgtttcttcgccaaatacaaggcagctgacaatatcaaagaatggattggcgcagaacagatggaagcaacatacggtatgagtaaagatgccagatgctcatttgtacatcgccataaaatcccctcacgtgtagtctatggcaaagtccaatactccaaagaccacatcgacattatcaagaacggcggtttcgaccaacgcgaaaagtattacagcgtagccgaagcgatggaaaaatatggtttgcgtagggatgatgtctataactatgcccggtataacaacatccgaaagatacaccacggcaaatccatgttcctgctgaaagaggattttgacaaggtgatggctgaaaaatccgtcacctgaaaattattccatttcagacaggaaaattattcaacaatgggtatggtctgcattgaaccatttcgttggtttgcagcaaattattaacaacaatataatatagtagagtatgcacgaatgtaaaactgtaacattgaggacaagacctctaaagaacaaaatgttgtcgttctatctggattattatccgggatatagagacaaggaaacaatgaaagtaatccgtcacgaatcgcttggcatttatatctatgccaacccgaagagcaaacgggagcagaatttcaacgatgtaatgaccgagaaagccgaagccatccgttgccgcagatttgaatctgtcgtaaatgaacggtatgacttcttcgaccggtacaaactaaagggtgatttcttggaatactatcgtaagcaactccgcaagcacgaccagaaatgggagttcgtctatctccatttcaagaacttcgtacacggcaaatgcacttttgaagagattgacatcgacctatgcaacaagtttcgggaatacctgctgagcgccaagaaactaagacgcaacggacgtatcacacgaaactctgcatcaggatattggtctactttcagaggattcttgaagatactatatcgcaacgggatgataaagaccaatgtcaatgacttcttggaaaagattgaaacagaagacactatgaaagaagctttatctgttgaagaattgtaccagttagctgaaacgccatgtaaaaagcctattgtgaaaatcgcatcgctgttttcctgtatgaccagcttgcgcatcagcgacatcctcgccctatgctgggaagacatagtggactactctgccggagggaaatgtgtgcatatcatcacacagaaaaacaaagcggaagacatcattcccatcagcgaggaagcattagggctgataggatacagttctgaaaagaaaggtctggtattcaagggacttatgcgtagttggacacaagtaccaatgaaagagtggattcgttctgccggaataaccaagaacataacattccattcatatcggagaacattcgcaaccctccagggtgctgccggtacagacatccgtaccatacaaagcataatggcgcacaaaagcatcaccaccacgatgcgttacatgaaagtcgtggacagtaacaagcgtgaagccagcaagaaaatcactctgatacgcaagggttgaactcccctattttgccccattacataggcttagagtatgattcccgattgattatcatactctaagcctatattttcttaaaaattgaccgatttactgcatttatttataactatctggaaatgtgcttataactttgtactatcatttcatccaaacaacaatagattatgacagatagtattcaaattcacaggaaaaaggcaagtttcatacttgctgtaagcgttacttcatactcggtaatcgccacttatctttataaccgccatcaaataaacctgatggaatataccacacctattatattgagtatcgtgctcttaactctttcatgcgcgttctctcaaagatttttctatcgctaccttatcaagaataacgtatgtatttcttttggcaagcaaaaagaatccattccacttgaaatcaagctgccatctgataccattaccccggaagtagaagttatagaaatgccggcagcaaagaatgattacacagatggttatgacgaacgcatagctgaaatagaacggaaaaaggcagagcagcaagctgacattatgcgtgtcatgcacgactataccacatatagtatggctgaatttctttcaaaagatgaccttattacacttcacgaaaacatagagtgctttgcccatgggcaatgtgatttatacaagcccatacgttccaaatttgacaacccattaaacactctcgatatacggcattttgtatggaatatcggcataaggttgaatatctcggtggaaaaatgcgcagaatttataaaaaccatattcccacacgaattgaaaaatgctactctgttttatttatcaaaaaatctacggactacaggtatttgtaaaattccacttgatattcccctaaaaggagagtattatttcaattgcctcaaaaaagcagacgatgagacagctggttctgaccgactgaaatgattccgtcgctgactgaaaaattaccctctgctgacgaaggtctgcatagtatcattgtgttggtttgcagcatgtttaacaaataaaacatttgaatcatgtctaagaatcaattcacattcaatgaccttcccgaagtgctgggagagttatgcgaccgaatcgcaagtatggaaagtttgctgaccgaaaagctttccaagcagaacgaagtcaaggagaacacgcacgtccccatgaccgtgcaggaggcttgcgcctatctcaaaatgccgctatcgaccttttattacaaggttaaaaaggacgatattccggttataaaacaaggcaagcacctctacatctatcgtgatgagctggataaatggttggagtcgtcccgtaagaccgccgttccgcaaagtttcgaggaagagaatgatgcgttgctcgcttcccatcgccgtaaaccaaactctaaaaactggtaggctatggagaagacgaacaataacatcccatctgctgaggaactggctatttacataaaggaggctaccgtgagcgtaaataccaaatacgaacagtcgcctgtggtgcttatggtggatgactccattatcggaacacttggcaacttcagtgcttccatcggtaaagccaagagcaagaagactttcaatgtttcagccattgccgcttccgcattggccaatagcactgtgctccattaccgttcatcgttcccggaaaataaacggacgatattgtatatcgacaccgaacaaggagagcctcattgtcaaaaggtactacaacgcattctatgtttggcgggattaccaaagaatgccgattctgacaatctgattatgttaggtctgcggaaatattctcccgaaatgagacttgcaatagtcgaacaggccattggcacaattccgaatttgggactggtcattatagatggcatcagggattttatgtatgacatcaattctccgaatgaagccaccaatataatctccaaattcatgcagtggactgacgaccgccaaattcatatccacaccatcctgcatcagaacaagaatgatgaacatgcccgtggtcacattggcacggaactcaacaacaaagcggaaaccatcatgcaggtagaagtggataaagatgataaaactatcagctgtgtcgaagccattcatatccgtgaccgggagtttgagcctttcgctttccgcataaacgaatgtgccttgcctgaaccagtggaatcctatatatccaaagagaagaaactcggacgaccgaccaaagaaccttttgaaccatacaaggaaatcccggagagcgtacatcgtgctgcgttggatgccatttttgccgatggcaatattaccggttacgacaactatctggagcgactgaaaaacggctacgggttacagggcgtaaaactcggtcacaacaaagcggtcaaagtagctacctttctcggcaataaacggatggtaataaaggaagggaaagaataccagttcaatcctgactaccattattaatcttgatgcaattagtacagccgtagaactttactttagtgtcggggcgtatatataggaataaagcaaagtggtcaaggattacaatatgcggtttcattccctacccttttatagtaggataggtcaaattctgattccaatccatttgccaattctgtatgtacatcctatacggcttgccgtgaagcatcaacaggtaactgttgcgagatatgccaaggtataacctcactgcgttacggttgtacattggcacccttgcctgctcagatacttcgccggtgcggtactcgcaagctcgcacctattcactattataacaatgatttatatggaacaaaatattgaagaacaaacacaatctccagaggagaaaaaagagacaagatccgtctttatcggagcaaaagtgactcccggtcagaaggagtatataaaatcacaagctgagcaatgcggtatgacggtaagcgattacttgcttgcctgtgcatacaactaccgtcccagaccgaggctttcaaaagaagaaacagacctgttgcagaatctggacaactgtcggtcagaccttgtaaaatacacttctgcacttcgtggaatgtccacaaagcaacgaatgatattgttcaatcaggtgccgttcatggtaggctggctcaaagagcttggctatattgctgaaagcgtctgccaatttctcaacgccgtaaaagagagaaacaagattccgtccaacgaaaaatccgaagaagtatgatagcaaaggctaaagcaatatcgcacggcataaacgccatccgttatattaccggcgaatctctgaagaaaaaacacccggagaaaatctatcgggtattggacaatctgatgccgtcgcaaccggacactttggggatatggaactccatgcaactgaccttatcacgtttcaaacccatcaagaactcagtcatcagaatcgagctaagcccctctgccgaacacacccgtttcttcgacatcgaagactggcaaaagctatggcaggatttcgctacggagtttgacaagcaagtgtttaccggtaaggacggaaaagtccgctcctgccagaccaatctggctaacagcaaatacactgtttggctacatgaggaatccgatggcgaagttccccaccttcatgctgccgtctgccgtttggatgaagacggcaacatcaacaacgaccacaacattcatcttcgtgcgcaacgtgctgccgagcgaatagcaaagaaacgtggttggactactgctgtacaaatccgatacaccaatatccatcaggtaaatcgcgattgcatggatgcgctgagatcaatgcctgaatggtcttgggaagagtataaaaataccctcacaagaaaaggttactctgtacacgaaagaaaggatgcgcaacacgttatcaggggctacgcacttgtaaacggtaataccaaatacaaggcttccgaattgggagttgctcggaatctgatgatttcaaaacttcctaaaacatgggacaaactgcatcataggccacaagttgtcactttaagcaatcagcctaaggaaactcaaactgagcagaatctcaaaccgtcagcatccgcagagcataccagatataacacttatcatcccgatactatttcctatacgcttaatcatgacgataaggaacatcggttctatattccggaaaaagtgcttgaatatttcaacgatgagtttgactacagagataccgagaactgtcaggaacttaccgatatggctgtagctatttttgtcggactgcttgaaacgccaaatgttgccaccggaagtggcggtggaggttcacaaagtaatttgccgtggagagataaggacgaagacgattggcaatgggcacgaagatgtgctcgtgctgccggtcgcctgctcggaaagaaaccaaaatcaggattaaaacgataatcaaatgaaaaagaaattcgacttttccacagaaatggctgaagcggaagccataaaatccaacccaaagaatgagtctttggaggaagaaaaccacctattcgacatcaatgtacaagaacttgcaaagctgaacaacaacgtgttcaagctgagaacggaagttgaaaatttgtccggctctatccgagagtgtaagcctatcatttcttcagaaatgcagaagttagcagtggaatttggggcaagacttctatgcgattttctcagtcagattgaaagcaaatgcaaagaagccgagcgaagaatgaagaaatccggcaataccatcctagttccggttacagcattttacatcactattataatactggtagccctatcttcttttttcgccagcatgatagtagcaaacgttgagatattgcattcaagcctgatttggaaagcagttgccatctgtgcccttattgcaatttcggggactgtcatggctataatcgcaccaaagattttggataaatggacgtaattggaagtgaccaaatctttattggcatttgtttggtcatatcagaggctataacaatcctgtaaccgccgtaacagttacggtggttacggaattgttgtatagttctgcgatttgacatttgaattaaaatgcatacaagccatacttcaatcaacataattatttcctttgaacttgtcgggtgcatgtcgggtacttgtcggcatcttctacgttttatttaattctatgatcaaacttagtacatttacacttggattatttttgctaaacttagaccgttttcttcaaatgatcgcacagaagttacataccagtaaaatgttatttgccaagcgacttgaacatcttggcgatacaacgtttcttttgttccatatttggatggacataaagattgagagtggtactgatatttgagtgtcccagcaatacactgactgttttatagtcacaattactttctatacagcgagttgcaaagctgtggcgaagcccatgaaatttcaattttgggataccaaggtgctccatcaaccgtttgtaataattgcgatatgttcgtggttctgtgggcgagggttcattggtgagtatgtagtaatccgcatttaccacttttttcagtggttttaccaaagcaagtaactccttgctcataggaatttcacggcaggagttctttgttttaggcgtattaataaccagctctgtatgtttcttttctccttcgataatataaatacgctctatggtacgctgaacgctgatagttccgctatccacattgatgtcactccagcgtaaagcacaaacttcaccaatacgaagtccggtgcttaggcttatatagatgcctaaattacggaatgtgaaattttgacgaatgtagtccaatattttcttgtgatgggctacagtcaatacctccaactctttgttcgtttcagctgtaggatattttatgtcccattctgaatagttcatccattcgtgttttactccgaacttcatcaccattttgagcacaataagaatgtcctttaccgattttacactcataccaccattgagtttttgtagtacgaaatcttgtaccgctttctcacttaacgcatcattttcaccaaaatatggtaaaagatggttctccagaatcaacatataagcggcaaatgttgattgcttcacatacggacgcttgtcttctcgccaagccatcgcaatttctctaattgatttctttgtcataattacttttttaggggtttcctataattagagaaatataatgggcaatgttccaaatctgagattcccggagtttagtgaagaatggaaaaagatgaaagtttcagaactcttggatttctattctaccaactctctgtcatgggaacaattagattataataacggtaaaatcaagaatttgcattatggtttaattcataaaggagtacctaccatggtagatgttgtttgtgattctcttccttacatcaaagaggaatctatgcccaaatcatttaccctattcaaagaaggagatgtggcatttgctgatgcgtctgaagacacaaacgatgtggctaaagccatagaagttgttaattgtgataaccaacaaatcgtttctggcttacacacaatacatggacgtgataattatgagcagactattattggttataaaggttatgcttttgcttctgattcattccacaagcagattagaagaattgctcaaggtacaaaggtgttttctataagtgctcgtaatttcgatgaagtgtatatcggaatcccttcaaaagaagaacaaaccaaaattgcaaaactgttaatagccatagacaagcgcatcgctacccaaaacaaaatcattgaaaaactgcaatccttaattagagggcttgcggttacactaacgactaaaggaaactttaatactgcaatttctcaatgtttagagtgtcatagttcaacacttcaagaaagcgaggttttgcctaatgggttgtataaagtatttggcgcaaatggattggttggttatacggatgtgccacaaatgaacggtgatgcaatactggtaatcaaggatggttcgggtgttggtacagtttcctacgcacaaggcaaattttcggcgattggcacactcaactatcttacagtcatagataacaatgatttgcggtatctgtactttgcactgtctgtgttcaactttcaagcgtacaaaacaggaatggctataccacatatctacttcaaagattatggtaaagcgaaaatatattgtcctccacttgctgaacaaaagcatatcgcaaatgtgcttgacaaattggagagtaaacttttattggaacaaggcattcttgcatcgtttaactggcaaaaacgctacctgctgggacagatgcttatataaacatttgacttaatagataccgcttcaataaaatgtattgctccaataatgacttttcatttgccatacagtaatgcaaagcgtcaagagttttagctatacgttcttgttcttctaacgtaggcaatacaaacttcatcttcataaaatcattcttttggagattaaaccgtgtactcccttgtgctaacggatatatagccttacgaaatgagaaacttgaaatgaagtgggcaaggtattgaggtaatacacgttcatcatagaaatgaatgccaaaacagaagctattcaaataaagtttctgcgtgttgcccaaatatactgcacctataccaacttcttccggagtttcagatgagagtgtaaataaagcatcaccgtactgcacacagttttgcctttcattgggagctatttgcacaaattcataatccttttctgaaatgtaagtgttctgatacacattcatgtaggtgataaatggctcaccgtcaccgaaatcatcaccactttttccgcttaatccggaataagcttcacccacacccgagaaacatactgtttctcccttaatatctctatggatattgtcgcttagccctctaattaaggatgaaaaatcaataatcttacagaaaatggaagtttcccatattctttactctccttgctgctccatcaactccttatagtgctgttcatattcttcctcagtaaaactttcagcacaacttttggatcgggttaaaattcgtagattctcttgaaataatatttcctgtcggctcatttgagaaccaaaatatttaggagaataaaatctatcaatttctgtttgctttaaatttttatatccaagagaaacggccatttcggaaagtaagtcaagtctaaaagaattactactatcaaaatggggtgatttttcgtttaaactatctaaatattctctccacgcatgtcgaacttttttattttcttgaaatacgacatctattgtatttaatgcatcaacccattcttttgttattggggctgattttcgatctgccattagtgtaaggaaaactcttaattgagcatctttttttgcttttctatcttggtattttattcctaatacccaaacaataattggaataatagcaacagcaataatttgaccgatgccgataatgatttgtatatattctgttgtactcataacacataaatttaatacaaagatagtcttttagattaaaatccatttgtgttattcgggaaattttatctttaattagatattacacagccaactatgcaaaatagtagaatatatagcttaaggcttagctcttctacacactttgagaataatataatgagcaatattctgtttctggtgtgatggacataaggtcataaacaatgcgatgatttgaggaacaaaccgtctgttttcgataaaattaaggattgttattcataaaggtccgcaatttatcaggagatattttccaatctgcaaggagaagaatgctcacttttagatttggctgaaataattaaagggcaacaaatcaatggaagtgagcttagtgacagtggaaaatactatgtgatgaatggcggtatagcaccgtcaggttattatgacagttataacactgaggctgatacaatttcaataagtgagggtggcaattcttgtggctatgttcaatataacagttccgaattttggagcggtgggcattgttacaccttacgtataaagccgacctcctccatagcgacacattttttgttccactatttgaagtggaaagaaccagatataatggcactccgaataggtagcggcttacctaatattcagaagaaagacttgtcaaaaatcagtatcattgtgcccacactggacaagcaattacagttaaccgttttgctttccgcttttaagaagaagattgaaaatgaagaaatgtacgtagcaaacttagataagcagaaacaatacttactccagcaaatgttcatataaacatctgctggagtaggtgttgccgttgtaaaagcaaatcgtcataaagatttttctctatggatatttttgaagttaatttgttgagtgcattagctatggctttttgttcctgaatgcttggaatacgatgaagtgttttgaagtaatcaattacagataggttcagcaaaccatgattccttgctccctcacctgcaatatctgcaatacctttgtaccatttctttgattcaaaatagtgtgcaagaaaatctgaatcaattcttgctgtatcgggtctaaagcagatatataaaggagagagcacgccttcggaaaaacattctagtcgcttgaccgcaccccatgcataatcacctgaatagctcttgttataagcaaaatcaccttttcgtagaaggtaatacccctccaaattatcacttgctacagatttattgaaaaattcttcttgactgactaaaccaaactgagctgcaatagtaaggactaaagtacattgggtattgaaatttttagtgcgtacacgttggcatatatcagaaaggtgtaccaaatgccactcttcggtaaagccaataaaccttttttgtggcgaagattcatttggataacagaatgacttatctataattgcggactttagttttttcaaatcctcaatgattttgttttgggtcgctatacgttcatcaataacagacaacatttcagatatttttctctgttcgtcaagctgtggaataaatactttaattttttcaatagtgtctttagaaagactcggaacaccagaggcttcattatatcgcaaccagtttatagtttgaaaaaggcaataaacgaactttggagtggtcttattgaacgaatgggtataaaagagagtatcaacagtccaaaacttcccattataatagaacggcttattgatactcccttttcgtccaataaatgttgtttcaccatcgtatatacattcatttacagatgtcatataaccacctgttccaaatacagggatattccctttttcaagatgtttgtaatccctcccactaccaatagaaaggatattggctatttgacaattttcccattctccactaaactccgggaatctcagatttggaacattgaggattttattttcgttattattcttcataatcatctattctttatcagggttaatatcaaacggcaacaatttgtcgccattattaaaccggtcgaaatcagagataaaagaacggtcttgaatcactttatatttctcgtactcgccatacgccttctctcgtgctacttcttgtgaaactttaccggcagtatcttgtgccttataatccatagtgccaagaaactgttcaagacgttgcttccagtcttccatcgttgttatgatgtggcgctgggcacgaagttctgcaaattcaagaaatgcgttagttacgccgttaagttcggaaatctctttgtcagacaaatagttctttgccacaatcgtatcggacttctgaactctaccatcgggtgctttcttccacattgtcaatcccatgtggggcatttcagagtcggcacgttcatacactatttcagcagcggtacgattagtcacagccaagtgcatcatattttgcaccattttgaagaacaatttagtacaatccgatttcgggtcgtaatcagcactgcattccgcataaatgtctgttatcttctggtagtatctgcgttccgatgtgcgtatctcacgaatacgctccagcaagtcatcaaaataatctttgccaaaatgctttccctgttttagtctttcatcatcaagagcatatcctttaatgacaaattccttcaagacagacgtagcccaaatacgaaactgagtggcttgatagctattgacacgataacctaccgctatgatggcatccaaattatagaacaacggtgtacgctccacatctcgttctccctctgattgaactatcccaatttttcggatagttgtctctttggtaagttcaccggattcataaatctgtccaagatgatagttgatggttcgtacatccaccccaaacaagtccgccatgcgcttttgcgacatccagaatgtttcgctattgaatattacctctactcgaacttctccttgtgcggttttatatagtaacagattggaactatatgagttgagcaccaattcgttggtagatatggtttgagaaaagtaatctcttgcctgttgtaccaatactttttttgcatcagcattttcagcaataatcatacacgccatacgtgacaagcggaagatactgactttacggaacgagccactgcctatcttcaccatatcaaccgcttggttgaaatgctcgtcaatattcattccttttatgccggctactttgattgctttgtctatgactttttggaatttccaataagccgaatatcccatagcagcgcataggtcacgtgaactccaatattcattgtcgttctcatcgtgacgacggatattgtcgaatgaaggacgcatttccgggatgttatctatctctgccataacactattattcaaccagtcccaattctttaagatatacttcaatctccttatcgagttcggcacgtttggcttccaactccttgatttctgccattacagctttaatgtcaataggttcttcctcttcaaaagtatcgacataacgaggaatattcagattatagccgttatcggcaacctcctgtaaagtggcaagatggctgtacttttctatttcttttcgctcgcgataggtatcaacaatcttgtcgatgtgctctttacgcagtttattttgtgtcttgactttctcaaactccttgctcgcatctatgaacagaatattatcatcttccttacggcatttcttcatcacaagaatacaggtcggaatacttgtaccatagaatatattagccggcaaaccgataatggcatctatatagtttttcttctctatcaggaaacggcgtattaccccttctgcattaccacggaacaaaacaccgtgtggagcgacacaagccatcgtaccaccttcgttcaagtgataaatcatgtgtaggataaaagcataatctgctgtcttctttggcgcaagtcgccctgctttgctgaaacggtcatcggtattaaatttgtcggcagcactccattcggcagagaatggaggatttgcgactaccgcatcaaactgggtgtcgccaaaggcatcccattcaagcgtatctccgttttcaatcttgaagttactgaatctgataccgtgaagcaacatattcattcgggcaagattataagttgtcggattcttttcctgtccgtaaatatcaactgcatttccaatgctggcagcacgaagaagcaacgaaccactaccgcaagtcgggtcatagacattgcgcaaacgctggtgtccgatggaaacaatttctgccaagatacggctgacttcctgcggagtatagaactctccggctttctttcctgctcctgccgcaaactgcgaaatcatatattcgtaagcatctcctaatatgtcaatctcctgtgatgcctctaatccaaagtctatatcgtccaatgcaagtagtacattgctgacaagcgtatttttatcatcagcagttttgcccaatttaggtgaagccaaatcaatatctgaaaacaatccgccaaaatcatcttcactatcttgtccaagtgtgctgtcttcgatacgcttcaatgaacgttccagcataggtaaaatgttttcttttcgtttgatggcctcaattacagatgaaaacaaaaatttcggttctatgaaatagcctatattctccagacattgattctttgcctcctcttgtaactcgaccgcatcggcatcattcatctcccacaattccttaaaggttatctcatcatccaccaaggcattgttggcatacttttctattttctctgataagtatttatagaaaatgaaacccaatgtaaaatacataaagtcgcttgccgacatattgccacgcaaacggtttgcgacctcccaaagctggtcacggagtttttgttgcagttcttcgctcatatctttatttctcaatattattctgtattacatctttttccgacaatggtatattgttctctattatgcttctaaggtcatctaatactttcccttgatatgagaaatattttgccccttgatatgcacctgacgtatttcgtttttcttctggcataaacgttccgacaaaaggggacaatttataaatacgaccttcatattcaacggaatcatcgcttgccactttgacttccgtattcgtaggaataaaggtaacgcattcccctattttaatacctatcatgctaaatttaaaacgtccccgctttacgattcgtttctgcacgacaggcaatgactctttttctgtagcacaaacaggtttattatcaacatagacagtaacaacagcatcatcaatcattttggctatgtcattgaatatatccaaagctatttgtggcggcacattgaaaaactcccgattctgacgaatacgcaaatccgtcaatctatcgatagtcttgtgtacatgcttttcaacatcgttatatttgacagtctgaatagttgcataaatttcaaaaggcaacggaactgccgtattgtcaagttccttggaacgtatatcgacagggcgtgcgcttttgccaatcttaacccaatcctcacgaaaacttggattagtcaagatatacacatatccgggttcatttgtctttaccatatccgaatttactcccaattaaatgttcttattatattacgcaatctctccatgattctcgtcaatgcttttcttgtttttataagaccaagatgcttttctttcagtgccttttgtatgatttccggctgttccttttgcaaatagtcgtactcttttatgtatatattcagcacttcggcagaaatttgttcatcgtccgccaaatcgtttactgccttattgcgttcagatacaatatattgattcaaatgctcttccaattcacttgtaccatcagccttactacgtccgctcatgaagttttccttatcttcatcaacatttttccgaataaagccatcgatgagtttggctttacctcgcatcccggcatccttaatcattgtgtcaatgatatgttgccgcttttctgagtaatcattgctatatgggtcaagttctgcaataagttcaagaatgtaagccacattgataatgtcgctatgtagaagttcaagacagaaatctatatcctctaatccctgactgttcccatacggaacaggatcttctgcaactacagatggaattacaggcggttctataaacccgactgtaatgtcaagatacttactcttatagtcgttgaattgctgctcggtcataccaaggtcttccgcatcctcactataatcttcgtatatctggatttccgcatgtttacggataatatcacgaaatgcaagaacaaaatttttcttgtcattttcgctttgcagaaaatctatactgccgggtgtaggatattttttcaggaactctgttgccaagcatttatattccttttttacatcctcaaacggagggcgtactatgtcttcagggttatcagagttgctgaacaatttaatagacgtatcaacattgtttttcaagtcacggaagcaaacgattttaccgaaacgtttcttttcgttcaatactcggttggtacgactgaatgcttgcagcaaaccgtgatattccatattcttatccacatagagtgtattcagttttttactgtcgaaaccagtaaggaacatccccacgacaagacaaaggtcaagcggtttcatatccgctttcttctttttcatgcgcagattgatgtcatcatagtaggcacggaaattttctgtagtaaaggcagtgccgaacatattgttataatcatccataatggcttgcagctcatccgcctcgcccacgctcacttttgcatactgccctgtgcccatgccagtctgttcatcatcctgactattgttagcagcgtaagtaaacacagcaccaatacggattttcggattcaacgatttgaatatcttgtaatagcgtatgagcatcggcacggattgcacggcaaacaaggcatcaaactctccgtcgaatgtggatttgttgaaattgttaaggataaacttggctatttcctccatacgagcttgattgtcgttgtcaacaacttcgttaccatgataatactccacaaggaatccaagcacgttttcatcggctatggcatccttaataagatatttatgaagacaatttccgaatatctctttagtagtatgcccatctaccgcattttcagtaaagataggtgttcccgtgaagccaaagatttgagcattgtcaaagaacttcataatcttcttatgactatccccaaagtggctacggtgacactcatcaaatatcatcacgatacgtgagtggcgaatagtttcaatcttgttgctataccacgtcttgctgactgcagcattgagtttctgaatggtagtgatgataatcttggaattgctttgaaggcgtttcacaagttcatccgtattatcagtactatccacagctcctggctcaaaggcttcatattccgattgagtctgggtatcaaggtcatgtcggtcaacaacaaacataaccttatccacatcatccaactctgacacaagttgggcagctttgaacgaagtcaatgtttttccggctcctgttgtatgccatatatagccgttatcgttggagttctgcacacgatccagaattttctctacggcatagaactgataaggacgaagcaccatcaaacatttgtcgccctcgtgctgcacgatatatttccctatgattttgccaagcgtacatttttccaagaagaatacggcaaacttatccaattcattaaacggatgattggcagcatccgtccaattgaatgtaaacttataaccgctattaggattgttggcaaaatagcgggtattgacaccatttgatataacaaacaattggatatagtcgaacaatccgtggaacgaagtcttatgatagcgttgtatctgattatatgcctgtttgagttctactcccctgcgctttaattctatctgaaccaatggcaaaccattgataagtatagtcacatcatagcggcattttttccgtccttcaacagtaatctgacttgagacctgaaactcgttctgacaccactgggtacgattaagaaattccacccaaatccgttgtccatttaccgtatcaagcggatagaggtcacgaagtttcttggccttttcaaagcgtgtgccaccttcgagataaatcaatatcttctcaaactcttcatccgtaaatgaagtacgaccaacttccgccagttgtttcttgttatgaatctccaactgacgtttgaaattggcataaagattatcttcctcgacaatctggacatactcatagtccatttgtcggagtgtggctatcagtccggcttccaatgccgcttcgctttgtgttgacatattcttgttctgctatggtgttgttacttatttattctagcttgcaatatcttgatgcctaatgcattttctattttgcataaggtttccaacgacaaattttcacgacctttcaacactttagaaacatactgctgggtacaattcattttctcagccaaagctcgttgtgtcataccaagttcctccatccggttcgacatagttgcagctatagcctgtgaatggcaaacccaatcctctctcttgttttccattatattctttccttctcctaaagcgttgtctatcttgtcttcagccattgtatgcatcaaaaatacctttgccttattttgtaggcaaaggtactataaataatcgagattacacaactttcaggttgttgattggtgtttctactctaatttgggtaaaacattacgcaatatagcgcgagcatttggacaactctttaagtattctaatgctttcgaattataagctgaaatacctaaggccttttcaataatagaatgaagacctttattattgtatagtctaataactcttgaataatcgttagttttaattacatcatctaattcctgttctcgcatattataccactcttctattttgatttgctttacaaacttgccaaaattcgcctctacttctgttttgtcttttccattccgaacatgagactcattaaaattatagttaattcgataaattagatatgaagaaatttgttgctctttatctcgagcaaacgaagtgaaaatttgtgttttaatgctatctatatcgcaaatctcatgtttatattcagcaaaacctttaataaagtcctccaccagaaagagattttctatttcagcaacatcatacgaatagacattctccgttactagtttatccaattgttcttttgttttaaaatctctatcaataataccatatgccactgcgtatttattacc

SEQ ID NO: 61 - DNA, 44582 bp, Bacteroides thetaiotaomicron
tgtagtgtactgaataagttgacacttcaaaaatcgaaaataaagatgaaatattcgaaaaagaagtacaactattacagtgatgatgaacgaatgtcttatattcgtgagtatttatcaagtcccgagagcaaatctgagttttgtaagcgtcacggcttttgtgccaagcttcttacttattggcttaacaagtatcaaatagaagacaaagatatgggtagatcctctaaaccagtaaatagcgatgctattgattctagtatttctgagctccagaaagaactatcgctattgcgtgctgagaaccgtaaacttcatcgggctcttgctgatgagagtttacgtcacgaggcgtgcgaagaactcatcaatcttgctgaatccacgtatcatatcaaggtacgaaaaaactccgatgccaagtaatcgacaccttgtcacagaggtactcatcccgacgcaaacgtggttgtataaagttcctctgtgattacttcggcataacccgacaaggttattacaagcatgtgaaccgacatttggaggttgatatccttaccacaagcatcgtgttgtactgcaaagaactgttggaactcatgcccaaagctggtatgcgcgagttatacgcctgctgcgtgagtaagtttggaccaaagatggttatcggtcgtgatcgttgttatgacatttttcgctccaatggtttgtgtcaacgtacaagtcgcaagcgtcctaaaacaacgaattcgaaccataattactatatctaccccgatctgttgaatgttgcacccaaatttgtcgctacaagattgggcgctatggtagtggcggatataacctacgtaaacaccggtcagggctgggcttacctctcgttgcttaccgatgcgtcaagtcgtgccatcgtgggatatgcgctttacaaaactcttgagacggaggggcccttgaaagctttggagatggcaatatcattctatgagaagtatcacatagacatgagcactcttattcatcattccgaccggggtgtccaatattgctcaaataaatatgtagagaggcttaaagagcatcaaatcaacatcagtatgacgcagtgtggtgatcctttacataatgcattggctgaaagaatgaacaacaccattaaaaacggttggctattcgactgtgatgatgagagcttcgagcaagtaagcaagcgcattgaagatgctgtatatgtatataatcatgtgcggcctcatcaagggataaacatgaggacacctatggaagtggtcagcgaaacgggaggattaacagcataatacccgctcgtcgggacgggtggtcccgccccttgccgctagggcgatccccgaccgaagagtttttggttgttggcaacattacattttcctgaagaaggcttgcgtaaataaaggaagatgcataaatttgcaagcaccaacaaaagacaactaacataggaataagaataacaaaagtaaacctatttagatattaaagtatattgagtaaactaattcagttataacaaacgaagttgtcaactaaaaccagtacacatcatcccgttaggaaacgggcgttccctcaccgagaaacgagagttacctttaaaggaaacgatcgttcccacaccgggaaacgacagtttccaaagcaggaaattcatggaaactctaagccattcatatacaatcaattagtcatatcatacctatgtctattggagacatgaagagagactagagtgtacttacaaattcattacatcctgttcgaaccgatctttatctccggcagctttattgcgcattctgctccggtaattatagatagttgccaaagaataacccagaaaatgagcaatcttgttactatccactactcctaaacgaataagggcaaagatccggagttcggttgtcagcagttcgtctgattttggataaactcttgcttcttctaccagcagattattgaaagaagtaataaagtgtgggaacagtttaaggaatgacttatcaaattcgttataaaattcattccgctcgtcccggataaactgttcggacttgattgctttaaacaagtcatcgatacgtgacgacatagcaagtttggccagagagcggcgataagtttccagtttatctagataattgacgcatctgtccaaataacgggcaatatatacttcctttatctttccggtctgttccaattctttgttgaccgcagacatttgtttgttggccaaacttagattcctacgcatgacggatattttcttcatccaacgatacagatagaaaatagcaatgaggagaaacagcgacaacagactgacactaatcaacatggcacgggaaacggcccgttctctctcttctttcagtttataagccttatcaataatcgggaaaaactccgtcacttccataaatcgcaaacgggcattacatgctacagcatcttccatcgaacaactcagatatttgtaagcacggtcaatatcccctagttcatacatcagatgcgcgagtttctgcaaggaagcatactccctgacggaagattccaagtctgcaatagcagtcagtatcagataataaacttctttctcaacgtctttcttcatgctatatgcttcggaaagggtataatagatatatactttctgacgttcgtcttccatatctttcagtgcatcgttcagcatgccgatagccgtatcggcctttccggtcacgatacatcgttccgccataacaatcgttttattttcttccggaggcatggcggcgataatggaatctctgtacaaatcggtctttttcaggtatttttctttttcggttttgtttgtcgtataatcagcgagccagccgtagcaggcgcgataggtctggtaataagaaagcaaagtccattcattcagttttttaggatcaatcttctccaattgttccatagcttcgatgtacatgcccattacacccattaccgtagcacggttaatgacaatctcatattccaggtccggacgatttaattggggcaatatctccatctgacggttaatataatgaagcgccgaatctgcctgataatgaaggtaagccccaaagagggaggcatacaactcataattccgggcaggatcggtggaatgggcaagttgtacttttaaatcagtaatgtctttttctctccgtatctgataagtttccttcttacttataatgtcatccagttttttaagggccgccttatttatatccgtatgctttgcggacaaggaaagaggataaacaaaaagaagaaacaaaagataataggttagatttctcataaggtgcttttttaagatgtgacaaatataatgattatagtaataaaaacgaaaaatatcgccataacaattttcattttcacttgtatttttcgacagaggcaataacgataaaaagcttattatcaacagcctattcaaaacaagcatttatattttctttctaactgccatacggcatacccgattcacctacatttgcatcatcggttcccccgaacaaattttaaaaatctagttaccatgaaaaggaatttattattcattatcttactattattattacccggtcttcaccaggtattcgcaacaagcactataaagaaagtagccccgaccttttggtgggcaggaatgaagaatcccgaattgcagatactattatatggtgaccgcatatcatccgcagacgtcagtctttctgccgataatatcacgctgcaagaagtggtgaagcaggagaatcctaattatctggttctgtatttagacctttcgaaggctgctccacagaactttgacatcatcctgaaacaaggcaaaaagcagacaaaaatcccttacgagcttaaacagcgccggccgaatgcttcggcagtagaaggttttgattcgagcgacgtgctttatcttattatgccggaccgttttgccaatggcaacccctccaacgacatcattcccggaatgctggaaggaaatgtagaccgtaatgagcctttcgcacgtcatggcggtgatttgaaaggaatagagaatcatctggattacatagcagacctcggagtcaccagtatatggctcaacccgattcaggaaaatgacatgaaagaaggatcgtatcacggttatgccattaccgattattatcaggtagaccgccgcttcggcagtaacgaagagttccgcaaacttactcaggaagctaatgccaaagggctgaaagtcgtaatggacatgatcttcaaccattgcggttcggacaactatctgtttaaagatatgccctccaaagactggtttaactttgaaggcaactacgtgcagaccagcttcaagactgccactcaaatggacccgtatgcttccgattacgaaaagaaaatcgctatcgacggttggttcacactgaccatgccggacttcaaccaaagaaaccgtcatgtagctacttatctgatacagagcagtatctggtggattgaatacgccggtatcaacggcatccgtcaggatacacacccttatgccgacttcgatatgatggcacgctggtgcaaagcggtcaatgaagaatatcccaagttcaacattgtaggtgaaacatggctgggcaacaatgtactcatctcctactggcagaaagacagcagactcgcttatccgaagaacagcaatctcccgactgtcatggacttcccgctaatggaagagatgaacaaggctttcgacgaagagactaccgaatggaacggaggacttttcagactctacgaatatctatcacaggacatcgtctacagccatccaatgagcctgctgaccttcctcgacaatcacgatacttcccgcttctaccgttcggaagcagatacaaagaatctggaccgatacaagcaagccctgacgttcttactgacaacccgcggaataccgcagatatattatggaactgaaatcctgatggcagccgacaaggcgaatggagacggcctgctccgctgcgacttccccggaggctggccgaacgatacaaaaaactgctttgacgcagccaaccgcactccacagcaaaatgaagcattctcctttatgcaaaaactgctccaatggagaaaaggaaacgaagtcattgccaaaggtcagctcaaacatttcgcaccgaataaaggtgtctacgtttacgaacgcaaatacggtgataaatcagtcgttgttttcctgaatggaaacgaccgggaacagaccattgacctggttccttaccaagaaatacttcctgcctcatctgctttcgatttattgacagagaaaaaggttgaattaagaaatgaattaacacttccaagtcgtgaaatataccttttatccttttaataagttcacttcaacttatatttatcagaatacagaaaagaaataaactactgtaaaacaaaacattaacattaatacaaacttgtatttttattctagacaacccaaagtctcaagatggttgctatatttgcaatatccggaacagagcggagtaaaaatattagttagcttataatttaataccataaatagaatgaaaaagagaaagattttatcgctcatcgcattcctttgcatctcattcattgcgaatgcccaacagaaattaacctcaccggacaacaatctggtaatgaccttccaagtagactcaaaaggtgccccaacgtatgaactgacgtataagaacaaagtggtaatcaaacccagcactctcggactggaactgaagaaagaagataataccagaaccgacttcgactgggtggaccgcagagacctgacaaaacttgactcaaagaccaacctgtacgacggcttcgaagtaaaggatacccaaacggctacttttgatgaaacctggcaaccggtttggggagaagaaaaagaaatccgcaatcattataacgaactggcagtcaccctgtatcaacccatgaatgaccgttctatcgttatccgtttccgtctgttcaatgacggtctgggattccgttatgaatttcctcagcagaagtcactcaattacttcgtgatcaaggaagagcattctcagtttggcatgaacggcgatcatatcgctttctggataccgggtgactatgatacgcaggaatatgactacaccatttcccgcttatcagaaatcagagggctgatgaaagaagcgatcactccgaactcttctcagactcctttctcacagacaggcgtacaaactgcactgatgatgaaaacggatgatggcttatacatcaatcttcatgaagccgctttggttgattactcatgtatgcacctcaatctggacgacaagaatatggtattcgaatcctggttgacaccggatgccaaaggagacaaagggtatatgcagactccctgcaacacaccttggcgtacgattatcgtgagcgatgacgcccgcaatatcctcgcttcacgtatcactctcaacctgaacgaaccatgcaagatagcggatgccgcttcttgggtaaaacccgtgaaatatatcggcgtatggtgggacatgatcaccggaaaaggctcatgggcttacaccgacgaactgaccagcgtaaaactcggtgaaacggattactccaaaacaaaaccgaacggcaaacattctgccaacacagccaacgtgaaacgttacattgactttgcagccgctcacggattcgatgcagtactggttgaaggctggaacgaaggctgggaagactggttcggcaacagcaaagactatgtgtttgatttcgtgactccttatcccgacttcgatgtgaaggaaatccaccgctatgcagccaggaaaggaatcaaaatgatgatgcatcacgaaacttccgcttctgtacgcaactacgaacgccacatggacaaagcctaccagtttatggcagacaatggatacaactccgtaaagagcggttatgtaggcaacatcatcccccgcggcgaacatcactacggacaatggatgaacaatcactacctgtatgcagtgaagaaagccgccgattacaaaatcatggtgaatgcacacgaagcaacccgccctaccggtatctgccgtacatatccgaatctgatcggtaatgaatccgcccgcggtacagaatatgaatcattcggaggcaacaaagtatatcatacaacgattctgcctttcacacgcctggttggcggtccgatggattacactcccggcatcttcgaaacgcattgcaacaagatgaatccggcaaataattctcaggtacgttctaccattgcacgccagttggcactatacgttaccatgtacagtcctttgcagatggctgccgacattccggaaaactacgaacgttttatggacgctttccagttcatcaaagacgtagctctcgactgggacgaaacgaactatctggaagcagaaccgggagaatacatcacaattgcccgtaaggcaaaagatacggacgactggtacgtaggctgcacagccggtgaaaacggtcatacctccaaactcgtattcgacttcctgactccgggcaaacaatacatcgctaccgtctacgcggatgccaaagatgccgactggaaagagaacccgcaggcttataccatcaagaaaggtattctgacgaataagagcaagctgaacctgcacgcagctaacggaggcggatatgctatcagcatcaaagaggtaaaagacaaatcagaagctaaaggtttgaaaagattataataaggaaaagaaataacaaagatagagaatatacattttggtaaaaaagagagtgttttcgagcactaagaacaatgacgaagagaaggttttcaataggtatttttaagagagaatgataagagaaattacaattaactttaaagacaaaaacatgaaaaaaggaaactttatgttcaaggtcctgcttatgcttatagctggaatattcttgtccattgacgcatttgctcagcaaattactgtcaaaggaatagtgaaagacacaacgggtgaaccggttatcggtgccaatgttgtggtgaaaggcactaccaccggaacgattaccgatttcgacggcaacttccagttgtctgccaagcaaggtgacataattgttgtttcattcatcggataccagccacaggaacttcccgtcgccgcacaaatgaatgtaatactgaaagacgatacggaaatactggacgaagtagtagtcatcggttacggtcaggtgaaaaagaacgatatgaccggttcggtaatggctatcaagcccgatgaactaagtaaaggtattacgacgaatgctcaggatatgttatccggtaaaatagccggtgtcagcgtgatctccaatgacggtacaccgggtggtggcgctcaaatccgtattcgtggcggttcttcattgaatgcaagcaatgacccgctgatcgttattgacggtctggctattgacaatgaaggtatcaaagggatggcaaacggtttgtcaatggtcaaccctgcggatatcgaaacccttactgtactgaaagatgcctctgcaactgccatttacggttcgcgtgcatccaacggtgttattattatcaccaccaagaaaggaaagaacggacaagctcccagcgtaagctataacggttctgtatccttctccaaaactcaaaagcgctatgatgtattgagcggagatgaatatcgcgcttacgccaatcagttatggggtgacaaattaccggcagatttaggaaccgccaatacagactggcaggatcagatattccgtactgctgtcagcaccgaccatcatgtttctatcaacggaggattcaagaacctgccttaccgtgtatctttaggttatacagacgacaatggtattgtgaaaacatccaacttccgacgcttcactgcttccgtgaacctggctccttccttctttgaagatcatctgaagttcaacattaatgccaaattcatgaacggtaaaaaccgctatgccgacacaggtgccgctattggcggggcattggctatcgaccctacccgtccggtttattctaacgaagacccttaccagtttacaggcggctactggcagaatataaattctaccacaggtttcagcaatccggactggaaatacacgtccaatccgaactctccccaaaatccgctggctgcactggaactcaaaaatgacaaggcgaacagcaacgactttgttggaaatgtagacgttgactataaattccatttcctgcctgacctccgtctgcacgcaagcataggtggcgaatatgcggaaggtacacagactacgattgtttctccatactcattcggcaataattactatggttggaatggcgacgttacccaatataaatacaacctttcgtacaacatatacgtacagtatatcaagtctttgggtgcaaacgactttgacatcatggtcggtggtgaagaacaacacttccatcgcaacggatttgaagaaggccagggctgggattcctatacgcaagaaccccatgacgccaaattgcgcgaacagacagcttatgcaaccagaaatacactggtctcttacttcggccgtctgaattactccctgctgaaccgttacttgtttacctttaccatgcgttgggatggctcgtcacgtttctccaaagacaaccgctggggtacattcccgtcattggcactgggatggaagattaaagaagaaaacttcctgaaagatgtaaatgtcctgtctgatctgaaattgcgtttaggctggggtattaccggtcagcaaaacataggtgatgattttgcttatcttcctctgtatgtagtcaataacgagtatgcccagtatccttttggcgatacctattactctacttcccgcccgaaggctttcaatgaaaatctgaaatgggaaaaaacgaccacatggaatgccggactggacttcggattcctgaatggaagaatcacaggcggtatcgacggatacttccgtaaaacggatgacctgctgaacagcgttaagatccccgtaggaactaacttcaatgcccagatgacacagaatatcggttcactggaaaactacggtatggaattttccatcaacgccaaaccaattgtgactaaggacttcacctgggacctcagctataacattacatggaaccacaatgaaatcaccaagttgacaggtggcgacgacagcgattattacgtagaagcaggcgataagatttccagaggtaacaataccaaggtacaggcgcataaagtaggttacgcagccaactctttctacgtttaccagcaggtatacgacgaaaatggcaaacctattgaaaatatgtttgttgaccgtaacggaaacggaacaatagacagcggagacaaatatatctacaaaaaaccggcaggcgatgttttgatgggactgacctccaaaatgcagtataagaactttgacttcagcttctccttacgtgccagtctgaataactacgtgtactatgacttcctgagcaacaaagccaacgtcagcacttcgggactgttctccaataatgcatatagcaacaccagtgccgaagccgtcgcactcggtttcagcggacaaggtgattactacatgagcgactattttatacataacgcatcattcttacgttgtgataacatcacgttaggttattctttccagaatctgtggaagactcaaacctacaaaggtgttggcgggcgtgtatatgctacagtacagaatccgttcattatcagtaaatacaaaggccttgatccggaagtaaaaagcggtatcgacgccaatccatatcccagagctatgactttcttattaggtttaagtctgcaattctaacattcattaaatcaatttatcatgaaaacaaaatatatcaaacagctattttcagccgcactgatcgcagttctctcttcgggagtaacttcatgtatcaacgatctggatattagtcccatcgaccctcagacaggaggtagtttcgaccagcagggagtatttgtgaaaggatatgccatgttgggtgtaaccggacaaaagggtatcgacggctctcctgacctcgacggacaggacgaaggcgaatccggtttctatcgtaccactttcaactgcaacgaactgcctaccgacgaatgtctttgggcatggcaggagaatcaggacatcccccagcttacaagcattagctggagtccttccagccagcgcacagagtgggtttacgtccgtttgggatatgacatcacacaatataacttcttcctcgaccagaccgaaggcatgacagatgcagaaacactgcgccaacgtgcggaaatacgtttcctgcgtgccctccattattggtacttcctcgacttgttcggtaaagctccgtttaaggaacactttagcaatgacttgcctgtcgagaagaaggggacggaactctatacctacattcagaatgaactgaacgaaattgaagctgatatgtatgagcctcgccaggctcccttcggacgtgcagacaaagccgccaactggttgctccgcgcacgtttgtacctgaacgcaggcgtatacaccggacaaaccgattatgcaaaagcggaagaatatgccagcaaagtgattggctcagcatataagctatgtacaaattacagcgaactgtttatggccgataacgacgagaatgaaaatgccatgcaggaaatcattctgcctatccgtcaggatggagtgaagacacgtaactatggcggttcaacttatctggtttgtggtactcgtgtagccggtatgccccgtatgggaacaacgaacggttggtcctgtatctttgcccgtgcagcaatggtacaaaagttcttctccaatctcgaagatgtgccgatgctgcccgccgatgttgaaattccgaccaaaggcttagatacagatgagcagatcgatgctttcgatgcagaacacggcatcagaacagaagacatgatcaaagctgccggtgacgaccgtgccttgctatactctggtgtaggaggcggcagacgcaaaattcagacagatgcgatcagcggattcaccgatggcttgtcgattgtaaaatggcagaattaccgctctgacggaaaacccgtcagccatgctacttatcctgacacagatattcctttgttccgtttggcagaagcatacctgacacgtgcggaagccattttccgtcagggaggagacgccacaggagacatcaatgaacttcgcaaacgcgccaactgtacaagaaaggtacagaccgtaaccgaacaggaacttatcgacgaatgggcacgtgaattctatctggaaggtcgccgtcgttcagacttggttcgtttcggtatgttcacaaccaataaatatctttgggactggaaaggtggagcaatgaacggaacatctgtcgcttcatactacaacaaatatcctatccctgtatcggatataaacaataacaggaatatgtcacaaaatgaaggctataaataaccaagagttcatccttatataaaagaatgccattatgaaaaaaatatccaacatattactcgctgtcaccttcgcactgcctctatttacggcctgcgaaacagacaatgacagcaatccgatcctgaacgaacccgatacattcacgctcaatacgcccgcgtatgcagccaacaatgtatatgacctgaagaatgcccaaactgtagaactcacttgttcgcaaccggactacggttttccggcagctaccacctacacggtacaagcctcatttgaacaggatttcatagaagcgacagatgagagcaaagccaactatacagtgttggaaagcacctccccgacagcaaagatcaatgtggatgcttccgaactcaacaatgcgcttctcgacttgtggacggccgtgaacggagagcaggcagaactccctaccgaaccggtagctgtatatatccgcctgaaggccaacatcacaagcagtggaaaaggagtatgtttttccaatgtgattgagttacccaacgttctgatttccaagagcaccagctcattgacacctcccaagacaatgttcattgtaggttctatgctggataccgactggaaagtatggaaaccgatggcaggtgtctacggtatggacggtcagttctattcaatgatttacttcgatgccaactccgagttcaagttcggaacaaaggaaaacgagtatatcggtattaacgacaaccgcgtgacggttaccgacaaagccggagcaggagtcagcggcagtgacaacttcgtcgtagaaaacgccggatggtatctcttctacgtcaaagcggctgtcaaaggggatgattatcagtttaccattactttctacccagctgaagtgtatttgttcggtaacacaaccggcggttcatgggcattcaacgacgaatggaagtttacggttcccgccaccaaagacggtaacttcgtatctcctgccatgactgcaagcggagaagtccgtatgtgcttcaagacagacctcgactggtggagaactgagtttacactccatgacggtgaaatcttctatcgtgatttcaaccttattgacagttggacagaaaagggagacggttattccatacagggttcagccggcaatgtgatccatctgaacttcacggcaggtacaggagaaaagaagtaattaactttaaaaagaacgattcatcatgaaaaaacatttaatatacacagggatgtttctggcagcaatcggattttctgcctgtaatgaagatttcaaggactgggctgatccccagtccaatccccaggaagagtcggcgggacagttgactgcaactttcacagcaggcaaggacgccagcatcgtcatggacgcggccacagccgattccgtagaaatcgcaaagttaagctcgaccacagccgaagaaggcagtaagatcgctgtcaactctttgacactgaatgagaatcacaccattccattttccatgacggaagaccatgtctttaaagtagccttggcacaactggacagtgtgacgcaggaagcctacaaaagccgtgcaagcgtggtacgtgaattgaaaatctctatcaatgcttctgccgtaactccttccggtgaaggtattcaactggtgggaaatgaagtaagcatcaccttgcagcctgccacaactccggctgttgatcccgacggctattatatagtcggtgatttcacaggctgggacggtaacagtgcccaacagatgaagaaggacgctctcgatgaaaacctgtatatactggaagcagaaatagaaagtacttcgaacttcaagattttcccggcttcagctattaacggaaacgacatagactggaccaaagccttgggaagtagtgtagatggtgatgactccggtgataattttgttagctggacgaatgcaggagccattaatacagcactggacggtaaaatcaaaatctcgttcgatgccttcaactaccgttttacagtgaaagacaacagtgcgcccaccgaactttacatgactggcagcgcatacaactggggaactcctgccggtgatccgaatgcttggaaagcacttgttccggtcaacggaacgaaaggaactttctggggaatcttctatttcgctgctaacgatcaggtgaaatttgcaccgcaagccaactggggcaatgacttcggttttgtagatgctatctcacaggaatccaaagaccttgccggattatcggacgagggcggcaatttgaaagtcggtatagccggctggtacttagtatacgtctccgttatcggtgatgataaagtgatagaatttgaaaagccgaatgtatatctgatgggcgatacctcatacaacggttgggatgcgcaactggtagaacaggacttatttaccgtgcccggaacggctgatggtgaatttgtttctccggcattcctgaaagatggcgcagtacgaatctgcgtaaatccgaaagctgtctctgccggcgactggtggaaaacagagtttatcatcttcgacggacaaatagcttatcggggcaacggcggtgaccaagctgcggtacaaggtaaaaccggacaaaaggtttatctgaacttcggcaacggaacaggccgtatcgaataatactacaagaaatcaaggaaacagggaatggccgtcgcgaatacaatgaaatcggggcggctactgttttttaagaaactacacttattgtctttaatacatcatcattatgaataaacatctccactttttatctcttttgtggttgtcaatgctcatggcattcatgaccgcttgcagcgatgacaaaaatatcaccgaccctgctccggaacccgaaccgcccgtcgaagggcaatggaccgcacttaccgcctctcccgacacatgggacgagaccaaacgggcagacatctcctaccaattactgctctattccttcgccgacagcgacggagacggatatggagacctgaatggcgtcacccaaaagctggactatctcaaccaactaggcgtgaaagccctctggctctctcccatccacccctgtatgtcttatcacggatatgacgtcacagactacaccaaagtcaatccgcagctcggcacagaaagcgacttcgaccgtctggttacagaagcccacaaccgaggcatcaagatttatctggactacgtaatgaaccacaccggcactgcccacccgtggttcaccgaagctagttcatcatccgaaagcccgtatcgcaattattattctttctctgaagacccgaaaacagatatcgcagcaggcaaaatcgccatgatcacccaagaaggagcagccggatacaatgccgcagaatggtttcaggtttctgacgagaccgctgccgtgaaaggactgctgaaatttacactggactggagcaacgcaccttcccccatccttgtcgtttccacaggcaccaaagcagacgaggataatccagacacaggtaccgacaacgccaaatacttatactacggagaagacatctgtaaaaagttttatgacaaaggaaacaacatctatgaactcaccgtcgactttgagtccacttgggggcttctgatccgtactagcaatgcttctttctggccatccggaacaaaatacggcgcctcttcctcgtccgagaaactcgcgctgaacaaggatttcaaactgaccaacgccggcaaccctgccaacatcatgttcgacagccagcagatcacctatttccattctcatttctgcaccgactggtttgccgaccttaactacggccctgtagaccaggcaggcgaatcaccggcatatcaggcaatagcagacgccgccaaaggatggatcgcccgtggtgtggacggcctccgcctcgacgccgtgaagcacatctaccacagtgagaccagcgaagaaaatcctcgtttcctgaaaatgttctatgaagatatgaacgcctattacaaacaaaaaggacatacggacgacttctatatgataggcgaagtgttatcggaatacgataaagtagctccttattataaaggtctgcccgccctttttgaattttccttctggtatcgtctggaatggggaatcaataatagtaccggatgttattttgccaaagacatcctttcttaccaacagaaatacgccaactatcgaagcgattacatcgaagcaacgaaactgagtaaccatgacgaagaccgtacatcgtccaagttgggtaaatccgccgacaaatgcaaactggccgccgccgtcttactcacttccgccggacatccttacatctattacggtgaagaactgggactttacggaacaaaggataacggagacgaatatgtgcgcagcccgatgctatggggagatagctacactaccaactacacagacaagacggatgccaccgtttcgaaaaatgtgaaaacggtagcggaccaacaagccgatacccattcacttctgaacatatatttctccctcacccgattgcgcaacacctatccggcactggcagaaggaaatatgaccaaacattccgtctacaacgaatcacaggagaaagactataagccgattgccgcctggtatatgaccaaggacaacgagaaactgcttgtcatccataatttcggcggaacggccatgctacttccgctgacagacaagattgagaaagtattgtttgtgaatggcgaagctcaacaaaatacagacagcgacagttacaccttgaaattgggaggatacgcctctgtagtattcaagttgggcaactaaatacatcaagaccacgtcttcagattcatttcataagaatagaataaatctgaagacgtggtcttgactttttccggtttctatctatcttcaagaaaccttatatcaatcggaatttccactttttaatggaataagaatcaaacttgtgtttctccttctatatactcttccaaaaatagattctccccatcgaataccgcataggagaaatagttaatccagtctccaagaatcagcacacgggaagtagcactcaacattaaatccagttcaatgtgacgatggccataaatgaagaagttgatattaggatgactcttcagatattcttttgtataaagtaccagatgttccttattctcccccatgtaatccggttctttgccgtccacccgcttttcgcggctatgttttgcccacgtcaagcccaattccacactccaacggggatggatggcagaaaacagtgtctgaagtgttgtactgtgaaacatccagcgcagcaacttaaacttcttgtccgggtcacccagtccgtcaccgtgagccagataaaactcttttccgtatatttcggtagtcaatgcttcacggtgaataatcactccacattctttagaaagataatccccacaccagatatcatggttgccggtaaagaaatgtacctccactcccatatccgtgagttcggagagctttcctaaaaagcgggtgtatcctttgggaaccactaaccggaattcataccaaaaatcgaacatatctcccaacaggtaaacggcagaagctttatgcttgatactgtcgaggaagttcaccaagcgccgttcctgtgtacgtccatgttctatggcacgggaaccaagatgcgcatcggaaaggaaataaacgttcttcatgagttttgagtttagagttatcagttttatattttgagctataaatttacaggaatccgagttccagttttgcttcctcactcatcatatctttatcccattccggttcgaacacaaggttgatagtggcagatgtcactccttccaccgattctactttctggcggatatcttccatgatgaaatcggctgccggacagttgggagcagtcagagtcatatcaagcgccacttccccattgtctgagacgtctatcttataaatcagtccaagatcatatacatttaccggaatctcaggatcgtacaccgtctttagcatggctacgatcttttcttctattttaaatttttccatagggctttccttattaatatgtattgcaaagataagaataaatttattcagagcagcccttcgtcggcaaaactgtaaaacttatcctcacaaacaataacgtggtctatcaggcgaatgttcattgtgtcggctgcccggcggatgtgttccgtcagcgtccggtccggttggctgggttggatatttcccgaaggatggttatgcactacggctatttgcgtggctctctgcagcaatgcttcccgaagaatggtacgtacatccgtatacgttccgtctattccgccggtgctgatacgtaccttatcgatcagtctcgtcgcctgattcaataataatacccagaattcttcctgttcaaggtcgcacatgacaggctggaagatgtcataaatatctcttgaacaagagatgcgggggcgttcttggatattttgcagtttccgtcgcttgccgagttccagggcagccattacagtgatgctctttgccggtcccattcctttaaaacgggaatagtcgcagacttcccactttgccaaggagttcagattgttatcacaagagagaagcaaacgcctcatcagttcgacagcactttcttccgtatttccggagccgattaatatggcgagtagttcggcatcactcaatgcggctgctcctttctccatcatcttctcccggggacggtcttccagcgcccactggttgatggatagtttgtgtttgctttccatgatcaaatcacttacttataaaaattcttttgaaacgcctcgaattcgtcctttcctcttatacaacgctgccaccatgcacgccagaatcccgttccataaccaattagttgtataaaggaagcagtaattgacagcattccaatccataaactgcgatttctgattgtcgaatccacgcaaaccaccaaggaatagagcagtaagggaagaggtgctgccaacatggcggcaaatcctaaaaacagaagtgccatctcgcctgtcgcacacccgggaaccgttttggaatatagtagataaaaagctaacaaaacgagccccaaccccaaaagagtcagtaataaaagcaaagagactcccagcgtgaacactgccggtagcaaatgcaccaatttcaacgaatcgggatatttcttataaaggttaatgcgggcaatgccggagttatggacttgcttaaagaacttcttcaagtctgtccgacgtttgtgatatacccatgcgtcagggaaaagacgacaagtatagccacctttaaaaatacggatactgaagtcgatatcttccccgaagcgcattttagagaatccccccaaagcttcatacacttcgcgacgaatccccatattgaagctacgaggataaaacttgtccatcttcttttttccgccacggataccgcctgttgtaaaaaaggaagtcatcgagtagttgatagctttctgaatatccgtaaaagaatcgtgcgcacggtcgggaccaccgaacgcgtcggcaggagaagcctgaagctccttctctatcgcgtcaaaatatccttcgggcaaaatgacatcagagtccagtatgataaaatattctccttcgcttcgctccgctccgtagttacgggtctgccccggtccggaattgggtttagagaaatacttgatgtccaaccgatctgtataccgatctgccacttccttacaagggatggatgaaccatcttcaacaataactacttcaaaatctttaaaacactgtacagtgagactttgcagcaattcatccacctcatcgggacgattgtaaacgggaattatgacagaatagcgcatatcaatgaatttataaaataacgattttgcgtaaatccaataaaacgaatattgatttgaagcacaaagtaaggtaaaaaaaacgagacttataaaagagttaacaaaaaaaggcgacttcatgataagccgccttttttttattatctcagttcttcttactttttcagaatatccattgtatccgatgcaatcaacaactcttcatctgtcggaatcactactactttcactttagaatctgcagtagaaataatagcttcctcaccacgaacttttgcattcacattattgtccagtttaatacccatgaattccatgtctttacaaacagattcacggcattcaaactgattttcgcctacaccacctgtaaacaggatgatatctacaccgcccaatgccgcagcataagcaccgatatatttcttaatacggtagtagtacatcttttcagcaaggatggctctttcgtttccgttagcacaagcggccagcagttcgcgcatatcgcttgatacgccggaaatacccagtacgccgctcttcttgttcagcaggttagaaatgcctgtcgtattcaagccttctttttccatgatgaatgttactgcaccggcatcaatgtcaccgctacgggtacccatcatcaaaccttccaacggagtcagtcccatggtagtatctatacatttgccatccttgatagcagcgatagaaccaccgttaccaatatggcaagtgatgattttttgtcctaccggattaacgccaaggaactcacatacacgttttgaaacataacggtgagaagttccgtggaagccataacgacgtacgccatatttctcatacatttcgtagggaatagcatacatataagcataatccggcatcgtctgatggaaagctgtatcaaatacgcctacctgcggaatgttgggaagaatagcggacactgcattcacacctttcaagttggcaggattgtgaagcggagccaggtcgttgcaggcagcaaaagcttcgagtacttctttgttcagcaatacagattcactgaaacgttcgcctccgtgtaccatacggtgacctaccgcattgatttcgtccagtgatttgatagctccgtattccgggctaatcaatgtattcagaatgaactccacaccaatcgtatgttccggaatgtctttttcgagtactttcttttcgccattcggcaaagtcaatttaaggaaagagcctttcagaccgattttttcgataccaccttgtgcaatcacttctttggtggtcatatcgaacaatttatatttgatggatgaacttccacagttcaatactagaattttcatattgtctttaatacttaaagcttgatacttatttattgttttttgctgcaatagcctgattagccgtaatagcaatcatgcgatatacatcttcgatagagcaaccacgagacaagtcattcaccggacgggcgataccctgaaggatcgggccgatagcgtcggcatgtcccagacgttgtaccagtttataagaaatatttcctacttccagactcggaacgatcagcacgttagcctctcccgctacgggtgaacccggagctttgcttgcgcctacttcaggaacaagagcagcatcagcctgcatttctccgtccagatcaagtgtaggagccatttccttagcgatcttggtagcttccactactttatccactacttcatgtttagcggaacctttggtagagaagctcaacatagccactttcggattttcgataccggcaacggctttggcagtctgtgccgtacaaacagcaatctgtgccagctggttagggtccggaaccggagttacggcaacgtcacccatcaccagaataccattcttaccatactcgggagcatgagtcaagagtaacatagcaccggatacacaagtgatgcccggagcagtcttgataatctgtaaagccggacgcagtacattgcctgttgtgttgcgggcacctgccaactgaccgtcagcatcaccgctcttaatcattaaacaaccataaaacaaaggatcattcgtcaattgacgggcttcttcaatagtcatgcctttcttcttgcgaagttcgcacagcaattgtgcatactcttcgtgtttcggagaagtttcaggatcaataatagtagctttgctgatgttacccagtccccatttcactgcaagttcgttaatttcagcgggtttacccagtaaaataaggtcagcaacttcatctgtcaaaatctgattggcagcttttaatgtgcgttcttcagttccttccggaagaacaatacgttggcggtctgctttcgcacgagccacgatttggttgattaaattaagcatagatatatttgaataatattataaaccttgttacgatttgtaatttgcgctgcaaaagtactcaattttgcaatatccacattacaattccggctaattttattctccaagtctaaaatattataatatttaacactgtacttctattttttctacctttgcagtgttttcaaacaaatcaataggtaattagtgtatgatacgtcagtgcgccattttatttggctgtttggctttgggtgaattaatcgtttatttaacagggatcaagctcccctccagcattatcggtatgctgctgctcaccctttttttgaaattaggctggatcaaactgcagtgggtgcagggattgtccgactttctagtagctaatctgggcttctttttcgtacctcccggagtagcattgatgttgtatttcgacgttattgcggcagaattctggcctatcgtcatcgcaacaatcgttagcacggctctcgtgctggtcgtaacgggatgggtacaccagattgtccgtaaattcagactggcacgtcagattaaactggcgagtagcctacgcttatcagactttcacttgtccgacaagctacatttaaaaaacaaaactaacttaatggataaagacaaatgagctttttagaaaataatttctttctgctggctgtcactttcggcgttttcttctttgccaaattgcttcagaagaaaacggggctggtattgctgaacccgatcttactcaccattgccgttctgattatcttccttaaaatggccaatatctcttacgagacttacaatcagggagggcatctcatcgaattctggttacgcccggctgtggtagctttgggagtccctttatatcttcagctggaaatgattaagaaacagttgctgcctatcctcttgtctcaactggcagggtgcatcgtcggagtgatctctgtggtattaatcgccaagtttatgggagcttcacaagaagtcattctttcattggcacctaaatccgtaacgactccgattgccatggaagtgaccaaggctatcggaggtatcccgtcactgacggcagccgttgtagtagcggtaggtttactgggagccatctgcggatttaagacaatgaaaatcatgcacgtaggcagtccgatagcccaagggctttcgatgggaacagccgcccacgctgtcggcacttccactgccatggacatcagcagcaaatacggggcgtatgccagcctgggattgacactgaatggaatattcaccgcattactgacaccgactatcctgcgattattaggtgttttgtaaaaacaaaattctttcattttccgttatataaagagttaaacgcaaaaagcattttatgattccatttaaagacattacactagctgatagagacacaataactgcattcaccatgaaaagtgaccgccgaaactgcgatctttcattttccaacctctgtagctggaggttcttgtacgatactcaatttgcagtcatcgacgattttctggtattcaaattttgggccggcgaacaactggcatacatgatgcctgtaggaaacggcgatctgaaagctgtattacggaaattaatcgaagatgcggataaggagaagcataatttctgtatgttgggagtttgcagcaatatgcgcgccgacctcgaagcgattttacccgaacggttcattttcacggaagaccgtgcctatgccgactatatatatttaaggagtgatctggctaccttaaaaggaaagaaatttcaggcaaagagaaatcatatcaaccggttccgtaatacgtatcccgattacgaatatacaccgattacgcccgaccgtattcaagaatgtctggacctggaagccgaatggtgcaaagtgaacaactgcgaccagcaggaaggaacgggaaatgaacgtcgtgccctcatttatgcattacataatttcgaagcactcggtctgaccggaggcattctccacgtcaacgggaaaattgtagcatttactttcgggatgcctatcaaccatgaaacattcggggtacatgtagaaaaggcagataccagcattgacggtgcttacgccatgattaattacgagtttgccaatcgcattcccgaacagtatatctatatcaaccgggaagaagatttaggtattgaaggcttacgcaaagcaaagctgtcttatcaaccggtaactattctcgaaaagtatatggcttgtctgaaagaccatcctatggatatggtcagatggtaataatatataaggtatgacgacaaaagaaaaggttaaggcattatggcagttatgtttcgacgacaatgaagagttcgttgaaatgtactttaggctgcgctataaaaacgaaataaacattgctatcgaaagtggggatgagattgtttccgctcttcagatgattccttatccgatgactttctgcggagataccgtacagacctcttacatttcaggagcctgcactcatccggattttcgcggaaacggagtgatgcgcgaattactctcccaagcctttgcaaagatgcttcgtaacggaacgtatttcagtacattgattcctgccgaaccttggttattcgactattacacccggatgggatatgcttccgtattccaatattcggttaaagagattaccgtaccggaatttattccgtctaaagaaataacagtcacctctgaaatcggatgtcagaaagaagtttacgaatatctaaacagcaaactttccggacgcacttgctgcatccagcactcctttgaggattttcaagtagtcatggcggaccttatcctcagtgacggaattttggttactgccagatcagagaatcaaatcaatggattggctattgtatacagaagagataagcaattaattatcagcgagctttttgcagaaaccaaagatgccgagcacagtttgttgcaccatatcaagcaatttactggatgcaggcacatgactcagttgcttcctccggagaaagaacagacgcaatatccgttggggatggcgcgaatcatcaatgccaaagaagtgctgcaactgtatgcctccgcttttcctgaggacgaaatgcaactggaagtatcagataaacaattgtcagtaaataatggctattactatctgtgtaatggcaaatgtatgtatagcaccgagcgtttgcccggcgcacatataccaatgaatatcagtgagctgacaggaagaatatttcaggcactacaaccttatatgagtttaatgctgaataagtgattccagataacgtaccctttcacaagctgccagcaggaaagcaccgactccgaagtttgaagtagaattagcatctacgacttgccccggtatggctttctcgccgatgggttgcacataaccgatctttccgtcgggctgtaaagcaactgttgacaaatatttccatgccttctcaactacaggttgataatgggcggagtcaaggaaaccgttattgaccccccattgcagaccgtacgtaaagaatgccgtaccacttgtttcgggtcccggtgcatgctgcgcatcgagcatactacgcgtccaatacccttcaggttgctgacaggccgcaacagattttgccaatgtacggaaacggtctatatattcctgacgatacttatctgtttccggaaggtctttcaagactttcgccagccccgccagtacccagccatcaccacgtgcccagaaatcctttttaccattcacacttttgtgcttggggtatacgtattttccatcgcgatagtaaagtccggcttcttcatcatacatgatactgtctgcataagcgaggtattcatgcagtttctccaggtaaagtggattttttgtgatattatatagtttggtcatcacaggcattaccatatataaaccatccgcccaccaccaataatcattgttgggtgtactcatctgatactccatcacctcacgggcacgggctatcttatgtgtatccggttccagattatataaatcggcatacgtctgaaaacagatctgataatcgccgaacagtacataatcattgctttcgccataactgtacttccagttggctttatgatccgatttagcgcctttccactcattatgttccgcccatccttttgagtattccaagtattccggtttgttggtcaggaagtaagcctccatgtttccggtatgataagcggcattgtcccagaaagaacgcccgtgttccggatggtttgtctgccagtagccattgactttatgaataatgtcaaccacttctgccgaagatgaaactttcttggttgtgcaaccggcacacaccgcacagcctaccaccagtgcggaaaaaagagttgcatacaatttcttcatatctttatttttttgtattcgtattcgcttccagtacatatatcatttgaggttcaatttccgccgtgcgttcaccgtcgccttgacaagtgtgctgtacaaagagattgagtttccgctgcttcttccacaattccgtgtcatgggacggttcccaggcatctacggaaaaatccgtcaggtcggtgactatccacttaccgttggcaacatcagcagtatgcgccattgagacacggctgccccgctcttcgtcacggaaaatatagaagatttctccatcctctaccacaatacgcggacgggcaacaggaatcatcttagtgcctcctcccttcagtgtaaacggagtcttgcggtctgtcacctgacgattatgccatgtcttcccgtcattccagacaatgcgatattgagggacttcactgtccgaactcctccaataagtggcaatataaggattgccaccagcgtctgcactcatacttgtctggtttatcaattccgagttttgtggaatacgacaagcatactctgcattcgaagctgtaatcggaagtttatattgttcaccatccgacttataccaagtcactccgttatcaaaagaacgcgcgtagcaaagatcatggttggtctccacctgccaggtttcacgccatacccatgagagatgaatcgtacctttctcgtctacatatagctgccagtaagcatttcgtttgtcttcaccatcaatcaggacatcctgtacacgggcccatttatggtctttcaatgaataacggttcatcaccagatttccacgtccggaagaaccggaacggtagacaaacaacaaatccccgtctgtcagagggtaaaattccggataagtaacatttccttcgtccactccggtcatcggcattttatcgcccagttccaaagaaccgggggcgatactgcggcagtaattcaacttatgtccatggtggtcaaaagaaacgtgcagatacccttctccgtccaccattatactgatgatattgtgggcatcttttacatttccacgatattgagtacgatgcaatgtccattgcttcgaatttagtttccgtttgcccaacacaagatagccatcggcatcataatagctgatatattgctcatccccatgcgttaccaatgaattattgcggaatatcgttgtattgacagatgtacaactatatcctttggcaacttccaccagtttttgcgaaaagcacaaggcagaaacagatagtaataaaaaagtaagcagcagtgtccgtttcatgatctattttttctgtttgtcagatttcttgtatttgtcagatttcttctgtttgtcaaagacggtcaaatcccacttttcatgccatgggatggtaatagctccgtcttttatcaatacaggaagccatacatagcgtgaatcttcgaggtctttctttttccagcggtcaaacatggcaatatatgcattcttctttccgataaccggttgtacgtatgtactctgcgcatagaaagtcttgtctgcatccggacccgtacaaggattacctatcgttttccatgtacccatgatggaatccgccactgcgatttccgctacattcgggtcccagccggtgcagccggaacttaacatataatatttgcccttatgcttaaacactgccggagcttcacgggattctttgatgaaattgcgtgtaaagcgtccgcttggtttcaggtaatcgtctgtcaggagactgatatacatggtttcgttattttctgaagaatagaattggtaggcacgtccgtcatcatcgacaaaaactgtctggtcacggctcatcgcattattcggtcggaaacttcccaagtaagtgaatggtccgtttggaaaatcagagacagctacacccgcacacgctttgctgtaatcggcactctctacatgtgcccacatcacgaacttacctgtctttttattataaatcactttcggacgttccaaaaccttcgacggatgcaggtcatggttcgggtcctctttgactgccggaagcacaatgccctcaaacttccagttcagtaaatctttggaagaatagcagcctactcccgtcacatctgtacgataacactcccatgtagcccaatcaggcaaaatcgttttgccctttttatattctccataccagtagtaagtaccgtcgtggtaaagaagtcccccgccatgcgcattgatagggttaccgtccgtatccttccacacttccccgggaataatataactattcttctgagctcgcatttgtattggcagtaaccctatacaaaccactaccagtaataacattcttaccatatatatttcattatttttgatgtttctcattattctctgccgacatatcacctcgcagtgaaatcattcgctcacaaagataacctataccataaagaaaagagttcaaatatccgtcaaaaaagggatataaaaagaccattcttcgcaaaatgtataatcttccggaattttcccctttctcatagagaatatttattgctgaaagcaataaatatgaaaagtatatccgccggcttctatatatacgatattaatcaaaattccacctatccatccattttataaaggggactcctttatcatcaaactgaacaggcagccagatgtagcgtgaatccgccaggctcttcggacgccacatatccgccataaagaaaaattgccctttctccggcaaaggcaatatataagtactttgtcctccaaatgtcttatccgcatcttcaccaacacaagggttcggcagttgcttccattcgcccaacatagaatcagcggttagcaaacgggctttattaggatcccatcccgtgcagccggaagttatcatccaataagttccctctttcttgaatatagcaggagcctcattgtgtccaccagggaaaatacggatatattttcctgtatgactgagataatcatcggccagttctgcaatctgcaatgtcaggttatcttctgaggaatagatatgataagcctttccgtcatcgtccacaaataaagtcatatcacgggacatttgtccgtctttcagatcacgctttacgaacataccttttgcaatagcttcataccacttcggtgtccaccattccttatactcttccggattccacttcattttccgttcttttcgggtcatgttcaaggggtaagctcccggattgaccctgccggagcgaatgaaacgatagggaccggcaggagaatcactcactgcaacggctgcacgcgcaggtccataaccttgtcctttcagttctaaatgaagccacatgacaaatttcccggttttcgcattatagatcaccttggggcgttccatgatgcatcctttctcaatgtcatgcccttcttcctcagagacagctaaggcaataccttcagatttccagttatacaggtctgttgatgaatagcagttgattcccttctctgtgacaaaaccggatgcaggacggtgttctccaaaccaataatattttccttcatggaaaagtattccgccaccgtgcgcattgattacattgccatccgtatctctccagacctttccggaagcgattcccttttctttctgatagactcttacataatctatttcatacttcatcggcagggcggcctcatcaatcgggccaccgttaattccgccaatggcgagattcagtaacaggtattgtggttttgtaaaaggattggtacctttaccgatacttccattccttgtgctgctcaaaggaatttcatttagcagttcatcgtccaaatatagtttgatagcctcttcatcccagtccatgcgccagatatggaacttagatgcccaatcgggatctttgtcagtgaaatgcgaataaggagtagcctgactgtcccattttgcatgccattgacggtctgttccccaagcagcattggctaagatatgtggtgttcctttaatctgataatattccatgatatctatctcaccacatgaaggccattccatattacttcccaatgtccagatagcaggccatgctccttttgccacaggaatacgagcctttatctcaaaacgcccatacagaaactctttctttccggcagtagttactgaagaagaggtatagtcaataaattctctcttcttccgccaatcattacttccggatacataaagaggatttttacggttctgctctttccgggcttctattatcaacagcccattcttgcaaactgcattgtcggattggtaccattgagcttcttcattacgcgcatatccttgctcaaagttccatacagaagagttcaaaggaccatctgcattaaattcatcactccaaacaagttgccagtcgtcctgggcaaatatgcatagtgaaaatgacaagcccatcattaaatttacaatcttctttatcttcatactaatttgtttttctttggtatatccaaacctattgaactatttatccctaataaataaaatgattcatatttacatcagcaaaaataagacttcaataaaaaataaaggactagaaatcgtgcaattaggtcgaactttagatcatattcattgaaatgactcaataatgagcatctttgcacgattttataccgaatagaacacatctgaagtcatataatcaaacgcaggagacaagttcaatcatctcatcccctgcatttactacctatataaaaatacctatcgattacttcgtcattgtacctctcaggcgatacctctttccaccggactcgtaatcgtaacaaaatgtaaatgtgccatcctcaaaactaacggtcccgttagaaaccggaagattcttccagccagccactgtgaaagtaccgtccggttgacgtgtaaacgtcacaccgttgttatcaattgagttgaaataatcttcagatgtaatgtttccagttggtgaaagatctgaattctgcgtaacattaaagaaacgagcctgatttttattcactgccttcaacgtacgctgcatattaacggaagaaggagtcagttcttcatcattgtcagtcaacgtatatctgatggctaccatctgataaatccctgaaaagtcattcgttaaattgagattcattatgagaactgtatccttaggttgtttcacgtaatcggatactgactcaattttgaaagtcaacgcataaagtttatcacaatccaatccggaagtttcgacagtaaatggcaaccgactatatacatcgcccgctttaatggtcgtgctcattgacggaaaactgcaaaattgatcacccaacttctgatattttaatggggcatccaacatatacttattattgtaccattcgatggtagcgtcattgtgagtcaagacgacttccacattccggtcgatattctggctacctcccgtagcaacggcaacatacgcattttgtggaccatcgccatacgccacatcaaattgctgtaccacttcataggcacctacaatataaacttgtttgtagtattgttcaccatccaaagggctctctttactacaggatgcaaataatcctacaagtagccccaacgtataaatagttctaattagtttcatatttcttttgattatataggtttatctccattccggattttgcacgaggtttttatttttatccaacacactcttaggtataggatagaaatagtgtttgtacgagaatgaacgccgtgtcaatttatcgttcaaaatagttgttgtgtagaatttctgacgttcattgcttcttgctttgacgttgcaaccggagataggacgattgtatgcctccatagcatctccccaacggcgcaagtcgtgataacgacgtccttcgcaagcaaactctattctgcgttcatgcttaatcagttcacggaccttattcctgtcggcagcaacagcctcagtaattccgggcagaccggcacgatgacgaatcagattgaaatacttcacaatatcagctgtattatgttccaccgtcacttgactgccgttaggcatctccagcgtataaggttctttcaactcattaatagcctccacataattcagcaatgtttccgcataccggaaaaccgggaaatatttagctttgaccgtaccctttttcatctcatcttccaaatgtctatatttgacacaagtatagcctgtacgattataatcttcaggatgatccggattagcggaagcatatccgtcggaataataagtaacctcaatattcttgtactgattctccgaagaagaagtgcctggccagaatgaatggcaaaagcctatcgttgcataaaaacgaggttcgcgattgttatacattctagcagtgctcgccagaagtgtaaagccagagaaagtttggttagcgccgccaattctttcaaaattaacgctggcatccggataaggatagtcctgactggattcattgatatcttgtccgtccaccatttggtaagcatcaatcaagtcctgtacgagattcaagccaccccatccacctaatttgaaaggtgcagcagccaccaatggggcatcacctgtcggcatttgacaggaatagataaattcaggattaatcatcacaggaatttcaccactgaatgtataagtcaacgaacggtaatggtcgataccggctgctccctttggataaggctcataataatccggatctatctctttgataaattcttcattagtgggcagatccttgctatctatttctttgggagtccaatacaactcaaatttatttgaatcaataatgtattttgaataagcggcagacactccccatttcgaattatcattttcctgcgatataaagtttgcgccgtcacttgtccgctgccagtcagcataaaacttattgccgttataccacggactggctgcatacaatgtaattcttgacaaagtagcgtaagcggcccattgggtaggaagcgtcacaaccgttgaactttctacttccagtggcaagaactgaatggccagagacatccatttacggatttccaatacgcattcatcgtatgttcctcgttccagtgacatttcggctaccggcacatccacattaaagggcgtttccggaacaatgggcacaggtccgtactgcaacatcagcagataataataatatcctaccaaaaagtagcatcgtcccatcaactcacgacgttcaacgtctgtcacatcgggtacttcattgattctcgacaaggcagtgagtgccatacgaataccctgataatatttgggatagttattgtaatatccgtcataaggagtaatctcgtccagcaaaaacttcatgccgtagtgctggctatcattccaggacatgaaattctcatcagaagcaatttggaacggtgtagaagaatttgaccaaagtttgccttcattgggtatatattgcgctgcaccgttaatatactgatccaggagttctttgcgagagaatacggagtcaagaaaagtcatctggtcaatatattcttcgacatccagataatcaccgcaagattgcagcccgatggttatactacaaaccatcgacagaaataaagtctttataatatttgttttctttttcataataatcgtcctttagaaagttaagttcaactgtaaggtgtacatcctttgcaaaggatattccgctccattaccagaggcttgcgatggatcaaaaagcttcactttatcccacacatgtagattctcgcctatcagactgagagtagcagattccacaccgacacgactcttcaaccaattattcgtaaaacggtaagagacatctacatttttgaggcgcagatatttaccgtcagctaaccagaaggtagactcctgattattatttttattttctccatacgttagtcgcggaaacttagcattcggattctctgccaatgcaggatcaatgccattaacctcagcatattctcttggaatccaacgatttcttggatcagcaaccatttcgagtaagttacctcttgattcatttaagaaaggatagaatccccgaccaccttgaaaatattgtactttagagactccttcaaacaaaatactaacacggaatgccttgtagttccaatcaagtgcaaaaccgtattgtataaacggtacagcagagtagttgagaggtacgacgtcatctttatcaatcttaccgtcaccgttcacatccttatacttgatatcgcccggacgataattatccataaaggtctgtttgggactacttttaatgtcatcctcatctttaaataatcccaaagcaattaatccgcgctgtactttgtaagggactccggaattagactgatatggataattcaccccactctgttcccagtagatcacttcgttttcagcgtgagtaaagttaccacgtacagtaagagccatatccttattaaatgtatgagtataagctagtgtaccatccataccccacgacttcatgcttccgatattagcataaggaagtacattgcttaaaccaccctcgtccggtatattggcacgcctctggaaaatatcggttgtcttcgtatgaaagaaatccactgtcatgtctaccttatcatcaaagaaacgggcatcgataccaaagttcgtttttgtactgacttcccattttaaattcattgatccggtacgattttcggcaagtccggttccccatgtactggaaacgttacctaaagtagttaaataagggaatcgaatatcattaccattctcatctttcagacgatcatttcctacccgtccccaagaagcacggaacttcaggaagttattgaatgggagcagatttctataccaatcatattgcgtaggcacccaccccccggaaatagaggggaaccaaccgtagcgacgttctttattgaaattttccgaaccggtatagccaagattaccttctacaagataggtatctttataagaataggtagcgcggaaggaaagtgcctgataacgtttgggaatgctgactaacacaccgtttccccaatccacattggtcagttcctggcggtaaaaatgcgccaaccccgtcacacggtgatcttgattaaacaaacgtttatagttggcggcagcttcgaaatataattcccgattggatgctgatccctgtgttgctgtcatatcctccttatttacagtacgcacagttttcaagctaccatccaaataacgtccatctttgggatcggcataatattgttcggggttcatatgtctgtcgactatgtgtgcaccattcatagagaatgagaacaagccacgtactgacaatccctctgtgatcatacccaaatcctgcgacaagcctacatttattttggtagaatacgtctcattggtagtatatcccatgtaattcaggcgtacatatggtgatttatcctccagattagtgccataagcaggcaactgaccattagagtacctcacaggaaccacagtaggaggtaagttcgcttgcgattcccacaggtatttattgcttgagcctgttcctggtgcgttttgtgtcttgattactgcttccaaattcaaactcaacaaagttgtttttgtaaggtcagcatcaatatttgtacggaaattatatttatgatagtttacattaacgtcatgtttgcttgcagacttatcctgtttaaatagagcttcagagttaaggatacccaaactcatatagtagcgagcactttgtccaccaccggaaatacttaaatggtgttgattgttaattacatgatctttcaaaatcacatcacgccaattcacattcggatataaatccgggtcaagacctgttttgaataattctagttcagtagcagaatataccgggtcgtctccacgaacggagcgcgcttcattcgccaatgttgcatattgataagcatcagcatattccggcatacggggtgaataagaataagtagcattagttttgaaattgacatgcaactttccggcttttcctcgcttcgtagtaactacaactacaccattggcaccgcgagttccataaacggctgttgccgatgcatctttcagaatactaaaactttcgatatcagcaggatcaagatcgttgatatttccttcgattccgtctatcaacaccaatgcactagaactggcgccaaacgtactcataccacgaatccagaactccgagaagttgttaccaggttcgccacttcgggtcacggcaataatgcccggcacgcgtccacccaacatgttactcaccgataccgcaggagcttgaatccctgccgggtctacattggtgatagcgcctactacagaaacctttctctgagtatcacgccccactaccacaacctcatcaaactcattgaccgcctccttcaaagcaatcttctctttcagtttcgtagcagtatatttaatttcccgagtttcataacctatataagaaaatacgagtgtacttccggcaggaacacctgttatcttaaaccgtccgtcaaaatcggtaacaactcctacaccctgttttccttttatctgaacagacactccgatgagttcctgtccttgctcgtccaagacgatacccgcaacatctattccgccttgggcgaacatagttgctgacatgaatacccaaaatagtactaaaatacttcgtttcatatttatgtttttcttagtgattattctactgcatacttcctaatagcttttccccaggcttcagctatccaatagccaccttcaccatcgtaacaaatatcataaggatagttaaaggtagcttccagcggtgtgccatctatctgacttgctacatctacctgaccagctacagtagatacatagccatcaagaatatccaacttgcgcaagcagtaccccttaaatccatcaacaatataaaagtttccatcttcgtccactgtcattccgttgggttgggcaaacaaagcttcttcccgaagaccatcttgcactgtcttttgggtagccgacccacagaaccattcacattctccatcaggagtaatcttgtaaactgaagacagattctggtcagacatgtagaaattgctatctacaaaataataaataagataagggccaggatttgtgccaagagatcctgagagttccagttgctttattaatgttacctcttgtgtcttcacattgaagcgaccgaaattcttgttagaatcaacaaaatagagccattcttctgtctcatccaatgcaacagcaccaattttaccactaaaagtagaaccaagctgtccgatacgtgtaggtgcccaaccacttgctttcatatagacatatactgtatgagtcccttcccaaccaatactatacactctttgtttgtctttggtaacagcaggctttccacctttaaaacccggatgaacggtagtcaccttgttatcatccaccgaaatcaaacggacacgaggatcatctctttgataagcaagtaccgtattatttcctacggctgcaattccccacatgtacttgaactttgcagatgcaaggtcaccatcatcattcccatcttttgaagccgaaccagagatggtagaaacattctgggcctgttcatacttaaatgtgccatctgtagtcacttccttcccatcaacaattaccttgatacggtttccacccggcaattgtctgggtgcaagacaataaagggtattattatcgatacctattactgtagataagcgttctgctgcctcgtccacaaaataaactttcacctttgatttgtctgtaccaaagttagaacctttaacgataaccttttcccgtagcttgccctctaccggcataaagctctccactgtaacgggctgattcggatcataagtcgccccagtggttttgttgtcatcgctatctttacagcttcctattaaaaagagaagtgctagcactaaagaatagaaaatgcaatttctcatagcaaaaatatttaagatattagtaaataaaaaattaaccgttcattaattgatttatgatttcaacgaccaattaacaagtgcaaatgtaagttaagtcactccagatgaggtccaatatgagttatctgaggtcgaattatagatattcctcctttttaaactataattcgaccaaggaataaggataatctgatctgtaaaataaaaactacatataacataacatcaataaaacaataatttgttatatggtaaaccgttaatgaaatcagttcactccttgcaggttatcgctcacattcttaagtccttagctacgaacaattaagttttttgttagtcatattagttcgtgccactatagtggtacgcaagatgcactatagttccctttacgcaccactatagtagaacgaaaagataactatagtggaacgaattagctaatggggcaaaaaatattaatactacaaagaaaactgattaaatattcgaagagtatagcttattgccatactaaacttaactataactctgctatcctcagaatatggtttgttacaccctacaatgcactattttacaaatatgcatatcaaaataattattggtaaataggttacccctatctatgcctatacattttgaataaaccgctcaatatattcagacggtaacatatcaaattcttttttgaaacaagaactaaagtatttaggatcattgaaaccaactgcataagcaagttcagaaacacgaacattagtgcctttttcctccattatcctacaagctgctttcaaacggacatttcgaataaaagaagaagtattcaaacctgccaaagatttcaatttcttatataacgtagatttacttgtacgcatttcatctgcaaattgcgcctggtcaaaattagggtcttccaagtgattatttacacaatggatagcacgttgaataaagtcttcatccaaacttgtgtaattcaggtctttcacctcaaaaactatttgatttttaaagtcacgcgccattcgttccttatatttcagcagattacgaatacgtgcatgaagaactgtcagattaaagggcttgctaatgaacgcatctgcaccaatttcataagcttctgctctgtcctcttccttatttttggcagtcagcagaatcatcggtatatgactcatctccagatgccctttcacatacttgcagaactcaataccatccatctcaggcatcattacgtcagacacaatcaaatcaacatcctctttttctaatactgcaatgccttctttcccattctgggccgtaaagacattgtattcacgactcaataactttgtcatcaggtgtagtaattccccattatcttccactaataatatagtgttagcctttatagtcacttcctgagtttctacatcggcatcctcctgtgtatcctcgtaatttacaggattttgcattaaagagatagcctcatcatcaatttgctcttcatcataataagaacgctcaataggaatccgtaccataaattcggtaccatgatccacttcgctttcgaccgagatggttcctccatgtaactctaccaaatctttagtcagcgaaagtccaattcctgtgccaatagtattgaacttacgatagtcaccttcataaaatcgtttaaaaagatttttctgtttctcttttgaaatgcctttcccgttatctttaatcttcaacaggataaaatccttatctgtctcatcataagataaggagacttgaataaatccatcctctttattgtatttagctgcattagataacaaattatacagaatcttatccaacttatccatgtcaaagtagcctatcattgattcaggatcacaaagaaatgaaaagtgtatcttacgtttctttactaaaggctggaaactctcagccgcattcttcacaaaggcagcaatatctcccggcgaaacccgtaacttcagattacctgtttccgcttttcgaaattcaagaatctgttgcagtaaacgtattaatcgctgtatattgctattcattacagtatacaaatcattatggctgggcgcctgtgtcttcagctcatcaactgtagccgaaataatggtcaacggagttaatagttcatgtgtgatattagtaaagaactgcaatttcgcatgattcagttcttccgcttttgctttttctatttcacgcagacgcaaggcattccgaagcaatatacgattctttgctgtacggtaaatcgaaactcctataactgatactattatcacatagagcagatatgcccaccaggtagcccagaacggaggaaggactaccactgtcaattcacgtacatagccactccattctccgttctcattggttgctttcaactgaaaagtatatgtcccgctcggcagattgttataataagcaaagcggcggtctgcatccgtatactgccaatccctgtcaaagttctgtagccggtaagcatatctgtttagttcgggattcttataggtaagggcggcaaattcaatactaaaattattgtatttatgaggaagttcaatcttactggtataggtaggcattaccggcgaaatcttctgctgcagttcaaccggcaagttactgaaagaatgattgaatattttaatatctgttatcaggaaattggtttcctgagagggtatttccattttatcaggaaaaaaactgttgtaacccttatgtcctccaaaaaacaattctccatttcgactacacgatgaattgactataaaattatcctgcaacccatcagcagaagtatagatacgggtcgagaaatcatttccaacagcagctacataaagtttcactagtccggaaatcgttcccagccataaattaccacttttatcttcttctatgctaacgataacgtctcccggaatactatatgcacgcgttttttcctcaaattctcctttgttacgattataaaggtataatcctcctccctcagtccctgcccacaatcgaccaaaacgatcaagatgtatacagagaactgcatttgtgattagcttacgattatgaaaactataattctcatatttcaatgtggaaggttgacggacatcccccgttatatgaatcacacccaaattagaagttgccagccagacactgctatccatatcctttatgatatctcttacatatatccagcctgccgacaaactatcattaaagttcatcgtttcaaagcgatagtctgtaccgtcagccaatctgacccctattcctcctcgcgtgccaacccagcaattcccttcataatcttcatataaagccgacacacaatcagaagtaaggaaaccgctattctttgtagtcaagtgttttaccttttcacctttccgatatacgtagattcctccattatacataccaaaccagatttcaccactcttcttacgctgggtaactgcgaaaagggatggcaaatcttttaaccccgaaaattccggtatgtgcgaatacatctttagctttcctgtttcatactctctacaggccagtccataagttcctactccaatccataggttttgatctgaatcagcaaataaggtacgaacggaagttaccggaatatcttcatctccaaagttaagtgtatataaagcaaatgtagattgacgtgtatcagccatcagaactcctcccccaatagcccctatccacatattcctctgagcatcacgcataatcgagttaacctcgtcagaaggaatacgataatctgtttttcccggtttataattaataaatgcgtccggttcatcaagttttaagatactcaacccactacgtgtaccaacccacagggtatgagtattgatatcttctgctatatcatatactatattatcagacaaactggaatcatcaccgttctcatgcagaaaacgctgataagacacacgttgcatatctttaggattctgcaatttaaaaagaccatatccccaactccctacccaaatatctttattactatcttcataaattacatgagaagaatattggtcattgattttcggatatatttccactttatctgtggatggagaataacgaaataagccttgtgcccaagttccaatccagagatcgccatctgaatcttctaataatgattttatggtaacataccgcagtctactatctccaaagtcatctccacaaactacaaaagtatctttctctgcaacataacgacataaaccgttatccgtccccacccaaacagtattatcgcgagtcacacacagagcagacactacattgttagaaagatatggtgccttatacttttttatttctccggttcttttatccatcacgttcagtccttccgatgtaccaatccaaagatgattattattatcatcaaccaaacaagtgatgctattggtagtcaataaatccggagagtaaagattggatttgtaaagagtggtctcatagccattatactggcaaagtccattacgagtagcgaaccagataaatccatctttatcttgatacactttttgtacttcatttgtcggcaaggaatatggtgcagaaagttgcttaaatttgaggttgtagatgacatcctctgttgccaatagtaaagcagacttcaaaagcaaaaacagaatcaaaaaactcagcttataataaaggataacgattcgcgcgtttttcatatggtcatattttgttcgttaaatacaatataataattgacaactatacata

SEQ ID NO: 62 - DNA, 44076 bp, Bacteroides thetaiotaomicron
cataagtattgattagatagtaatatgtattaactttaaattgaaatgaatgaaaaattgtgtatttattaagaaatggaaattctggtatcaacgctttcctgtgcttattagaacgacatttatggtaactccagtctttttcagacgttacctggtacaatatcctttttgtgcttgtcttttatttttaggggcgtgtaccgatgtcaaagggtttactaatatggagttaggtccctatgcgaaaggaccagaggtattaaaggctttccctacagctgaaggcttcggtaaaaatgctacgggaggtcgtggaggaaaagtcgttatagtgaccaataccaacgatgacggagaaggctcttttagatgggcattgcagcaatgctcacaaaacgaagcaactactgttgtttttgcagtttcgggcaaaatagaattaaagtcggaaatccgttgcaaagctaagaacttcacgctggctggacaaacagctcccggtgatggtgtttgcatcattaagaatgaaataaattttggtggttcggagaactttattattcggcatatgcgttttcgtgtcggtgaaaaagatgcgagtggaaaggaacataatgctgcctgtctgcgagtggaaaatgcgaataactttataattgaccattgttccttcagctgggctagtgaagagaataccgattttattgatactcatttttctacagtgcaatggtgcatttccagcgaggggctttattattcggtcaataaaaaaggtgcacgtgcttatggtggtgcgtggggaggaacttcatctacttatcaccataatctgtttgctcattgtaatagccggacgccattgatgaatggcgcacgggggaaggatcccggacaggatatcgttgtttatatggaatatattaataatgtgaattataattggggcagtcaaatggctacttatggaggtatggacgagtctcaggatccggaacatcatggatggtcatgtaattttgtgaataattattataaaccggggcccgctacgacagcccgggtaaaagaactgaaattcttccggcaatcaagcgcccgtgaacccaataaggcacctttgcgtgccgtttcaaagtggtactttcatggtaatgtaatggagggtaattctcaactgacttccgacaattgggaaggtgtatatacggatggtaattatccttattctatcgatgagatgaaagcttcttctttcattattccttcagggaaagagaattatgaacaatattggttcgactgggaatcatacactttatctgaccaatatgaatctgcggagaaagcttatcaatctgtgttggctgataaaagtggtgccggcgcatttccccgtgataaagtagatgtgcgtattgtaaaagaagtgaagagcggactttgtacttatacaggagccggagacgccaatagtggtgctatcccgggcataataaatagcccggatgaggctgaaggtctggatggactgacgtataaaaccagcggaaccattacggatacggatcaggatggcatggatgatgcctgggagaaaaaggttggtttggaccctgctaatccggaagaccgtaacaggacaacagaggttggttatacagctttggaagtatatcttaatagtctggtagatgaaagtatttcctacaactttaagaagtgaaatcagtgttaatattaaaatagaatgctatgaatttattgaaattaatgacagtagggtgcctgttaagttgtttttcaggactgatgacaagctgttcggacgatgatgatgccggctcaaaagtattgttacgaccggttactgctatggagatagtgcaaaacaaggcatatcttagttggaaaagcgtagaaggagcgaccgaatatatcgtcgaggtgtataaggtggtggataaaggggaagaactttataagacggagaccgtgccgggtgaccgttcttcctgtgtgatagatttagactgggaagaaaactacaagtttaaggtgaaatgtgaaggtaacggaaggctgtccggttattgggaaacagaggtgacgggtattctttaccgccctttgtcgatagagttaggagaagctcgtactatagatacacaggctcttatttcgtggacgcctaatgatactgttgtgattacagctctgactgctgttccgatggggctggagactgttaattctcaagatataaaggtttataacgtttcttccgaagaatatctggccggctccaaaatcatagatgatttaactccggagacttcttatcgtgttagtttatattcgggtgaggaacagaactcggatacttatcaggcacgcatagaagtaaagacagctgtaaccgaaaatctggatgaagattatgggacggcaaaccggatagatttgcgtaacgaagcatttgatcctgattattttaataaacttgactggaactctctggcagaaggtacaacctttgtgcttccggcaggtaagacgtacgtgttgaatagtggagaaactgttattgagtttgcacattcagttcattttgttactccgcaaacgttggaagattatccgacatttagttttgataacgctttccgtatagtagaaggcggagttgtagacaaggttacttttaaacgcatcaatcttagggcttccaaatcattaagtgaggttgctgataacagtttgagtggtaaacaagtgatttgtccggagtccgatgtttttctgattaacacgattgatttcactaattgctatattgagaatttccgttctattgtccgttcaaaaaaggctacaggaaatgtaggagctattgctttcaaagaatgtaccattaacgcaatcggtaatcagggtatagtttcgactgatggcaaaaatggaaattacatcaatgatgtctcttttgatgagtgtactatcactaatatttgcggtattgcagatttgcggaatagtagcagcggaaagagtatttcgattacaaacactacattctgttatgcgccgatggaaaactccttcttattccgggtagatccgagtattgctgtcaagattgaaaattgtgtatttggcggttccatgaaaatagatggaaaacttccgaaatttaatgaactggggtccggaggacaggatgattataccggcgtatatcctttcagttcggttaatagttttcaggctaatgatcgtacctcaagcaaaggaaacctcggactgagtgattctaaaatgtcaactaccactctgttcactgctccggggactaacaattttaaattgaacgagttattcacaggttgttccagcgtaggtgcttcaaaatggagacgatgaaccgcgcattaaataatatatataatatgaataaacacattgtattgatgaagttcaaaagttcttcattcattaaaaaggtaggagtgttattgtgtttcgtagcatttgcgctgtcagctaacgcacagacccgaaaggttacaggacagatagtggacgaaagtggtcagccgattatcggagctactatacggttacaggatgctacgacaggtactattactgatattgacggtcacttttcgctgaatgtgccggatggaaaaaaggtggtaatatcttatatcggatatctgaaacaagtaatcctgccgaaaggcgatactttgaaagtcattcttcaggaagataaccagaaacttgatgaagtagtcgtagtaggttacggtagtatgaaacagaaaaacattaccggttccgtatcgactatttctgctgaagaactggaagatcttccggtatccaatctttcggaagccttgcagggaatggtgaatggcttgaatgtacagttaggctccagccgtccgggtacgaatgccaatgaggtttatatccgtcagaaccggactttcaccggaatatccaaggatggtggtaattccacccctttgattattattgatgatgtcattcagttaggaacgaatggtcagccgagtatggagcagtttaatatgctggacccttcggaagtagaaagtataactgtgttacgtgatgccagcgcagcgatttacggttctcgtgctgccaatggtgcaattcttgtaaagaccaaaagagggaaaaaaggagtacctgttatttcctattcaggtaaatttgccgtgaatgatgccgttagtcattccaaggtgctgaaaggttctgcttatggacgtttctataatgctttggcgataggttccaataaagcgagtggttatgatgacctcgacgtgctgtatagtgatatggaactggctgagatggataacctgaattatgattggctggataaagcaggctggaaatcggctttccaacagacacatacactgaatgttaccggtggaagtgaacgtgctacatattatgccggagctacttattttgaccagggagcaaatttgggtgatcaaagctataagcgttatacttaccgtgccggtgttgatgtgcgtttgacgaatgatattaaattatcagccacggttgccggtaatgagggtaaatccgatcagatctatacaaaaggagcccgctttaaactgtacgggatgagtggaagtacggaaaaatcagactatagtgctttgcatcatatgcccaaccatatgccttggagtgtgactttatcggatgagaacgggcaagatcaggaatattggctgggacctatcgagaatacctatagtagtccgagctttaatagagattatgttacttcctggaattattttgcgttgaataatagtggttcgttcagtaagaacagaagcaacagctggaatgctgatatttcattgacctatgaagttccttttgtgaaaggtttgtcactccgtgccacttattcgtcttcgcattcaagtgaagcaaccgagcaggctagtttcccttatgaactggcgtatgtaggcggcagaatgcctgccgaccagcatttggtttataccatcccgagcagttcctttaaaacggctatctttgataagaacagtacattatcatttaaagataaacaggcggaaagacgtcagatgaacttttacgtaaactatgaccgtacgtttggccaacatagcatttcggctatggcttccatcgagcgttatgaatcattctatgattctcgtgatattgaatatgctgatctggctcatgacatttctgatacttatctgggagtcggcggtccctccatcgtcgggccggacggcaagtcagctctggcttccgacaatacagtgacgcttaaaggtgaatcgggctcgctttcttacttgggacgtgtggcatattcttatgctgaccgctatatgttgcagtttattttccgttcagacgcttcgactaagtttgctccggagaattactggggattctttcccggtatctctgcgggatggatcatgtctgaagaatcatggttcaaacgctcgcttccttggtttgaattcttgaaggtacgtgcatcctggggacgtacgggacgtgacaatatcaagatgtggaaatggaaagaacagtacaagatggacttgaaaggaatgcagttcggtgccgaaagcggaaagccaggtaccagtctgatcccgcagtcatctccgaaccgtaatgtgaaatgggatgtttccgacaagtttaatcttggttttgatactcgtttctttgatggtcgtttaagtgcggtattcgatttctactatgatatcaatgataacatcttgaatcagtttatggctagccaaccgggaattcccgtgtatgccggtggttcgtatgctgaagaaaattttggccgtgttgatacatatggcggcgagttgtctttgacatggcgtgacaaggtaggacaggtgaactataatatcggtatggatttcggtctgaacggtagtagagtgaaagagtgggtgccgggtttgcgctataacaaatatccgtccagctcaagctgggaagaaggaatgtctacatatctgccggtatggggattcaaggtatggaaaggaacctcgaatggtgacggaattttgcgtacgcaggatgatattaacagatactggtcttatctggaatcatatactcccgaaggcggacaaactaaatatctggataagacaagtaaagacgatttgcgtccgggtatgctggcttaccaggatttagggggcgaaatggtcaatggagttcaacaaggtcccaacggacagattgtattggaacaggattatggaaagttatgtgaaaagaataagacttataatgtctcgacaagactgggtgccagttggaaaggacttgctatcagtgccaatatcgctacttcatggggtggagtacgctttatagaccgtgcttctatgggtggtaataagagtacaatgatatgggcaccggattctttctggggagatatgtttgacgaaatgtacaatccgaatggtaaatatcctaacttgggaacagaatctctgatttccagttcggctatcgccaactctgatttctggatgattagtaccttccgttgttacatacgtaatctgtctgtcagctatacacttcctaaaaagtggattgctccgttgaaaatgtcggctgtccgtctgaatctgaccggtaataatttgtgggatttgtacaatccataccctgaccattaccgtaatatgtatgatgcttcttctacagattatcctactttgagaacttggtcattaggtgttaatgttacattttaataattgtgtcaacgatgaaaaagaaaaactttttatatacaggaactttagccctcggtatgtttatgtccggttgcagtgattcatttttggatatgaataattacggagcttatgatgattttaattctgaaacgaaaatcacctggtatctggccggattataccagacaagttttgaaaactatacatctccgacgtctcagtatttgggattgtatacttcttatgcgcaggattttaacgaattcacggatgagatgtggggaatcacgtctaccagccggattgacccgagtacgcaatattcgaccattgatgatataaaaacacagacagatgcttccagcggtaaaagttacgacccgttgtttgccggttatttcggcaaggcactaggttcaagtgttacgaacaatgcttatacgcgtatacgtaactgcaatatcctgcttcgtgacattgatgcttcctcggtttcgcaggataccaaagataaggcaaaagggcaagccctctttttacgtgccatgcagttgtttgatttggttcgtatgtatggttgcgtacctattgtgacaacagtgctgaatgctgaggtgaccgatgccggactgccaagagcctctgtgacccaatgtgtggaacagattgtgaaagacctgaccgatgcggccgctttgttgccggatgaatggggaacaaacgattacggacgtctcacacgtggcggagcattggcatacaagagccgtgtgttattattctatgccagccccatctttaataagaattggaatgatccgggcaaccttcgttggcaaaaagccctggaagctactcagaacgctatttccggtattactgccagtggattggacggtgtgacggatgctgcaagctggagtaaaatattggcggatgacgataatgaacattctaacagagaaacattagttgtccgactattggctaaggaaagcaactcgtcattaggttacaagaataatcgctgggagaagaatatccgtttgagttctcaaggaggaagcggtggaaaaggtgctcctattgagttgatcgatgtattccctatggctgacggtacacttcctgatgccgctcatcaggttaccgaaggtagtttgcgctttatggaaaaccgtgatccgcgtttctaccagacatttgcctttaatggtttgaagtggggacataaagatgtcaccaatgatacggtctgggcttatcgttggcgaacttcggagtcaactaccagcggctttgcctatagtgaaggagtaaatataaccagtccggtattcgtacgtaagatgagtggactcaatactgcttctgccaacaactacgaagcttcgggagtgcatatctatgatttccgttatgcggaattgcaattgaatcttgccgagtgttatgcggcaaccaatcagattgatttatgtaaacaggcaatcgggaaattgcgtgcgcgggttgggattccttccactaataattacggtttggatacttatgtgtttgaccgggcatcggcgttggctgcctgtttgcgtgaacgtcaggtcgaactggcatatgaaggcaaaagatattgggatatttggcgttggatgctttatgatggaggacggggagaagctatgcagttgagtaccactaatacctgttcattcctgggagtaactccgttgaccgaaagatatcgtacagctaaatatgtggatgtaaaagatggatatactccaggcagtaaagatgtgttgtcggaactgcgtaagaatatatttgcagaccctgaatctgccgatttccagaagcaacttaaagaagtggctgatttttgggagtctaatttccagtacggggagcccaatgtgcaacctgataagaacaacagcaatgaatggattaagatcggatggcgatctaattattatataatgggtctgtcaaaagatattttggacaataactcctggctcggacagaccaaaggctggacagaccaaaatggtgctgccggaactatagattggcaagatgatgaaactctgaccatagattaaaactgttttcaggattagattaagggccatagtaaggaagaattttataatacttttctactatggcttttttatgaattattttccggagatatactttgtttgagtacaattttaatagacgaacaggtaaatgactattttttactcctaatctgtcaataattgaacttagggggagtagacttccattacttttgcttgtgaaatgggaaaaacatatcaatgaagatatggatatttctgtaagtagttatcaataggaacccgataaaataaattaaaaagagatgaatggaattttgaaaaaggatttgagagttgtgctgacaggtgttatgatatttatatcatatcaggtttattcaaatccggaaagtggaacaaaagaacagggagacgtatacaggaatcttccgttttcaatgcctgaagtgagccaaccttcctttcccgattatgaggttaatatccgtgatttcggcgcactcagcgatggtgtgaccttgaacacagaggcgataaacaatgcaatcaaggcggtaagttccaaaggaggggggaaagttatcatacccgaaggattatggttgacggggcccgtcgtacttttgagtaacgttaatctatatgccgagaagaatgctctcattgtatttagcagcgatacatctctatatcccattatcgacacttctttcgaagggctggacactaagcgctgccaatcgccgatttcggcaatgaatgctgaaaatatagccatcaccggcaatggtgttttcgatggggcaggagatagatggcgtccggtcaagaaagacaagatgacggaacggcaatggaaaaatctggtgagttcgggtggtaaagtggatgagaacggaaaagtatggtatcctgatgcgggtgctttgaaagcctctgtacttatgaccggacaaaataacgggcagaaagaaataaccgatgaagagtggacttacatgaaaagctggttgcgccctgtcatgctgagtatagtaaagagcaaacggattctgctggaaggggtgactttcaagaactcaccgggctggtgtatccatcctttgtcttgcgaatctttgactttgaacgatgtgaaggtgttcaatccctggtattcgcaaaatggcgatgcgctggatgtggagtcgtgtaaaaacgtactggtcactaattgtttttttgatgcgggggatgatgctatctgtctgaaatcgggtaaagatgaggatggacgcaggcggggagaaccttgtgagaatgtgattattaagaataatacggttttgcatgggcatggcggatttgtaatcggcagtgaaatgtccggtggtgtccggaatgtatacgtatcgggctgttctttcgtgggcacagatgtcggtttgcggtttaagagtacccgcggacgtggtggcgtagtggagaacattttcatagataatattaacatgattgatatttccaatgatgctctgacgatggatttgtattatgctgtcaatgactttccggaaactccgataccggatgtgaatgaggaaactcctgttttcaggaacatttatatttcaaatgttctttgcagaggtgcggaacgggcagtatatttcaacgggctgccggaaatgcctcttaagaatatctttatcaaaaacatgactgtaactaatgccaagaaaggtattgtaatcaatcaggcttctcaggtgaatatggagaatatcaaagtggaggatcctgaggctccgggcatacagataaaaaatgctacaggcattattattaacgggaaagaatataaaaaggattccggaaaaatgctgctttccggaaatcagcggaattaacagatacggaactgttgctaacttattggaacatagggataaataagtatcctgctagccaaaatcttttatgtctttagtcgtttttctttcgtagcacctaggtgagacgaatgtattacctaggtgcttcagttatctgacctgggtgctacaattgtctgacctaggtgctacgaaagaaaatagccggttatggtgattaatgaatgcgtacggtcggcttctttttttatttattcttctctttatattcggaaggcgtgatacctactaccttcttgaagcatttactgaaatacttcgggtcattgaaaccggtcatataggctacctgtgagaaattatattccccgctgtctattagctgtgctgcacgtttgatgcgtacttcacgtatgaagtctacaggagtcagtccgatgatggacttcagtttccgatagaagatggtgcggctgagcatcagatgctctgcaaattcgtcgatggtcagttcggcattatccatctgttcttctatgaactccattaccttttgcatgaattgctcgtcgtagggagtaatctgcggttgcgatggggtaagagcttctgcgacagctatttcttttccttccgtcagtttggccatatagatttcctgcaaggatttgcgttggcggagcagtgaagcgatacgtgttttcagatatgtggcgctgaaaggttttgtgatatagtcatctataccttgctccagtccggcaatccggtcatccaaagaggcttttgccgataatacaataatgggaatgtggcagatgttattgttttctttgatttgccgaatcatctccagaccgtccataaccggcatcattacgtcactgatgataagatcggggatattatcaactgcgtgttgcaatccttcttttccgttcgaagcggtgataacagtataattctcagataagatgttttttaagaaagctttcagttcctcattgtcctcaaccaccaatatagtaagcgtatccggagccgtattattctccatatcttctttgtcttccgcttctgctcttttttcagtctggaggctgctgtccggatgagtagtcggactttgactgtcattcagaataaattccacctgactgtcttgttcgaagacttctttttgaagaggcagagttactatgaaacggcttcctgcttccggctcgctcgttactttgattgtaccgtgatgcatatcgaccatttcctttaccaatgacagaccgatgccggaagacggttggagcatattctgctgtgccagcgtttcgaagcgctggaacaaagtacgcagtttagtcggttcaattccgatgccttcatccaccacagagattgtcactttatctgtttgttttgtcacttctattgtaatcgccttctcagccggtgtatatttgaatgcgttggatatcagattaaagaatatcttttcaaacttatcgcggtctatccatgcatatattgatttaagttcgcttgccaaccggaaattaatcttcttttcttctgcaatcaagcggaagttgatcattactttttcaagaagtggaatcaggtctgtcttctccaccagcactttcatcttctgattctgtatcttacggaagtccagaatctgattcatgagacgtagcatacgttcggcattcttttgtaccacagtcaagtgctcacgggctgtggcggataagtcttcattttccagaacttcattgaccggactgctgatcagagtcagcggtgtccggagttcatgagatatgtcagtaaagaaacggagcttgatattggatagttgttgctcgatatccacttggtggcgcaaccgataaatataaaaaagtacatatacgatactgcccgtaaagagaacgaagagaataacgtagagcagccatgcccagcccgtctcccagaaagtgggcagtacgttgatggataaagtgcggatattgtccatccatactccgtcgctgttggtggatttgatttgcagtttatatttgccattcggcaagttgatgtagctggcagaacggttcttgtccccgtcgtgccactcttcttccagtcctttcagtcggtatgcgtaacggatttctttggaatcgacataatcgagtgccgcaaactggaaagtaacattacgctgagagggggtgaggcgtaattcttccagatcgtcaatggcgatgacagaagattgtccctgcactttcaaaccggtaaagacaatgggagggacataggaacttttctgcatctctttggaagaaatctcaatgaatcccttgtctgtaccgaatacgatttgatttcgagcgttgatcaccggtgccgcttctgagaagctaaattcctggtgcagagagttaagcccgtaattctcgaaagtctttctttgagcgtcgaatttagaaatggcattttccgaaagaatccataagttgccttgttgatcttcctgcatggcttgtaccaagtccgaagccagtccgtcatccgttgtatatgtcttgaactcaatcttgttgctgagcaggttcttggatacgatttggctgatgcctcccgtaaagctggctatataggttcgtttttgcttgtcggtgtatgtatgcatcacatcatttccgctcaggctggtacttattcctgactcgcaacaattacgataaaacttgatttcttccggtctctcaaattgattggagaaagtcagtaatccgttggtggttcctattaacagcacaccgcccggcgcttcggatatgtggcggactttcgaagcgtagccggtcgggtaattcttcaactcattatcgctgtgtataaattctgtcttaccgtccttattgtaggttagcaaattgattcctccgccatagcagcctatccagatacgtttatggctatcttgaaaaatggaatatacactgttgccactcaagctgtatggcatattcggttgatgagtgaattgttgtacggaataggaatccggcgactttttctttaacagataaatgccgttttcctttgttcctatccagatattgccttcatggtcttcaagaaagcaatatacgcttgtaaaactctgtttatctttgcttatttttccttgtggcgtcagatagccttccaactgtccgtccggttggtacactctgatcatctgtgccttcgaagaaacccacagcctcttttcattgtcgcataaaaaagcgcgggtctcgaatccattgtcaatatgcaccagattataggtatgtggaaagaaggacaatttgtaaatgccacgtgtactggtcagccagcagttaccctgattgtccagtgtgtaaaagcggacgagcggactgaaaacagacttcggattgttgctgtccttcagcatgggtttcagttctttgttttcacggtcataataagacagattcccttccggggggagaacccataacgtgtgttgccggtcttcaaagatcacattcttatttttccgttcatatctgatcacttcgtcggccggtgtgaacaaatgctgcatttccttggtggatggattataacggatcactcctgtcgtttgggggaatatccatagttccttgtaatggtcttgataaactgactgtacgacgttggaaggttgcgttgatgtgcgtatatcaatcaactggaattctttttcttttatcttataaataatcagtccgttatctgtagccagcaaaagtgtattggagtcaaacttcttgacttcgttaatcatcgaaacatgataaggaatctctatgaatttgaattgtctggtcttaaagttgtaagaggccaatttgtccgattgggaaaccagataaataattccatccgcttctttaatatattggaacgggaaatcgctgtctacctgcttctttcctatgatagaaattcctttgttggtcagtatccattcatctccttcggaatcttcgaaaacggtatatatcttgtctcccttcaagttttgtttgaaggaactgtacagagtgattcctttcccctgtttgcaaagttggtcatctatgcggatggcggcacattcgttttgaaaggtgatccatgagattcctttggaaagggtataaatatggtcggcataattattcgttatcatcgtttctgctactgaacctaaaatgtcgatgaacttctctgtctgattgtcgaacatatacacccgtccgtcataggcttggcaccagatatccccatatttcgtttccgctatctgactgatccggttggtattcagaatatagccgtctttgtaagatgtcttatagtttttgaatgtatatccgtcgaatttattcagcccgttccatgtgccgaaccatagaaatccttttttgtcttgtatgatcgtctgtactattccttgagacattccgtcattgacggaataatgcttgatctgataggtaggctgggccactaatatgcaatagttaaaaagagaaataagaaggagccgggcgcgtttcataatatcggtgttttttgttagaacaaaaataaataaaaggatggaaaacaagaagcccggacgctacattgaacggataatacgaaagtttgcctattttttcctccctttcgctgtcttgtctgcctgcttatgctaaaaatcctctttatattctgtttttagaacataaagaggatagtttattgacgagagtcgcatggggtatggtgagatgaaatcataattggggaataattgcacaagactttcacaagtatcctcccgtcaatgcttaaaatcacacaaaactaactaaatagtttctgctttcgcaataaatattaatttatcttatgcactttatgttttttttaatatattgaagatattttggggcatctttccgtaactcgctgttttttcttatgtttgccacacaaataacaaatgaattaaatagatatgtcttatcaaatacaatataatgatttcccaacctttctgcgaaaacattttccttacaaagtgcagaaaatatcattaaatgccggttttacttgtcctaatcgggatgggacgaagggatggggcggttgtacgtattgcaataaccagactttcaacccggactattgccggacggaaaagtcgattgctacccaactggaggaggggaaatgtttctttgcccataaatatccggagatgaaatatctggcgtatttccaggcatataccaatacttatgcagaactggaaggactgaaacgtaaatatgaagaggcgttgcaggtagacggggtagtaggattggtgatcggtacgcgtccggattgtatgccggaagaactgcttcagtatctggaagaactgaaccgccatacattcctgatggtggaatatggcattgagagtgccagtgatgagacattgcggcgtatcaatcgcggacatacgtatgcggatacggtagaggctgttcagcgtaccgccgcctgtggcatactgacgggcgggcacgtcatcctcggtcttccgggagagacacatgatacaatggtagagcaggcaggaatcctttccgcgcttcctttgtccacactcaaaattcatcagttacagttgattcgtggtactcgcatggcgcatgaatacgaagagaatccggaaggttttcatctgtttacggaagtggacgaatatattgacctggtgattgactatgtagagcatctccgcccggatctggtattggaacgttttgtttcgcagtctcccaaagaattgctgattgctccggactggggactgaagaattatgaatttgtaactcgtttgcaaaaaagaatgaaagaaaggggagcttatcaaggtaagaagtacagggattcagaaaaaagagttatttttgcggaagataacttcaccacagaataaatctctgtcctcagaggatcatagctggtgagcagaaattaattaaagttgaagaatggaacagaaaacaagaattaaaggaaatgtccactatgtgggagtaaatgaccgtaataaacaccgttttgaggcgttatggccgttgccctatggagtttcgtataactcttatttgattgatgatgaaatggtggcgttggtggatactgtagatatctgttattttgaagtctacttgcgcaagatcaagcaagtaatcggcgaacgtcctattaactatttgattataaatcacatggagccggatcattcgggctccatccgattgattaaacaacactatccggatattattattgtcggcaataagcaaaccttcggcatgattgaaggattctacggtgttaccggcgagcaatatctggtgaaagacggagacttccttgcattaggcaagcatatgcttcgtttctatatgactccgatggtgcactggcccgaaacgatgatgacatttgatgaaacggacggaatccttttctcaggtgacggattcggatgctttggcactgtagacggaggatttctggatacccgtatcaatgtagataagtactggggtgaaatggtgcgttactactccaatatcgttggcaaatacggtagtccggtacagaaagccctgcaaaaattgggaggactgcctatcactaccatttgctctacacacggaccggtatggacagagaatatttccagggtgatcggtatctacgaccgtctgagccgttatgatgcggacgaaggtgtggttatcgtatatggcagtatgtatggaaatacggaacagatggcggaagctattgctgcggaactctcagcacagggaatcaggaatattgtgatgcacaatgtgacgaagagtcatccttcttatatccttgcagatattttccgttataaaggattgattgtcggttctccgacatacagtaatcagatattcccggaagtggaatcgttattgtctaagattctggttcgcgaactcaaaggacgttatttgggatacttcggttccttcacctgggcaggagctgctgtgaagcgtatggctgaatttgcggaaaagagtaagttcgaactggtaggcgatccggtagagatgaaacaggcgatgcaggatattacttatacccagtgtgagaacctggcacgtgcgatggcggaccgcttgaaaaaagaccgctaaataaagaatgaacaattatttactaacctataaaacaatcgacttatgagacttattattcagccggactatcagtccgtatctcagtgggctgcacattacgttgccgcaaaaataaaagctgccaacccaactccggaaaaaccttttgtattgggctgtcctacgggatcttcacctctgggtatgtataaagctttgatcgatttaaataagaaaggaatcgtttctttccagaacgtcgtaacatttaatatggatgaatatgtaggcttgccgaaagaacatccggaaagctattactcttttatgtggaataacttcttcagccatatcgatatcaaaaaggaaaatacgaatatcctgaacggtaatgctcccgacctggatgcagaatgtgcacgctacgaggaaaagattaagtcttatggtggcatcgaccttttcatgggtggcattggtccagacggacacatcgcattcaacgaaccgggttcttcactgacttcccgtacccgtcagaaaacgctgactacggatacaatcattgcgaactcccgtttctttgacaacgatattaacaaagttccgaagacagctctgactgttggtgtaggcactgtgctttctgctaaagaagtgatgattatcgtaaatggtcacaataaggcccgcgcattatatcatgcagtagaaggttctatcactcagatgtggactatcagtgctttgcagatgcacgaaaagggtattatcgtttgtgacgatgctgctacggaagagttgaaagtaggtacttaccgttacttcaaggatatcgaagcaggtcatctggatccggaatcattgattaagtaagaaatattcaggcacggatttcacggattaacacgttttttagatatgtaatcttttaaaaccgtgaaatccgtgtagtccgtgcctgatttatatattctctaagttaatagtcttcgggattaaatcccttccagccagccttttccctgacggacaatttccggttcatcttctgtgcacttcactactgtagaaggttctatgcctcctattcctccgtcgatcaccagatccacgatatcgccgaacttttcgtcaatcagttcgggatcggtcatatattccagatcttcatgctcatcatatggcagtgtggtggtcataataggagcatccagtaagcgggcgatttcacgaatgatgttgttgtccggcatacggatacccacctcttttcggttgcggaagattttgggcagccggttggtgccattcaggataaacgtgaacggaccggggagattatgcttcatgagcttgaactcattattacccactttggcatactcgctgatactgcttagatcgtagcagatgatagacaggttgtttttgcgcggatcaatatctttgatccggcaaatccgttcaatagcacgttctttcagcccgtggcatccgatggcgtacatcgtatccgtaggatagatgatcagtccgccgtcgttcaggatgtcggttacccgttgcaagtcctgcgggttattgtttttatcgtacagtttcagaagcatactctcttctccttttcttatttaagtttcttctttaagaaatcaagtgctttctctgtagctttttccgtcactttctgtttgatggaatctttgttggcagtcgtggcagaatccagtccgagcttttctcccagtttgctgattgcttcgtcggctacggattcaagtgcctgattggccatactctttgtatcgacactgactttcggggaagtgaatgaaccgccgatcttcagatcgagtgtcatcagcttggaaatgccggtggatgccggaagcttgatcttgccggagtagtcgatggtctggtcgagtcctgtgctaccggaaagattcagattatagtcacccattttgatatcaaacggtttggtttccacccgtccgtctttgatagtgaagtccagtgtcatatctttcactttcatttctttcagactcggttggctgatggcatcggctatctggtcgattgctttcacaccactcagactgagatcgcgggtagacaagctgccgtctccttgcatcgtttccagtaccgggctcatggctgcgtccaggtcggtcagcacattgatgctgccggagaagtttcctttcaggttctcaaagataggagccagttgctgaaccatatccagttctttgtatgcttgtgagaagctgatatccgacagtttgaatccggctttcatttccggtttcttcgcattggcggtagagtaatatccgttcatcaccacattgccgctcatagtgcccatagaaagattcttcatatctacctttccgtctttgacaataagtttaccgttcatattgttgaatgtcatcttgtcaaacagcacctgtttcagattggcgtccatctggaagtcgatattgcgcggaacttctattacgccggcaatcgccgtggagtctgtagcagcagcctcggtagttgccacgctgtctgtggaggctgtcatgaaatcattcagattgaaataattggaatggatgttcagcgttcctttcagcgtagtacctttcagagcgtagccgatatagttctcgaaacggctgtcggcagtaatatcgttcttaccgatattgaccgtcgtttcgctcagttgcagatatttcggggtgaaggtgaagagtgatttcttgatatccacatccggcatatcctgcattttcagtttcatattggtcagaccgatggttccggaggctttcatgttgtcgtactgttctttctctatataagaaagacgtccggacatttgcatatcggcgttgatggttccgttcagttccatatctcccaaagggtatacctgtttgatcatacccaggtcgagggtaccttttgcctcagctttgaaatcggggtcgctgaccggtgttttcacgtccgcagtcagactgaaaggatttcctgccagacggaaactgaacgggttgatttggatggtggtcaggtctatatttcctcccggatttcggacgttggcattaatgttgatctgatcgactcctgcgggcaatgccggatagcggaacatagcgttcttgacttgcatgtcgatgttgaatgcggggacagtatctccttgcagcgtacctttggctgatgcggcaagagtagcggttccgtctgttttcagactggagaattccgttgcgtaaatggcaggaatcaaagacagtatttccttgaagcctacatcattggtattgagtttgagatccatgtcgatagcgggatctttcagttccacccaaccgtcgatacctgcctgaatggcgttgaggcgaatggtattgtctttcagtgtatacttgttgttggcaagatcggcgtctacatccatcttggcggagatgttggcgtttgcaaggaaaggaatgccattcatcttgtaagtcagtgatttggtttccgcttccagtttcagcgtagtgcggtcactgcccaggtcaccggcacaaagggcgttgaaatcacggatgtcggcatacattttaccttgctggtcgtcataaatcaaattcatgttcttgatgacaaaacgttgcagcttgactttgaaaggagatgaatcttcttccgcggcaggcgtttcctgcgtgtctgtcgtgtcgggcttcataatatcccagttggcacgaccgtccggcaggacaatggcgtgcaggcgggtatcttctatgaatactttggagatgtcataaccgctgtctccgaaaagggagaacagattgatggtggcagttacctctccggcttgtacaagggtatcatttgcgaattctcccgcgcctttcagccagaaatcttcgagagtgacagaagcctgcggaaagttgcggaacaggctaatgttgagtttcttgaaatcaaattgtgcattgagcatcttgttgccttctgtttttacaatacctgctatcttaccttggaaggcgaaaggaaggaggagcatcagaatgattattacccctacgacgatagctgcgattttcaaaccttttttcatttgcttttcttttaagagtttgacgtacatacgaaggcaaagttaataaaaagtttttgatgtaagatgatattcaataactttcacaatcagaagacttctgatacactaccaacttatttatgattttttctttctgagttcctcggcaattctccattgtatggcggcttccacttctttccccactctcaacagggcatctccgaaaagctcgtgtgcaccggcatgctcgggtttcagacttgtagccttgtccaggtcggcaattgctccttcagtattatcgattttcagacgcagttttccacggttgtacacagctttaaagtttgcaggatgaaggctgacagcggtattgaaacagttttccgcatcaaaatactctttgctgttgaacagggtgattcctttccgtatccaggcgtctatataattagggtcgaggctgagcgctttgtcataattggcgatggcggcacgggcgtcgtgggcttgggtgatacattcatttcccattaacagatattcgtgggcatattgccgcagacgttcctgctgttcccgcatttgctctttgagctttttgttctgctcctgcaaggtgttgataatccccagtttccggcggattaatcggcggggaacaggtttctctatgtcataacgggagtgaatggcacggaaaaattgttccaggcattcttccatatcccctttgtcgaatgcacgtgcggcagcggcatactggacatcggcctgcgcctgtttcagagccttgtcgatggcttgccggtcgttgaaccgtccggcaaagtttacgatttcgggacgcacaaagatatccgcccggttgatcggctttttgagctggatgccatccagtgaggtacaacggctgagtgctacatacgcctgtccgccggcaaatacacctcccgtgaagtcaatcactactctgctgaaagtcaacccctgactcttgtggacggtaatggcccaagccagccgaatgggatattgggtgaagctgcccagtacttcctcttcaatctctttcgtcttttcgttgtagcgatagcggatgttacgccatgattcccgttttacatcgcattccttgccgtcatcggtgatgacgtatatcgtttcttcttcctcgtcgataccggcaatcactccgatggtaccgtttacccaccggcggtcgaaatcattcttgataaagatgatttgagcacccggtttcagaacgagttcctgtgaggtcggcagactactttcgggaaaatccccttcaatgcttccctcaaaggtgatcggttctcctgccagctcggccagtttcttctcattgatcgagtcaaccgtatcccttcgggtggcaagcgtgatgtacatatcggcttccgattcttcgatatggcttccgtatcgggtgttcagcagttgcaggtcggctgctccggcggtgttggtacggatatggtcgagaacgctgacaaagacggagtcagtttgccggtatactttctggagttcgatggataccagatcgatctggctgaatactcttgccgagaagaagtatggagtagggtaggcacggttcagaatctcccgctcgtcattcttcacgacaggttccagctggaaaacgtcgcctaccaataacagttgtttgccgccgaaaggttcccgtaaattatgtgaatatacacgtaagatgcggtcgatggcgtcaatgaggtccgcccgtaccatagagatttcgtctatgatgaccagttcaatctgttccagtaatttccggtgcggtttggtgtacttgaagaactcgtgaatgcgtcctctctggagacttaaatttggatcgtccggcagtaacggatagaaggggagtttgaagaaactgtgcatcgtacttcctccggcgttgatggctgcgatgccggtaggtgcgagaacgacatgtttcttcttggtatgttcgcagacataacgtaggaatgtagatttacctgtacccgcttttccggtcagaaaaaccgactggcgggtatactgaataagattcagggcgtcctgaaaagctgcgttattagtgtctacgctcataaagttagtgacggataagcagatgtgctgaccggataaatgaattagataatcccgaaatgtttcatagccttgctgatgccgtcctcatcaatgggggctgtcacatagtcggctgcggcttttacatcctctttggcctgccccatagcgactccgatagctgcgtggcggagcatgctgatatcgtttcctccgtcgccgaaggacatcgtttcttccaacttgataccaaagtgccggatgatttcatcgatgcctttctgtttggtatcgcctttggctgtgacatccgcaaaagccggataccagcggcctatttcgcaagtcgggatggatggaagcacttctttttcttcttcctccgtgatgaagggagtcatctggatgacttctttattgcttgcttcttcaaatgaaactgtcggaatgacatttacatgcaggaagtcataaaagatcttcttcaccatctcattcggttggcaaacagagatattatgctcctctacgaagatgcaggggactcctttcttctcgcagaaagcagccattgcttttacttcttcctgcgggatggcacttttgtaaattacttcttctccgacaaaacaataggctccgttcatggttatatatccatcgatcaggttccggtcctgcaattcggaaagattgttgataatggctttcgggcgtccggtagcgataaatattttaagcccttttgcgtgggcggcttccaatgcctcaatggtagaagacgggatacggtgtgtttcgaaactaaccagcgttccgtctatatcaaaaaataaagctttcgtcataaattccttttagtccaactgttgatatgtagcaaagataattcttttcggttatataaacctaatgaacaggtacaatttcgtgataatataatcgtctcacttccttctgcctgatcaattttatatatttgtgctatggttccatattattcttattatcgaaatgttctgtttttaagattgctgtaggaaaaaatagctcaaaaactaataaactggagattaaactgtataaatagacgtaataatatgcagaaaagtagtctgattctgtataaaactgtatggtatatgtatcttttcttgtctgaaaatagaagtgggaagaaaatactttttcttcccacttgatttaatcaccgactgctattatttttttcccattgtaaacataatctctgcaatacttgcatttacgccattgttgctgtcggtcactgtagtacggaaatatcttccacttatagcctttggtaataagataatttgtgcattaggaaccttatcattaggaaaatctaattttcctaattctgtccagttttctttgtcatcactgatgctgaacatgactgcttttaaatcaaggttattttggcgcctagccaattctattgatagaatgttttgtgtttgttgcatatcaaatatgattatatgtggcaatggtggattcttcccttcaccatcccattgtgaatgccagaaagtatttaaattaccatcaattaatgcttctttatgcccgtttacggctccttcaccggtcaattcttctgtgttagcctcaactccccatcctgtcctgtccacatcgatatattggttatgaatctcgtcccactcttcttttgatacagtataataggttggaaaactcacaactttttctaatgatggaatttcgtcaatagcctcctctgaaggtttaaaataagaagttactttaaactctgtatcaagtacggcatctggtatgatagaagttgttgctccttccatcaaagtgattgttttttcgctgccttcgttgttggtataagtaaacatcgtttttgtacatccttccataggagcccatttaatggtaactcctttcgacagtgtcgcttccatagagttgattccttgtgcggataacccagcttgataggaagacccatatacttcaccggaaatggtttgtatcagagattcttttcccgtttcactcttatttattatcgaaaagatatatttcccttctggaagatcaattatctttgagatataatcattgatatcacgatctgcagagatgggtacctcaattggagtttcgcatccttcccaagaaatgatactggcattgattcgaggatcagcatttagtttccatttcaattcaatacggttgaaaccgctgttcgcttccaaatcactggcgattccgagataggtctcttcacccattttaagatacttttcgtgtacatcatacatatctccgcaagcagctattccgagaattagcatgctgcaaactatatagtttataatatttttcataatctaattattaagttatttcccgataggttgcccccaaaaggtcatttcaccgatctgtgcataagtacctccactccaattctcaagcatgtaaattcgaatgtaacggaaattgggtgcatctagtggaatctcatgttcgtcaccgttttcaatatattctaaatcttcatttgttttcgtagggttatcgcttccagaaggtttataacactctacttccatgatttttgtccatccttcgaacgtaggatatttgatgccatcttcttttacttcacctcctagatacatattatccgtaagtgcttcacaaccatagataacatatttttttaaattgttatggtcataagcccatacattaactggatcatttcctctacgctgatacattttaaaacgactgactttggctacctgtcccatgtcaaaagttatcgtccttccaattgcagggtttgtcgtattcgtaatattatggaaacattccatgttgtaatcaccttgccatatatttcgtattggcaaaccggacattgcttcacaatcaccaggtaatggattaacttccttgaataaagatttagacagttcttcttcatacaaaggcgtactttccttttccagcatctgagaatagttctcccagcgatcttgaattctatatcctagtgttattggttctgcagccaaattacggattttggctactccgtttagtacactagaatagaaattttccagagatatccattccccatcatcttttttaaacacttctaaaataatgttttcccttgttggattttcccaagtcagactaaccccgccaaaactattttcgactttcagagaattataaataaattcgacgggtggagtcaacgggcttatcgttaccgaaagtggttcagattcgttcctgcttttatctatactctttagagtcacttgatagtcacccactttgccgaacccttctactgtaagtttgtttacataaggagaggctttagtagttctttcttttccattgatcatataagaagctactacacataggagatcgtcatctttaggaggagtgtagctgatgatagctccaccgttaatattttctacttttatattgctaggcaatcccggtgctatattgtcagtcgcgtcaagtccaattctgtcgtcttgtccgcatcctgtaagacacagtataccaattaaagtcgcagacatatattttgtcagctttaatatataatttatttttttcatctttccagttttttataacatgaatacggtgattaccaacccggattctgtcccaggttcggatctttcaatacagtttctacttttaagggccacaagtaatctttaaaactgtatctcgaacgtagataaagcgtagtgacacggtaaaattcttgtgctgtttctccttgtacataccaccccttcacttcacgaggaagttccttcttccaacgacgtaaatcccaaaagcgttttccttcacaagctagttcatttaagcgttccatacgaatgatttcacgcatacctgttttcgtgtttggcttttcaggatactttgaatatttttgccaggattcctttactccgtcaagaccagcgcgctcacgcactaagtcaatataggtataaacatcgttgttaggggtgttgagcgtttcattcagtgcttccgcatacatcagatacagatcagcaagacgaataatcggaaatgcataacgttccgttgacagaccgttatcagtcacactagttttatagctacatacttttttgtttaaatatccagtatatgaatagtcttcggaagtaatacgaccagaaacttctttagcgcgaaatttatagaaagccagatctttcggttcatcactggcataaccgtagccgtaccatgttccacgatcgaatgataggttagcataaaagcgtggctctcggttgaggtgaagatacgccgtttcttcaccgattttgagataatgcttattatttccttcatcaggaatgatagtgaaatcataccgatttgggtagtttttcgaccaaaagtctcctttatcttcggagatgggaacaccgttagaggaataaaactgttcggcaacagttaaggtcggagccattacagatattgcatcgtagtgactgcccttagttgttttggctactgctaccttttgtaatccgttgacgttccatgtacttccccatataatttccgtattccatttctctgtaactgcttcaccgatatcaagtaacttgcgtgtagcatccgaaagtccgttaacgggcagagtgaaatagtaaaggtcatgtccggcttctttggcgcactttatggcgtctaaagctgcgtctgcagcctgtttccatttgttattatctgtttcagagggaaaaagacttcttccttgattatcttttacgttgatataatcggtatttccattgaatagaggactagcagccaataaccacaattgtgcttttaccgcttttgctattggttgggtgattcgtcccagttcttcacctgcatcagtgacttgaagaggcagatctttagctgcgtcatccagtagattggaaatatagttgactacatcgtccactgggtcccggtaacgtcgtacctcttccgcagatgcatctatcgaaatgttgttatccatgatagggataggaccatagagcataaatagataatagtggtagtatgctttgaggaattttacttccgcaatccatctgttacgttcatattgctgtaaatctagaggcttgtcaatattttcaagaaagatattgcagtcgcgtatagcagtccaaagatttgttcctccattaaggccatcccaataattctgataagggtcattactgttctgttctccacgaccgatttcccaagcgttgagactgaggcgttgatctataaatccggtacctttgggtattaaccaatgttcatcacctgctagaaagccgatggaaccggcttgatcccactttggcaggtaactataacaagtaaaaagaaacttacgggcatttgtcttgttgctgaaggctgtttccatgtccggggtaccttcgggcactatatccaagtaatcactgcaagatgtattgcatagtatagccgtaagaataaatgatatggatactataatttttttcatatagcaaattttagagtgaaagttgaacacctatattaaatacacgttgaacgggatatccaagaccattgcctcccatttccgtatcccatgttttaaacttagagatattgaacaaatttgttccactcacgtagatacggaagttttcaagtttggctttactggatattcgctttggtagtgtatagcctatttctgcagatttcatacgcaagaaagtcccgtcacgtagccaccatgtacttttttggttattattactaatagcagtatctgacaaacgcggccaaaatgcatacatgttctgattggcttcgctccaatgatcgtctgcgacaatttgcaaaagagcattagttgcctgtttacctcctaattcattattcgggtcattaggttgtatgaaagggcttatatctgcaggtgatataaagaaagaagaacgtgatgatccttggaagaaacagttaaaatcaaaatctttatatcctattgagaagccgaaaccgtaaataatctcgggagtagtaggataaccaataggaactctgtcctgttcgtcaataattccgtcatgattaatgtccttgtatttgatatctcctgccatatattctccaaattgttgtttaggagagtttgctacatcttcttcatctacaaataaacgttcagcaatcagaccgaattcttggctgagtttcgttcctattttacttctccatggagtggctgaataatcgggttcttcgtacttggagaacttgctactggcataggtaaaattacctctaatggtagcccataaattcttgttgaagaaatgagaatagtccagtgaaatatcgacaccatgtcctttggcttcaccaatgtttgcctgcggagagacttgaaaacccattagagttggaatatcggcacgtgtctgcaaaatattggttcttctttctttaaaatattcggcttgtatttccagatctttaaatagtttcatctcaaatcctacgtttagtttatgagagatttcccaacctatcttaggattagcataacgcttgatggaaatcttaccgttagagttctttgcattgaaatttgttccgaatcccataccgttatcaccatccatgctaacttcagatagatagaagaaacgttcgtcagaaatattatcattacctactaatccataagagcctttcaattttagtgaactaattacttttgtgataggtttgtctttccaaaatttttcattggaaaccatccagcctagccctcctgatgggaagaatccccaacggtggttcttgtcaaaacgttctgaaccgttgtagccgaaattgaattctgcataataacgatcggaatatccataagtgaaacgaccagctatccccatattacgtgatgggagtgataattgtagagtttgtgcatttccagattttgattcacgtacggtatataccatcattccacttatattatgttttttataaaatgtccggtcataagatagagatgcttccaaatacagagaactgtcaaccgatttgcttcctggattatatgatagatagtctgtacctttgtccgaatttaaggcgctaagtatatatgtgtccgtgtacttatcataactgtctaaagaataatagaacggagtatatgaacgggtgagatcataataagagtttcgcgtgacatttgccaatagacgtccgttcaatccgtcggtgatgaaaccgaaatcttgtttaagttcgagttgagcaagaacaacagttttttcatattctttatatcctctggccatttctgcataagggttcagatagtttgcactgcttcctgagttaccgaataatacatgtttggtgttaatattcgtttcatcaggagcatacatagcaggaaattcaacagggctggctttaatagcttggctgtatatggcagaaccaccagataacggtccttgataactgtcgaatgtgccactaatacgtacagctaattcggtcgtcttggttaagttgatgtttacatttgaacgtactgtatatttgttcagcttgatgttattatcaaagatattattaggaacttgtttgaggataccattgtctcttgagtaagataaggctacatagtagcgggctacccgaccaccaccactgatgctcatgttaccacgatagtttactgtgtaatctttaaaaagcatgtctttccagtctaccataggataaacatatggattcaatcctttttctcgggcagctattgcactttcaagataaggtaatgcattgcctggatttctagtccttgcagcttcgttatgaagtttcatgaaagttagcggatctgctaattctacctcttttgacggggcagagaatgaactttctgctctgaatgataacttcattttgccttctgttccttctttagtcgttaccaagataacaccattggcaccacgtgcaccgtaaagggcggttgcggttgcatcttttagaacagaaaaactggctatatcgtcaggattcagtcttgacagatccgaagaagttagttcaacattatcaattaaaatcagtggatcggctttacctgtaccaaaagtagttacaccacgaataaagaactctgcattgtcttctcccggttccccacttctttggtaagcaaccacaccagctaactttccagcaaaacctgttgttaagttactgctagtcgtttttaactctgcaggcttaatagtggagactgaacctaatacagattcttttttttgcttggcgaatgctactactgttacgtcctctagagctatcccgctatcttctttcatggtaacaacgcgaaagacatttagatttttaggattgaactcgatgatcttcttttcatacccgatataagagaattcaatagttttagtattagccggtacctttaaagtaaagtttccgtctaaatcagtggcaactcctgtattggttcccggaatataaacacttgcgccaatgataggctcattgttgaaatccaggacaatacctttgatcgtgtaagtttttcctgtctgttgtggcgatgctgtatcctgtttggcatagagtggagtaaaacacataccatacaaacaaaacaggattaatatttgtagtattcttccaccaccattttgtttttcattaatcatagaaattaaaagtgttaacaattcattcttgtgttttcaataagcatgaatcttgtggttaattaaatttttcgataagtttggatagacagtccttatatattaaagatctgttatcttcattaagactaatttctctttctttgccttcattggagttaatttgataataagaagatttatatagtgtaaaaatcaaaatagatggcgtcttttctattctgatttttgcttttagttagtacttgtgatgaatgtaaaatcaaggggctattgttactccgatttcatttggttcaacttttgcggctgtatcagtgggagtggtggcttccagtttgataaagcgtgcctgaactttttgattgaaatagaccgtttgaggcaatgggttgtgcataatgttgctgaattctccattggtaggtacttccttccaactcttgccgtcgagactgatataaaatttatatcggaaagccattgttgtctttgcctttgcatttaggggagcataggtaaaggcgttgattgtcaccttcttttgcaaatctatcgttaatggctttgtagacataactttccatcctgaacgaggcaactgattccagttttcctcttgtttcccttcctttataggtgctgcataataagcagccacctggctgatgttagcattcagacgagattctaaaatctttatccgtaactgatcggctttaatagttggaaaacgtagcaatcgtttgtaacctacagttgtccctttagccacttctttccagctgttatctgtcagtgcttctacggtgaatgcttctatccgttgtcctttggttatatcttcttgcagcataactacattaatttctgaaccggcttttaattgatatatcttttcattgccggaagctgtattccaatattttttccctttcttcacatagttgtcagcaaatacttgttttcggtaagcagcaaactctttcagacgttgtacgtctgcttcatgaattaagcctctatggtctggtggtatattcagcagaagtacagaattgtatcctaccgattggaaataaatatctgcgagatgtttcaatgacttcactttattatcttcttctttatgatagaaccatcccgggcgtatggaaacatctacttccgagggataccaaaataactctgtcgctttctccaacatcttgcggcttcctaaatcatttgactgtccattgattcctaatttcttattattcttgtcagcacgggcatatatctctggagttaacacggtggtgctccattctgtttcacgacctaatccgctttcgttgcctacccagcgaatatcatctcccataattgccattactgctttgggttgtaaccggtggatagtttcatagacggtatcccagtcatatacttgtttttttccgtttggaccttctccgtttgccccgtcaaaccacacttcgtgtacttctccatagttagttagcaattcggttagttggcggataaaaaacttattatagcgaggggaatctccataacattcagcatttcgatcccatggagagaggtatagtccaaacctcatgccatattttttgcatgcctttcgaagttcttttactacgtcgccttgtccgtttttccaactggaagacgctacggaatgcttggtcgtagctgtaggccataagcagaaaccgtcatggtgcttggctgtcagaatcaccattttgaaacctgcttctttcaagttgcttacccattgttctgcatccaattctgtaggattaaagagattggggtcttcctttccatctccccattcacgtccggtaaaggcgtttatactgaaatgaaggaaagccgtcagttccatttgttgccagactacttgttgaggcgttggaaccaaacgtgcagccatatcgattttttgttcaagagtggcattcaagggaaactctacgtgttttacataatagttttctttcttttgcgcctgtcctcccaaagtaataatggagaataatataaaagaggtcagtagtttgttcataggtcatagtattaattgaaattgctatttttaggagaaaatttccactatccagcaccaatgccgctagatagtggaatttttggggtaatgttaagttcttatttgcatatttcgtatccagagaaaatgcaaatcgtaaaaattgaaaaatgataggtcatttaatagtgtaaatcttttcatatgtattatagagtatttattcaacttgatgtgtgctgcaaaagtaggagaatgaatggtgcagtatgtttcaaaaatcactaatttattttcaaaaatcactaattagccccatttcatcggggaatctgttgttatatagtaaaaataagaagttgttagaatggaaagtattcttttttgtgtgatgcgttttctttttgacatagcagtgtttgtgagatagagcagaagatactttttctctttttctggtaatattttctcttaaatgtagtatctttgaaaactgaatcttataatctgactataatgaacgcaacaaaactattgctcatagtatctattgtacagatgttcttttcatatcctcttcgggcagaacattattactacaaacaaatctcattaaaggctggattaccttcaactgtacattgcattgcagcagataatcgtggcttcgtctggatgggaacaagatcaggcttgggaagatttgatggacaggaacttaaaaaatatatccataactcatccctgtctaattcacttcccggtaatcaaatttatcagattgcgagaggagagcaggggaatctttggatattaacagataagggaatttcactttatcgatatcagagtgatgactttcttttgcagacggatgagaaaggtgaaaatttgattgcttattctgtttgccggacccctgaaggaattttattcggtggacaagggaaaatctatcactatagttataaagaatcttgtatacggaaaatctacgaatttaaatcggagcagaactttaatattaccgctttgggtttgatagattctcatacgatactatgttgcagtcgttggcaagggatgtatttggttgatcttcaatcaggcgaatacagacgagcgccttttggggcagaaaaagaaattacgggtatgcttgttgattccaaacaaagagtgtgggttgcttcttataatgtcggactgcgttgttttacccgtgatggaaagcagattgcactttatacaacccgtaattcctctcttagtaatgatatcatattgagtattgttgaacgtaaagggcaaatatggcttgggacagacgggggaggcattaatatactcaatcctgagactcagcagttttcctccttaaagcatatccccggaaaagtcaattcatcacttcctaataactcaatcatctgtctttataatgatcaaaataataatatatggattgggagtatttatagtggtttgattagtgttcgtgaggtatatatgcaggcatacacagatgcgttgccgaataataaacaaggtttaagtgacaatatagtattgagtttatgtcagcaggaatcaggtcatatctgggtgggaacaaatggaggtggaattaattgttttaactccctggccggagagtttacacattatccttctactttgggagataaagttgcttctatttgtggctttgcttccgggaaattattgttgtctatatttgcacaagggatatttatttttgatccggtcacaggaaataaacaaccatttactattattgataaagaagtcaatgaacgtttatgtcttcacggaaatacggtcaatgtttatcggaatactcccaacacgatattgctgttgggcaatcacgtgtattgttatcatttgaaggagaagcagttttctattgtttccgaagaaaaaggcataaatattattgaggggtccttgaaagcaattgcttgtgatgggcattcaacttatttgaacgatataaaacatatttatgagttggataatcatagtaataagctgagagtgttgtttactgctcaggatgatatgaatataaattcagtatccatggatgagagtggctgtttttggatcgggagtaatttaggtttggtgagttatcatccagcgacacagaaacaaaaaatgatttctacttcattatttatagaggtttcttcattgatttgtgatcaaaaaggaaagatttgggttggtgctgaaaaccgactgtttgcatggtccatagccgaggagaagatggcattattcggcgaaacggatggagctgttccgaatgaatactttccagaagctcgtttgttaagtcagaagggtgatatttatatgggaggggtcaaaggattgcttcatattgatggtaagctaccattgagaaatacgaatccgcaattacaattatcagatatcataatcaatggagaacctgcgaacaataaattgtatgatggtataagaaagctttccgtgccatggaatagtaatattgtcattcatgtcatggcgaaagaagaagatatcttcagacagaaggtgtatcggtatcagataaaagggctggatgagcagcttgttgaatcatatagtccggaactgactatgcgtgcgcttcctccgggtaattatcagattatggcttcttgtaccactaaagacggtagttgggtgcctgctcaacaattgttacaactgacaatttctcctccatggtataagacatggtggtttatattgggttgtattctattggtagctgtcattgtcattgaaagtgtgcgaaaagtgttgaaacgtaaggaggaaaagctacgatgggaaatgaaggaacacgagcaaaaaacgtatgaagaaaaagttcgttttttgattaatataagtcatgagttgcgcacacctttgacactgatctatgcacctctcaagcaaatattgaaatcgctttctcctcaagatgcccaatatttgccgataaaggctatttatcgacagtcacagcggatgaaaaatctgataaatatggtgcttgatgtacgtaaaatggaggtaggtgaaagtcggttacaaatagaaccacagccgctaaacgaatggatcaagcatgtatcacaagactttatcagcgagggagaggcaaaaagtgtacatatcagttatcggtttgattcacgaatagaagcagtcagttttgataaaaacaagtgtgagattattctaagcaatttgctgattaatgccttgaaacacagtccgcaacatacagagataactattgtttcggaattgatttctgaaagaaaaagagtgcgcgtatctgtcattgatcagggaagcggattggaaaatgtggatacacgaaagctctttacccgattttatcagggcactaaagaacaaaacgggacaggaatcgggttgtcatattctaaaatattggttgaattgcatggcggctccattggtgcccgggataatcaggaaacaggtgccacatttttcttcgaactgccgttgaggcaggatgctgaagagattgtttgtcaaccgaaagcttatttgaatgagttgatgagcaacgatgatagtgaacatatcagtaaaggagaggaatttgatacaacttcgtatacgattttggttgtggatgataattcggatctgacggacttttttagtaaggcattgagtgaatattttaaaaaggtgttgatagcttctgatggagtggaggcgcttcagttggtaaagagttatacaccagacattattgtcagtgatgtgatgatgccacgaatgaatggatatgaactttgtaaaggtcttaaagaagaccttgctgtcagtcatatccctattattttgttgacggctagagatgataaggaaagtcagattagcggttataaaaatggagcggatggctaccttactaaacctttcgaaatagaaatgttgatggagttaatccgaaatcgtttgaaaaatcgtgaatatacaaagaagagatacctggatgctggattaataccagctccggaggaaactactttcagtttggcagatgaaacgtttttggtgaaattgaatagaatcattcaggagaatttgagtgatacgaaactggatgtgtctttcatttgtaaggaggtagggatgagtcgtgcttcgctttatacgaaattgaaggcactgacaggcattggtctaaatgaatatattaataaaatcaggatggaaaaggcgattctgctgattactgctacagattttacatttacggatatttcagagaaagtaggatttactactatcagttatttcagtacagcatttaaacaatataccggagaaactccgacagcctataggagcaggcagaaaaaaaaggaatagagtgccggtatatattaaaagaatcggcttgaaaacgtctgttacagagttttaagatacaaactcggagtttttgtgtacttttgcttcaagatacataaaaacctcatgcagtatgaactataattttgatgaaataataaaccgtaatggtacggactccgtaaaatgggatgccgtagaacgccgttgggggcgtaatgacttgattccgatgtgggtggctgatatggatttccgcacagccccttttgtaatcgacgccttgaagaaacgtctggaccatgaagtgctgggctatacatttgcctgcaaagaatgggccgaatccattatcaactggctgaaagaacggcatggctgggagattcgcgaggatatgctgacgtttactcccggcattgtccgcggactggcatttgctatccattgtttcacggagaaaggggataaggtgatggtcatgcctcctgtataccatcctttctttctcgtgacgcagaagaacgaacgtgaagtggtgtacagtccgctggtattgaaagacggacaatatcatattgatttcgaccgtttccgcaaagatgtgcagggatgcaagctgcttattctgagcaatccccataatccgggcggacgtgtatggaccaaagaagaactgtcgcagatcgctgacatctgctatgagaacggtacattagtaatctctgacgagattcatgccgacttgaccctgcctccttacaagcatcctacttttgctttgatttctgagaaagcacggatgaactcccttgtctttatgtctccgagcaaagcgttcaatatgcccggactggcaagttcgtatgcaatcattgagaatgacgaacttcgtcatcagttccaggtatatatggaagcgagcgagttctccgaaggacacttattcgcttatctcagcgtagcggcagcctacagtcatggtactgaatggctggatcaggtcgttgcctatatcaaaggaaatattgacttcacggaaagttatctgaaagagcggattcctgccatcagaatgattcgtccgcaagcatcctacctaatctttttagactgtcgtgagctggggttaaatcaggaggaactgaatcgcctgtttgtagaagatgcccacttggctttgaatgaaggaacgacgttcggcaaagaaggtgaagggtttatgcggttgaatgttgcctgtccgcgtgctacgctggagaaggctttgaggcaattggaacaagctgtcaacaataggtagaagtattgtcgaatgctttacacaaatccggtaacataatacctgttttttattcttcacaaagatatacagacactcactacctgacaacggaaaagggcgataatatatttgataaccattttaatttataacgattatgcgaatattcttcctgatatttctgcttgcttatgtaggtggcaatgtttatatctttatccgtacattacagatgctttccggcttctcgctggctatgaagattctgttgtctgtcatctattggctggtagctttctcgttggtgatagctatgctgacccgtcatatagatatgcctgtcatcctgtcgaaatccatgtttcacatcggttcggtatggctggtatttacactgtacatgatttttgctttgttgatagcagatgtgacgaagatatttgtgccgtcactaaatcacggtttctattatgcgctgggagcgacttgctgtctgcttctgtacggttattataactaccgtcatccgcaggtcaataagattgatgtctcccttgataagccgatagaaggtaacggaatcaatatcgtagccgtgagtgacgtccatttagggtatggtacgggaaaagccatgctgaaagaatatgtagatatgataaatgcgcagcatcccgaccttatactgatcggtggagatttgatagataatagtcttaccccattatataaggagaatatggcggaagaactggcacaactgaaagctcccttgggcatttatatggttccgggaaatcatgaatacatcagcggtattgatgaaagcgtccgcttcttgaaagatactcccatacaactattgcgtgattccgtagtaacattgcctaacggtgtgcagatcatcggacgtgacgaccgttccaaccgttctcgtcattccctgcctaccttattaaagcaagcggatcgtagtaaacctatcattcttttagatcatcaaccctacaacctggctaaaacagattctttgggaatagacctgcaattcagcggacatacgcatcatggacagatatggcctataagttgggtaacagacagaatatatgaacagagtcacggctatcgcaaatggagccaatcacatatctatgtttccagcggattatctctttgggggcctcctttcagaataggaacaaacagcgatatggcggtatttcatctgaatcagatggcgaaatagtgagaatataataaaaagcgttcttgggtgtgttgagaattgaaaagaatcgagtatatttgcatataatcaatagattaagaagttatgagacgaacagaagtgatcgaacaaatcaaggacattatccgtcatgttgctcctaccgctaagaccatattatatggttctcaagcgaggaatgaggcacgcagtgacagtgatattgatttactcatcttgcttgatggagagaaaataactttgaaagaggaagaggcgattactttacccctttacgaacttgaactgaaaaccggtatatctatcagtccgatggttatgctgaaaaaactttgggaaaaccgtccgttcaaaacacctttttatattaatgtcactaatgaaggaatcgtattatgaaagatattttagacgatgaattactaaaagaataaattagactattcagactctgtaactcttttctcttcttaacttgttatatgtttatcgatctgattattgaaacggaacaaacagcgatatggcggtatttcgtctgaatcagatggcgaaatagtacacaccaaagtatcaatatcagaaaatataactatatttgtggcgtatctccgcaaaggagctacgctttttttattttggagatagcgtttttattatctgctctcataaatctggtaaatttagtattcgcagataataagtaaccggtctccacgtctttgttgtatataagtttgttatatacctcatgggcgtggagctattacttattattcgaatacgggcttaccagagcctttgagagggtaatgtagtaatagtttccacgccttttttctttggggcatacgggaacacacaaatgaaaaaacagaaaattatggatgatcctacttgttcctacccctgcctgatgaagcttgatttacaggactccaccgacaaacttgcctttcttaaagacaattggcctagctttggacaaattgaaagcattgataaactatcaaaacatgaacttaaatgtactctctgcttccttgatgtcctcattgatgagttcgtagatgatgaatatgtttgttcaagtcgtgttatgactcgtttggtgttgacacgcatatatgttcagaatactatggaaatcatggcattaaaagaattacgattggaactagagaagtcggatggttgagaataggttgattctggattttctccacagtgatttaatagcagttttgctctcacgctctaacaattcgcttgtatccctttattcatcgtagttttggctatgatagcaggcgtggtggcaagtatgagagcaagcggttgctctcactctgtcaaatcgtgttagtaagtgtttattcaatgctatcttttgatttgtaggatgttaatggttgatttgtcaactattaacgattgacatctcaggtattaataattgagaaatcaggtattaatacctgataaatgatgtattattgaacaatagatgatttagtgctacttgaaagaacaggtgaatcggaacagttgatacggttaagtcaatcagatcgtgcggtcaagtaatcccaatcgacagtagtttcagatagtttcaagcgtctgaaacttttgtttcaaggcttggaactaatggtttcaatgcttgaaactagagttccaagcgcttgaaactatctgaaacaaccgtgattttgaattggaaattgtacttccctaataatggttgacttgtttatctctaatagctgctatgtgttgactagaaatattactaaccctggcagctgtttactttattatttattattcctgcctccggtttacttatttt

SEQ ID NO: 63 - DNA, 43654 bp, Bacteroides thetaiotaomicron
tgataatatagacgaaaaatgagcgataataagtattatataataacagattgcaggcattcccacttcgggtaatgcttgtcagataatctggtacaagctaagggctgcgattctttatgggaattgcggccctttttgttgcctaaaattgatatttcttgcagcaagttcgaaattcgagtttataataaacttgggggacgtttataataaacggtgaaagaatttattaataaatgatcgggagttactgcataatcagtcaatgtctttcgtacagatgttggtgctgatgttgaaaagttctgtatcttctaagtaaatcgatgaattatcgctacactacttcctttctctttttgtgtcattgaactgagttccttacgaggtcaggagaagaataatcttcggacttaattcttagtttcgctttattagctattaatgcgaatcggcggttgattcaaatctgaatcgaaaacgaacaaaatccaactactgattcgcataaataataaatgccctgtttggctgatagtctgcacgaagaatgcggactatatctgtgatatttatatatttctgtataatatttctacgaatactcttctttttcttcaattaattcgattttaagtcattattaattcgtttttgtggtatttattaagggatgcccctttactttgctgaaaaatattttttggcagacgtaataacataacatgaaaaataaaagaataacatggtaaaaaggtttgattggttgttggtgtgtttattgttttcaataggggtgatggcacaatccggtgggaaacagtataattcttacaaaggattggtcatggcaggttatcaggggtggttcaacacccctggtgacggctcgggccgtggttggcatcattataatggacgtaatggttttcgtccggggtcatgctcggtagacctttggcctgaagtgtcggagtataagaaactctataagactgagttttcctttgctgacggtaaaccggcttatgttttttcttctcatgatgaatctacggttgatgtacattttaaatggatgcaggagtatggactggacggagtatttatgcagcgttttattacggagatacggaacgaaagcggattgaaacactttaataaagtactgaattcagcgatgaaatttgccaataaatacgaacgggctatctgtgtgatgtacgacctgagcggcatgcaaccgggagaagagcagttgttgctgaaagacatagcagaaatagcagaacgctattctttaaaagaccatgcaaagaacccctcttatctgtatcacaatggtaaaccgctggttacggtttggggagtcggatttaatgataatcgtcgctatgggctgaaagaagccgctcatattattgacggcttgaagtcacagggattcagtgtgatgcttggagtacctacgcagtggcgtacactgaatggggacacagaatcagatccccgcctgcatgagcttatccgaaaatgtgatatcatgatgccttggtttgtagggcgttataatgaaacgacttatcccaagtatcagaaactggtggaagaagatattcagtgggcaaagaagaatcaggtagattatgctccgctggtcttccccggtttctcatggggaaatctgaaggggaaagatcataattcgtttattccccgcaataaaggttctttcctttggacgcaattgatgggagccattcgggcgggtgctgaaatgatctacgtggctatgtttgatgaaatagatgaagggacggccatctttaaatgtgctaagaaggttcccgtaggtaaaagtacatttgtgccccttgaagaaggcgtggaaagcgatcattatttgaaattggtgggagaagccgctaagattttaagaaaggaaaaagctgtggcatttagtgcaaagctggatacgaaaagtccgaatccttttattcggcatatgtataccgctgacccgtcagcgcatgtatgggaagatggcagattgtatgtgtacgcttctcatgacattgctcctccgcgtggatgtgacttgatggaccgctatcatgtattctcgactgatgatatgattaactggacggatcatggagaaatcctgagttccgaccaagtgccgtggggacggaaagaaggaggttttatgtgggctccggattgtgcttacagaaacggcacctactatttctacttccctcatcccagcgaaacagactggaatgatagctgggagatcggtgtagctaccagtgacaagcctgcggagggattcaaagtacagggatatattgagggaatggatccgatgatcgatccttgtgtatttgtggacgatgacggacaggcctatatctacaatggtggcggtggtacctgcaaaggtggcaaactgaaagataatatgatagaactggatgggcccatgcggactatggagggactttcagacttccacgaagcgacctggatacataagtataacggaaaatattacttgtcttattctgataatcacgacgacggagaaaagcataaccgaatgtgttatgccatcagtgattcgcctttggggccttgggaatacaagggaatttacatggaacccaccgatagttataccaaccacggctctattgtcgagttcaagggacaatggtattctttctatcacaacagtgcattgtccggtcatgattggctgcgctctatctgtgtggacaaactgtactacaatccggacggcactataaaaatggtgaagcaaactaaataacagatagatccatacacaggcaattgataaatagaatccttataatagttgaaaaacgaacatagcatgaaaaacaaaatgaaatggatattggcagtagggttattgtcatgttcggtagcaatggcacagcaacagagtgatatattatcggtatctgcttctgcaaatgcggaaaatgctgctttagcctttgacaggaatgtaaaaacgatgtggacaatcccttctcaggcactaaaggctgaacaatggctgatgtttaccattcagcagcccggagatgtttgtgaactggaccttcagatgcagggtatcaataagaatgaactgaaagaagtactggatatctttgtcacttatgaccccatgaatctgggaactcccgtgaactaccggatcgaagggagcgacaaacagatgaaagtcaaattcactcctaaatacggtgcacacgtcaagctgaattttaagtcgggaaagttggataaacctttctctctgaaagaaatttcggttcttgtggcagaaaaggtattgacggacagtcagggaaaagtaactgaccgtcggtatatggatgcgtcactgccagtagaagaacgggtggaaagtttgttggcagtgatgacgccggaggataaaatggaactgatccgtgaaggatggggcattcccggtattcctcatttgtacgtgcctcctatcacaaaggtagaagcggtgcatggtttctcttatggtagcggtgctactatcttccctcaggctttggcgatgggagctacctggaacaggaagctgacggaagaagtggctatggtgatcggagacgagacagtggctgccaatacaaaacaggcatggtcgccggtgttggacgttgcacaggatgcacgttgggggcgctgtgaagaaacctttggagaagaccctgtattggtgtcacaaataggaggtgcatggatcaaaggataccagtccagaggattgtttactactcccaagcatttcggtggacatggtgccccgttgggtggacgtgactcacatgatataggactgtccgaacgtgaaatgcgcgagattcatctggttccgttccgtcatgcgatccgtaattatgactgccagtctttgatgatggcctattccgattatatgggagttccggttgccaagagcaaagaactgctgcaacagatattgcgtcaggaatggggattcaatggattcatcgtcagtgactgtggcgctatcggaaatctgacagcccgtaaacattacacggcaaaagataagattgaagcagccaatcaggcattggctgccggcattgcgaccaattgcggtgatacttacaataataaagaagtgattcaggcggcaaaagacggtcgtatcaatatggaagatctggacaatgtatgccgtacgatgctgggtacgatgttccgcaacgaactctttgaaaagaatccttgcaaaccactggactggaagaaaatatacccgggatggaactcggacagccataaggaaatggcacgtcaggcggcacgtgaatcaattgtaatgctggaaaacaaagacaatcttcttcctttgtcaaagacactgcgtacgattgcggtactgggtcccggtgcagatgacctgcagccgggcgattacactccgaaattgcttccgggacaactgaaatcggtattgacaggtatcaaaggcgcagtgggcaagcagaccaaagttctttatgaacaaggatgtgactttaccaatccggacgaaaccaatattccgaaagctgtgaaggcagcttcccaatcagatgtcgtgattatggtactgggtgactgctctaccagtgaagcgaccaatgatgtccgtaagacatgtggagaaaataacgactgggcgactttaatccttccgggcaaacagcaggagttgctggaagcagtctgtgcaaccggaaaaccggtgatactgattcttcaggcaggccgtccttatgatattctgaaagcatccgaaatgtgcaaggctatcttggtaaactggttgccgggacaagaaggtggtccggctatggcagatgtactgtttggtgattacaatcctgccggtcgcctgccgatgacattcccgcgtcacgtaggacaacttcctttgtattataacttcaagacttcaggacgccgttacgaatatgtagacatggaatattatcctctctaccgcttcggattcggactcagctacacttcgttcgaatattctaatctgaaaatacaggaaaaggcgaatggcaatgtggaagttcaggctacagtgaagaacgtaggaagccgtgcgggtgatgaagtcgctcagctatatgtgacggatatgtatgccagtgtgaaaacccgtgttatggaattgaaagactttgcccgtattcatttgcagccgggagaatcgaagactgtttcgtttgaaatgactccatatgatatttcattgctcaatgaccggatggacagagtcgtggaaaaaggagagttcaaaatcatggtaggcggaatgagtcccgattacgtagctaaaaatgagatcaaacatagtgtaggctatagtgataacaagaaaggcgtcacgggaatgcttaattatacacatgagtttggtgccaatttcgatcttgctgtgtccaaggtagaagagaaccttgtcaagaatcagaagacagtgtgggtgagtgtgaaaaatacaggtacgttgatggatatcggtaaggtggaaatgtttgtggatggtaagaaagtgggagatgccgttcattatgaactgggagcaggtgaagaaaaactgattccgttcaagctggcaaaagagaataagcagcctgtagcgtttacgaccaaatacaagatggtgtctatgtagtactaatttattcccctaacttttaatacaatgaaacgacttcttttcatattatggatattcttgttgtccgtaagctttgggctgacaaagatgaaagccgatgtacggatgccgctgatcttcggtgatcacatggtgttgcagcaagacacaaagattgccatctttggatgggctgatgccggagaaactgtagaggtagtctttgccggacagaaagtgaaaactactgctgacactgacggaacatggagagtgaacctgaaaccgataaaaacgaagaaagaagggcagactctgacgattgccggtaagaacaaacttgtctactcggatgtgttggtaggcgatgtatgggttgcttccggacaatcgaatatggaatggggaataaaggtaagaaaagaatatgctgacgatatatccgcttcggaagatcctttgctgcgtttgttctttgttcccaagaacacgtcgttagagccattgaccgatattgaagttcctcagggaacatctaaccccgaacgggctgccagatgggtgctttgtacaccggagatgttggctaagatcaatggacagggcttttcggcgacagcttattactttgcacgtgatatgcgtgctgcaaacggacgcccgttgggagttatccagtctgcatggggaggtacgcgtgcagaagcctggaccagtctttccggattgaaacaagaaccggctttggctcactatgtagctgcgtatgagaagaatgtgaaagataatccggaaatactcgccacttatccacagaagcagaaagaatttgatgaagcggtaagggaatgggataaaacggtaggaaaagaatggaatcaggcacaaaaagaatgggcgatagctgtgcaggcagcacaagcagctggaaagccggctcctcccaaaccacagcccagcgttccccgtccgcccaatccgcgtaaaccgaatgggggaaataatggtccgtccaatctgtttaacgcaatgatttctcctttaatccctttgagtataaagggagtcatctggtatcagggagaatttaactccggcggctctggaaaagaatatgctaccctgttctcccggatgattacggattggagagagaaatggggaatcggtgattttcctttcgtatatgtgcagcttcccaatttcgaaccggtagatcccgagccgtctgtcgaaggaaacggctggcgctgggtacgggaaggacagttgaaggccttgaatctgcccaacacggcaatggctgtgacaatcgatgtaggagatcctttcgatttgcatccggtagataaatacgatgtcggacaccggctggctcttgctgcccgaaagctggcatacggagagaaaattgtcggcatgggacctctttataaaaagatgtctgtgaaaggaaataagatcattctggagtttactaatcagggtaaaaagttggtgatgggaacttctccgtacatcccggcaggaaaaccgcctcatccgaaaccgacgaagctgacaggcttcggcattgcaggagcggaccgtaagtttgtatgggcggatgcggtgattgaaggaaataaggtgattgtgtccagcagtgaagtggctgtacctcttgccgtacgttacggattttccaatagcccccgttgtaacctgtataacgagaaaggcttgccggcatctcctttccgcacggacagctgggataaatgatgggggagagtacggggcttaccatgtttgttattaaataaggtagaaaaatgatcatgatgaaaaggtataaaaagattttgttgacaggtgtgttgtcagccttgtcttgttcattcgttcacgcacaggagctatacaagaatgaaaatgcgcctgtgcatgaacgggtaatggatttgatttcccgtttgacggtggaagagaagatcagtttgcttcgtgccacttctcccggcattccccgtttgggtatcgataaatactatcatggcaatgaagcattgcatggagtagtacgtcccggacgtttcaccgtatttccacaagccattggactggcagcaacctggaatccggagttgcagaaaagggtagccacagtgatctcggatgaggcgcgtgcccgttggaacgagctggatcagggaagagaacagaaagaacaattcagcgatgtgctgactttctggtcgcctaccgtgaacatggcacgcgacccgcgttggggacgaacaccggaaacgtatggagaagaccctttcctgagtggaataatgggaacagcctttgtgaacggactgcaaggagatgatccgcattacctgaaaatcgtttctactcccaagcattttgccgccaacaacgaagagcataatcgctttgtctgcaacccgcagatatcggagaaacaactgcgtgaatattattttcctgctttcgaaatgtgtgtgaaggaaggaaaagccgcttccatcatgtccgcctataatgcgctgaatgatgtgccctgcacgctgaatccgtggctgctgcaaaaggtgttgcgtcaggactggggatttcagggatatgtcgtttccgattgtggcggacctgccttgctggtcaatgcccataaatatgtaaagacgaaggaggcggctgccactttatccatcaaggcgggactcgaccttgaatgcggtgacgatgtgtatgacggccccttattgaatgcttacaaacaatatatggtatcggatgccgatattgactccgccgcctatcatgtgctgacggcccgcatgaaactgggactttttgatagcggggaacgaaatccgtatactaaaatctctccgtcagtgatcggttcgaaagaacatcagcagatagctctggacgctgcccgccaatgtgtcgttttactgaagaatcagaaaaataggcttccgctgaatgctgacaaactgaaatcaatcgcagtagtcggcatcaatgccggcaaatgtgagtttggcgattacagcggcgctccggtagtagaaccggtttccatactacaaggtatcagaaacagggtaggcgatcgggtgaaagtcgtctatgctccctggaaatctgctgccgatgggctggaacttattcagggagagaacttcccggaaggactgcaagctgaatattttgacaatacccgcctcgaaggcaccccgagagtgcgtaaggagagttggatcaactttgaacctgccaatcaggctcccgatccgttcctgcctaaatctccgttgtctgtccgttggacgggaaagttgaaaccgaccgtttccggtcgctatactttcagctttacatccgatgacggttgccgcctgagcattaataatcagatgctgattgatgcatggcaggcacatgccgtatctacggattccgcttccatttatctcgaagcgggaaaagaataccagttgaaagcggaatattatgacaaccgggattatgccattgcaaagttgcaatggaaagttccgcagataggcaaggcaactcgtctcgatttgtacggagaagccgggaaagcggttcgcgaatgtgaaacggtagttgctgtgatgggtatcaataaatcgatagagcgtgaaggacaggaccggtatgatattcagcttccggcggatcagagagagtttctgcaggaaatctataaagtgaatcccaacataattgttgttttggtagcaggcagttcattggctattaactggatggacgagcatattcctgccattgtgaatgcctggtatccgggtgaacagggaggaaccgccgttgccgaagtattgttcggtgattataatcctgccggacgtctgccgctcacctactacaagtctttggatgaactgcctccgtttgatgattatgatataaccaaagggcgtacttataaatatttcaaaggagatgtcctttatccgttcggctatggtctgagttactcttcttttacatacagcgatctgcaagtaaaagacgggggcggtgaagtcaccgtttcattccggttaaaaaataccggtaagagaaatggcgatgaggttgctcaggtttatgtgcggataccggagaccggaggaattgttcctttgaaagaattgaagggattccgtcgtgttcctttgaaatcgggagaaagccgtcgggtagagattaagttggacaaagagcaacttcgctattgggatgtagaaaaaggacagtttgtagtaccgaaaggggcatttgacgttatggttggtgcttcttccaaagatattcgtctgcaaacagtcattgatttatagactttatttaaatttgaaccagaaagaagattaagattacattcactgaggtaatgccttctgattgcacagtctgtgtcaccctattggcacagttgtgccaccgcactggcactgttatgccaagcctttggcacagttgtgccaatagggtggcacaagcgtgacacagtatggggcaatcttaagacattacttcttaaaatttagtattatgagaaacaagtatttgcgttttgcagatgtattatttctacttagctttgtggcaggaactacgatgatggcttgctccgaacagcctcatcaaccgaccttgaaggcaacttataataagcctgccaaaaactgggaaagtgaagctctgcctatcggtaacggttatatgggagccatgatttttggtgacgtctacgtagatgtcatccagacaaacgaacataccttgtggtcgggaggccccggtgaagatccgtcttacaatggaggacatctgagagctccggaagtgaacaaggattatctccacaaagcgcgggtgatgttgcaacagaagatgaacgactttaccgcagaccgttctgcatatatagatgaaaatggaaaactgattacccataactacgatggagacggtgacggcacagaattgcggaatctgattgataatctggctggaacgaaggagcatttcggttctttccagacattgagcaatatcattgtagaggctgtcaatccgggtatccctgtcttgataaaagaagcagtgcagaccaattatgacaatacaaagaatcaaagtcagtcgataggcagccttttcgatcagagcactaccagcaaatggtttgccgataacgaccggttccctagctttggaagcctgccatgcgttatcaagtgggcatatacccatgctcccaaggctgtttcctatagcctgacctccgccaatgatatgccgggcagagatccgaaatcatggaaactctacggttcggcagacggaaaatcatacgacttgctggatcagcagtccggtactttttggggggatgataaggacggaaaggggagccgcaataagaccctgtcttttcctttgaagacggacaaatacaccttcttcaaactcgaaatcacagaattaatcgataacaaacagaaaccgcaattggcggaactctcgatagatgcctctaccgaactgccttattccgactatacccgtacgctcgatatagataatgcgattcatacggtaatgtataaggagaatggaatcacctttaagcgcgaatattttatgagttatccggataatgtaatggtgatgcgtctcacctcagattcgaagaagggaaaactttcacgcatcatttctcttgaatcgctgcataccgataaaaccattacggcagacggtcataccattaccatgacggggtatccgactccggtcagcggagacaagcgggtaggggatgcctggaagaatggactgaaatatgcgcagcaactggtcgtgaagaataaaggaggaaagatttcggtagtggacggaacgaagctgaaagtagaggatgccgatgaaataatcgttctgatgtctgccgccacaaactatgtacagtgcatggacgactcctacaattatttctctcaagaagatccgttggaaaaagtgcaggctacgctgcataaagtagctgataagaagtacacggctctgttggctacccaccagaaagactatcattcgttatacgacagaatgcgactgaatctcggtaacttgccggaggcacctgttgcccctacggacagtttgctgaaaggtatggacgagaataccaactcggaacaggaaaaccagtatcttgaaatgctgtatttccagtttggccgttatcttttgatatcttcttcacgagaaggttctttgcccgccaacttgcagggagtatggggtgaaaggctttccaatccgtggaatgccgattaccatacgaatatcaatatacagatgaattattggccgacacagcctaccaatctgagtccgtgtcatctgcctatggtagagtatgtccgaagtctggtgcctcgtggaaagtatacagcgcaacaatattattgcaaacccgatggtggcaatgttcgcggctgggtgacgcatcatgagaataatatttgggacaatacggctcctgccaagaaaagcacgccccatcattttccggcaggggcaatatggatgtgtcaggatatctgggagtattatcagttcaaccttgataaagacttcttgaaaaagtattatgatacgatgctcgatgctgctcttttctgggtagacaatctttggacagacgaacgcgacggtacactggtagcaaacccgtcccactctcccgaacatggtgagttctcactgggctgttcaacttcgcaggctatgatttgtgaaatgttcgacatgatgatcaaagccagcaaagaactgggaagggacaaagaccctgaaatcatagagatagcaacagctatgagcaaactctccggaccgaaaatcggtttgggcgggcagtttatggaatggaaagatgaagtgacgaaggatgttaccggagatggcggacacaggcatacgaatcatcttttctggttgcatccgggttcgcagattgtaatcggaagaagcgaacaggacgataaatatgcagatgccatgaaagtgacgctgaatacacgcggcgatgaaggaaccgggtggagcaaagcatggaaactgaacttctgggcacgtctgcatgacggcaaccgctctcataaactgttgagaagtgccatgaaactgactgttcccggaagccatgtaggcggtgtatatactaatttgtttgatgcgcatccgcctttccaaatcgatggtaactttggttgtacggccggtatcgcagaaatgctgatgcaaagtcagggcggatatatcgaattgcttcccgctttgcccgatgcatggaaaaatggctcattcaaaggaatgaaagcgagaggaaactttgaagtagatgcggcatggactgacgggaagataacagctatagagattctttctaattccggtgcggaatgtgtgattaaatatccgaatgcaaaggagctgaacgtttctggagcaaaggtaaaggtacttgctgatgatcaaatctcttttgctactgtgaagggtaaaacgtatattattaaaaacgtatcttctttataaagagaaaactaagtgtataaggaggtaatgtagtctgtccagggacaactattaacgactgaaaccaaaaggcaattgattcgcaatgaatcagttgccttttggtttgaatctatgttcaatagaataaagatgtgaatagtttggataaggcttgttctttggtttgattaaaagtcgaaactatcttcattgaggttgactgaaaaagcggtagtatctacaatggaggtgactaaaagtcggtagtatcttaactctcttcgggaaggaggagtacccgtagggggaggtggtaggtgaatgcactcctatttcatttacaataaaattaggaatacacatcattttacctaccacctcggtcttcgaccactcctccttcccgaaggaggagaatgtggatactaccgactttttagtcagttctcaatgaagacactaagaattctactgaattgggaagtttttattatttcttatcttttgtgaattaactcagagattgcagttgtaagaacatctttgctaataacttcgattataattaaaaacaaaactgcccgtctcctctaatgggaagacgggcaggaagaatggaaaaactccactcaatgatatcaattacatacctatttcaataattcattcaccatgtttaccagcagtttacctgctatcggatcagtggttgccttctctgtacataaggttgaaacgagagactttcctttattgtcggctatctgtagcagcgtcagtccgcgcatagattcgatacgtgcgatacgttcctccggcttaccaccgtcgatataagcatggatcttcatttgggcggcgagttccttcacattctcatggcggacagctttcaatgtagcggtgcaggctagtggaatttcacgcttgttgttattgaaatagcgtaattccaatgcaccgattccgtcgaatacaggggcatcatcccgttccatcaccacaatgtctccctcggtgggaataatccatccggtgatatattcgggatagactttttgtgctgcctctttgctgttcaggaagagaatccgaccgccttttgactgatattcacgcagtaatcttgcttcttcatcggtacattctttcaagcccgatataatgcagagattagctttttgcttggcattcagtagttccttgatagacggtactgtctggcaggcgatgttcaggaagtcaagggtagctttcatatgatccttatccagtaaaagaatcttcttgctggctgttacttgaccgatattccattccttgcgtgccagtaataatccgtattcattctgcgataaagtgactccgctttcggtgagagtgagtttcagttttacattaaccttgtctgccggtaaattggaaggcatatggatgttcggttcgatgtatttacgaccataatattccactgccggaaattgttccgtgccggaagccagtaccttattggtttcgtctacaatgctccatgccagtgacataggcttcaagtcacgtccttcttcattgtcattcactacgtagatacgtgtatgtaacttctcacctgcataaagattgcgtccccacagttccgcactgacaagtacgggctgcatagcacgttgcatagcgtaataagtgggatacggttgtatattccggtgatcatagcattggcggaaccaagtcatataggcaaagtgcatgatacccgaagcctgttcgttggtacggcggagggtttcggccaactctcctgtgatgaacgattgtgtattcaggaaactggcgggattcccccagtcatatgcttcatatccgattaatgaatagggattctgatgaatcagctgataagagcgggtcggatgaccggtttcagcattcggataacccgtactcatttcctggctgatcaacgggcgtccgggagtcttgaattgtttctggaattctccgttgaagaagcggaataccgaatagtcataccaattatagtaggcatggttgtcatcaatatctccgtcatcaactgttttcagaaagtcatcaccaaagcgtttgctagctttgttgtggagatagttggagtcgaaacatacaggacgtgtagggtcagtctttctcatatctttcaccacatcggatacgatgcggaatttttgcttggcacgttccgtgtcggcatccagatcgtagaacttcatttcattgttcacagtccagaagaatatggaaggatgatttctgtactttttcatcacgcgcagccattcactgctccaaagatcgagcacgcctttgtccggtatcggggtggagtgtatcatgagccacgaccaagtgccctcaaagctgatagcgataccgttgcggtctgctgccgacacccaaagttcgttccagggggtggtatgtgtccgggtagactgtacattcccttctttcattagcttcatgaacttgtctgcaaggagcgaatcattgggacagagcgcaaaaggaatatggttacctccacgcagccaatatttgcggccgttcagataaaggaatccatctttgctttcaaacgtgcggaaacccgaagttacggtgatgcagtccgtcactttgttttttccttccgtcaggctcacgcgaaaatcataaagattaggagtggcaggttcccaaagtttgggtttcagtcctttgatatcacaggtaaatgtttcttgtgcgcttgtcgctaatgagagtttgctacgtacaggtgcaccgtacagtgtttcccccgtctgtttgtctataatatctacacggatatcgaagtttttctttttgggcgcatgatttttgatggtgacatctattgatgcaccgtccagagccggcttgataaagatatcttctactttcagcgggttgctgacaatgagtttcacgggctgccatataccggcagggttatcaccatagaatccatgagggatgtctgtcaatacggctttgttggcctgttggtcgttttggttatcctccacttccttgcgtactgacgaatagtagttttccatggcgtcactggtttgtgcggcttttccgttgatgtcacgtgtcacttttactgcgatcaggttgcgtcccggacgcaggaatcgggtggcgtctacttggaaatcaccgaacataccgatgttggaacctgccgattcgccattaatatatacttccgccattttggatacggcgtcgaatgaaagagtcagctgttttcccttcacgtcggcgggcagttccagccattggcgataccaggcagcaccggttttccggtagttgaacgtatagttctcgcatcggtcggtttcttgttggtagtaagtgtccgatacccctttatgttgcggaccggtgggcgatggcatggtttctccatgcagccagatacggatagggttccagaaagcgggaacaggcattatatgccagtcgttgtcgttagtctgcatggagatggccttcgtcttatcgttcagttggtagtcgggcatgaacagccagtttccgtccagcgatagttcggtgcggtcggcagttagtttatccagtttgaccgaggtgtattgcgcccgctcttcgcggcgtatcttttccttttcctgtgtggtgagtgccatacgatactcctgaaccttgacatctttgagagcgtcttctgccaatggggtgacagtgaggtcatcaaattccgtatctatccatccgcctcccagtgctacttcaccggtaggagccaggttgctgtttttgtcctccaaatcaatgtgaggaagcttttcgtcgtttacaaaaacccggatacggttaccgcatacttccactttcactttgtaccactctcccggcacggggtgaaagcccagcggacggactcccatgaattcgtctgtacccatatatccggtacgcatcaagtagagatcgtcttgcaacccgcctttgatacctaccacataacggtcaaaacggttatgtgtacggaagcctgcccatatctgtacctgttcggcgtctttcggggcacgtgccttgaaggacagggtataatctttccactcaggattgccgaaaagggcataagcgctgcgcgaatgaaatactccgtcgttcacccgacagacaccacgtcccaccatattcagtggttgggaggcattggagaaatcattgctccatacggtttgatcttgggcttgcgttgtcagaccggacaggctacaggcgcaagctaaaaatactttgctaatttgtttcatgatatgattttgtagttttaaagttcattgtatttaagtttatgatttggcaaagactgtaattcacgggttgatcacgaaaaatgatgtggcaaatatagagacagatagttaagtgagagcttaattttcgcttaattgattattaaatatcccttaaatgtagaatttatgcaaataagtatgctgaagaggggataaaagttagctgtagttataaatattcctgttattccttattatataggaaacttatattatatgagaaatagggaatagtacaacttaaagcttatatcatggggagcgctttgaaaatctatcaggaataacgccattgtaatactaaaaatccacatcttatataatcggataagtcactaattggatatctcctaatttgtgttatgtttgtatagtatttgccttatttacctttttagcctttctacttgaaatattcttctttttgcaggaagtgaatactcatttagataaagaaatagggtgtggacagcatactacaggatataaaacttcccccttttcctgaaattaatacctaagattgcgaaaaattataagaagatagtattagttttaaaattaattagaaattaatcagagtttaatcgtattttataaaaaatcttaagcaggctcttgttactttgcatcagaactcaaaaataaccttaaatattaagtttgttcagtcgacgctttcttaaataatagataaaaagggtgttttcgaggtgtaacaaatagcaaatgtataatataaaaaagagaccgtgaaaaattatttgaaaatcacgatggggcttgtattagcttccatgattgttagctgttctgatgaggacaatactattgttcctgatactaatccggacccggttataccgacagaagggacgttcatacttcctgctcctgcggtagagagtaatattcccgaacatagttttttgatgggggcgctgttcagctatcagaagaatctccgcaatggagaagatgctgccagtggcgggactagttctactaccttttataataagccgcttttcgaagtgaagtcttttggtgctacggaaacagagtggtgggataacttggtagaagagatggtgtatagtggtttggattatgtagctcccaattgccgcggacgcttgccgaaggcggacactgatcctgcttatgacagagatcatggcgatcctacccgtatcaaagacttcgttgctgctttacagcgtcggaatgaagaaaatctgaagatcgccatcttcgatgactgtccggcttcctgggcggctgcccgcaattttgacttgtatcagacctatgctacattcattagtgcggaaactcagcaaaacaagggactgaccgatgaagaggtgatgtatccgctggacaatttggacgatatatataagtatatatgggattacaatataaaactggccttcgataacttttatggcgagaataaagccaataacaagtatcttcttcgcatagacggcaaacctgtcctgtttttgtggagcatcaacggtttccttaatgtagactatgctgcattgggcaacaagaaaattgactgtaaaggcaaattaaaggccattctgaacaagattcatgctgacttcaagtctgcttatggcgaagatctctttatttgtgccgacagagcctttcaggaccgtgataaagaggtggacgaatcagtcgtagaatcactgaacgattggtttattgcctctgagcaggctcccacccgtagttcctggacggtacgtaccttcaatggaaaaactgtaggtgtggctgttccggctttctataccaatgataaatcgggtacccgtatgttttttgatgcagatcacggcaaacgtttgacggatgctttggacgatatggttgcgaagaatgctgatctggtcttcctggaaggttttaccgatatggccgagaatgccgcttattggagaagtaccgacaacatttactatgacttccccaaccagcgtctgaacattctccgtaaatacagtagcagccgggcatgggccgaatcattccgtgtagaaatggaggcctgcgattacttcttcgatgtatctgctaagaatagcggtaatcaataccgtaccggaagtctggatgttgccaaaatagccggtgtggctccggataagaacaccgaatggtatgtcaccagcacagaggcgggtgagtggatggaatggaaagaactgccttatgctgccggagatatcacagtcaaggtatgttatgctgccaaagaagatgctaaaatccgttttgactttggcgaaggcacgaaaagaagacaagggcctgtcgtagaacttcatgcaaccggaggcgaatgggttactgtcgacgctttcaccatgaagagcgatgtgaatggctggcgccgtacagtgctgaacattgtggcgggcaaacctgatttgaactacttcaccatcactgtagaaaaatgaaaagaacaaatttattaattataaacttaagctaatatggagaaactttatctgaaaagaagctggaggatagggacgtgcctgatggtattgctcacgttcttcgcactttcactttcggcgcaaaaccgaaaggtcactggagtcgttgttgacgagtttggtgatccgcttccaggtgctaatattacggtggttggaaaccaaaacttagctactgcgacaaatatggagggacaatttaccttgaacaatgtgccgaaagatgctattctgaatgtaagattcataggctatgctgtaaagactatcagactggctaccttgaaaaacaatgatctgctgcgcatcgttctaagtgaggatgtcaaagaactgaacgatgtcgtggttacggcattgggcatcagtcgtgaatccaaatcgttgggatatgcccgtcagtccattgacacggaatctctgctggatacacgtgacccgaacttattgaatagtctgagcggtaaagtttcgggcgttaattttatttcgaatggcggtccgttgtcttctacccgtgtggagattcgtggtaacaactccctgaccggaaataaccagccgttgtacgtaattgacggtgtgcccatcatgaacccgatgggagaagatggagacttggactatggtaatcctgcttctgctatcagcccggacgatattgaatcaatcgaagttttgaaaggtgccaatgcggctgccttgtatggatctgatgctgccaatggcgttattctgatcactacccgtaaagctaccaagaaatccggactcggtgtttcttatggctacaatatgcagtttactttcttgcgtgaatttcctgcctatcagaatgtttatggttcggccagccttccggctgtcggtgtgggtgacggattcaactattatggttccaactcaaagaacggttatgcttatgaccccagcctgccttatggtatttttgtatttaactgggcgaatccgaaccaacgctcatgggggctgccgatgttaggctttgatctggtgggacgtaataatcagatacgttcttatgtacctaataaggatggtatcacggatatgtacgaaatgggtgtagccatgactcatagtgtttcggtcaataaggtgttcaatggagcaggtatccgtttcaactatacgggtatcgactacgacggaatgctgaagaactttgataacatgaagcgtcacacatttgacctgcgtgtgaatatggatctggctaaatggctgtccagtgaaatctccgttaactatcagctggaaacagccgataaccgtgattataaaggtgacagtaaccgtaacccgatgcgtgccatcatgaatatgccgcgtgacgtcgttatggaggaattactgccgtggaagcgcgagacaggtgaagccttcacgcgtggtaacggattctacaatccttactggctgctgaacgaaatcagcaatggtgacggccgtaataacttccgtggtaacctgactcttaatatcaaaccgattcagggaatgaatatccgtttgcgtgccagtgtagaaaaggcaaacaagaacggttggaagtttgacaattattataccatgtgggatatcgacggacagtacgaaactttccgtgaagcctccaacaactacaattatgaaggagttatttcttataaccgcaatatcaagaaggtcagcctcagtgctaacttgggtacttctatgcaaaagaatgactggtataaactctggaatcaggtttctcaactggcagctccggatgtgaagtcattgtccaacaatgcctctatattgagtggaacggaaagtgtgaatgcgaaagagaaacagtccgtattcggtatgttgtctttgggatatcatggtttgtttgtagacggaactttccgtaacgactggtcaagttctttgccgaaagctaacaattcttacttctatgcctccggtagtgccagtgccgtgttgacggaaatcttccccaagctgaagagcaagacattctcattcgccaagttgcgcggatctattgcccgcgtgggtaacgatgctggtttcgaccgtttgattaacagttacagttacggaggattgttccgtaatgacatggcgtggttccagggtgacgccgtacgcaagaatccgaacttgaaaccggaaacaaccatctcaaaagaaatcggtgcggaagttcgtttgctggacggacgcctgacagcagatgttacttactatgacaaatacactcgtgatcagattgtcgagtcggaactttcttatttatccaattaccagcgtgtaatcatcaactccggtaaaatctccaacaagggttgggaaatctccgtgagcggtgtgccggtgaaggtgaagaacttcgagtggaaaaccattttcaactggtcaaagaacaattccatggtagaatcattgcccgaaggtatcgacaagatacagattggtagcggtgtgtacaacgtgaagtcttatgcggaagtaggcaagccctacggtgctatctatgcgaagacatttaaacgcgatgccgaaggatacatcctttgtcagctcgacgggtcgccgaaagaaggacaggactatgaatatttaggttgtgtacaggctgactggcgaggtggctggaacaacgtgttccgtttgggtaatttctccttctctgttatgttcgacttccagaagggtggtaagttcttctcacagacatccatccagagttctgtagacggacaatccgtcaagtcattggaaggtcgtgacgcggatttcttctccagaaagattttgggtgagtcggacgaagaacgatatggcttcatgcgtcctcagaacgccaacacaccgaccgcaaacgggcagatttatcctgactggggacgtcctaaaggggtagttcttcctaattgccgttatgacgaagacgtagaagggctggcaggacaacaagtattgggttattgtacccccgaacgctattggatgcactatacctctcgtgatatttcccgtttcatctacgatgcttcttatgtgaagttgcgtgaaatcactgtcagctacgatttaccgaaaaaatggctgagaaagactccgttccagacattccgtgtggcggctgtcggacgaaacattgctaccttgtttgccaatacaccgcacgggcttgatccgcaggcaacgagtacaacaggaaatgcacaaggtttcgaacgtggtttcaacctgccttccgcaacctatggatttgatattaaagtttctttttaaattcgtaaagcatgaaattgaaaaacaaaatattaccgttactcctgctggcatcgactgccgtggggtgtacggacggtttcgaaaccatcaactcggacccgaacaaattgtatgaggtaaatctgcagagtattttccccggtacggtttacaagacaatgaatgcaatcagtgaattgaataataaccgtatgtggagttattcacgttacattactaacgtcgctttccagacaccgtggaacgaaaggggagacggattctaccgtaagttttatgtagagattctgcgcgacctggaagagttggcaaaagcatacgatgatggctctttgcctaacagtctggctgttgtaaagacatggaaagcattcacttactaccagttgctgtcactctatggtccggtcggactgagccatgccggtatggacggaggaacggacaagcgtatctttgactatgattcggaagccgatgcttactattccattttgggttggctggaccaggcagtcgatgagttcgacgaatcatctactgataagattctgaaagaccctgtttataacggagatgtacagaaatggcgcaaactggctaatacattacgcctggagatagccatgaatatccagaatatcagcgaagagaaagcacgcgaatatgctgcgaaatctatgggacatgaagaatggctgttcagctctctggacgatgcgtttgctcccaaatatggaacggtgatcgacaaagactgttcctggtattacactcgtttgtataaagaagaaattcagacgaaagcaaactgggggctgatcccttccatgaacgaatatttcgccatttacctgttctcatacaacgatccgcgtatggagacttactttgacggctccaacgtttattggccggaacgccagccttatcgtatgacggatgtgctgactcgttcacacgactgtgatgtgagcggttgttccgccagcgatcagcaggaacacctgcaatggatgatagatggatatgaagtgcgtgattcattgcgtgtacgttactctattccatacgttcctacaccggacaatccgggcgcccgtacaccgttcggctggagaagaccgatcgacccgaccgacccgaatggtacaagagaaatccctgatccgttgtcaatgaacgaagacaacagatgctacatcaacccgagatattatgcaatggacgctacgatgcctttgctgcgctgggcagatgcttgtttcctctgcgctgaagcgaaagtgaagttcgacttgggatccaaggatgcacagacctattatgaagaaggcatccgtgcttcgttcgaagagaacggcttgtctgcttctgctgctgcctatatggctcaggaaggaatcgcctggggaaccagtcataaaggattctatgatacccgtaaactgatgactgccgacatcaacggagcagacggtaaggacggacaattggaacaaatctacaaacaacgctggtttgccgacttcctggatggaatgtctgcctggcgtatggaacgccgcacacgtgcattgaaccttccgcctctgttcctgaacggatctcaggcttatgaagaaggcggaaatatgtactacggctggcccgaacgcctttacttcccggatgcggaacgtcagacaaatgcagaggcttattacagagctattgatttgttacagaagaatagtccgaaacctaatgccgcccgttggggagacaatatcttcacgatgcttcagttcgcaaaacctgtacctaaccaggaagagatgatagccggatgggaaaacagcgattatgtacagttcaacatggatttccaagccaagaagtatggacagacttatgaagagttcttgaagaatgcccgtgagctgaccggtatcaaggaggctgaagaggctttggacaaggcttacaacttcttgatagaagctacacttttagtttataaggtagaaaagtagtaattaagtaatgactgaaaaatgaaaaagtataagatttttaataagacaggtcttgcaatatgcctgacgttgggactggtggccggatcggcctgttcaccgacagatgacggtccttccatcgatgatcatttcttgaactatgagattccgcaaatcagaccgagcagcgatattccggtaggagccatttattggaacttgggtagtacgggtgtggatgaaaagaagtatgcgcggttgattggtgaatataatcagagcggacagtatccacagctttgtccgaatgtgcgtccggtgctgggacgttattcgatggatatcaataaagccgaaacagccgatttgattcagcagcaccttacctgggcaaataatgccggtatcaatttccttatcttgccgaacatcggtctggataccagtaagggagatttgctgaacgaaggtaacgtgaatttcgtgaactatatggcgggactgaatcccaactcggaaggtatcgaatggggtggcttgcgttatgcggtttctatggatatgaataacttcgcaaacggacttaacaacaccgccatgatagaagacgatgccgatgaaaatggtgtctctgcacgttgtgagcaactttacagcttttttgtcaacctgacaagccgtttctgtacgaacaacgatctttactatactgtagacggcaaaccgatgattgttgtctggaatgctgacaagttgtatgcacgcgattcagagaaactctataatacgatccgtgaaagagtgcgtgaaaatgtaaaggacggcaatggcaatggactggagatctatattttagcacgtcaggaacgttggacacctcctgcacgctggcataacttcttcctgagcggaaaagtggatgctgtgtacatggataatatgtacaatcagaccgactggttccgccctacctgctatccgcagtgcatcgaccagaactttaagtacaaccgcgaatatgagtgggctaattacggagtagacttcgtacctagcgtttcaccttcgttcaatcagtggatagatggtgatggaactcagttctataacttcccggtggtatttaaggatgaagatatgttccgtaagatgtgtaatgttgccaagatgaacttgggaaagcgtccgatggtcatcatcgattcttttaaccgttggaatgtggatcaggctatcgaaccgactgacccgaattacgggaatggatacggtatgaaataccttaatattgtaaaagaagaatttaaagtgaaataagcatgaaagcgataaattttatcaattggaaatatatcggcttgaccggatgtttggtggcatcgttactgactgcatgtggtgacgatgaaactggtccggaagtggtgacgccgctagagcctaaattggagatcgtgaacgaagcgtccaccttcagtttctcttctgcgggaaattccgctcaagtactgacattcaacgccaatcaggattggcatatcgtattggatgattcggaaggtgtggataatagctgggtagtgctgtttgaacgcgaaggaacggccggcgaaggcaacaaagtatgggtagctgcagccgaaaatgtggaaccggatgcacgccgtgctaatttttctctcgtgtccggtggctttaagtatgatttcgttatctatcaggcacagaaggatgcggtggtaatcaccgacccgaaggcctacgaaaacctggatgccggtgagcatatcatttccgtagagtttggaattaacacaggagagtataaaaccagtttcctctattccggtgacacgggctggatcatgccgacggacgaacgccccgcaggcgaaccggagacacgtgcgatggaaaaccatacactgtactttaaggtgttgccgaatcagaagtttgatattcgtagaggtaccattgaaatctcttcgaaagataatgataatgtaaaggctacgatgaatatcttccagaccggtctgcccaaacctgtcattacggtcgataacaaggaaatgttcactaacctggcatcgaaagaagattcgattctgttgaaatataaagcaaccaataccaacggaccaagggatttgacgattgatattgataagaacgatcaggattggatttcgttcaagcctgctatagatgccaagggcgactctaccttcctcgtttccgtgaaagaaaataccggtggcgaacgtacggcaacgatcgcgctttgtgccgctgccgacaagaaggtgagagaagagtttatcgtgactcaagctcaggcaagcgatgtggaattggttattaccaacaagaacgatttcagaacaagtttggataagctgggcagtgccgctaccgtgaagtatagcgtacagtctacgttgaccgatccgaagaacgagattttggtggatatcgtatatccggaagaaagtggctatacggcagagaatggttggctgcacatggcaaacaactcgatgcccgaacgtgtcatcttcacgtacgatgtgaataaggtactgagagaacgtcaggctaccgtttacatctatcgcaagggttatgaaaacaagaaagactatatggttatccgtcaggctgcggccactcagattgaaattccggctccgggaggtttgacaaatgtattgcagagtcttattgatgacgaaatctataaagattgggaatccatcactagcctggaattgaagggcagactcaacgataccgatttgaacttactgaagaacatgatgacagcgggtaagggctacaacctgaaaactctggatatgacggaagtggagaatgaaacgctgaagaatggtgtattcaacggatgtaaccttctggagaatatttcattcccgacaggattgcaatacgtaccgagagaagcttgtcgtaactgtaccaagctgagaacggtagtggtgaacgaaggtccgacttatatcggtcgtcacgcgttcggtaactcagtagtaaatgaagcttggttcccgagtaccatgacttatgtttacggatacatctttgataatgtgacggcactcaagactttgcacttgaagtcattaccgttccagtgtaaggaagttgcccgtagtgatgccgacgaaggtgctacccaaccgacaacctggtgtactgtctttaagacatggccgagcacggtatatgtaccgatggaatatctggaatattacaagaatccggacccgaaacacgtagtttccatgcacttccaagacctgttgaatacattgacatccgaatcggaagaatggacgaagggaccgaaggttcagcaaccgtacttgaagtccaattcggcattgaagagcaactttacttggggatcatctgccactactatcatgggagaatccaattgatatagagtcaagtaggtatatactataaaaagagcggactatcagtcggcgggaagattcccgccattgatagtccgcttttcttttgagtcagtagtaaagtcatgcattgtttccttgtcgattcattcgtaatggtacagtgaggtttttagtcctatgacataaaaaaagaaaagaatcattgtcgcaataattcatttacttatttaaaggataaagaacttttcaaggtcagcatccatatctatacgaaagatattgaccgattatgcagtaacttccaatcgtttattaataaattccttcatcgtttattataaacgtcccccaagtttattataaacttggacatcgttattttagtgataaatattaatttaaagcaacaaaaagggctgcaattcccataaagaatcgcagcccttagcttgtatcagactatccgaaaaacattatccgaagtggaaatgcctgtaatctgttattatattatacttattatcgctcatttttcgtctatattatcaatgttatcgaattttcttccggtttctacttacaaatatacaacataaaaagcggtttgtcaagtcctccatgcttctttcgtacatctgattacctatccatacggtttagtttagctcattcccgattcagatttgaataaatcgatagtatctcaattcccctcccttcgggaaggaggggtggctgaaagccggggtggtaggtgagcgcatcaacttaataatcagccatgtgtattcacctaccacctccccctacgggtactcctccttcccgaaggaggagaatgaagttactgctgttttgttcctttctgtgaagaaagaagtaaagctatacagttataaatcggcgaatggtgttttataatcttctcccatcgagtcccgatactccttgcagaaacggtcatacagatttcgtgcaatccctttctttccctgtgcggagaatacagcgcatttggcggccaatgcttcttcattcagcgggtcatgcaggaacatgatgtctgccaggcggagaatcatgtctggatggttgcgttgcttttcgatttcaaacagatccttcaacaagtcgatggagtggctggagtatgtttctttgaagtcatccaaccaatcgagaatagtgttgggcaataatggtccatacagcagaagttccaggatccggttgagtaactcgctgttttctttctccttgaattgctggatgcgtgcaagtacttcgcgatagtcgcagaatacgttctcgccccattttatgtgcatgaagttgttttccgtcacgacttctacatcaccgatactctccagtaatacccgcagtttgcgtaaatttacgttacggttgttgcgggcagccgtctcttccttatccggccataggattcccgttgttttggaggtcaggataccgttcggattcttttccgtatataatatcagcaaaataagcaagtgcttcagacggggagtgaaattggcggtgatatcatttccctctttatcgcgtacgttgaagcaccccagcaatgagatggaagaacggctacgatcgtagtagtggactatctctttcggtgcgggctcgttttcttgttccggcattgtcggagtaactttctcttgattctcagagatagcttttggagccgtaaccgattgaggtgtttcttttgagattgcggacgattggattggctgacgtttgcttcttgaacgatagaacaaccaggcaccgcaacctagtattgccaggacaccgatgacatacagcagattccaccatttgccggagcccatttcatccactgactgccggatatctatctcgttgactaaaggcatattgatggaatagatcttaatatcgtgcgtacgattgttcagtatcttgtccaatacaaggaacagtttcctgtgagtcggtgaatagtaaaggttaaaatcgcagtcctgataatccagtcggttattgatcggttttgaaacttctgtataaacagggcttttcatggaaattttccacagtgttcccccgttgtccgtagatacggcatagaaagaactgtctgccggctcgaagtacatggaggaagccatgatagtttccttgttatcgtcttttttctcccagatggtgcgggactgtttactttttaaattgatggcatacaggccgaggtagtagtgggtactcaattcctgtttaccatatttgtttcctttgcctccaaagatatatagttcgtcgcccactactgccatagcagccgaatagcggggataaagcggatgatcatatttaatttgctccataatttcgctgccggacttcatgcggaacaggtcattacggtatttatagaagccatatccgccgaaaaagtagaatgaggagtcggcgggattaaatgctttggcatggttatagttgttgggctctttggtattccgcacttcgttgctccacatgccgtcggcgaacgaaaagcgggagatgatgttttctgtcagcgagtaagataccagtgcattgctcagcgtatcatacagtaggtggttgggatattctacggcaggatatcctccgcgtacggcagtctcttgtttgagtcttccgtcttcgtccagcactttcaccgattcgggactgactacatagaataaggcgcaacgggcgtcgaatgctatgcctactctgctggaagtcgtgatcttattgattgttttccattcgatatggttgtctatcagccagagaggctggacagcacgtgcaacggctccctctttttcgtcataacagagattgtcgttatgtttccataatttccattctcttgtcagtttgccgtcctgtatgatgttgatatcccttaagttgacaggggctacttccgcctgatagcctaacatctgtccgaatgtaatcgttacactgtttgtttcttgcagggggaaggtggacgacatcttttttttgtcgtattctatttcgatcacattgtctttttggcgtagattcagcgagacattgatccatttttccagttctatgggtttgtcaatgatgataatctcatcattgagcattaaagcgggagcatggttttgctcgcctgcaacaaacgaaaagcgtattatctggcctttgtctgtcttcagatgaagaatggagccatagtcggcttcattggcacgtatatatatatgaaaagaaatggttaagtcgttttttacggagaaaggttggttgtcatccaaatataaagtagacctttccggtgccggtacggcatgagacttaagataaagtccgtaatcatataaaggagacgcatccagtctgcccgctaggcaaagcaggataaaaatcaataattgcagttgatatttcatagtacttctacttgaatctgttcctatgtggcaaaagtacgaaaaacaatatgatattcataagaatcggggacttattttatataaccaaagtgttggaatactcgtatatgatagctgtcgtccgaagaatatgacaagaggtattgtcgaagaatcagatgttatttcgatgattcttcgacaaacctcttgcgcttaatcgctagaatatagctacttgatttctaatgatggaggaacatcctctgctccgctggcccatgtcttgttgggtttgttgcccatcaccaatactagcttgccaccgctcatcaggtcatcatggctgaaccatgatttgttccattctttgccattcagcgtggcggactggatgtatttgttatcagtggaagcgttcttagcttcgatttcgaagacagctccgttgctgagtctaatctttgcatctgtgaaaagcggacttccgatagtgtaggccggcaatcccggagtgacagggtagaagcccagggaggagaagaccacaaatgaagtcatacctccgccgtcctcatctcccggaatacccatcaggtcattgcggaaccatgttttcagcatttgacggatgcgcttctgtgttttccacggctgtccggcgtagttataaagataaggaacgtgcaaagacggttcgttcgccatcgagaattggcctacattacccgtgtggtcgggcagtttcgcgtagaatgcatatttgctccgtcccagcggttcggtgaaagtacggtcaaggttggcgatgaactgctcgtttcctcccataaggctgatgaggtcggctacattgtgtggcacgtcccagcggtaaacccagccgttgttttctccataatactcacgggctcccatgcctccgggaaaacggtagtcgaatggttcaatccattgtccttccttatctttcggatggaagaaagcggtctctttattgtagagattccggtagttatacgaacatttcagatagtattcggcctcttccttcttgttcagagcttgggcgatacgggagagacaccactggtcgtagctggttcccagagtgacagcgacaggctggcgcttctcgaaaggatgtacgttcgggtcgttttccggttcatccacacggagggcggggatataaccgttttcacggtagaaattgtccagccagccggccggtgctcccgaccacggggcgagcgtcttttcttcaatccctttccggcaagcttcgtaggcttttgccgtgtctactttcaacccttttgccagtgcgtcggctaccgtggcaacggcatgattggagttcatacggcgtgtgtcacctgttacttcggggaaagtaggcatccacatattgcccatttgttccgccatgcgcaggtaggatgcgatgatgtcttcttccttttgttggtcgatcagtgtgcggagaggatgtgcggcacggtaagtgtcccaaatccagtcgtcggtgtagaaaggagtaccgttgtcttcgtgtacttttccgtcgaaggcgctgaagtaacggccgccttcgctcatgcagatagggcgttcgaaggtacggtagaaagaagagtagaatacggttttgtcatcttccgttcctccttctacttggatacgtcccaacgtttcgttccagatttggcgtcctgcttctgccagtgctttgatgttatagtcttttaattcgcggtgcaggttcttttcggcctgttcctcgctgataaaagaaataccgtagcggaggttgaccgttgtggttccatcggcaaagcgccatgccgcgcaggcgtttgcgccttcggcattatccttacttgtttcaatagtgccgttttcgaggatgccggcgcttatcggcttctcctgtgcttctatatatacatagacattggtgttgtcatttagttgctggcggccgctgatgaagttctcgttggcgtggatagagccattgcgggagtttacgatgaggtaagccggtttgtctgcctcgtacgttatccggtagatagccgactggtgggaaagcgcatattccgctttcatacggttgtcatccagttccacatcgaaagaataaggagtaatgtgctcgttgtcatagttgtacgttatgaccggacgcagcttttctccctgatagggactgaaattgaatgcggaacgttcccggtgattggtgacaatcaatggaagccccttcagcagttcggaggtgtagtcggcgcgttccgggtaaacacgaagcatactgttgggtaactggatggtggggaacgtgggaaccagcagatggctgatgttgccgatatacgggttgacgtaatcgaccggtgtccgatccgctgtttgcaggctaccgttacatgcgctcagcgttgaaatgatagccgccgaggctaaaatgtgtgtaagtttcatcatatatttatttactattatttggtttccggattcacgaaagctgctttcaacaacggaaggaaatctttcttgttatcgcatttgaaatagccggtgaagtcgttccggtctccggctcctagtttgatcaccagtttattccatccttgcagcaagggcaattctttgtagatgatttcgttgcgtccgtcgtgggatacagccgtataaggtttgtcgttgatgagcagcgcacgtttctttgctttcacaaagagggatagtttcggcatgttcggctctatcaacaggtcgtccagagggcgtggactgaatacataaagttccagtgtccattcaccgtcgctgtccttcaccagtttctctttggtggctacggggaagttgatctgttcgtcgcgcaggaagaagacctcgtcgatattgacttccggcttttggaaggctattccggcattcttcaggatagcgctcaaagtgttgaaccccttctccgagttggcaaattcggttaatgtgttcagatagaaagtggaagcgttctgctggcattttacaaatacaggagtggcggctgtacattcgtattcactgcggatcgttccggcagtcttgatctcttccgggcgtttgttccactttctccagtcggtcttacaggcgttcagcaagacctcgccttcttctacgaaagctcctttcagcgagtagctggaagcgttggtcttctgaagttcgcagaagtagaagtcggaattattgagtccgtgcatccatgacttttgtacgggcaggaaagaagaacgctgcagattatccaaggacaccggaagcggaagaatttcattgtatgcggctaccgtttccggtgtgagtccccatatccatacatccgcacctttggcgatttgcttttgcatctcatctttggtagaagcatccaacttttggctaccgtctacaatatagagcaacagggaaggagtgtttgccttcttggcgaatatgactccttgcgcatccatcagctgctttaatttactgttctgactaccgataaagatgacttccttatactttttggaaggagttgttgttttgcgatgatcgtactgttgtttgtcgattacagcataaggagaccaggccggttgccccggagcattggctgcgcgtagagcactgtacatcggccattcctgatagagcggcaaggtcgggtcgtaaccggggttgaacgtcgtacaataagggcctacccgttcgggctgcacgcccggaactccctctttgtaatcaccgaagaagactccgtcagcttcaacggtgggagctttgcttttgtctttcttgccgagtggaagcggtttcaaggcataccatgccatattgaagactgtgctgtaagaggctcccatctgtctttggttgacgatgaggttgtaacattcgttagccagcccttccatacggccttcctgtgattcgtaagcgcgttctccattatatttggcaacctgttccggggtgccgtaataagccatactgtgttcaccgattccccaaggttttccgatttcgatccagcgtttcatggagttgatgtctccgtagtggcctacggtcacgggcaatataccgtcaccgtcatcttccccgtctgctgaaatccacgggcgggtagggtcgtactgatgtacaatgtcacgccattcttcccatgccttcttttgtaccggcatcagttcggggcgattgtaaacgtgcaggataacgggtttgttttcgttgctgatactccagccgaaaacggacgcgtgatttctgtcgcgcaggacaaaacgtttcagatgttctttggatgcttcccagaagaggtcggagtccagtttcggaccaccgtcgctggcccagttggctgtttcattcagtacgcagatccccatttcatcagccatatcaaggtagaagcggggatagacttgcgcgtgcggacggactgcgttggcattcatccctttaatggcggtgaaccaggcccacgcataacggcgggtcatctgcgggatacccataaaatgccaggagtcaccatgcaatgcgtaaggttcgccgttcaggtattgtgtagtaccttgcaatgtccattcacgccagccgaaacgttcgtatttggtatcgacagtctgtttctggttattgacggaaagtaacagggcatacaggttgggatgctccggagtccagtattttaatatgtccttgtcgacaggtacttgcaaggtcactttctgtgaagccttggctggcagggacagtttcgtaggagcgactttcaatgcttcattaccaagcgtccagttcggaacgggagcggagttgacgtctgttcctgcgcagttcacccattcgcagatattaccttgtagttgtacatcagtcttcttctctgtccggttctgaagagttacttctatttccagtgtattctttgataccagcggttttacgtatacgtcttccagatggattttcggcaaagccaacagatatacatcctgccagataccgttgatctgatacccccacatcgatccgcccggaacaatgcggcgtccgatggtcgcattgttttcgaataacgactggcttcgtacgcctaccagtatctctatgttttcgccggcagtcactttatcggtgatgtcaaagctgaacggtaagaacaaatcgaagttctcgcctaccttttctttatttacgtagacttcagaatatccggctacggcctcaaagtgaagtttgatttgttgccccgaccagtcggcagggatggtgacattcttcttcatccatgccattttcacttgttcccattctttggggtatgaagggtagttgcggtggtcgggaccttccaggtcgcggtaagcaaaagcattgatattccacggtgaagggattttgatacgtgttttgctccattcgctgtcgttttccggcaggggtagttcgggagcgataccttttccctgaacgtattctttcggcaagcggacaggctggaaatcccaataaccgttgatgcaaatctcttgtcgatgttccttttctgtttggttcaccagaccttcgctgggggcaaaggtgtagggatagaccagtttctggtcattagccactgtttgtgtctgcgcgtttacctttgtagattgcaaggtaaagccggtcagcagaccgcatagtaaaattaaacttctcttcatattcataatttaatgagtttttcggtattatcaagggcaaagtaaaggtcgaaccattaaaaagagaggataaagcaaattaattcttcattaaaatggaattaattgtatcataaaatgtctttttctctccggaaaggatgaaaatggtccggttacttgctttttatccgaatgtaactcacttgggcttttcgtattgttctaccgccctccttaatttcttttctattagctccaccagtgtctgcgggtaaagaacttgtattccgttggcatatccgaagaatacccgttccagttcatggttgatgactacttctatttcaagaatcacacttccgtcttccaatgtttctatggttcgttggctgtggtgtatcggtttggtcaggatgtagggggcttcgttggcggctactttaaaaccgaccttctcggctttgcttccggagtttttggtcacccctaccaagtcgtcaaagaatgtgttcgggtcgaagaatgtattctttataaagggttcccgcgataacacctctaacgaatggattctgtccagagccagattctgcaatatccgtccgctttttctgactccaaatacgaaccaacggttgcgatattcctttaatagataaggatagaagatgaagctgtttgccgaacgggccttgaacgaacggtatttaagttgcaggggatgttcgttgacgatggcatggtaaatggtatccagataatccagccctttcagagattcgttcttttcgaagtcgatgaccggagtcgtcttcattcgggcggaggctacgtgatcttccagccggttcacaatctcactcatctccgtgaagtaggagaaacccttgaactgccgcagaacttccacggcttccgacatcgttttcaggtcctgttcgttcagcggggtttgtgtgatgctgtattccgggtcttcgtacttgtaatacttgttttcgtataccacaatcggtgcgttataacccagcttctcgctgcgcatcatctgtatatccatttgtacggcacgtttgctgattcccttgtcgattccttcatattcgtaaagggcatccgagcaggcatctaccaagtcttccagtgtccagcgacgataaggattacgcagacagttatcaatcgttttataacgaatcaaggcatttctattgaccggcataggcggaagtataaagattttctccaaaagtagaaaaataatttgaggtacgcaaaaaggctgcgtacccacccccgtatctttgcaaaagaaaacaaataaagagtataaatgatgaagtttaactggataaataaaggaatgaataaagtgctgaacaaagaatcggcaccggcttaccggctgacacccgaatgggaattgtacacatccgtggtaactacttcattgaacaacagtttctatgagcaggaggaagagagaatagaaagggtccgtacgctcatcggaaaatgtaaccctttgtttgtggcgcaactggcggcgtacgcaagggaaacgatgaacctgcgttccatccctttggtgatggcggtagaactggcgcgtatccaccagggcgacaatctggtgaagcgggtaactgcccgtaccgttcggcgtgccgatgaaatcaccgaactgctggcctgttatcagcaggcaaaccggcggacggggacaaagaaactgaaccgtctttccaaacagttgcaggcagggctacaggatgcattcaatacattcgatgcgtaccagtttgccaagtataaccgttcggcagaagtttgtctgaaagatgccttgtttcttgtgcacccgaaagcgaaagatgaacggcaacaggaaattttcaatggaatagttaacgataatcttccggttccctatacttgggagacagaattgtctgctttaggtcagcgtacctttgctacggaagaagaacggcgaaaagctttccgtgccaaatgggaagaattgatagacagtggtaaactaggatacatggctttgctgcgcaatctgaggaatatactggaagcggaagtttctgcagaccatattctgacagtagggaagaggctgtcttccgaaaaggcggttgaaaactccaggcagttgcctttccgctttttggctgcttaccgtgagttgtcgaagactccttcgctctatgctacgatgttgatgacggctttggaacgtgccgtgcaggtatctgcccgcaatattaccggatttgatgaatctacccgtgtgctgatagcctgtgacgtatccggttccatgcagtgtccggtttcggcaaagagtaaagtattgtactatgacatcggtttgctgctgggaatgttgttgaagtcacgttgcaagcaggtgatgacgggtatctttggcgatagatggaagattattaatctgcccgatacgggtatcttgtccaatgtcgatgctttctataaaagggaaggtgaagtgggatactctacaaacggatatttggttatcaaagacctgatagatcggaaggcgcagatggataagataatgatgttcaccgactgtcagttgtggaatagccatagtgatttgcagataacggatttgtggaggaagtacaagaaaatttgtccggcagccaagttgtatctgtttgacttaagcggatatggcaacactccgctggatatcactcgtgacgatgtatttctgatagcgggatggtcggataagatatttgatattttgtctgcaatcgacaaaggaaatgatgcgttgcaggagataaaaaagatagtggtataaccggagttctcaggattccggtttacggaaaaaaacagaacaagtgtcgtagagaagagttacttcgtttgggacgaccataggtcgcgggttcgactcccgctgctctccttattctttaaggaaaagcatagctcagttggatagagcagggtatagtctcttttcgtttgttaccttgttttttactttgacataagcagaatgtcgtagagaagagttacttcgtctcattttaggggaggaatagtgaagttgtaaaatcagcaagactatccggttcgactccggcattgacgtgccccgtttctcttttcgcctgttacttctgcttttaaaaaacagaaagggatgccgtagtatagagatacttcgctgttaacgattcggttgaacgcttgtctttacagacttgaggtacaggttcaaatcctgtcttggcggctggtcacacagttggtcatgtagtttaaaacaaactctgtacgcctgtagctcccttttttcaatgatgtatcaaaaatgttactctttgaaacaaagtttatagacgaaggtgaagataccccctatctttgcctccgtcaatttttgattaacactagtataactctgaatatcctgttaccatgaaaacaactccttggataaaactgtgtaaaggtgccgtactcgcactgactgtctcctttggactgacctattgccagtcgaccaaaagcacgttcactcttgaacagaaaggtgatagccttactattgtccatattactcatcctactaattatatattactccccatcgaagaagaagccgacgaaagtcaggtgcgtcttgatacggggaatgcagcggataccgatatggatatccgcctggcacagactaaggtcgattatttcgttccttttgctttgccggctgatacaaaggtagccactttacgcattcaaaagaaatcgaaagacgccctctgctgggaagaaatcaaattatccgatacgtttgatactaccaatacggataaattccgtcctgtctaccatcatactcccctttatggctggatgaatgatgcaaacggattggtatataaagatggagagtatcatttgtattatcagtataacccttatggctccaaatggggaaatatgcactggggacattcggtcagcaaagacctgatgcattgggaacatttggctcctgccattgcccgtgatacattagggcatatcttttccggtagttctattgtcgatcaggagaatgtggcgggctacggagcaggttccatcctcgcttactatacttctgccagcgataagaacggacagattcagtgtctggcttatagcaaagacaacggacggacatttactaaatacgaaaagaatcctgttctgcgtccttccgatggtctgaaagatttccgtgacccgaaagtcttctggtatgcaccggagagtaaatgggtgatgattgtctctgccgataaggaaatgcgtttctatgactcccataatctgaaagactggaactacctgagtagctttggcgaaggatacggtgtgcaaccctgtcagtttgaatgtccggatatggtggaacttcctgtagacggcgatatcaactataagaaatgggcattgattgtcaatgtaaatccgggatgttacttcggagggagtgctactcaatattttatcggtgactttgacggcacaaaatttatttgtgataatcagccgaatgtcacaaaatggctggactgggggaaagatcactatgctactgtctgtttctcaaatacgggagaccgtgtggtggcagtgccttggatgagcaactggcagtattgcaatatcgttccgacccggcagttccgtagtgccaatgcactgccccgtgaattgggactctatacacaggacaatgatatttatctttccgccgcaccggtagcggaaactaagaacttacgaaaagaaagcaaggatgttccgtccttcacggtagacaaggattatcacatcgaatctttattgactgataatgaaggagcttatgagctttctctgaacatcgaagctggaaaggcggaaattatgggattcagtcttttcaatgacaagggagagaaggtggatatttattttaatcttccggaaaagaaactggtgatggaccgtacgaaaagcggcatcgtagatttcgggaaaaacagctctccgcacgagatcgaggcgcacgaccgccggaagacgacttctatcaattatatagatgatttcgcattggctacatgggcacctatccagaaggaaaatgaatacaaactggatgtctttgttgataagtgttcggtagaaatatttctggatggcgggaagatagcgatgactaatctgattttccctacagagccatacaatcgtatgtgtttttacagtaagggcggtacattcgcagtcgattcatttagtgtgtatagattaggtttataaaaggatggatttatttttcaataggtatttatcaaggatataatc

SEQ ID NO: 64 - DNA, 42462 bp, Bacteroides thetaiotaomicron
gtagcaaagcaagcgatagaaaggttctatttgtatgaaaaaaaagatactattagttgacgataaagcgactattggaaaagttgcaagtatatatctaggtaaggattacgatgttatgtatttggaaaatcctattaaagcaatagattggcttaatgaaggtaatgtacccgatctcattatttccgatatccgtatgccgctaatgagaggagatgaattcctcagatacatgaaagccaatgagttattcaagtcaattcccatcgttatgctgtccagcgaagaaagtaccacggaaaggatcaaattactggaagaaggagcagaagactatattctgaagccattcaatcctttggaactaaaaatccgaatcaaaaagattatcgactaatacagcctttaaatgcaatattttgtttacataggcagacacaacaaaacaatagaactgttttcgaaattaagtaccggagtattctatgcagcaccaaactgctataaggcaactaaagtgctagacaagatacgagaaaaatacgatgcagctttatttattgagcaggtagaactatcaaaagatatcgccgatattcgctctatacgaaaaatgtatccagggctttatatggtactagttatagattccattactaaggaagaagctacagaatacttgaaggcaggagttaataacacgattaagtatgaaaccaacagtgaagtactgaaagatctgtcaacttttctcatacgtagaaaagaacaaaaaatagaagcgctgcaactcaaaacacagaatttaaatgcctttcgcttgccttcgtggaaaagaatcttcgatatattcttttccggaatagcattacttttcctttctcctcttttaatagcaacttctatagccattcgcctggagagcaaagggccgattatctataaatccaaacgtgtaggaagcaattatcagatatttgattttctcaaattccgttcgatgtataccgacgctgataaacatctgaaggatttcaatgccctcaaccaataccaacaggaagaacaagaggaagaagatatatggggagaagaatccaatgtctctgaagaagcagacgaagaagaaattctcctgatatccgacgattttgtaatttcggaagaagactatattcacaagaaatcaaaagagaaaagtaatgctttcgtaaaactggagaatgaccccagaatcacaaagataggacgttttatccgtaaatacagcattgatgaattaccacagcttatcaatatcctcaaaggagatatgtctatagtaggcaatcgtcccctcccactctatgaggcagagttactgaccagcgatgaacatatcgaccgttttatgggaccagccggacttaccggactgtggcaggttgaaaaaagaggtgaagcgggtaaactctccgcagaagaacgcaagcaactggatatccaatatgcaaaaaacttctctttcggactggacataaaaatcattctgaaaacagttactgcattcgttcaaaaagagaacgtataactctttcactgcagaatggacaactttatctacatagcagacgatttcttctttttgtgtatagggcttttgctcctataccttttcatattggctgttgcctcacatttcaaacattccaattatcccaaagccagaaaacaatatcagtgtgccatattagttccttacggaagcctccttccttcaatataccaacaggaagcatatgaattcatcacatataaagatctgctggaagcaattgattcattagataaagaacgatacgaattagtcatccttctttctgataaagccagtgctttatcaccccattttctggaaaagatttataatgcctacgatgccggaatacaggcaatgcagttacacacgatcattaataatcgtaagggagtacggaaacgtttccatgctctatccgaagaaatcaataacagtcttttcagatcggggaatactcagatcggcttttcttcaagtcttttcggaaccaatatggctttcgacttagaatggctacagaagaatcaaagaactgccaaaacaaatctcgaacggaagttattcaaacagaatatatatattgaatatctgccggatgtgattgtacattgtgactcagcccctgtttatccctatcgcaggcgcatacggaagaccctctcttatctattgccgtctttattagaaggcaactggaatttctgcaaccgtatagcccagcagctgataccttctccgatgaaattatgtaccttcgtcagtatctggactttattgataacaggataccactggacctcgtcactcaaatggtggatattgcttttaggattggcaatcacatacagtctggcaataccgaattatttagtagaagataaaaagaaacaaaaatattcaatatggagaaaaggacactgaaacagcgaatcaaacagaatccggctttgaaacaagccgtacatcgttttattatgcatcccgtaaagacacgtcccaactggtggatacgccttttctattttgtatatctgaaacgtggaaaaggttccgtaatttatcgcagtgtccgcaaagaccttcctccttttaatcagttctcgctagggcgctattcggtagtagaagacttttcctgccttaataatgcggtaggagatttaatcattggagattatacccgcatcggattaggaaataccattatcggtccggttcgtatagggaatcatgtgaatcttgcacagaatataacagtcacaggacttaatcataactatcaagatgcggagaaatcaatcgacgaacaaggagtaagtacacagcctgtcactattgaggatgatgtatgggtaggtgcaaactccgtcatactgccgggagtaactttagggaaacattgtgtagtggctgccggaagcgttgtcagccgttccatcccggcatactctatttgtgccggttgccctgccaaagtgatcaaatcatatgatttcgcaacgaaagagtggaaaaaagtaaaatgatatccaccactaatcattaatagtgagaacagctacgcaatataccttataaaggggattgtgacagatacagaaacgcactatctttgcagtatcagaattgaattaattagtcataattttattacgtagccacatttaagtaaaaatgaaatagagtcccgccgaagcgatttcgtcgggattttgttttataccaatcccggccattagcaatcccggtatttatatacctttcagctcccctgcgtctataaacaaaaaacgagtcaattcctagaagggaaccactcgccgcagcatcagaaaagccaggaaggcttttcttttattacctcaattcctgaaaactaatcttctttttaccttttaaacttcttactattgttatcctttttaccttttaccaaaaatgtcctattgaatactaaaaaatttaaaaccttaattatttaaatctaataccttaataatcttttcttttaccttttaaactaatagcaatttctcaattgcactgcaaaggtacaaaaagattccgtgttcgcaaacggtttcagattttataacattctttgaaggttataaatctttcacatcattgagcgtaacaagcttatttacaatcgcataaatagtcagaccagccgcactgtgtatctgcagcttcttgctgatattccttcggtgagtaatgacagtatggatagacaagaaaagattctctgcaatctctttattcgtcatacctttcaccacacagaccactatctctttctcccgttggctaagcgtttcctgattgtcaagctcctcctcttccgaagctagatttagcagaccatgaatctttttagaaagaatatccagatcatcaaagatagaaatcgactcatcatatttagtcagcaaagaggcatctacaaaagaggtaaccaaagcaatcaaacgtattttcttaccggcagtttcttcccggaacttatttacatcaaagtagtcaccaaaagtaggatttacaatcagcatttccggatattgcgtacgcaggcaatcactcagagcctccactgaaagtaattctataggttgcaccttcacattaggaagacgcttcaatgcagcggtcagcccaccccggataatcactgaggtttcggcgatcgcaattcgaatggcttcgttatttttcattttccctaatcctcctttccagcttcagaatggcaggaacaaaaatatagtcttcaaccttgcagtgagattccaagccggcctcacaggcgtatatatcgaaaagagccgcattcaacagattctcattggctttggcaggacaatatttaatgatgatatttttcagttctgtcagcttctctcccacctggtcgtgatgtttggagaatgtgctaatctgataattccggggagcattgccatttatcagcgcatccacatacttgaataccgttttctcctcataatccatatgcttacgtacctctcgtgtatattcatcaaagaacttgagaatcagaaaggctacatcatcctgcgaacagtcaatcgcttcaatcagtttacgacgaatggcaggaagggaaaagtccaggaagtaaatatgggcttgccgcagataatcgattagtgctggtatagaaatatcctcactgcttccatccatccgtgagaaaccttcagacataaagttgactacaatcagaaaagtcctgcaatctactccattaagctcgcaaacttctttcactgttttgtcgccaaatcccaacgaaaggccgaaacggctcatcacttgtaacaaggaatagttatcactgatgagatcaatcatcttatcagttggtttgtatttttgcaaattatccatttacacctatttatattagagactgcaaagaaacggaatatttcgaggatatgcaatcaccacaaataggtattttcgctactcacagtttccccaatactaattacttgttactaatttataacaggaggctaggctggctattctttttttagtaattttgtcgctatcaatttgtaatcagtaattcataattaaataatatggcaaacgaactcgaactgaaatacggctgcaacccaaatcaaaagcctgcccgtatcttcatgaaagaaggcgaactacccattgaggtattaaacggacgtcccggttacatcaatctgctggatgcattcaacagttggcagttagttaaagaactaaaagaagctaccggacttccggctgccgcatcattcaaacacgtcagcccggcaggtgctgctgtggctgtagaaatgagtgacactctgaagaaaatctattttgtggatgatgtaaaactgtctccactggcaacagcctatgcacgcgcacgtggtgccgaccgtatgtcttcttacggagacttcatcgcattgtccgatacttgtgatgaagagactgcacgcattatcaaccgtgaagtatccgatggtgtgattgcaccggattacactcccgaagctctggaaatcctgaaaaataaaagaaaaggaacttacaatgtgatcaagatagatccggcttaccgcccggctcctattgaacacaaagatgttttcggagtgacttttgagcaaggcagaaacgaactgaaaatagacgaaagtcttttgaaggaaatgcccacacaaaacaaggaaattccagctgaagccaaacgtgacctaatcatttctttaatcaccttaaaatatacacaatccaattccgtatgttatgcaaaagacggacaagcgattggtatcggtgcaggacaacagtcacgcattcactgcacgcgccttgcaggaaataaagcagatatctggtatctccgccaacatccgaaagtgatgaatctgccttggattgaaaaaatccgccgtgcagatcgtgataatactatcgacgtttatatttcagaagatcatgatgacgtattggcagacggcgtttggcaacagttttttacagaaaagccggaagtcctgacccgcgaagagaaacgtgcatggctggatacaatgactggcgtagctttaggctctgacgcattcttccccttcggagacaatatcgaacgtgcacacaaaagcggtgtaagctatatcgcacaaccgggaggttctgtacgagatgatcatgttatcggtacatgcgacaagtacaatatggcaatggcattcacaggcattcgcttgttccatcattaatcgttttctgctatattttaagatttatatcaggtttgttggctttaacctatttatagatccgaaacgttatgctatccccatttataatgagaataaagcaattattccactataaatggggatttcctatttctccgagaccctctatctttgcaccatcacattaaaatagaatcaaagatgaataaaattggagtattttatggttccactaccggaacaacagaagaccttgcccgtcggattgcagagaaactagatgttccttccgcacatatttatgatgtatccaaactcactgaagctttggtcggtgaatatgatgtactggtactgggcagttccacatggggagccggtgaattgcaggatgactggtacgacggtattaaagttttaaagaaatgcgatctgtctcacaaatatgtagccttgttcggttgtggtgattccgattcttacagcgatacgttctgtgatgctatcggtattctttatgaagaactgaaagatacccgctgcaaattctgtggagcggtggacacagccggttatacattcgattcttctatcgctgtcgttaatggcaagttcgtaggtcttccactcgacgaagtcaatgaagacggtcagacagatgaacgtatcagcgcatgggttgaacaagtaaaacaagaaatcagctaatctttatctccatataaaataacagtttacatcatggctaccgaaagaatcattcccggagaaatccggattttcctcaaccacatttatgagttcaagaaaggcgtacgcaacatggtactctatacgatgagcagagagcacgaagagtttgccatccgccggctgaagaatcagaagatcagttatatgatacaagaagtaggtactaacaagattaatctgtttttcggcaaacccgaatgtatggaagccatgcggcatatcatcattcgccccttgaatcaactgtctgccgaagaggacttcatcttgggagccatgctgggatacgacctttgccaacaatgcaaacggtattgtaataaaaaagaaggtataaagatagccgtttaaagaataacttttgcattgttagctttgttttgtatgtagtttatcttgagtagaatcgtttcaaaaaaaacaggttttcataaaaacattttccactggaaacttgttctaataagaaacgattctctcaataacaaactaacaacaaacagtatgctgacacaacaacaagaaccatccaaagcctacgtacttgcgggcattttcactctctccttacgactgatcgtaggctggacttatttttcagctttttggcgcagactcgttctcgaaaacaaactcattccggatgccaccggatacattggagaaaagttcaatcatttccttcccaattccattggtatcaaaccgattattgaatacttggtcagcacaccggatttactttggtgggcaatggtaattttcacattagtagaaggcatcgtcgggttactctatatgctcggtttcttcacacgattaatgagtatcggcgtattcagtctggcattcggcattcttttaggctccggctggctgggcactacctgcctcgacgaatggcaaatcggcatcttgggagtgtcagccggattcactattttcctgtccggtggtggaaaatattctttggattatctgttattaccaaaactttccaagaacaaatggcttgtatggcttacttccggtgaacttccactatctatcaagcaattcagtaaagtcgcaataagcggtgcagtactgcttttcatactgaccttatatactaaccaagtcttccataacggtatttggggacctttgcacaacaaatcggtcaaaccggaactgaaaatatccaatgcaaagattcaagaggatatcctcacgttcaaagtataccggatagaaggagccgacgtgtacggttccttcctgatcggcataacactaaaagacgagaatggaaaaacaatacttcaaaagaatggagaagagctagcccgcttcccacttacccgaataaaaaatgactatgtagccaaagtagctccgggaaaacacagcctcatcattcctttaggaagtaaagcaactcttacaatcagaagtgatgtttttatggacttgcccaaaagtgactacgaactaattctgacagatataagtggtataacctggaaagagaaaattaccgtcaattaaatcaagtcagaaaaatctaataacaaaagacggactttgtggaaagaaatatatatcgtacaaactgtttttgctatttatggggagtagatactgacgctatttacaggatatagttacgctatttgcaggctgtagttacactatacgcacaatataccttatctaaccttactcttcacgctactaagccccgtgctgaagcactctgagagccggtccgggagtagaagaactactttcagagagcgagaaaccgctatttgaggcaattctacaatatacaacgatagggaattactttaaatcaaatcaaaaagaaaggatatcacagaaagtatcacactttttgctattacacatatcctttccaatatatgcaaaagggggagaatatcaattcgcacatcctgtggataaataccagcctagcatggtaaagataaaaacgagcccgctctttaccttttcctgatcaaacatatcatgcaacagatcattgttgactgtcaagggatgctttttcataggatagaggaaaaaactaacaaattcctttgtgggtgatcagacaaaactgtatttttagaggcataatattgatgaattattaaatagaaatgaattagattgctaacaaactgataaagcaccttaatagtcaattatctgccggacattagcggttaaaataaaaaacaaatgaacagaatatttgaaatagaagaattaaacgaacttgaagtttttttgaaatctcaaaatgatattgacaaattgcgagatagtttattcgctgaatttcttaaatatgcggattacaaaaatgtagaagagtggaataatgcagttcgggtttgcgagagtttggcaatcataggttggggatctaatgaggcccttgaggcattaagaggctctttctttaatggaaacccgatgacttgctttgtcaataaacacagagagcctcgtttcgtcgaagccatttggtcaagaagaataaacggatttaccatggaagcaggaaggacaagttatcatttcagcccggatgatccctttcagaggcaatccatagcatgggaatataaaacgaaagaagatgtacaaggtatagaacttagaagtcaacgaaattggattcctaaaaatcccatttggattgaacgtacaattggtaactgttatgagaactctaaggttgttattgaaagtattgagaatgatttacaatcaaaattaaacaaacaaatgcgacctgaattgtatggtcaggctgtcaataaaattattctaaagtgttcatttagttattacgaccatgtttgctgtaaatgcaattacgttatcgctgatgaaaaactgaaattgagacaaaaagaattataccccaaattactaacaatgtttaccaaacaagagattgaaaagaatggatattatcttcgaaatcgctttgagtttggaccattcagaacagatactggaaaagtaaaagcagtgataacccttgaaaaagaatttagtgaactgaatcattctgaacaaaaaaaaagattaagcgaatatatcctatcagcattaagtcatataacaaacaaactaaataagaaggttaagtatgactttgatttaatgttggctgattttaatgtaatattgaccgaatggagtaatgaacaactaccactaacgagcaaatgagttgtcttaacggtcggttagccaccggacattagttgcaataaaaaatgaagaaaaatgaaaggatatagaatagcaatgaagctgattaatcaaaccaagatttttaaatttatagttcccattatagtattcattctattgtatgctgtctcaacaattagaaacaacaatgtaagaaaggatggcatatattctatagtaactcttattaaatacggttctgcttatagaggacaaagcgcaaaatatgaatttatatataataagactttatataaaggaagtttttttatatcatttaacgagagtaaaaacactccaatcggaacccgttattttgtaacattcttagccaaagcccccaaccgacatcgaatattagacaccgtaccatcctggtttactctaaaagcgccagataaaggatggaaaacattacctacacaaaaacaactacgaataatgatgaaagatagcttgatttaaacgaaacatggcaatccggattctgtaaaagaattgaattaaatatgaaagataaaagtttggaaaaaaacacattctggatttattctacaaataagtttgtttgggcaggagttgcaatatgcagtatattcagtgcatttatgatctactttttatgtgtatccaatttaagtgagaataaagtcctttttattttcttgttgcccatatctttgtctatcctgttaatctattgggcattacccagtaagattttactttgtgaggatagaatagaagaacgaagcctgttcgggaaaagaagcatccgggtggatgagattaattcgtggggagttgtgcaaatgtataaaccctaccgttgtaaagagggtatttattcttacatacctgccaagtcattcaagccttcccgccaaatagaggagaacatgattttctcgtatagcctgtttttatccaatattccgcactatgacggtaaaaagaaagattccttccaaacagataaaactatttttgtcagttatcggaaagaagtgtatattgcattggaaaagcatctaaaaaaaataaaacgaacaatggagaacaaccaattcaaagattaattatctttgtcccaacaagaactaaacacattaacaacatgaaaaacaaatatctactaagtctgctcgccgctttaggcttttccggatgtggcaataataacgagatctgggacgaaccttgttattatggtcccggtcccgtctggactcctgacattataataagcagtcaagtacaaaatgaagaaaaagaaactattaatggcattcgcgtagtatccagttatatgaatcaagaagattcattaattacagatactgcctataccgagtcacgtgaaatagagcattatacggtaagcggtatagcaatcaatacatttaaattcaaagagtatcctcccaaagatacagaaatgtaccttgagtatacagatgtagacggcgaaaagaatggtgcataccaaacaaaaaagattagaatacaagaccttggaaaagagggaaaagtcactttacttaaagaggagaaaaaagaagaagaatgaaacgtatcatcccccttactccccgccgatggctggctttagaaatatttcgccggatgaaacacgaaagagtggaagaacatccgctcagacagcttttttgggaatgcaccttacgatgtaatgtacgttgccgccattgtggcagtgactgcaagtcctctcccgctactccggatatgcctctgcaggattttctaaaagtactggacagcatagcaacacataccaatccgcacgatgtattcgtcattatctccggtggagagccaaccgtacgtgaagatttggaaacttgcggcaaagaaatatcccgacggggatacccgtggggcatggtatgcaacggcctgtgtctcacacgcgaacggcttcacaacctgatccgcagcggtatgcgtagtatatccatcagccttgacggactgaaggatgtacacaactggatgcgacgacatcccgaaagtttcgattgtgccgtaaatgccatacgggaaatcacagctatccctgaactgacattcgacgtcattacctgtgtcacccgccgtagcctgccacagttgccggctatgaaagagttacttatcagtctcggagtcaaacgatggagagtatctaccatctttccggtaggacgagccgccgaagaaccggaattccgtatgaacggagaagaactgaaacaagtactcgacttcatccgtgacacccgaaaggaaggaattatccgtgcgagttacggctgcgaaggtttcctgggtaactatgaaggtgaagtacggaatactcctttcttctgtagtgccggaatatcagtcggctccgttttgattgacggttctatcagtgcctgtagcagcatccgctccaactaccatcaaggaaatatctatcaggatgatttttgggaaatatggcaaacgaaattccagccttatcgcgaccgttcatggatgaaaaaagacgagtgcgcccgatgcaaatacttccgttattgtcaaggcaatggtatgcatttgagagataatgaaggaaaactactggtatgtcatctgaacaggttgacaggaaactctgcaaatgttccggaataaaagattcagacccactatatattgctagtaacccgcccaagaatacccatttcaggtgattgcaggaaatcgtcaaagcccctatctttgcaatatcagaattgaattaattagtcataattaaaaattacgtagccacattgaaaacattggaatcggccgaagtgattctcccgcattctcacatttggttgttagtttaaaaaaaccatataatgtattcaatattacagaataagtgtaaatagcataaattctagtaaacaaaaggcccggcttgtgaaagccggaccttttcgttttatctctgatgagccgtttttatagtttccatcccgatgtctgttcctgtatattccaaagtttggcgtacagccccggccggctcaaaagttcatcatgagtgccttgttccgcaattcgtccttcttccagcacaataatccggtcggcatttcggatcgttttgaggcggtgagcgataacgattaccgtccgtcccgcaatcaaggtattgatagcctgctgcacttctacttcattctccggatcgagagaggcagtagcctcatccagcagcacgaccggagcttctttcagcatggcacgggcaatggagatccgttgtttttctcctcccgaaagagtgcagccaccttctcctaccatcgtatcgtatcctttgggcagacgcatgatgaattcgtgacaacaagcctttttcgctgccgctacgatctcttcatccgtagcatctgtcctgccgaaacggatattattcttcagcgtatcctgaaacagatagacatcctgaaaaaccatggaacaatgtttcattaatgactccggctccagttctttcatatccattccgttaaaacgaaccgagcctttacgcggatcatagaagcgtgcgcaaagtttcagcatcgtactctttccgcttccggaaggaccgaccaaagcagtgagcgtcccttttctaagagtcacggaaatatcatgcagtatttccttttcctgataaccgaaagatacatgatcaaaagtaatatctccgctttcgggcacatcacgatctcccttcatttccggttcgttcatcaacgtaaggatacgtcctcctgcgatggagaagtagcgaaactcggcaaagttagtcaaggcagatgtcagcggatcgaaaacacgggaaccgaccaccagaaacatgacaaacgtgagcagtgaaagttcgcctcctatcaacaggtacgtaccgcaaagtatcatgaatgtcaatccggcacgaatcaatgtgaccgagaataagataaatggaccgagaagcgcctcctgccggatacaggcacgacggagatcactaaaagccattttcaggcgttcgaacttgcctcccagcaaattatatgctttcatcacccgtatgccttgcagatattcttccaagcggtttccggcattaatcttggcttcaatctgtcgcacactcagcttacgctgggcgatattgctaagcaacaggacagcaaccgcaagcggtaaagctacgaacatggccaccgccatgcgccagtcaatccaaagcaagccaaggaaggcaaaaaccggcattaccaacgctcccatcaattggggcaagtgatgggatattcccgtttccgccatggtaaagtcagtgatcagcatggaagaaagatcccccggatctctgcgggacaggaatcccaaggataatttacgcagatgctcggctaaattaatacgcccttcggcactcatctcataagcaccgcgaaagttggcacgataggcggcgcgttcggcaaaagccatcaccaccatatacacgaccaatatagcaaaaatcatccaaagacgattcgtatccagcggtgtaccactaccgtcaaacgtacggaaaatcacatttatggcttcgatagaaagacagaacggaacgatattcaccagattggcaagcatcgtgtaaccgacaggtttacgcagacgttcggtatgtcctaccgtaatattcttgattgcattcattttgtttcctcctttttgatagttaattgccaacggaatgcgctggtataggcatcccacattcttttatatacaccgtccgttttgctcagcacttcgtgacgtccgctttgtacgagcttgccttctttcaggacaagtatctgttcggctgaaatgatggacgaaagtctgtgagcaataatgatgaccgttttatttttgataagttgctgaatggcttgctgcatcttatattcgttctccggatcggcaaaagcagtcgcctcgtcaagcaccagaatcggagcatttttaagaatggctcttgccacacaaacccgttgggactcaccgccggacaaatacactcctttgtcaccgatccgcgtatgatagccgtccggcagactctctataaaatcgtgacattgagccgcacgggcagcttcgatcacctgttcacgggtagcagacgtattaccgacccgaatattctcatagagcgtatcaaagaagagaaagctgtcctgaaaaacaaaggaaacgagattcatcaaatcctcggtcgctatctcttttatattaattccgccaatgcagatctccccttcactgacatcccaaaagcgcggaatcaggttggctaccgtagactttccggaacctgacggaccgaccagcgcagtaatcgctccctgtggcgcagtaaaagagatgtctttcagcgcttcggtacgggtagtctccgccttgttttcgtaggcaaacgatacgtgacgaaactcgatatcataggaagcgggcaaatgcgaaaccgcagtttcgggaagtacctgttcatcaaatatgcggtcgattcgtttcactccctcgtcaatctcgttcgtacttgaaccgagatacatcagtttatagataggagaaaccacgccgggccccataataataaagaagagataaactgccgccagaccaatattctgcgtctctctgctcagaagcaacagacctacgggcaaaatgaaggttatcagcgaattcagcaatacagtaaaagcaatcataccgggctggtaggtgtcgcagactcttaaagcataactcttataggcctctatctcactattaaactggcggaacgagcgcacactctgaccaaatatcttcaccacgggcattcctctcacatactggacagctgaagcactcatacgctcctgcgtatcataatagattttcgtaaactctttggcttttttcccaaagaagttcataaactgcaaaccgatactacaaacgatgcagaccacacaaatagccgccatccacccgttcagggagaagaagatgataaacatcagcacaatggttgccagcacattgaccagatcgggaatggtatgcgccacaaaattctctatcttctccacattctgttccatagtcttcttgatcgctccggtggaagtaccgttcaggtatcccagcgaaaggcgtccgatatgcccggacagacgaatgcgcaacccgtagagaatacggaacgccgccacatgcgatgccatcaatgctccatacagtaaaagcagtcctgccaccagaccgacaaatgccacccatccccagtgtataagcacactgctatccaactcgcttatcttgctgccatgcaacaaaagctctttcagcacttcatataccgaccaataaggcaccagcatacacaaggcactgatcgccgaaagtaccccggcaagcatcagtaagcctttcttctcacctgctatctcaaacaagcgactcacaccacttttctttctctgtttttctttcataccttttcatttatatatatctgatttttaaaaaagaacattcctctgaatcgttcaaaaaaagaaggagctcatacattcatgagctccttccaacctgccgtttcaaaggctatatattctgctataaatttctgcatttcttctttcttcacgtggtgcagcaccagttcttcgagcaaggcaaacagccataccgtattgagatgaataaagaaatcggtgatacctatattcaggtgcgggtacttctgcttcatcccctgaaaaaagacaaagatagtacgtgtcatcgcatcggtatactccgaacggaagttttccagggatgatccctgtgcctggaaaagtaacatacgcaaccgggcacggtgttcggaaaccaaatcgatatattcctgcacggattcctgctgatagtccgaattcgtaaaaacctctatggacatctgattggcatcatgactatatatcttggcatacaaatcattcagcacaggtttcagaatcgtgcggaatatctcatccttattggtgaaataatgatagatgttgctgactgtaatccctgttcgggaagcaatttcgcgcatggaagcatccttatatcctttttcggagaatacttcttcggctatgtggaggattttttcctgtatgtcttctttcaaatattgcatagtggcgttttattcactctgcaaagttgagaagaacttttgatttgggaaatacccatttatagggatatttcaacaagaattacctcatctatattaatacctaataaaaaatcttcaggagatctgtttattcatgtttcagccattctttaggaagcacttctttctcacccttttcattgactaattccatctgcaaaactccgccattgcaatcgaagtagcgtacttctatcgggtgcagtccggctttcaaggccttctgtactataatctctaccggtgagtgtgctccgtcattatctcccagtaattcgccgtccagtttcagcgtactgccgtcgtccgaaagaagagcaaatgtatagatgccatcggcaggtacttccaggtaacccgtgattatcaggccgatatctcctttcacctcttcggggatagaaacggattctacgacatactcaccattcacgggagccgcatcgatatccgcacaaagattaccacggaatttatgccatacggctttcagtccggaattcaaagaagccggagcagcagttgcctccgcataaggagctttgacgtatcgggtacgtgctacatccgatggagtaccgtcgggacggaaagtgcggaaagtaaaatctgtcgtttccgtcactttcagatttccttcataaagagtggattgcttagtcggcatacttccgtcagtagtataacggacttcaatgcccggcaacggacaagtcagatcaaccgaagcctcatcaaggaaagcattcactttgtagaatccttccagatcgggtacccggtagttcaatccaaggatatccatccgcttgaaatgcggaacaagctgacgatagaactctttcagatccggtttcgcctccggctgcacccaggctatttcactcaacgccaccatacggggaagtatcagatattcgatacgtttcatagacggaatccattctgcccagagattagcctgcacgccccagaaacattctttctgttcgggtgacaagcggtcgtctgcatacggatcgtatgccaatatcttcttcacggagtttttatcctgcgcataatcaaaatagaaatattcattcgggcaggcaatcactctttgtccttgcgaagtggccataggcactgcctctttcgaccaacttctccaccaggtaatagcagcatccgaagtcagtccgtcggcaacaacttcatcccagcctatcaacttctttccattggcaaggaagaatttctccatatcacgcacaaaccatgcctgcaaatcttctaccgatttaagtccttccgtgcggattcgcttctggcaacgggggcactttttccagttatttttctcgacttcgtcaccccccatgtgtacatattcataaggaaagagatcgaaaatctctttaaagacatcctgacagaattccagcgtcgtatcctttcccggacaaataggagaagagaatgtttctccccagccgatcagtccgtcacaagcgagatccgggtattgggtgatagcagccaggaaatgtcccggcatatctatttccggaatcacatcaatacctctctgtgcagcataatctacaatttctttaatatcttcgtgcgtatagtaaccaccatacagagtatctccttctacaatccgtattttgttttccggaatcaggaagtcggtattgtcctcttctaccgcacgctccatacaaccacggtcgtgcttgttaaatttacgccacgctcctttttccgtcagcaacggatatttctcgatttcgatccgccatccctgatcatccgtcagatgccagtggaacttattcagtttatataaggacatcagatccagcacatgtttcacttcatctttattccagaagtgacgggaagcatccagcataaaaccacgccattcaaagcgcggcgagtcctctatttgcacggcaggaatggagaaagtctgtttcgttccctgcacttctattccggcaggcagcagttggtggaggctggcaatggcggaaacgatacccgaataatctccggcttcaacctgaacagacttgggggtagcctgaagtttgtaagagccgggctttccattatcctgccctagctggagatagatatccgccttatcggcttcggtcacctctacagaagtagacaccacattccgaagaatatcctgcaaatatccggcagccggaaataaggactgatcggaaacgccgattttcattccatcctttaagacgaaagcacccgactgttccgtcagactaacgggggtaggtaaaattgcaatctcctgcttcaccgtaggcgtgcaagaggacaaaatacatgctgatgcaatcagtagagaagtacttagttgtttgaacataaggttaactgtttaataagttgattactttgacttttattgactatctatatataatacaactcaaacaggcaaactactaaaagggaaagaaaagtttttagtgatttactactaatgatgctccatcgcttccatcagactataaggatattcttccataaagattcggacaatctcaataatatttctctattccgccaaatccggttatcatcttattctctttcactttacagataaagttgtttaatcgcttttcaaattcttccggtcgcttccttgctgcttcaatgtatgcaattcggatacgcttatatgcgtcggaaaaatgccggtagtttctccatgctatttcatcttctttcaatctgtccattatgtcattgggaaaaataaaagggtcagataaaactgtgcgtattttatcttcaaattcagggtgtatcattttatttgccaataaccatttaagtctttctttgttggcttgcgagtatgtacttttaggttttctaggcgtgaaacgctgaattctatgttctttatcaagcggttttatcgtactgtcaatccattcgaaacaaagggcttcttcaacagcatcgttgtatgcaatacttttttcacctgacgatttaagaggaaatacaaaccaaatttcgtcttcggtttcaaagttgtccatcagccactttctccagtcttcccgattttcaaaatactttattttattttctgttgccataataggtcattcaaactaattattttactgcctttacattcgtaataatgaagcatttcgtccatcttctttttatcataatccgtaatacaatctgataagactttgaatcgcttacttacaatcgccaaaaatactaaaaatcggtcaggcagacatgattatcgttgaaatcatcaatgccaaatctgtcgcttatttataaaacatccgggaagcaatcgttttatcacattcccggatgcataaaatgttctgaaaataacagaccggtatcgtatcaataactaatcttcactccggcaaagaaacttctcggaagcgaaggaccgtagatatagttggaatcccggttagctcctctgtcgaagtctttctgatatgcttcaaagatattctgaacacctccgctaagttgtaagtctaccgttttatagagtttgaagtcatacgctatcttcactcccatatcgaagaaccggggtgtacggatggcttccgcctttcgctcgggcatatcgcccattgctacgttttctgcgctgatgtccatacgctgcacaagcatactgccggtatatgtacccgagagagcaatggacaacggtttgacgggagtataagtagccgtaaaataaccgtagatatcgggagtacggaagatttttctttctgccggcgcatcatcgtgccatttatgcggttcatcgtatcggctgcgctgcaatgtcagtcctgcctgtatttgaagcaaagaaagataagcaatctttccttccagagtcaatcccattactttggctcccggaccattgctgcgtattttcaccagcacaccgtcaccacggtcaaaaggccctcctaacacgaacacatcagtcagcctcgtataaaatccttctactaacagattagtctgaaaagcaccaaagcggtgatacatatctgcggatgcactgaagctctgcgatttttcctctttcaagtcctttgcacgctcgatcatcgccactgttccacctacattttcgatatgcatatcttcgtcaaatgcctgtggggcgcggaagccggaagaatagctcaaacgcagattgatattatccgtaggattgaaacgcaggttggcacgcgggctgaaaataacatcatccaccatattgtgcttatccagacgcccgccaatcaaaattccccaatgtttgtttttccattcgttctgtagaaaagcactgtaaaccttgaccgtctggtccgtatggcggtcgtatccccacatattatctttcagccggtcacggttatattcgagtcccgctgtcaggtcggaaggcatgaaaagacatttgtcgaatgtgtgcacatattgcacaccgcccatagcggtgaggtcggtcgtctttccgtatgctttcagaggatcgttgccgggaccataataactgtcacgatccgtattggctgccgaggcaaaaacacttaaacgattcttttcattcggtgagaaataatcgtatttcagacttccgccatctatggagtgttgtaactgctcggcaatatgggcttcgtgaggaggacgatccagcatatctccaccacggcggaattcctgcatatgatggtattcaaacgttagtttggagtaagtactcgttttcagataagaacggaaaccgaccgtctgattcttcagtttcggaagttccgtaaatccgtctccgtcataatcatatcccgaccgatgacggttctgcccgaagatatacaatccggcacgatgatcgtccgttacaagggaagcattcagcgaggtgttgttatcgaatgcggaactgccaccaatggaagtgatcgtatgcgataactgaccggaatttcgcagaggctccttcgtaatgatattgatcgttcccgcaatggccgaagagccgaacaatgccgatccacccccgcgcatgacttctacacgttcgatcatgctggcaggaatctgctccagcccgtataccccggaaagggcactgaacacgggacgggagtcgatgagtatctgtgtataggggccgtccagcccattgatccggacttgctgaaacccacaattctgacagttagtctctacacggacaccaggctgaaaattcaagccctgtgataatgtagaagaattagtggtttcaaacagtttcaaatctactacattgaccagagtcggtgccagacgtcgggtcgtttcactacggttggcagagacgactactccgtccagagcaatcgcatcttcttccagttcaaagttctcttccagcgttttaccttttttcaaggtcacactacgggtaaccgtcttataccctaccgagctgacttccatcataaagtttccttccggcagattcttcaggaagtagtgtccggtagcgtcggtgacggttcctatagtggttccctttaatgctatggtaatataaggcagatgctcacttgtctttttatccaatacatgaccaattatattcgcatcagattttttcaattccggatactccggatgttcagccaatgcaggcaacaaggcacaacataggctgaccaggactaaaagatattttttcattgtcgttagtcttttaatgttttaaatcaaaaataataaggatgggaagcaacagcagtttccaaagaagacctgcctgcttctacgtgatgcagactaaacgacaggaggcgctctgagagaaatggcgcccggacagggacgacaataccgcatacgctgcggagaggcgagaaaaatacataaaagagacaggacagaagtcacaaacaaaggtgtcaaaccattatctgtcaccaatgtatggtccaatatgtgaatcagctgaaactctactgtcgtatggctatgttcgccacctttcttaaagggatgtgaatgaacaatcgtaaccccgtttaccacatgggagtgagtaaacaaagtaatccctgccatgtacgaaataaacagtacaggcaaaaaccacttcattatattcaggtatatttgtttcattcgtcagtttttgtgcagcgaagataaggtttatcttctgcggcaaagatagggattgtccggttccgaaacaatccccatttataaggatttataagctaaaaagattattaaaccattattaatagctaattttcactccagcaaagaaacttctcggcagtgaagggccataaatatagcccgaatcacggtcggctcccttatcaaagtcattctgataagcattgaagatattctgtattccggcattcacctgcaagttcatcgacttatagagtttgaagtcgtatgccgccttcagagcgatatcgaagaagtcttccgtattgaccgtaatcggtttgtcgaggaatccgggaacaggttcgtgaggtatcagcatcgaacccgtataggtaccggaaagggcgatagacaacggtttgaccggagtataagtagctgtaaaatagccgtaagtattcggggtacgcatcatcttctttactgccggagcttctttgttccacacgtgcggttcgctgtaatggctctgctgcaaagtagccccagcctggatctggaatttattcagataagccatctttccttccagtgtcagtcccatcacacgtgctccgggagcattatagcgtgtacgtgtcagaattccgtcttttacttcgccatcagtcaatgcaaagacatccgacaatttagtatagaacccttccaccaaaaagttaatctggaatgcaccgaaacggtggtaaatatctgctgaagcacttaagctctgtgatctttcctctttcagatcctttgcaagctcaaccattgccacatttccacctacgttctccacatgcaaatcttcatcaaaagcctgcggtgcacggaaaccggaagaatagctcaaacgcaggttaatattttgggtaggattgaaacgcaggttagcacgcgggctgaatataatatgatcaatcaggttatgcttatccagacgaccgccaagcaagaatccccaatgatcgttcttccattcattttgcaggaaagcgctaccgatatttactttttgatctaccgtgcggtgatatccccacatattgtcttccagcttatcctggttgaattcgattccggcagtcaggtccgaaggcataaaaatacattttccgaagctgtagacatattgtgatcctgccatccagttcaggtcggtagtgtttccgtaagcattcagatcctgcccgccaccataatagctgtcacgattgatgtgttgtgcggatgcaaacacattaaaacggtgcttctcgtttggtgagaaatagtcatatttcaatccaccgccattgatggaatgttctgtctgttcggccacattcgcttcatgaggcggacggttcagtaagtctcctcccctgcggaattcttccatatgatgatattcgaaagtcagttttgaataagtagtcgttttcaggaaggaacggaaaccgattgtctggccatgtattttcggtatttcagaatatccgtctccatcatggtcgtatgccgaacggtggcggttctgaccaaagatatataaaccggcacgctgatcgtccgttacaagagaggcattcaaagcagtattattatcgaaagcgtctccatctccaataccggtaatggtatgagacaacattcctgaattgcgaatcggctctttagtaataatattgattgtaccggcaatggcagacgacccgaacaaagctgaaccgcctccacgcattacttccacacgctctatcatgctggcaggaatctgctcaatgccatatacacccgaaagtgcactgaaaatcggacgggaatcaagcaagatttgtgtataaggaccatccaaaccgttaatacgtacttgctggaaaccacaattctgacagttggattctacgcgtactcccggctgaaagctcaatccctgtgccagagtagtggagttggtcgtttcaaacattttcatatcgactacattcaccaaagtaggcgctaaacgacgggtggtctcgttacgattggcggaaacaactacgccgtccaaggcaaccgcatcttcttctatttcaaaatcttcttccagcgtacggcctttcttcagtgttacattgcgtcttacggttttataacctactgagctgacttcaagcacgaagttaccttcggggaggttcttcaaaaagtagtgtccggtagcatcggtcacagtaccgatcgttgtacctttcaatgccacagtaatataaggcaggtgttctttggtgtttttatcaaggatatgacctacgatgtttgcatccgatttacgtaaatccggatattcgggatgctcatggagagcagcttgtccttcgagggcaggcaacaatgcacagcacaagcagacaagcgaaaagatgtatttcttcatttttcgtttgttattcgttttcgttaagtgatgatgtgaacaaacagatgaggacttcccgctttaccataaagcaggataccatcggttcaaatgacggaaaaacgaatagcaggaggggctctgagtgccaccaccccatgatagggagaatagtagtgcgtatgctgcgtaataccatgcaaccgccacaagaggaatggaataaaaagagagagagcaaacacaacagccgcaccgtccgttgtcagatgtgacaggaaatgaactaataacagttcgactgttgagtgcttatgtgccgcccctttcttgaaaggatgcgaatggacgattgtcacgccattgaccacgtgtatgtgagcaaagaatgtgatacttaccaaatacgatacaaacagtaccggcaagaaacagcgcatgatattcaatgacaatcgtttcacctcatcttaaattttgaggcggcaaagatacaaactattattttaacaatcaatacctatatatactgattttcattaatacacagctgaagatatcacctgtataaataaaataaggaataccatagcaatcggataaacggtcgcgtatgccacgcttggaatattactgtctaccatcgaatcggcagcagccagtcccggagtactggtcatacctcccgtaatggttcccagtagatcaagtatgttgatcttgaataccaagcgtcctacaattaccgcaaccagcatcggtactactgtgatagctgcacccactccgaacatcagtaatccgctttcctgaaaagtagccacaaggttctttccggcagaggttccgacttcagcaaggaaaagcaacagacctaactgccgcaacagttgattggcggggccggacatagaccaaatgataggccctgtcttaccaacggcactcaaaaccaacgccaccatcaatactcctccggtcaatccaggtgaaaacgacagtgtatcggagaaagaaatattcaacttaccaaataagacccccagcacaatacccatcgcgatggggaagaaatcagtatcggaaagtttcttcgcattgtttcccagtaggcgggctactcctttgatgccttccttctctcctaccaccatcagtttatcaccaaacttcaaagccaaatccggtgacggagataagtcaataccgcttcgacgaacacgggtcaccgtacaaccgaagtttttctgtaaattcagatcacccagttgcttattgatcatatctttcttggtcaatagtaaggactcgatttcctgtgttttatccaaaggaagttcaccttcttcacgttcgccaattaatacagacagctgattcagtgattcctcactgcctactgcctgaatatagtctccttcgtgcaatactgtatgcgcggtggggatggatatttcatctttatgtttcagacgggaaataacagcacctgtcattgcccgtgcattgatctgcatcaagctacggttgaatacgcttgcattagtgacacggtagatacaagtgcccaactccggaaattgtccgcggcgctctatttcaaggcgacgggcttcctgatccaaatttacacgcatgattttgggaagcagcttcacaaacaaaatcactccgattacaccaaacggataagcgataccgtaagcaatggatgctaacggagagtgggtactatcaattgctaccgccaatcccggagtactggtcaaagctcctgcaatcaatccgactacactcggcgtatcaatatcgaacgcatacttcaaacctactgccgtgaggcaggcagaacagataataagcatagtaatgagaatcagcgtctttcctttactacgaaaagagtcgaagaatccgggaccggcctgaataccgatggtaaaaataaaaagtaccaaaccgaagtttcctaattctttaggaataataacaccaaagtgtccaaaaagaagagcaataaagatcaccgctgacacatcaagcgatagccccttaatcttaattcttcctaacataaatcccaacgctactatcagaaagagcgagaaataagaggaatgcaataagtcagtaaacatgttttttaaaggttagttagtttaagggcgcaaaggtacggatttatttcaatcctcacaacattctgtgctacaagtcacttcctcgccctctatctctaatgtagcatgatggatacctgctgcttcaagcgcctcctttatacgatgttttatttcctccatttttgctatatcatccactacaacgtgtgcagtcaaagccgtttccgtagtactgatggcccaaatatgcagatgatgacagctttctacccccggctgttccactatcagttgctgaatctgctgagtatcgattcccaccggaacaccatccagcgataatcgaagactgtcatgaagtaatccccaggtagaaacaataataatcacagcgatgcccagtccgataatcggatcgatgatgctccatcccgtatacatgataataataccggaagcaactactccgacagagaccagtgcgtcagctgccatatgcaggtaggctccttttacattcaggtctttatccttatccttcataaaaagccaggcagtaagtgcgttgaccaccactcccactccggcagtccaggcaatggcggaaccgtcaactgataccggatgaaacagcttgtctatgctttcagcgataattatcccgacagcaaccaataatatgactgcatttagtaaagaaacgaggatggtacttttcttatatccgtaggtataacgactattcgggtgtactttctccaaccggaaagccaacatagcaagaatcaggcttgccacatctcccaaattatgtccggcatcagagagcaatcccagagaatcgtaataaaaaccaactccgaactcgactataacgaaagagatattcagaacgatacctattataaaggctttattaagagacgttacccgatgattatgttcgtgatgatgaggttccatattctaaataggtttatatcatatatttaggaaacagttatctaagaaattagttcactcttttctcaaacatcaagaatgcaacaagagcggtgacagggctgtgctcaccaataaagttttcatcataacaaaacaataaaaccaaatagctggtccacatgatgagattcagttccatgaaagttacgatagaggcacgtgctccataaaaatcatcaatgcatgctctaaagacatagtaaacaatacaatcaggaaataagtaatccctgtcaatacacttttctattgtagccacctttcattctcttctcaatttcgtatttttaatatttaattagtaaatgactgcaaaaataaggacttatccttccctattcaatacctatatatgattaaacgcccattttttttcatttcttttaggtattgtccctgcttatatatccccctaactttgcaaacgaaaaataaattaatcattatctatcaaaattaagtatgaaaatattaaacttatggatggttgctctaatggcactatcattctcattcacttttgtatcttgcagtgacgataacgacgataccgacaatacagagcaagcaaaagccattgccggcacttacaaaggttattctattggcgaaagcagaatgttctctgattatctgatgggcgacgatgccagcgcaacaattaccgccaatacagatggtaccgtcaatctggtttataaatcaggatccggagattttatcctgaataacctgacagtttcttccaaatcatttaaaggcgaaggtgaagttgccctagctatggaaggaagtgaacctgccaactacgaatatacactggaaggtagtgtcagcgatgctaaagtactaaccctgaaagccaatgttcctgtgccaatgggtggcatcgatatcaatttcattcaggcagaaactccgattgcttattacgtagccgctacttataagtataatactaatcttgctatcagcgttatgggaagttcatatggttctaccgaagattgtaaagcagtcattaaacgtgcatccgaaacgacagtagatatcaccctaaacggttttggcaatttgaccggaggcggtaatatgaatttgggagacttcacgattagcggagtaaacgttgaaaaagcagatgacggctacacactcagtttaggcgcatttgaatctgcagccgaatccgcaagcggtactactccaattacaggtgaaagtctggaaggtacagttacagcaaatggtaaagctaatattacggtagccttcaaaccaggagccatgcctatggcaatcaccgcagtattcaccggaaacgtcaaaaaaactagtgcacaataaataactaatagaaaaaatgagaagaagcagtaacgctattttcaaaaatataatgatactgggagcggctatgtcgctctcagcttgtaatggaatgtttgaagggatttatgacgatcccattgaagcggaaatggagattaaagaaagtagcttttcacaaatcaatgctaccgagtacactaactgggtctatatcgacctatccgaacgtaaagcaacgactgttgaaatcggagaggaacataagagcgagataccagcaaaatgggaccttgccatccaccgctacgacatcaaaaccaatgaaggtgcagcctttcagacaacttatacaagtattgatgacctgaaggccagtggaaaacttcccgccgaagaaaattttgtaaaagacgaatggacgacagataaaatagcaatcgatatgtccggtatgatggaaggaaacattaaatatacagaagactatcgtaatgatattttatccggctggttaaacgtagacacttcaagtatgcctcctatttacaccatgtccaatcaagtctatctgatacagttgaaggataatacctatgcggccattcgttttaccaactataccaatgccagaggcataaaaggctatatcgacttcgatttcctatatccacttgatttcgaagaaaacaactaagaaaccaattacaaagaatgaaacctacatttatagcatcaatcttgatattctcctttatagtaacctgttccacattcgcacaacaatcaaccgagcacatcagcggacgtgttactgataccaatggtgaacccctaccaggtgcgaccatttccataaaaggagaagaaacaggagccgtcaccagtgttgacggaacctatacattacaactgccgggaatcggttcatatatcattactgcatcttacataggttatcaaaccgaacaaaaaagaataaccaccgagaaaggaaagaaagttaacttcagcttatccgaagatcagttcgacctcggaacagtcgttgtaaccggtacccgtactcccaaattgctgaaggacgctcccatcatcacccgggttatcacctcagacgatattaagaaagttaatgccaacaacgttgccgacctgctgaaaacagagttgcccggtatcgaattttccttctctatggatcagcaaaccgctattaatatgcaaggcttcggcggtaattccgtactgtttctggtagatggcgaacggctggcaggggaaacactgaataatgtagactacgaacgtctgaatctcgacaatgtagaacgcatagagatagtgaaaggtgctgcatctaccctttacggttccagtgctatcggaggagtaattaacatcatcacccgcgaatcggacgatccatggaacttaaatcttaattcacgtttctccgaacacaacgaccagcggtgtggtggcactgcaggatttaatgcaggtaaattcaacagcctgaccaacgtgcagtataataatgtagacacttatgccgtagacaatccgggagatttctctacagtgttcggaagccgggtgtggaacttcaaagaacgtttaatataccgtccgctggaaacgctcaaactgacgggaagagtcggctattatttccgtgaacgcaataaaccgggggatacccaggacagataccgtggattcagcggtggaatgaaagctaactacaccttcaatataatgagtaaccttgaagtcggttatactttcgaccagtatgataagagtgattatcagtctctttataaaaatgacgtgcgtgattacagtaatgtacagcacaatgtgcatgcactctataattataccttcaacggaaagcatacgctgactgtcggcgccgactacctgcgcgattatctgatgtcttaccaattcactgataacgcagaccacaccatgcatacggcagatgcgttcggtcagttcgactggaaccccacagaaagactgaatgtgatagccggattacggttcgactacttctccgactccaatgtacgccatctgtctccacatttgggaatgatgtataagataggcaattgttcattaagaggatcgtattcgcaaggattccgctctcctaccctgaaggagatgtatatggtgttcaatatggcaaatatgatgatgatttatggtaatccggaccttaagtcggaaacaagccataatttctctgtatctgccgaatataccaagagtcgttataacttctctattacaggatattataacctggtacacaatcgtatcaataccgtttacagcgaagaccccaaaggacaaatctataccaataccgacaaaatggatattgcaggaattgacgccaacgtttccgccaagtatccttgcggactcggctatcgtctgtcatacacatatattcatgagttcatgcgcgacggtcaaaagaaattcacggatacacgtccccatacggcaactgtaagaatcgactggggcaagactctgaacaaaatagatttcaactactcactcaacggacgtttgctgtcaaaagttaaaacaaacatctacaacgatagtttcaacaacccgtctgccggaagccaggcagtcgaatacccgggatatatgatatgggatcttactttctcgttgggaattataaaagggatcaatatgaatctggctgtaaacaacctgttcgactatgtgccggattattattatttcaactctcctaccacgacgggaaccaacctgacattaggactatcactggatatagacaggctcttcaaaaaataaacggcaacaatagaactacatacaaagctaaaaataagagaaatgaaaaagaaaagtaaaatcattttaggtggatgcatcgttgtagcagccctgataggtctatccgtatggaatacctggttcagcgctaccaaaatagctttcgtcaacttccagaccatacagcagggaagcatctcgaaagccaacgacaattcattcatcaaactcagcgaagtgtctcttgacaacctcgatcgtctgaccagttatgacatggtattcatcaatggcatgggactgcgcattgtcgaagaacaacgtcagcaaatacagcaggcagcagataagggtatccccgtatacacctctatggctaccaaccctgccaataacatctgcaacctcgacagtatacagcagaatctcatacgcggctatctgagcaacggcggaaagaccaactaccgcaatatgctgaactatatccgtaaagccattgacggaaaggcttctgctgtacccgaagtggaagatccgatagaaagaccgagcgatatgctttatcatgccggaatcagtaatccggatgatgaacaggaatttcttaccgttgccgattatgagaaattcatgcaagagaataacctttataaagaaggggcacgaaaaatcatgattaccggacaaatggcagatgccaccgatctgataaaagcgctggagaatgcgggatataatgtttatcccgttcaatccatgacaagattcatgtcattcattgaggaagtgcagcccgatgccgtcatcaatatggcacacggacgtatgggagataaaatggttgattatctgaaagccagaaatatccttttgttcgctccgctcacaatcaacagtcttgtggatgaatgggaaaacgatccgatgggtatgtcgggaggctttatgtcacagagcatcgtaacaccggaaatagacggagctatccgccctttcgcccttttcgcacaatatgaagataaagaaggattgcgccattcgtatgccgtccccgaacgtctgaagacttttgtatctacaatagacaactacctgaatctgaaaacaaaacctaattttgagaagaaagtagctatctattattacaaaggtcccggtcagaacgcattgaccgctgccggcatggaagtagtaccttccctttacaatcttctgcttcgtatgaaacaagagggatataatatatccggtctgcctgccaacgctcaggaactgggaaaaatgatacaagcccagggggcggtattcaacgcttatgcagaaggagctttcaacgacttcatgcaaaacggacatcccgaactgatcaccaaagaacagtatgaaagctgggtgaaagaatcgcttcgtcccgaaaagtatcaggaggtggtagatgctttcggagaatttcccggcaactatatggtgactcctgacggcaaattaggtattgcccgtttacagttcggtaacgttgtgctattgccacaaaacgctgccggaagcggtgacaactccttccaggtggtgcacggcaccgacatggctccgccacacacctacattgcctcatacctgtggatgcaacatggcttcaaagccgatgcactgattcacttcggtacacacggcagtctcgaattcactccgagaaaacaagtcgcattatgcagcaatgactggccggaccgtttggtaggagccgttccccactactacctctactctatcggaaacgtcggagaaggtatgatggccaaacgccgttcttatgctaccttgcaatcatatctcactcctcctttccttgaaagcagcgtacgcggcatttaccgggaattaatggaaaagatcaaaatctataataactcccagaaggcaaacaaagatcaggagtcgctggctgtgaaaaccttgactgtgaagatgggaatccatcgtgatttaggactggacagtatggctaataaaccgtatacggaagatgaaatcgcccgtgtagaaaactttgccgaagaactggctacagagaaaatcacggggcagctttacacaatgggagttccttacgaaccggaaagaataacttcttctgtctacgcgatggcaacagaaccgattgcctatagtctttttgctcttgacaagcaacgcggcaaagctacagaatctgccgaaaaacaccgaagtgtctttacccagcaatatctcatgcctgcccgccttctcgtagagagactgatggctaacccttcactggcaaccgacgaactgatttgccacacagccggaatcactccgcaagagttggcaaaagcgagacagatagaagccgagcgcaatgcccccaaaggcatgatggcaatgatgatggctgccgcagccaaaaaggatcaggctgataatgagccgtcgggcaatggtcatccggcttcggcaaaaatggaaaaaggacctcatggtaaaatgcctgcaggcatgaaagaagccatgaagaaaatgggtgctaacatggacccggaaaaagcgatggaaatggccaaatcaatgggtgccagtccggaagctttaaagaaaatggaagccagcatgaaggctaataaggatacatccacagacgcttcgggcaaaccggcaatggcaggaaagactgaaaagccgcagggtatgtcagcaatgatggcagctatgggaaaggctccgaaagaatacagcaaagaagaggtggaatttgcgcttgcagtagctgaagtagaacgtaccatcaagaatgtaggcaattataaaaatgcacttctgacaagtccggaagaggaactgagcagtctgatgaatgccttgaaaggcggatacacagctcccacacccggtggtgacccgatcgctaatccgaacacgctacctaccggacgtaatatgtatgccattaatgccgaagcgactccgacagagtctgcctgggaaaaaggtattgctttggccaagcagacaattgataggtacaagcaacgtcacaacgactccataccacgcaaggtcagttatacactatggtcatccgagtttattgaaaccggaggggcaaccatcgcacaggtactttatatgttaggtgttgagcctgtccgtgatgctttcggtcgtgtcagcgatttaaaactgattccttcaaccgaattaggacgtccgcgcatcgacgtggtagtccagacttccggacaacttcgtgatcttgccgcctcccgtctcttcctcatcaaccgtgcagtagaaatggctgccgccgccaaagacgacaaatatgaaaatcaggttgcctccagcgtaatagaagccgaacgggtgctgaccgaaaaaggattaagcccgaaagatgcccgcgaaatttcaacattccgggtattcggaggagccaacggtatgtatggaaccggtattcaggaaatggtagaatccggcgaccgctgggagaatgaatcggaaatcgccgatacttatctcaataatatgggcgcgtattacggcagcgaaaagaattgggaagtattccaaaagttcgctttcgaggctgcactgacccggacggatgttgtcgtacaaccacggcaaagtaatacctggggagctttaagccttgaccatgtatacgaatttatgggaggtatgaatctcgccgtacgcaatgtgaccggcaaagatccggatgcctacctcagtgattatcgcaaccggaaccatatgaagatgcaggaactgaaagaggctgtcggcgtagaaagtcgcaccactatcctgaacccaacttacatcaaagagaaaatgaaaggcggggcttcttcggcaagtgaatttgcagaagtgatcaccaatacctatggatggaatgtgatgaaaccggctgcaatcgacaaagagctttgggataatatatataatgtatatgtgaaggatgaactgaacttgggagtcaaacaatatttcgaacaacagaatcctgccgctttggaagagatgactgccgtcatgctcgaaagcgcccgtaagggattgtggcaagcaagtgaagaacaggtagcggaacttagcaaacttcatacggagattgtcaatacttaccgcccgtcttgttccggatttgtttgtgacaatgccaagctccgtgacttcattgcatcgaaagcagacgcacaaaccgctacacagtacaaagaaaatatctctaaaatccgtgaagcaaaagcaagcggcagcaacaagggagtggtgatgaaaaaagaagagatgaatcagacagccgaaaatcagacaaatacattaagcaatgtagccgtaggcatcgctgtcattatcgttattcttgctctgatactctttgtacgcaagcgccgcaaaagcagtcagatgtaacccacgtcctgtgaattatcaatcgtaacttgtaaattgtaaaatcatataatggatacagttgttcttgtacttatgcttcttacagcatttaactttctgttgaagcaaacgttctggaaattaatagcggtcggtattatcaccgctatctgcgctgtcttcgccggattgatgtggccgtatgctatcgagcaatcgaagactcagatagccaattggctaagcaatcagcccttgatgctagatacttccgtactcctcagtgtggaagtctgcatacaaatggcttatgccatgcttgccgtccacgtagccaatgactatccggtcaagccgcgcatgatactcatgtaccgttttctccgctggtttccgggattattgattttcccggttttattcagcgggctggtatatctcatctttgcttttccgggtacttcatttcaaacgatagcatggagctatgcagcctttatcctggcagccatcccttgcggcagatttatactgctctatttgttgccggaaaaagaactgcgcctcgaactatttttcctaaccaatgccctggtagccgttttgggaattgttgccacagtcaacggaaagacttccgcagcaggtgtcagtgaaatagactggaaagcattgacaggcgtcatagtcatcgcactggctggcggaattctcggacttctctggtggaacatccgaaacagaaacaaagaaaaaagtgtgaaacaataatagaataaataactcttcaaattatcaataacaatgaactttatatcagatattttatactggatttcaacaggcttgctcgttcctgtcatcgttttattaatcatcctcttttgccgcgcgattttacttgccggtagtttctatggtcaatatctgtccattcgtaaaacggaaaccctgctccgcaacgagctgagcaagctgactccggacacagtagaagaactgagttccaaacttccggaaaattctagatcacttgtcattacctatatgcgtcaggtattggacgcccgtgatactccggcacaggtacaacgtttattggctaattttgaaatcgcagcggacaaagacttagccatctccaagaccctgaccaaactgggaccgatcttaggtctgatgggaacattaattccaatgggacccgccctcgcaggactggccagcggagatattgcttccatggcttacaatatgcagatcgctttcgccaccactgtagtcggactggtagccggtgccgtaggcttccttacacagcaagtgaaacaacgctggtacctgcaggatatgaccaaccttgaattcatatccgaattgctcaatgacaaacgttccatccataaaacctcagagaaatgaaacataacctattgcgaaaagaggaagactccgacccgatcagcgtagtatccaatctgttcgacattgcgatggtttttgccgttgcattgatggtagcacttgtcagccggtataacatgacagaggttttctcgcaggaagactatacgatggtaaagaatccgggtaaagagaatatggaaatcattaccaaggaaggcaataaaatcaaccggtataccccgtccgaagatcaggacaagaaagaaggtaaacgtgggaaaaaggtaggcattgcctatgaactggataacggtgaaatcatttatgtacctgaataactaattaaggcatctttgtcgtccgaacaattaacatcgtgaagaatctcctctttgtatgtacagaagaagagattcttctttagcacaacacacatacaacttttatcattggtatggcgttgcacaacagcgataaccccgattgcatgtgccttgtctgcctgtataattgatctacatcaaatcatttgaaaagaatatgcttctcatgctccatcgtttacttttttagttacctttgcgccgattttaagaatccctttgaactaaaccataagtactgtgttgaaaccataacaggaatttacgtataacttaaaagggtaagaaagatgtctacagaaatattagtggatactgtaaccacaactacagatagctgccagatggtagcaacagaaacaacactgcaagtaacagcagccaccaagtctgacaatcagactacagccaacgaggcttataccgctgtacctccacgccgcactttcaatgaacagaaaccgtttgtattttcaatcgtaggctttgccgtggtgtacattgcagcgctcgttatcggacggattatcaaaatgcgaatgccacatcattcttaaaagaagcgcttacgaccaacaaaaaaaacaagtcaccaaaatgatcactcattccgatgacttatcccctttaaacacctttaaacaaaatggaaaatatgcctcattactaactaaactaactaaccctttgaggcatattttgaagaggctgacgcatcagcctcttttttatttatagatagctttcgctctctaatcttattttttgcgagcctcggcaatatagctaagagcttcttcgcattttgcagttacataagcccagtcttctgctgctaccttgtctttcgggaacagttttgatcccataccgacacagaatacacctgctttaatccatgcagtcaggttttccttggaaggctctaccccaccagtcaccatcagcttagaccatggcatcggagccatcaaacctttcacaaagttagttccatatacatcacccggaaacactttgcaaagatcacaacctacttcctgcgcaaaacctacttcagatacagaaccacaacccggagtataagctaccagacgacggttacatatcttagcgatttccggattaaataacggacctaccacaaagttagctcctaactgaagatacatagcagcagtagccggatcaacgattgaaccgataccgatagccatttcaggacattcttttgctgcatatttcacgatttcagcaaatacttcctgtgcaaagtcaccacggttggtgaattcgaaagcacgaacaccaccgtcataacaagcctttactactttctttgccacttccgcatctttgtgatagaatacaggaaccatacctgtagagccgattttattcaatacggctattttatcgaattttgccattttaatttcttattttaaatgaattgatttttcaaactctcaactctccattctcaactctcaactatcgctgtacgcgaccgcttgcgtcaccaccagccaatgcttccacttcttctacagaaacaaggttaaagtcaccattgattgtgtgtttcaaagcagatgcagcaacagcgaattcaagagctgcaccctggttaggcttagtcatcaaaccgtggataataccgccggagaaagagtcaccaccacctacacggtcgataatcggatcgatatcataacgtttggaagtatagaattcttcgccattgtatatcatagctttccaaccattgtgagtagcagagaaagattcgcgcaatgtagaaaccacatacttgaatccgaattctttcatcatctgctggaagatacctttatagccttcagcatctgtgtggcctgcttcaacgtcagcatccggtttgaagcccagacacagttccgcatcctcttcgttaccgatacatacatccacatacttcatcaacggtttcatgatagactgtgctttttcctttgtccacagtttcttacggaaattcaagtcaaccgatacagttacgccatgacgcttagctgcttcgcaagccagacgagtcagttcggcagctttgtcagaaatagccggagtgataccggaccagtggaaccagtcagcaccttccataatagcatcaaaatcgaagtcggcagcatcagcttcagcgatagcagaatgagcacggtcatagataaccttgctgggacgcatagaagcgcctgtttccagatagtagatacctacgcggtcgccaccacgagcaataaagtctgtctttacaccatatttacgcaatgcgtttacagcagactgtccgatttcatgtttcggcaatttggttacgaaataggcttcatgtccgtagttggcacagcttactgcaacgttcgcttctccaccaccatatactacatcaaaagagtcagactgaacaaagcgggtattacctggagttgacaatctaagcatgatttcgcctaatgtaacgactttctttcccataatcttatgttttaaattctaagttattaatattatgaagtttcaatttatcatttttaccccattttatgagttaaactactgattacatgactattaatacataaacagagttataccacacacctttcgtgtgcgggcacaaagatacaacaattt

SEQ ID NO: 65 - DNA, 42183 bp, Bacteroides thetaiotaomicron
catttatagaagaatatcatgaaatactggatgttattgtttgcccttttgtgggtatcttacggaacgggcatggcccggaaaacggaaaaagtagtaaataacggaattccctggtttgacgacaggggagagatagtcaatgcccacggtgcctgcattgtggaagagaatggcagatattatcttttcggggaatataagtcggacaagagcaatgcttttccgggtttcagttgttattcatctgatgatttggtgaactggaagttcgaacgtgttgtactgccgatgcagtcaagcggaattcttggccctgatcgtgtaggcgagcgtgtgaaagtcatgaaatgcccttctaccggcgagtatgtgatgtatatgcatgcagacgatatgaactataaagatccccatatcggttatgctacctgtagcactatagcaggtgaatataaacttcacggacctctgttgtatgaaggtaagcctattcgccgctgggatatggggacttatcaggacacggacggtaccggatatctgctgttgcacggaggaattgtctatcgtttgagtaaggactaccgtacggcagaggaaaaagtggtatcgggagtaggtggttctcacggagagtctccggcaatgtttaaaaaggacggcacgtatttcttcttgttctccaatctgaccagttgggagaagaatgataatttctactttacagccccttccgtcaaagggccgtggaccagacaaggtttgtttgctcccgaaggaagcctgacctataattcacagaccacttttgtgtttcctttaaagtgtggtgaagatacgattcctatgtttatgggcgatcgctggtcttatccgcatcaggcttcggctgccacctatgtgtggatgcctatgcaggtggatggaacaaagctttctattccggaatactggccttcctgggacgttgataagttgaaacccgtaaatcctctgcgcaaaggaaaaaccgtcgatttaaagaagataacgttcagtaaagaagctgactggaaagtggaggaaggaagaatatcttccaatgtaaaaggaagtacgctgagcattcctttcactggctcttgtgtggctgttatgggcgaaacgaactgtcatagcggatatgcgcgtatgaatatccttgataagaaaggggagaaaatatattcttcactggtcgatttctatagtaaggcgaatgatcatgcaacgcgttttaagactccccaattggctgaaggggaatatacgctggtgattgaagttacgggcatcagccccacatggactgataaaacgaagagaatctatggcagcgacgattgctttgtgaccattactgatattgtaaaactgtaatatttatgagaaatagaattttattttctttccttgcttgggtagcagtgatcgtgtccgttcagggtaaacaaaaagattttgttttgcagtccggtcagccggttgcgatagcttgcagcggttcggaagcaccggtggtgcgtacttcgctggacttgttgtcccgtgaccttcagactgtattgtcggcaactgcccatatagacacaaacaccggaaacatcatagtaggaacgatcggacagagcaagctgattgagcaggcaggcatcgatatttccgcattaaaaaacaaaaagcaggctttcatgctcgccgtctcagaagatggaaagctagtagtagccggcagcgacagtcacggtacagcctacggcatacttgaaatatcccgtctgctgggcgtttccccttgggaatggtgggcagatgtgactccggagaagaaagagacatttcgtctttcgggcaagtttagagagttgcagtctccttctgtggagtatcggggcatctttattaatgatgaagattggggactgatgccttggagtaacaagacctacgaaccgtcggatgtgaaaggagaaatcgggccgcgtaccaacgaacgtatttttgagttgctgcttcgtttgcgggccaatacctactggcctgccatgcacgagtgtacccttcctttctttctgacgaagggcaatcgggaagcagcgaaaaagtatggcatctttatgggagcttcccactgcgaaccgatggcgtgcaatgctgccggagaatggaaaatacgtggaaaaggagcatacgattacgtgaataacagtccggccgtttatcagttttgggaagatcgtgtgaaagaagttgccggacaagagatactttacacgctgggtatgcgtggcgttcacgatggaaagatgcagggagccaagacggtagaagagcagaaagccgtcctggaccgggtatttgttgaccagcgcggcttgctcgaaaagtacgtgaataaagacgtaacacaagtgccgcaggtctttattccttataaggaagtgctcgatatttatcatgcggggctgcaagtacccgaagacgtgaccttgatgtggtgtgatgataactacggctatatccgccatttccccactgccgaagagcgtgcccgtaaaggcggcaacggagtctattatcatgtttcctactggggacgcccgcacgatcatttatggttgagcaccatgagtccatcactcatttatcaacagatgaagcaggcttacgatcagggaatacagaaaatgtggatactgaacgtcggcgacatcaagcctgccgagtatcagatagaactgttcatggatatggcatggaatctggataaggtatcttccgaaggagtgaccgcacatctgaaacattggctggaacgggaactgggaacctcttgtgcaaagaccatcctctccgttatgcaggaacattatcgcttggcacatatccgcaaacccgaatttatgggaaatacacgggaggaagaaaagaatccggtctatcgggtagtcaaagacttaccgtggagcgaaagagagataaacgaacgtctgaatgcttacagcgaactttcggaaacagtagagaaagctgcttctaaagtacctgccggtaggcagagtgcttacttcgaactggtgaaatatcccgtacaggctgcgacacaaatgaatcgcaaactgttatacgcccaattggcacgccacgataaggaagactgggaaaagagtgatgccgcttacgacagcattgctgcactgactcaacactataactcattggagaatggaaaatggaatcgcatgatggacttcaaaccccgcaagctccctgtattcaaccgtgtggaaagaaaggcggctactgctccgatgacagcggaccgtaaagcagtctgtcaatggaacgcggcggaggcaaagaagggaaacgctattgtctgcgaaggtttgggatatgaaagcaaagccgcagagataaaaaaaggcgatgcgctgactttctcctttggcaatctgaaaacggactcggtagaggtggatatccggttacttcccaaccatccggtgcatggcgataagttgcgtttcacggtttctctggatggtgccgagcctgaagtgatagcttacgaaacgaagggacgcagcgaggaatggaaagagaacgtgcttcgtaatcaggcaatccggaaaatcgtacttcccgttacgggtaagaaatcacatcaactggtcatcaaggcattggatgagggagtgatactggatcaggtaatgctttatgaggtgaatcgtaacagttcaggtatttgaagtttctgtcattcggaaagatatctaagggaacgcagtgaaggatctcttctctcttgtacagtaagaggagattcttcctctctttgcttaccccttggacattacaagcatttgccgttggcaggagcatttcagcaaagaattttttcttttaactcacattacagctcaagtgtccccaatatctgttggaagcagtcagctttatacgattaattgattgattctcctgtattcgtaaggagtctgattatatacagaacggaatatcttatagaaatgccccagattcctaaatccacaatttgtacatatctccttgatcggcatactggtaatagatagctgagtagtggcatattgcattttaaactcatttattaaatcagtcagagatttatgaaagtgcagtttcacgatcctattcacataatcgatattacggtcacataaagtgacgaaccccgcaattccctgaataaaaaattccggactattgaatttttgaatagcattgaatagccaaaccggtatctctgaagaatcttccaccttttcattagctgtaatctgccggaaaatgaaaagcaacagactatcgagctgtatattggatcgcccgtatttcattgcttcttccgcccgcgaagatagtcttttcacaatatcccttgataatctcatctgaaatgggaacataccggtagtccaaaagtacaagttactccattcaaaatatcgctgacggaaataatctaaagtctccacgggaaaagccacattcacaataacgatcccttttcccgaagaggaaaacgtatgcctgtctttgggacgtaccataattaaatctcccggagatagtctaaactgatgtccattgacatggtgaatgcctgttcccttttcaacccataagatttcagcatagtcatgtgaatgtaaggacaagtcctgagaagaggttatattcactcttgcaatatgaaacttttcatttgcactcagaaaataggatagcttaaaaacggaatctctcatattcttttttgatttgattgcaatattaagagttagccttcacaaacacaacccgtgaagactcttttttatatgtcaaagcataaaaagtcggaatagcgtaaaaaaactaccgctatgaataatttctatcggaaaaacgtatatggacaacctctacctttgtccccatcagctaatactaaaagaatcatatcatgaaaggctttataactaacatccaacgaatgtctatccatgacggtccgggaattcgttctaccatcttcttaaaaggatgcaatctgagatgtaagtggtgtcataaccctgaaacctggagcatgaaaccgcaactccagtatattgaagacaaatgtatccattgtttctcttgtataacggtatgtgagtatgaagttctgttcatcgactcaaacagattatccattcatcgcgaacggtgtactgattgtgggaaatgcacagagcgctgcacttcgggcgcactgtcctggattgggaaagaagttgattcttcggacatcatacatgaaattctccaggaccttatttactatcagaaatccggaggaggaattaccctctcagggggtgaacctttgcagcaaaaagattttgcgttagatattctccaaaaatgccgggaacatagaatacacacagctgtagaaaccaatctgttgactgatgttaacacgttggaggcattccttccttgggttgatttatggatgtgcgattttaaaatggccgatgacacattacaccggaaatggaccggacactccaatgttcctattataaagaacctggaatttctagccaaacaagctgttcctttgaccattcgtacaccggtcattcccaacgtcaatgattccgaagaagctatcgagtcaatatgccgcttcattcggcaattacctaatcagcctgcttatgaattgctgggatttcattcattgggattcgttaagttcgagaatttaggaatgaagaatcccttaagcaattctgcttttttaaagaaaggacaattacaaaaactaaaggaaatactgatcagatataatttaaacaataacaaaaaatgaagaattacgagcaaaaaatagcgaatctgcgtatgcggaaactcgctcaaactcaggaaaagattgaaaaggaaggacttctggacgaagatgactatggacgggtggttcctccggaaaatttgtggaatatcatacctaaccatcccgatggttctttctacggatttgatgcatgggctgataacttttgcagcctgatgaatattcatccggtatatattgatgccgatgatgcttttgcaggaagatggatgtatttcatgtctaaaatgcgacccaataaatggaatccggattattcttatgactttctaaaagagaatatcaagaagtatgacctcatttgtggtattggcgatgacgctcatttcgctcctgattatgaaatcggggtaaaattaggatggaatggcttgataaagaagatagaacattaccaatccatgcatcattcagaagagcaacaacacttctacagcttgcatctaagggtcatacgtagtgtgcaggggtggatacagcgtcatatcgaccaggcatatagaatggctgcatctgcaacagacgattgttctaaaaacaacttactggaaatagccaaagtaaacgagagcattatcaatgatgccccaacgacattaagagaagcctgtcagtggatcatatggtatcatcttgcatcaagaacttacaaccgtgatggagctggcggacaaattgatactttattggctcctttttatgaaaaagatttggcagaaggaaggattgataaagaaacggccgtttattatttggcgtgttttttactgaacgaccctgtctactggcaattgggaggtcccgacgaatcaggtaaagaccaaacttcccccctttcattcttaatactggaagctgccgataaaatcaatacctctttaaatctgacagtgagagtgttcgatggtctgaacaaggacttattccggaaatccgtagagtacctggttaagaacaagaatggatggcccagattctcaggagataaagcattggtagaaggatttatgaagaacggcttcagtgcacaactggctcgccgtcgtatagcagtgggatgcaactggatgtcgctgcccggactggaatatacaatgaatgaccttgtgaaaataaatatggcgaaagtttttgaggtatcctatacggaaatgatgaatgaacaaaaagatcatagcacctcccggctctggatgttattcaacgagcatttggctaaggcagtccaaacatcagccgacggaattcgccatcacctgaaatttcaaaaatacaatgagccggagttattactaaatctattgagccacgggccattggaaaaaggcaaagacgtatcggacggtggagcggaatactacaacctggcaattgacggagccggattggctactgtcgctgactcttttgccgctttggaacagcgcatcgagttggaaaacaaattgtcctggaataccctgaccgaatatctgagaaacaatttctcaggagacggaggatgcagaatacggcatttattgaagaacagcgaaaaatatggagccgccgaatccttgggcgaaaagtgggcgattcggatcaaagaaacatttacagaactggtacgtttgcagtccgaaccggacaaacgccggatttttattcccggcttcttctcttgggcaaatacggtaggattcggacaaagtgtgggagctactcccgacggacgtttagcgcaaacacctatctctcatggagcaaatcccactcccggttttgtaaaagacggcgcatcgctttcacttgctaccattatagctaaaattcagccgggatatggcaatacggcacccatgcaatgggagctggaccctacattcgccaatatggataatatagagttaatcatgtccatcatcagggcacacttcgacttgggaggtactttgattaacgtcaatattatgaataaggatactgtattggctgcccataaagatcctgccggatatccggaactggtagtccgtgttaccggatttacagcctacttttccatgttgtcccctcaattcagacaattggtagtagaccgtatcttagaaagctaaatcatattcactctaaaaatcttatatcatgaaaatcattgatgaacacacatttgaaggaaagggatatcacccgttcctgataaccgacaggtggcaggtagcctatctcaattatgcggaggccgaatctctggagcaaattgagaaactggatatccaccatcagacagatgaagtatttatactgttgcagggaaaagcagctttgatcggtgcttctgtcaccgatcaaaatattacctatgatgtagtaaatatgcaaccgggtatagtgtacaatatccgaagagaagtatggcacaagatcgccatgcaaccggggagccaggtactcatcatagagaataacgacacccatctgaatgattttgaatttttcgaattaacagagtctcaaaagtcccaactgcgggaatgcgtaactaaaatcgtttcactcaccgaaaattaaaacaagtatggaaactacagttatttcgggtttcttattaattctgctggctggtggttgttccggcacgtttgctttgccttttaaacacaactcacagtggaaatgggaaaacaattggtttatctggagtatcatcgctcttcttgtcgctccctggataatggcatttatctctattcctgacttggaaagtgtatatgctcatgaaagcaacacggtactgctagtggctttcttcggccttttatggggaattggcgctatactattcggaaaaggaattgattatctgggagtttcgctcagtcttcccattatgcaaggattgattaatgtggtagggactttgatgcctgtcattctcagaaacccttcggaattgctaacacctacgggactaaagttacttacaggtacagtaattattcttgccggaatcattttctttgcgatagcagggcacaacagagatagcaaaagccgccagacgcactctgaaacacctattaagaaaaatttcaggaaagggttaattatctgtttgcttgcaggaatattcggacctatgattaactttgctttcgtttatggggcacccttacaagaaaaggctgtagcaacgggagcatcttctctttatgcagccaacgtgatatggagtatcgctttgagtgccggatttattattaatctccttgaatgtatccgtttgttcggcaagaatcaatcttggaaaacttaccgacatcgtacaaccggaggcctgataatggcttctctggcaggggtattatggtatctgagcattatgttctatggtatgggaggcagttttatgggagttttaggagcttctgtgggctgggctaccatgcaatcgacagctattattgcaggtaatgtggccggacttgcttccggcgagtggaaaggagctacccgctatgccatccggatgatggtgataggattggtatgtctcatcggaggagtggtggtgattgccctctaacgactatacttaactatttatattgacttaattattatgttattcaaaaagtctaacttatggagaatttagccatttcattttttgaacgaataaaagaacaggtgacgctgagaaccataaaatattgcattttaatggcaggtttcctgtgtgtatgtgttccttcgctttacggtgtagaaaatctgaacgtaaccggaaaagtcgtagactcctctggtgaacctctgattggagtatctatcaaggtagagaacaaaaatatgggtactactactgatataaacggaaactttacgctcgctgacatccctaaaaatacggtgcttgttcttacatatatcgggatggagacgcaaaaagtaacggtgacacaaaataggctgaacatcgttatgcgtgaaaacagcgtacaactggaagaggtggtagccattggctatggtacagtgaaaaaagaggagttgaccagtgctgtcactaaagtaggggaagaatcgtttaatgcgggggtaactaccagtccgattaacttgctgaacggcaaagtaccgggattatccattcgcaatacaagcggaaatgacccgaacgcatcaccggagatacatttaagaggtatcggatctatccgggcaggaagtgctccgctgataattgtcgacggaacttacagtaccatgtccgagttgcaggcaatcaacgctaatgatatcaagtcctttaatgttctgaaagatggttcgtctgccgctatttacggtacacgaggcagtaatggggttatcatcgtagaaaccaaaaatgcgtctaaaggcaaagccagtatcgaatataccagttattattacacagaaagaccggtgcggaaactggaaatgatgtctgccgatgaatatatgggatatttgaaagacaaagggcactccaccatcaacaacgattacggcttctcaaccgactggacggatcagctgatccgaaataatttcagttattaccagggagtttctttctcaacaggaacggagaactcatccatacgaggctctgtcggttaccgggattctgaaagtatggtaatcaacactggcaataagcaactgacggggagagtaaacttcaagcagtattttttcgacaagaagctgactatagaaggtacgttgaacggagcaaacactcaatcggattatactgattacggagctttcatgcaagctatcgtatatcatcccacggcacctgtttataatcaggaaggaaaattcttcgaatacgcaggagtaggaccttataatccggtagccttactttcgcaagtagataacagaggagaacgttatacctactccggcaatctgtctgctaatctcaaagtattgccttgtctgagtgtatatgctatgatgtctgccaacaacgatacctacgaaggttccaaatatatcagccgtgattctcgctacagtgtattaggaggctttgaagggcaggcagatatgaatacttatttctacaagaaacgaacatttgaagcctatgccaattacagtttctccactgatgtacataatctgacagctcttgccggttattcattcaacagagaagacagaacctggcacaatgcgtccaactcaggattcctgacagatattccgggagctaacaatattggtaatggtacgtatctggaagatggacttgcctcaatgggaaggggacaggatgaatcaaagttaatagctttcttcggtcgtatcaactattcatataaaggtaaatatctgttcaatgcgagtgtcagacgcgaaggttctacccgctttggagagaatcataaatggggctggtttcctgctgtctctgccggatggagaatattggaagaaaatttctttagtgatgctaccccgcttagcaacctcaaactacgtgtaggctttggtatcaccggaaatcaggatattcctttatatgcttccatagccaaatacaatgatctcggatatgcttactataatggaaaatgggacaaagtttatggtcctgtcagcaacccgaatcccgacttgaaatgggagaagaacgctgaatacaacgcaggtgtcgatttcggaatatggaacgacaggctgacggcaagtgtagattactattatcgtaaaaccactgatctgctggattggtatgatgcgcaaatgccttcaaatatatacagtacgatatttaccaatgtaggtacactgaccaatcaaggtattgaatttgctatcgggtatgatgtaattcgcaacaaagaactgaaatggcatcttgacggaggattctcatacaatgagaataaattggtctccttggcaaacagttcttaccgtgccaatcacatcacttacaatcctctttcttcacctgccaacggtcagactacgtatatactggaagaaggcaaacccattggtacgtactacggattaaaatacagaggtttcaacagtgccggtaaatgggtatttgaggacagggatgaggacggtgcttattcggataaagactacacttatttgggcaacggacttccaaaatggtatttcaatctggccagtacattgacctggaaagattttgatttctctttccaacttcggggtgcagccggatttaaggtcctgaataccaaacggatttattacgagaactcggtgtctttacctttcaatctattgaaatccgcattgggcagacctttgaatgacgctgccactttttctgattattatctggagaaaggtaattatttgaagttagacaacataactgtagggtatacgttcgatttgtcccaattgaaatatgtgtcaaatgcccggatttatgccaccgccaccaatttgctgaccataaccggatatacaggagttgatccggaagtaggtacagggctcacgcccggattcgatgattccggttactatccgcgttctacaactcttatgctaggtttaaacattaaattttgattcacatgaaaaagattatctattttataacattgctttttctggttggttgcgtcgacttatccgaaaatatgtataatgatttgggtaaagataattattatcagacagaacaggaatatgatgcggcgtttatgaatcaatacgctttcttacgtacgatgtatgcttggaatgtattttatctgcaagagattactacagacgaagcttgtttacctcaaaaagggcgagacggttatgacggaggtatctaccaacgtatgcattggcacacatggaccgaccaggatgtcattatcaacggagcatggcaggaactgttcaaagcggtgggtttctgcaatcaggtgctgaatgatttgaataattcccgttccgatattcttccagagaacaagaaaaagctatatattgccgagtcccgggcattgagggcatttttctattccatgctggtcgatatgttcggaaatgttccgattgtagaaaaggtatccgaactaaatccgccaactaaaaccagaactgaggtttttaactacgtggaaaaagaaattgcggaagtcaaggaccagcttctgagaagtacagataccggcagctacggacgctttactcaggaagccgcattagcgctattatcccgactttacctcaatgctgaagtttataccggaacatcccgtctggacgattgtatttctgtgtcacagactcttcttcaaaaaggttatcagctggaatctacttgggatgctccctttgcatggaacaatgagaatagcaaggaaaatatctgggtgatccctaatgacgaaatagttgccaatgagatgagtgtccttttctaccggaacattcactggtcgcagcgttcgcaatgggattggaagaatccgaatgggggatggaatggagtctgtaccgtaagagagtttattgaaacgtatgatattactcacgaccgccgttgtaagtatgatcctcaaaacggaatgtacggacaatttatgtggggcccccaattcgatttaagcggaaacccgattttgggaaccaatgaatatgccggacaacagttggatttcaccctcgacttgccggacatggtaaacaacaaggagaatgccggtgcacgtaatattaaatataaagtaaaagtcggcgcacaaggcatggaaaatgattttgctctgttccggattgcagaaatcaacttcaatctggcagaagccactcttcgtaaatcgaatgaggtggattctaaggcgctggaaggtataaacaagatacggacacgtgcaggtgtttctacgtatgcaaccggagaactgactttggatgagttatacagagaaaagggaagagaaatgtgctacgagactttgcgaagaacggatatgattcgcttcggacgtttcattcaaccgatgtgggataagaattatacagataaggaaacaatcaatctttttccgattcccctgcaggcaaccaaactcaatcctgagctgaaacagaatccgggatacaccaaataaattgtaaacgattaaaaagaaaaaccatgaaaaagatatttcatttagcttgttttgctttcatcctactggcggctgcttgttccgatgaaaaagaagtgacacttgaatataataagatagacggtttgctttctcaatgcaatgaacttttatcttcttcctctgaaggagaagatttgggtgatttcgtaaccggttcgaaagctattttcgaaagtaagatccgggaaacagaatttatccggaataaaactgatcgccagtcagctctcgacaactattgcgaaaagctggagattgcccgacaaacattcctgtcaagcaaagtgctaccagcatgtccgttgttcgacggaacaggttatatcgactgcggccctgcttctcaatttttctctgataagttgacactggaggcatgggtgtatgccaatgagaaaacaggaggcagcataatcggttcagaaggttcgggcgataacggcatctacggtttgctgattcgtctggcagaaggggtgaataatgcgattgactttacgattgtcaacggtacatggtcaagctgcattactcaggagaactctattgaattgaaaaaatgggtacatattgccgctacattcgactcgcaaaccgcaaaggtatacttaaacgggcaagaagccgcaactatggatattgcgccgtacattcccgaaggtagttgtaaattcattattggcgatctttctacttggaacgggcgtcagttcagaggtaaaatttatgatgtaagaatctggcatacgattcgtactcaacaacagattgccgacaactatcagattttcttaaaaggggacgaagaaggattggttgccaactggcaactgaatgtgaaaagcggttcctctattaaagatattacaggtaaatatccggctactttggtcaacttaacatggtctgatcttgataatcttaattaaactttataaatactgactgctatgatacgaatcagcaataaaataaaaacacttttggctatgttgtcctttgtacaggttacttcgggctgtgatgccactgtacaggatatcatcattgacaccgatcccggtgtagaaatcggtaataatgattattatacatggtgtaaagagacactatctgtcattgataaagatttgaaaataagtggtacacattcttattatgagaatcaggaccgttcacaagtctcttttatttggggaaatattttccttctttatacatacaccgaaggaatctcattgagcaagtctgaatggtcggatgctttgatgaactgctttcttaattttgataactactggcatcccaactataaaggtattgcaggatatgccactttacctacgagtgccgagaaggttcccgaccgtttttacgacgaaaacggatggacagcaatcggactctgcgatgcttatctggcaactcaaaacaattcttacttggaaaaagccaaaggggcactcgctttttccctttcgggagaagataatgtgctgggaggaggaatttatttccaggaaacttttgtttctttacccgtacagaagaatacgatttgctctgccgtaaccatgctgagttgtatgaaactctatgaaatcactcaggaccgccaatatctggatgctgccatccgcataaacgactggactgttgagaatcttttggataaatcggacaatcttctgtgggatgccaaaatggtagcggatggttctgttaatacacagaaatggtcatacaatgctggttttatgattaggagttggctgaaaatgtatcaggccaccaaagacgaaaaatatttatcacaggcaaaagctaccctggcatcttccgaagccaaatggtataattcaatcaacggagctctgaatgatcccggatatttcgctttttcaataatagactcttggtttgatatgtatgatacagataaaaacacggtttggctaacgaaagctttccatgcgattaactttatccacaataaactacgtgacggcaatggacgctacccggaacactggggaacgccaacgacaagcaatcttgaaaaatatgatttaaggttttctactgtagcggcttatatgtatatgagagctgccaattacaaaagaatactcaacgattaaactacagtaccatgaaaatgaaattattgatactggccgttcttccattcctgacgccgattaacatgaactcacaagaggaaaaagcctcatgggtacagtatgtcaacccattgattggaacagaagtatggcaatccggagtagcggttgccgggcatgaagatccttcgggatatacttttcccggagtgacagagcctttcgggatgacagaatggactgcccatactttagagagcaagcacgctggaacgctgcaccatcgggtaccctactggtataaacataactatatttcgggatttatgggaacacactatccaagtggggccgtcatgttcgattatggtgctgttgaactaatgccggttgtcggacaactgaaatgcaggcccgaagagcgtagttcttcttttacccatataaccgaaaagtcaaaacctcacttctacgaagtcatgttggacgactatcaggtaaaagctcaattatcggctacaaaaacttcagctatcctgcaatttacctatccccagtcggatagtgcttacgtagtggtagatgctatgccttccatgtttacagccggagcaccgggctacattcacatagacccggtacgaaaagaaatttccggtaaaagcatacaatctgccagaggatatcgggaaaccggatattttgtagtccgtttcgataaggatttcgactctttcggcacgtttaatcttaataatgattatcccgaagtaatcgaagagaaatatctgttcactcaaaaagaaggcaagtgggtcaatggcttaaaagggatttatacacaggactcaaagggggtcggacatctgcggagtgaaaaaatcgatccggttatcgattttgactgggactggtataaacctgcggatgatttcagttttaatgattaccaggtgacctggagcggtaaactcaaagctccctctaccggtgaatatacattagggatacaagctgacgacggagcacgattatatatcaacggagaattgctcatcgatgactggaaatctcatagtttcagctatcaacctacccaaaagaagatttctctggaagccggtaaaatgtatgatataaaattggaatattatcagcatgaatggagctcacggataaaactgagttggatcaggcctgataaaaagtcatcaacatcccttctgactggcaatcgacatttggaatcgtctaccaaaatagggggatatatccgttttaaaaccggaaaaaatgaagtaattaaagccatcgttggcacatcctttattagtgtggaacaggcacggataaatctggaaagagaaatcggagccaaaagtatggaaacaatcagtgcacaaacagaagcattatggaataaagaattatcagtcatcgatttgcccggagctacagaacaagataaaattgttttttatacagcgctatatcactctttcctgttgcccagaagtctatctgaagatggaaaatacagaagtccgtttgatggaaaagtacataagggtattagctttacagactattctatatgggacacattcagagcgacccatcctctgttcgtattactgaaacccgattttgcgggagatctcataaccggactcctccatgcctacgatgagggaggctggcttcccaaatggcctaatccgggatataccaactgcatgatgggaactcatagtgatgccataatagcggatgcttatgtaaaaggagtgcgtaactttgatgtagagaaagctaaaaaagcagtgctgaaaaatgcgtatgaaaagggtaaccacattgcttggggacgcttgggcattatggactacgaacgattgggatatgtacctgttgataaatatggagaatcagtagccagaacgatggagtttgcctatgatgattattgtctctcccgtttctttgccgaaaaaggtgaaccggacttatcggataaactaggtaaacgaagcaaaaatttcaggaacgtactggataaggaaaccaaaatggttcgtgcgcgtaaagcagatggttcatggagtaatccggaagattacgatatcagcgtatggagtggttttaaccccaaaggagtgtacaactataaaaagaattatacgttgttcgttccccatgatgttcccgaactaattcgctttttgggaggtaccgattctttagccgtttttatggatgaactattcgataaagatatttactatgtgggtgacgaatttgtgatgcatgctccctatatgtataatctctgtaaaagaccgtggatgactcaaaaaagaatatatgatatagtcaataaatactatctgcccacacctagcggactgccgggaaatgacgactgtggacaattaagttcatggtatatcttcagtgcgatgggattctatcccatgtgtccggcttctattgaatatcagttaggagttccctgtctgccgggctttgtattgcatttgcctcaaaatagaacattcacaattaaaacaaagaatttcggcaaaggcaattgttatgtacgcgctgtatatctcaatggcaagcctcaccgtagttctgtcataactcattcagatattattaacggtggggagattttattcgaattaacagataagcctgcatataattggtttcaataggtaatatataaataggagttttgtgggtgaagtgactatactgattttaagtggcagttattgtcccggcttgataatcaaccgcagtacaaaccaagcatgatgtgctgcggtgcttatccatccataatgttttgccataatgcggaaccgttctttaagagaagcctttcggttctgagtagtcattccttcatccagatagtcgatgattgtcaggtgcgtattgtgcagggtatacgcctttttcatgatgcggatgcaccagtcgaaatcagcagagtaccggtagcttaagtcataaggttccaccagcgtatgtctggcaaagaaagcctgatggcagactaacattccctgtttgaaactcttccagtccagcttttcgggcgctgaaagccggcgcatatgcagaaagtgcctgtctttgtcaacaatcgcagtttccccgtagatgacgtcggggagaacactcccatgaatgctgtgcaccatttgctgcaaagtatcgtcttcgtgaaagcagtcgcccgcattcagaaaacagagatagtcgccgctggcaagggagatcgccttgttcatggcatcgtacaatcctttgtccggttcgctgacgacggtagttatccgtggacggtatctgtcaatgatagagagagtaccgtctttggaggccccgtccacgatgatgtattctacgtggtgataagtctgcgagataacactttggatggtatcttccagtactttctcggcattgtaggtcaccgtgataatcgagaacttgggagtaggatggacactatgcatatttccctgttattttgttgtaaacttccgtgtacttcttcgctatgatactttccgaatagttgcctatggccttgcggcaggcttgtgcggagagttccgcatattcgggttccgtcagtacccaatggatgccgttggctagatcttcggaagacttgcgctgagctacgtatccgttgtgcagatgatcgatcatttctggtatgcctccggtgttgaaaccgacgcagggcacaccgcaggacattgcttccatcaccatattcggcagattctcttcgagagaagggatggcgaagaggtctacggcattgtatatatccaccaactcatgctcattcttaatataaggaagcggatagacgcggaaaggaatcaggtcttgcaactgctgcgactggttgccgaaaacaaccacgcccaatgattctttccattccggatgtttctctgccagcagtttgcaggcttcaatcagatagtcgatgccctttcgcttgtctgtgatcttgacagaaccgaaaagaatcagcttcccttcctgcggcagcctgcattttctgcgggcttcctgcttattgtgaggcttgaacagattcgtgttgatggcgttcgggatactgataaccgtttgtccggtgagcaacccgctgactttggccttttccgccagccagcggctacagcctacaaacgtgatggatgcctgactataaatctcttttttcttccggaagattcgggtagataagtccttcttgcctcctcctccgtagatgtaagggcagtggtgacattcctgttcgtaattcttgcattcgcgtgcataatggcagatgccggtgcagggccacatatcgtgcatggtccatactacaggtttgccggaagtcagaatcttgcggatggtgttgagcgacagcatcccttggttgatccagtgcagatggatgacatctgcctgctgaaattcgggaagcgaagtgatgtccgtaccggtattggcgatatctacggcgaagagatcattcttcttgaaacggttggctttccagatgacgatgcgttcccacatgaatttccatacgtgcagccagctgccctttagtccgacgacgctgatttggtctgtttgtttgtcacgtaccaacattttcgccttgatgccgttgttcttaagcgattccatcagtcgtccggcagcgacagccgcaccacctattcgttcggaagtattgatgattagtaccctcatgctttcaaaatgtttgcacaaaagtagtggttttcagtgaaaatccgtacaaagtcacatattatttgtacttttgccacacttattaataaggagatattgaacatgaaaaaggttgtgtttttaggattagggtatatcggccttcctacggcagccgttgctgccgctcacggtttcgaagtcataggagtagatgtcaatccttctgtggtggaaacgatcaaccagggaaagatacatattgtagaacctgaactgggtcaggtagtcagggacgtagtgcagagtggaaagttacgcgctgtatgcaagccggaagcggcggatgctttctttatcgtagtgcctaccccattcaagcagaaccatcgggcggacatcacctatgtggaagcggccacccgttccgtgatcccttatctgcaggagggtaacctgtttgtcattgaatccacttctccggtatataccaccgaacgtatggcggaagtgatctataaagaacgtcccgaactgaaagggaagatacatatcgcttattgtcccgaacgcgtattgccgggaaatacattatacgaactggtgcacaacgaccgcgtgataggcggcatcgatccggcatccaccgcaaaagccattgagttttattccgctttcgtacaaggcaaactgcacggcaccaatgcccgcacggcagagatgtgcaaactgacggagaactcctcccgcgactcacagatcgcctttgccaacgaactctccatgatctgcgacaaagccggaatcaatgtatgggaactgatcgaactggccaacaagcatccgcgtgtgaatatccttcaaccgggctgcggagtaggcggtcactgcattgcggtagacccttggttcatcgtatccgactatccggaacaggcgcagctcatcaagcgtgcccgtgaaacgaacgattacaaagcggactggtgtgcgaacaaagtattggaaacctgccagaagtttgtagaacagaacgagcgcgaaccggtcgttgcctgcatgggactggctttcaaaccgaatatcgatgacttacgggaatctcccgccaaatatatcgcctcccgcatcatctccgaatcgagagcggacgtgctgattatcgaacctaatataagcactcataagagcttccatctgacagactatcgggaagcatacgagaaagcggatattatcgtctggctggttcgccacgatgtcttccttgcattgcccagggaggaaggaaagatagaactggacttctgcggtgtgagacgataaaaatgtagtttaattgcgaagaggttatatagactctataaataaagcagatgaaaaagatattgctcgttttcggtacccgtcccgaagcgataaagatggctccgcttgtaaaggcgctccagaaagatacggaacattttgagacacgtgtctgcgttacggcacagcatcggcagatgttggatcaggtattggaagtgttcggcatcactcccgaatatgacctgaatatcatggctcccaatcaggacttgtatgacattaccgctaaagtactccttggactgcgcgaagtgctgaaggacttccgtcccgacaccgtattggtgcatggagatacgactacctcgatggcggcatcccttgcggcattctatatgcagatacctgtgggacacgtggaagccggattgcgtacctataatatgttgtctccctggccggaagaaatgaaccgtcaggtgacagaccgtatctgcacttactactttgcaccgacggaacagtcaaaggtaaatctactgcaagagaatatagacgcgaagaaaatctttattaccggaaatacggtgatcgatgccctgctgatggcggtcgatatcatttccaccaccgccggtgtgaaagaaaagatggcgaaggaacttcaggagaaaggctacacggtaggtgatcgtgagtatatcctcgtcaccggacatcgtcgcgagaacttcggagatggtttcctgcatatctgcaaagcgatcaaagaactggcggctcttcacccggagatggacatagtctatcccgttcatctgaatcctaatgtgcagaagccagtgtatgaactgctttccggtctgagcaatgtctatctgatctctcctctggattacctgcctttcatctatgccatgcaacattctactctgttgctgacggatagcggcggtgtgcaggaagaagccccttcattgggcaaacccgtgttggtgatgcgggatacgaccgagcgtccggaagctgttgaggcgggtacggtgaagctggtcggcacgaatgcggaggcaattgtcagtaatgtcactgccctgctccttgataaagaaatgtataagcggatgtccgaaacacataacccttacggtgacggacaggcttgcgaaagaatcatagctgcgctcagatgttaacacatgagtagtcaggtattaacatttgatatgataggtattaatatctgagaagttaggtattaatacttgagaagctggttaacaatgcttgctgtgacatctaataatgcttgaaacgagatctaagaagcattgttaatcacatatacttcccactattattgtttttattattggtttattttactatcataagtgccgatatataaagtaatatagggcgaaccttttctgcttttgccccatttttccgctttcatcgctttcaccttatagaaagacatttcactttatccgcatataacatacaaacctccataattctgttattatgaactattcgtatattgtcatatcagtcggtttattaggcagtaacaatttcaatatattccaaagcaattaatagactgttatcaagctgagatatgaaatttctaaaaagaaatatcagtgctgtatgaaaggaggatattatcgtactttttgatagtgtttattcgctataaatggttttattttgtagtgtcatttttagaaagccgctctattacaaaatagggatgaatgctgagaagatgctttgtctgccggtgcacgtggatttaaaagatgatgaaattaatcaaattgacatggtcttggctgaatatcgtcgaaaatagaaaagtgtaaaatggtaataatcgggagtaaaggatgtgctaaggagattttgacagcactcaagtgggataatgtagaagaaactgtatctttgtttgacaatataaatacagatattagcgatgcatattatgactttcccattattaaatcctggaatgaactggagcaacatctgaaaacagacagtaaggttattattggtgtcggaggtggacagcgtagagaggtactggcacgaaagattgcctgtcttggaggagtattgaccacttttatctcccaaaaagcccttgtgggcgggtatgacaatactatcgaaccaggtgttgtaattctttcgggggcaactattacttgtaatgtaagtatagggcaggggacatttatcaataaaagcactgttatcagtcatgacgtccgtattggacgatattgtgaagtatctcccggtgcaaaagtcttgggacgtgccattatcggtgacaggacggagataggtgctaatgcggtaatacttcctgatgtcattgtcggtgctgactgcaaaataggtgcaggcgctgtagtgacgcgaaatatcgacagccatactactgttgccggagttcctgcccgttcaattacaaaaagcagtaataatgctttcaagttaaagtcaaagataagaaatttattgtaccatatacgaattgcagattttcgaaagctgagagaatataatcattacgtattcggaaaaaggaaactgatgttccttgagctattgtcacatagttggatgtatggtgcatcattcgaaaactactacgagttgcagttctttaagaaaagcagaacagaatgccgacagtatctcacttcttcgttacgtcatgaattgacacgtcaagtaaacgatccctgcgaagcgttagtgttaaaagataaagtgcgtttttccgaagtttttgaggatatcctagggcgccgggtaatgacgtttgatgagataaaaaggcaaatgcatgatccttactccatatccataaatgaggtcgtcattaaacccataaaaggacaagccggtcaagggattatttttccgatgcaaaactttacatcattgcgacaactacatgactatgttatttctactgtaaaaaaaccggatgaatatttgtacgaagaacgtattatccaacatagcgccctgaataaactgaatccgtcaagtctcaacacattgagaattgtgacatattatgatgaaagtataaataaggtcgatgtgtggagtgttgttttacgtataggaataaaggctcgcacagacaactttgctacaggaggaattgccgtccttgttgatcatcggggtgtcgtctgtcaacctgctataataaaacatccgtcaggagaacggtttcatatacatcctgtcagtggtgaaaaaataacaggttgcataatcccatattacgatcaggcaatagcattagccaaacaagctgctatgagaattccgaaagtgagaagtatcggatgggatgttgcgataaccgaaaccggtccttatatgttggaaggaaacgataattggtgtatgactttatttcagttgcccggcggagaagggttgcggcatttggccaattcggtttgcaatatgttttctgtttatgaataacatacaggctataatgcacattaggaatgtattttccgttcctggtctgttattgattcaaatcgggaatgcctctaacgaaaaacgggctgtcagagaatcacttctccggcagcccttcttcattaggatcaaaaaaaacagaggaagtatgatattctttattcctgacctccccctaaagcacggtataggttaattaaactttgtatctcggtaaaatgattggccgtttgtgacagttgtgcgctgagcaatgactgtcgggcggtaagtacttccagataggttgtattcgtatgttccatcagcagggaagtacttcgcagggccgtttgcagggaagtgacctgcttgtccagcaacagccttttcccctgactggtctgataggcagtcagcgcatcattcacttcgctgccagcgttgagcaatgtttgctgaaagccgagagctgcttcttcctgttgcgcacgggcgatacgatactgagccaccacctgtcctttattaaagagcggctgcgtgagcgaacctaccgccgatgccaggaacttgcccggattgagaatcatagacccgacggagttcgtccatccggcacttccgctcaacgtgatggaagggtagaaagccgaacgtgccgcattggtgccatagaacgctgcttccagcgtccgctcggccgagcggacatcggggcgggcggcaagcatccggacagggattcctacggcaaagtccgtaggaaactgttggtctgccaacgttccgcgttcgtagttgcggggcgtctctgccaataataaagcaagactgttctccacctgattgatctgctgctgcaaatcgagcacagaaccctgtacctgataataagtcgcttccatctgcgatacagccgattcgttcgccagtccggcgttcatcagggaacgggtagaggctacggtttctttccatgcctcctccgtctgtcgggagatgatgagctgttcgtccagcatcagcagcgtgtaataagtattggctataccggctatcagctgcgtgcggactgcttgacggtaatcttcactttgtgcatacagcgctttcgcctgcttcttggagttgcgcatacggccgaatacgtccagttcccaactggcggtaacgggtagcgaataaccctgcgtagctttgttcgtatcgaagctgctcactgtcccctgcggggaaagcgcaaaggcgggcaggaaagcaagtttggcggacatcagcactgcctgagcttcttctacacaaagctgggcggactggtagtcggtattggtccgcaaccctgtctcgatgagggactgcagatgagggtcggtgaagagttcccgccagtccatattccccagaccggcagtgtcttccgtcaccacttccccgccgtaaagatcgtcggggacggaagtggcgggcttgtatttggtatagatgccacaaccgctcagcgtcagactcatggcaactaacaggatgatatttttcttcattctttcttttatttattaacgttcacgttcagcttcacttttctctttctccaaaagcacttgtacatctgcttcttcctccatcggtttgcggattttctcctgcaagtattcaaagatgatgtagaagaccggaacgacaaagagcaatgccaccgttccgacagccataccgcctacgacacccgtacccagcgaactgttaccattggcacccgcaccggaagagaacatcagcggaagcataccgaagatcatcgtcagcaccgtcatcaggataggacgcaggcggacttgtgcggcagagtaggccgattctacgatgcccatccctttgcggcggcgttcgatggcgtactccgtaatcagaatagccgtcttggccagcaagccgatcagcatgatcacacccgtctgcaaatagatgttattctccagtccgagtatcttggcgaacaggaacgagcccatcaatccgaacggtacggagaagataacggcaaacggtacgaggaaactttcgtagagacaagccagaatcagatagatcaggaagatgcagatggcgtagatgaaaaccgtctgcgcaccaccgctgcttgcttcttcgcgtgccataccgccatattcgtatccgtagcctatcggaagcgattctgcggccacttcttcaatcactttctgcacttcacccgaagagtaaccgtcggcaggattcacattggctgtgatggtgctgtagagattgaaacggttggccgtttccggtcccagtacctgcttcagtgtaacgaactggctcaccggagccatttccgtaccgttgcgcacaaacatattgttcaatgcctgctcgtccagacgatattcgggcgatgcctgcatcattacacgatataccttaccgtattggttgtagttggagatatatgctccaccgcaataactgcctaccgcatcgagtaccgcgcttggcgaaattcctgcacgcttacatttggcggcatccacttctaccgagagctgcgggaagttgatggcgtaggatgtataagccatagccacttccgggcgctggttcaaggcattgaggaactgtgtggacgcgtcatagaacgtagcaagatcaccgcctgtcatatcctgaaggttcagttcgagggagttacccataccgtatcccggaatcatggcgggctggaaactgaatatctgcgcttccttgatggactggaattgtgcgttgaggcgggaagctacggcatccgaaccgtgttcctttccttttcgttcgctccagtctttcaggcggacaatgatcgtaccgtaagaagttccctgaccggagatcagaccgtatcctgctacgcgggcgtagtgttctatttcgggcgtatctttcagaatgttttccagccggtccattactttcgttgtctcttcgagcgtgcttcccggtgagatgctgacattcaccatgataacgccctggtcttcctgcggcacgagtcccgtcttggtcgtgctcatcagataaaccagcaggacgatggtagcagccagtgaagtccataccatccagcgatggcggatgaagtacatcacccctttcttatacttgcccagcacggcattgaacgaagcgttgtaagctgcgcgtacccgtccgttgatactcttggcgctcttggttccgtccgacggacgcatcatgatggcgcacagggcgggacacagggtcagagccgagatcatggagatacctacggcagttgccatcgtgataccgaattgggtatagaacacgcccgaagtacctcccatgaaggtgacggggataaatacggccatgaagacacaggtacaggagacgatagccatcgtcacgtcgcccatcgcatctttggtggcaaggtagggcgacttgtatccggcatcaaacttggactgcaccgcttctactactacaatggcatcatccaccaccgtaccgatggcaagcaccagggcaaacagggtcaggatgttcagactgaatcccgcagctaccagacaggcaaacgtacctaccagtgacacgatgatggagatagacgggatgagtgtacttttcaggtcctgcaagaagaagtataccacgaggatgaccagaatgatggcgataatcagtgtttccaccacgttgtgtatggaagcgaagaggaagtcgttcgaactcatcatggtgacgaactccgttccttccggaaggtttttctccatccgctccatctgggcggtaatttctttattgacagcggtcgcattggaacccgctgtctggaagatcatatagagcacggcaggctggctgtccatctcactgcggaaactataagtcatagtgcccagttccacatccgccacatctttcagacggagtatcgagccgtcttcacgagagcggacaacggtgttctgaaactcttccacgctcttcagtcttccgcgatatttcatcgtgaactggaagacgttctgcgaactctcgcccagtgagccggtaggggcttcaatgttctgctcgcccagcacgccggtgatgtccgaaggcaccagcccgtattgtgccatccgttccggtttcagccagatacgcatactgtaggtatcgcccagctccatgacgtctcctactccctcgatacgcttgatctgcgggatgacgttgatgtccagataattggcaaggaaggtctggtcgtagcgaccgtcggtgcagaccagcgcgccgatttgcaggaagctggtctggcgtttcatcgtgcttacgccgactttcgttacttcggcgggcagcagtccctgtgctttggctacacggttctgtacgttgacagccgccatgtcggggtcggtgccttgcttgaagtaaacctgtatgatagccagacctgcattggaggcgctggacgtgatatacatcatgtcttccaccccgttgatgctctcttccagcggcatgatgacgctgttcatcacagcttcggcatcggcgcccgtatagctggcggatacatagaccgtgggaggcgcgatgtcgggatattgctccaccggcagggtgaagagcgagataagccctatggcgagaatcagcacggagatggagatagccatcaccggccgtttgataaatatatttcctttcataatcagtctccttcttatttaacctgtgtgccttcgcgcaccagtccggcgccttccgatacaatttcgtcaccggctttcaggccgtccagcactacatattcgcgtccgtcgttgattccggctacggtgatcagggtggagactgctttgccatccactaccttatatacaatcgtcttgtcctgcatccgcacggtggctgtttgggggatagcgatgcagttcttgtagatgctcggcactactaccgtgcccgatgctccgctatgaagcagccgtgattcgttggggaacactacgcgtgccactacggtccctgtctgacggtcgatcactccactgatggattcgatggtacctttcttctgatagactgagttgtcgttcagaatcagttccacttccggcatattctttaacgcttcgtccatgtcgccgtactgtcgggtaagggcgagcagttggttttcggtcatcgagaaatagacgtacatatccgaattgtcactgaccgtagtgagcggataaggaatgttggcgcttaccaatgcgcctgcacgatagggcaatgcgcctacaactccgtcactgggacttttcacttcggtataagagaggttgttgcgtgcgcttatttcctgagcttcagcctgtgccagttgtgccttggcggtgagataagagttttcggcagtcttcaggctaaattctgaaacgactttctgtgcatacagttccttgttgctcttgtaagtcagttcggcggtgctcgtagcagcgcgtgccgcttccacattggcggtggcggttttgagcgcggccctgtaaggtacctggtcgatgatgaaaagcaactgtccccggcgtactttctgaccttcggtcacgcagagtttctcgattgttcccgacacctgcggatagatatcaatatcctgtcgcccgcgtatggtcgccgaataggaggaagaaagttctttgtccgttggttctatctgcatgactgcataagaagatttcactcctgcatccggtgcctgcttgcacgatgccatccacactgtacaaccgacaatccctatcagccgtatccattttttgttcactgtaatcatacttactctttttgtcttttattaaaatcagaacaaaagtaggagaaaagaacaagtcaatggtgaccgatttttctctatgaatgtcctgttttcgttatttgtgctttttgtggctaactatttgcgtataaacgatatatcaaacaattataaaggagtttgggacattctgttttccctattatttaccaactttgcaaaaagtaaaaaaggagagattatggaaaaagagaacattatgacagtagatatagaagactttaagaagagtcagcatatccttgattatatagacgatgactttgcgatagtcaacagtctggacgggattccgtatagtaatgatacagtccggctgaactgtttccttattgctgtctgtgcagaagggtgtatccagctggatatcaactaccggacgtatcagttgcaggcgggcgacttgctgctcggtcttcccaatacactgatcagtcgtacgatgctgagtcctaaatataagataaggctggcgggattctctacccgttttctgcaacgcattattaaaatggagaagaaaacgtggaataccgctgctcatatccacaacaatccggtgaagtctatcagcgaaggcggggatgatcctgttttcaggttttatcgggatttgattgtggcgaagatcaatgatgaacctcattattatcacagggaagtgatgcagcatctcttctccgcccttttttgtgagatgctgggacagcttcacaaggaaatcgatgctcccgacaagggggacagtccgaaagaaggcatcaaacaggcggattataccctgcggaaattcgtggagctattatcgaaagacaagggtatgcaccgttctgtgagttattatgcggatgcgctctgctacactccgaagcatttttcgaaagtcatcaagcaagcgtgtggcaggactccgctggacttgatcaatgaaacgacgatagaacatatcaagtaccggctgaaacgttcggacaagtccgtcaaggaaatagcggaagagttcaacttccccaaccagtcctttttcgggaagtacgtaaagatgcatttggggacttcaccggctaattaccggaatcgcgaagatgagtgagacgaagaatctcttgaaaagccttcaggtagcgttcgctgaccgtctccatattgatcttttcccggatcatccgttccgattcttttcccatctccttgcagcgttcgggagattcgaacatctctctgattctacctgccaggctatcggcgtctccgtccttgaagaaatagccgttcttgccttccatgaccaggtcgcgttccgtactgtcgcatacggcacaaaggacgggcataccatacgtcatggcatcattgatcgaaagccctcccatgccggcaagcacatagatactcgattcgttcatataggcgcccagtgtcttcgggtcatagacggctccgataaagcggatgctgtctgccagttgcaggtcgtttgcctgttgtctgaggttgtccagttccggtccgtctcctacgatcaccagttccgcttccggatagtcggtggctaccttccggaaagcctctatcaataaatctacccgtttccattttacgagccgtccgatgtgcagcaggcgacggtcgcacgggggaaggatggagggggaagccagtacggattctttttctttgagaagtgcttccgtatcggtcgagttgtaggtgacgtgtatctgctccttctttactccgtaagaggggaggatgtcgtaggcggctgtcgagtagttcagcgttccggcggcttgggcgtagcagtatttccgtatccttgccgttatccattggcgcagatagaagccgatacccttgctgagcaggcgcataccttcgtcgtgcatcggattggctttgaaatattccttgatctttccgtagggaggagtctggaaggggatttcacgaatcaccagcttggcgttgcaggacttcatagcctttctcagtgcgggctgaaagaatacttgcaggaagtagggccatcccactaccactatatccggtttttcttccgcaatgatttcgggaagggcggggaaagcgctttttccgtagaacatctttttctccggtgtggtcagatgcttgtaggttcctccttctaccattttcacccctttgccgatggtcgtattccctttcttcgggctgacaacggttatttctactccttttgcctgtagcctgttgagcatggcattcaggtagtgggggattcctccgaatgtaaaaagtactttcattgtatatgcttgctgatttgattaaaacatgtgattagtttctccacttcgtgttcgtgggcgtaccgggcgaaagcctgagtgtccatccttgtttcggtacacagcgagcggatagctgcgctgcattctccggcgttgtcttctccggtggtttggcctgttccgtactgctctaccctccggcccatgcagaggccgcggctgactatgaccggtttgcggaaggcggcagctttggtcaggaggttgctgctgccggtgaactgcttgtatgcggcaaaaataaggtcgctctccgctatcagggcattgaaacagctttcatcgggaatcttctccaatgagaacagacagttattccttgactccccgaacgcccgcaggtcgttttcctgttgtgcggtgagagatgatttccccgcaatgaggaagaaatattcatcctttggcaataaagggatactctctaacagtaactttatccccttgcggaaattgatggaaccgagcagggatatcaccttccttcctctggctctctccttcagtttgcgcagcaacgggtagtttgtggcgggagccgaaagatcggcaaagtcgggaaacagcagaatgtggcgctgaaatgtttccaggcctttcgctgaatattcgttcagtatgcctactcctacgcagttcttgcttcgcaggaaagggcgggtgtcgggcatccctcggtggtaaggcggcagggcggactgaaccagcaggccgctccactgatagggcagcaaaagattgaacagccataagggagccaatgtaggcagcatatcgtcgaggcaggcaaagaagaccagatcgggattcagccgttgaagactccggcgcagcctgtacagatttcgcagtcgaatcactgcattgcgcagtacaaccagctttttctgcaacggttttccggcaggaagcggcagtagcggaagcgctgagacaggctgaaaggcaacggcctcctgtatgcctttcccgtcgggagcgatgagcgacgtttcgtaccccatgcccgcccatgtctgagcaaactgtttataatacgtttcccgatggcctgatactgaacaatctatgactgtaactttcatgattccgatgcttttgggggcttggacatttctaatgcttctgaataaacttgccgtaacttctgccctgccaactgaaagtcgaaacggctgacgatggactggcggattttctctttgtcgaacgactcgtaggtatcgtacaatgttttcatcttagcggcgagcgcatccacatctcccggtcggatgaggaagccgctttcgggagtgatgatgtcctccggtcctccgcatatggtgccgatggcgggcaagcctgttgccattgcttcgatgaatacgatgccgaatgtctccgcaaaggaggccagtacaaaagcatcgcaagtacccagcaacccggacaattcttcccgtgacaggcggccggtcagttttacctgctcttgcaggtggagagactgaattaactttttgagtggctgcatttcttccccgtctccagcaatgatcaaagagacgtgcggcatatccttgaatgcccagtgaaaagcagtcagcaaatcccagaatcctttgcgcttattcaggtttccgatgctgatgaaagtaaaatgtttctttttctctgtccggtgaggactgaatgcaaaggtgttcgtatctacaaagttcggtatgacggtcactttatccgggtcactgacgtatgcgcacaggctccgtttcagtttcgtgccgacacagatgatcttgcgtgcctcgctgtatgccttcttcagtatcactgcctgtgacggtgtcgtctgattgccgttgatggaagaggcgtgctctgtgatgacatagggaaccttataccatttataaaccagtcgggcggcataccctgcccatgtgccgaagtgcgcatgaatcaggtcggggcgaccgtaagtgcggatatacttccgtactaacaagacggtcagcagagaccagatgattcctcccgcgcgggtgcttagtttcgggttccatgcgtgcaggcgcatggtgacgaaactgccgttatcttctgccgatatctgaaaatgactctctttgcggaaccgtttccatgtgaagttcttcagaggtctttgctccgtgaaggcaagtcctaccttgcagcctgatttagccagttgcatagcctgctcgaagaacatatatccccggtgcggggaggagtccttctcaggatagtacattggaagtatcagtatatgcatttgtcttttatttttagagaaagaatggtgatgaaatcgcggatgcgtttgccgaaagtaacggtcggcacaccggtgtaggcggaggctttcttgcggaaggcctcttcatcgtcgaaagtggggtggttcacaaagtgtttgtacagcagatacaatcctcttttcttctcgtagggaagatgccataccgccagttgctcgtctcctttttctaccgtattgtatttggggtaggtccagaggcgtttgacgtattgattggcgatattgttgtggatgttgagcctcgtagccactacgctcaggaagtgggcttcttcgttcagtttgggctgattggcggcaaaacgttccagattataattccataaagcaggatacgcttcgttgattcgtgccactacatcaccacgcagcgagataaattctcccccgtaataatggacaagctctgttcttgtgactccgtttttcgtatcttgctgctctgcttcttccttttccgcttctgttttcttcgttgcctccttctctttttctctcttctctttttctccgtaacagtcattatagatatctgtcatctcctttagtgtgattccgttcactttgaggtccggtcggtcggatgcatcgtacagggcggaaccgtatttccgtgtgtcgctgaatagttgccccaacggacgcatacagagacagtccgcatcgcagatgagcaacgtatcgtccgcctgcatccttttctccatatagcgcaggatatcatacagatagaattgatttctccatgccccgtaccatcctttgggagggatgcagagataaggcagggtaacagtctcaatccgtaactccttgaataaccgttccagataatcgggaaactgatccagattgctgaagaaaagcaacttatcattgggatgataatgcctgaaagtggtaaagaacggcacttgtatctgcatataaatggaatggacgagggcggaatctccccgtttgcctgcctgcggatagaaactggcatcttctttggattccttgtagaaccaggtcgctatgtaattggtaggtgtcgtcatgatatctttttctttttaatgaactgaatacactccttgaaaatgactgattgcattttccacaaaacaagtgcatatagagaagccacgaaaactactttgatggcaagtgacagatacaggttagtgatgcccgacgttatgtaatgggctgcgattgtcagcgaagctgccagtagaaaataaggagcgatatctttcagtatgctgaacagcgtcagcggaatctccctccgggcaaagcagtaccagacaaacagccaaagtatattgatagcgacaaacagataaatcatggtggtgatgccgtatggataactgatacaggcagtgatcagctgcaacacgctcagtgcgatactgttgaacataaagatggaagaccgtccgcggctgaccagcaataaagagaacagattgttgatcggaataaaggctccccatatacaaagtaattgcatgatccgtgcggaagcgagccacttgtccgtgatggcaatcagaataaactctctggaaatgaggctgagcccgaacatggcagggaaagaaataaaagccgtgaaacgcagcattttatgaaacacggccgcctgacgctgcgggtcattagctacacttgccagtacgggctgggtgactccgttgatcattccggtgatgagggcgtgtcccttattgttccagttgttggcctggctgaagtctccgacttcctgtttagtgtagaatttacccagcaggacggagaacaggttttggttgataataataaagacttgcgtaatcagcattttactgctgaatccgaacatctccctgatgggagagaagtcaatgcggaaactgggtttccagtgggcaaagtaccagttgagtgccgtgcctatgacgacaaaggtcattgtctgtatagccagaccccaataggcaaatccgtttgcggcaagaataatccccacaataccggatagaaacaggcttgaaagagaaatgatggtattctccttcactttgagattacggaagagaagagctcgcggagctatcccgaaactggctataaagaaactgaggaaagagaaacgggcgagcgacgttaactccggagtatcgtaaaatttagcaatcagcggagctgaagaatagagcaaaatataaagaacagcactaaaagagatactgaaccagaatacagcgttatagtctttatcgctgactttctcgcgattggcgagtgctgcgacaaatccgctttcctgcagggcggaagcaatggccggaaagatagccagcataccgatcataccgtaatcggcagggtccagtaatcttcctaacactactccgaaaagaagtcctaacagctgttgtacactgctgctgaggcctccccaaaatagcccttttgctgttttttgtttcagtgactgttcttcactcatattattataatcggtgaaggagagtgtgtcaaaagtcagtagtaactaaattcccctccttcaggaaggaggggtggctgaaagccggggtggtaggtgtactgcacaagtgaatatcatcagttgatgtattcacctaccacctccccctgcgggtactcctccttcccgaaggaggagagtttagttactattttgacaccccatccttccattcctcatttgttgatggcttattagcttattgcttatttcacttcgctgcccggcttcacctctttctgaggcatgataactgccaggctaccgtcgttgttttcggcactcagaatcataccttcgctgacgatacctttcagcttgcgcggtgcgagattggcgataaagcaaacctgtttgcctaccagttcttccggctggtagtgctttgcgatgcccgatacgatagtacgtgtttccagtccgtcgtcaatcttgaattgcagcagcttgtcggctttcggcactttctgacattcaaggatggtaccaacacggatgtcgagtttcgtgaaatcatcaaattcgatgttcggacgaatcgggtttgccttatagttggcttcttcgttggccttcttcgtgtcgagcaacttctgtacctgtgcctcgattacgctgtcttctattttttcgaacagcagttccggcttgttcagctgatgtcctaccgggagcaggtcgttccttcccagttccgaccattcgaagctttccatgttcagcatcttgcggagtttctccgagctgaaaggcaggaacggttcgaaagcgatggcaaggttggcaaccagttgcagagagatgttcaggatggtgcctacacgttccatgtcggtctttgccagtttccagggttcggtgtcggcaaggtatttgttgccgatgcgtgccaggttcatcgcctctttctgcgcgtcgcggaatttgaatacgtcgagcagcttttctacttctgcctttacgttggcaaattctttcagggtttctttgtcgtaatccgtcagttctgcgcaggcgggtactttgctgtcgaagtatttctgagtcaacaccattgcacggttcacgaagttgccgtatacggctaccagctcattgttgttgcgtgcctggaagtctttccatgtgaagtcgttgtccttcgtttccggagcattggcggtcagtacgtagcggagtacgtcctgtttgccggggaagtcttccagatattcgtgcagccataccgcccagttgcgggaagtcgaaatcttgtctccttccagattcaggaattcgttgctcggcacgttgtccggcaggatatagcttccttccgctttcagcatggcggggaatacgatgcagtggaatacgatattgtcctttccgatgaagtggagcagacgcgtttcggggtctttccaccatgtctcccaactgtcgggaagcaattccttggtattggaaatgtatccgataggagcatcgaaccacacgtacagcacctttccttccgcaccttctacgggcacagggataccccagtcgaggtcacggctgacggcacgcggctgcaatcccatgtcgagccagctcttgcactgtccgtatacgttggggcgccattccttgtggtcttccagaatccattggcgcaaccatccttcgtgtttgtcgaggggaagataccagtgcttggtctccttcatcacaggtttgctgccgctgatggcgctcttcgggttgatcagatcggtgggcgacagggaggttccgcatttctcgcattggtcgccataggcaccttccgaatggcagtgaggacactcaccggtgatgtagcggtcggcgaggaatgttttcgcttcttcgtcgtaatattgttcggatgttttttcgataaactctcctttgttgtatagcgtcttaaagaaatccgaagccagctcatgatgcgtcttcgaagtggtgcggctgtatacatcgaacgaaacgccgaattcttcgaacgatttcttgatcagatagtggtaacggtctactacatcctgcggagtgactccttctttctttgcacgaatcgtgataggtactccgtgttcgtccgaacctccgataaacaatacatcttctttcttcagtcgcagatagcgcacatagatatctgccggtacatatacgccggccaggtgaccgatgtgtacaggtccgttcgcatacggcagtgccgatgtgacggtggttctcttgaatttcttttccattgatatagagtgattttatgattttactgcttgcaatgtgcaaagatacggtttgcaacgtgcaaagataatgctttccacagatttcaggaagaaatgtgacaggaaatctgtggaaaaggcttgtttagcctgtgccgtttttacatcatcatattctttctgatggagaacttcactattgccatatcctgaatggtgtctacaggcaagtccatcggctcgtggtgcggattgtagctgacgagtttgacgtacccttccttctccgagcggttgacgtatttcaccgtcagatactggtctccgtcgaggtggaacgccacgatgtacatttctccgtaaatgacgttgctgaagttgttgatccccttgaaccctacgatatctcccgatttgagaatgggatacatactgtctccgttgacaaagatggctccgtcacacgcgggtatgctcggaatcagtattttgcccagcgcatattggcgtttgtcggaaagcagggtccttaaattggcggcggctgtgatgtcatagagcgtcacacttcggtcgtctatggcttctgtggtttttgaattgtgaatagtctctacttctccccgtatctttccgttgtcaaaagactttgggtcgtgcagcggacttccctttccggtcagcagccagttgtagtccacatgacgcagcttattcagcagtaaaggaaagtctatgctgtttcgcgcgcaccagttggaaagtgtcgctctggctactcctaaataggatgcaagttcactatcccgtttcagattcaacgctattttcgcccgctttacgatttccggtacattcagcagtgtatccgcttgtttctcattcatgtttttgcttacttttttatatgttaatatttattcttgccttatcgcctcatatacagtcttttgtaaaataattcagcgttaatatctaaaattatttgttttatat
